United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 28

SEQ ID NO: 114655 - DNA, 1012 bp, Glycine max
  Peptide Sequence Number=SeqID_231433
atggataacaaggcaacaattctgatgcaaaagtacgaggttggacattttcttggccaaggcaatttcgccaaagtttaccacgcaaggaacttgaagactggccagagcgtcgccatcaaagttttcaacaaagagtcggtgattaaggtggggatgaaggagcaactcaagcgcgaaatctctctgatgcgccttgtgaggcaccccaacattgttcagcttcatgaggtcatggcaagcaagacaaagatatattttgcaatggaaatggtgaaaggtggtgaacttttctataaagtgtcccgagggaggttgagggaggatgtggcaagaaaatatttccagcagctgattgatgctgttggtcactgccacagccgaggggtgtgtcaccgcgatctcaagccagagaaccttcttgttgatgagaacggggacctcaaagttacggatttcggtttgagtgcattggtggaatccagggagaatgatggccttcttcacacaatatgtggcactccagcttatgtagctcctgaggtaataaagaagaaaggatatgatggagccaaggcagatatttggtcttgtggggtcattctctttgttctcttggccggttttcttcctttcaatgataaaaatcttatgcagatgtacaagaagattatcaaagcagatttcaagttcccgcattggttctcttcagatgtgaaaatgcttctttataggatccttgatcccaatccaaagacaagaattggtattgctaagattgtgcaaagccgttggtttagaaaggggtatgtgcagcttgaagcatttcagctgccaccattgtcccctagaaatgctaaggatatctcagatgttcaagctgcatttgcctcttcatcagattcagattcagatggtagtccaatgtcaaataaagaagatagccccatgaagctatatcggttcaatgcatttgatttgatatcaatctcttcaggttttgatctttctg

SEQ ID NO: 114656 - DNA, 375 bp, Glycine max
  Peptide Sequence Number=SeqID_231434
atggctcgaagacctgctgaccctgaggaagaactccgatggatgtcacaagaagttcgtggatatgttgaagcagttttaaatagtttagctgctaatgttccaaaggcagttgtcctttgtcaagttgaaaaggctaaggaagacatgctgaatcaattatatagctctgtcagtgctcaaagcacagctaagattgaggaactgcttctagaagatcaaaatgttaagcgcagaagagatcgaatccagaaacaatcctcccttctctcaaaattgacacgccaattgagtattcatgacaaccgagcagctgctgcctctggctggtcaaatggtagtgcagtgcctaagcttgtcatcactgatgattga

SEQ ID NO: 114657 - DNA, 1455 bp, Glycine max
  Peptide Sequence Number=SeqID_231435
atgtcattactaaaacacttattgaagctaagaaagtctgcatttcatggccatgaaaataattattgtgaccttttgcctagttctaatgtgccagagattgctcataatgtaccaaaacatgttaattatgcacgtcgtatgttacttcaatccagtgataataactttgcagctgcaccttttaatggcgaatcaactatagagattagctttgttccaattacctttagtagtggagctttctcagctatttcaaatgctaataagaaacaaaatcaaacacctacaccctcgcactcaccttttgattctccacacgatgtttccaatgaaaatcaaacaagtcgacaagatgcaactaatggcgcttctagaaatttatggaagtatataattagtgttgttgttgtgttaatcattattatcataattattttatacacttcgagaaaacaagctgcaaaagtaataggcccttggaagacaggaataagtggacaattgcaaaaggcatttataacaggggttcctaagttgaatcgagcagaattagagatagcttgtgaggattttagcaatattgttaatctttattatgaagggtgcaccatatataaaggaacattatccaatggagttgagattgctgtggtttctactttgattacttctccccaagattggtcaaaggacatggagataaaataccataaaaagattgatattttgtctcgcataaatcataagaactttgttaatcttattggttactgtgaggaagaagagccattcactaggatgttggtgtttgagtatgctccaaacggaaatgtttttgagcatttgcatgttgaggaaatggaacgtcttgattggagtgaaagggttagaattatcatgggcattgcatattgtcttcaatacctgcaccatgatttgagtccaccaatgattcatagcagccttgcttcaaatatgatatttttaacagatgattttgctgcgaagatggcagtagttacttttagagatattgtatcgccaactgagacgataggtgattcaaagaaacctcaagtgtcatcccagggtaatcttgaaagtaatgtctttgactttgggaagttattgcttgaaattatctcagggaaattgccttactttgaagaacaaggaaccctagtgaattgggttggtaattactttaatgacaagtgcaacataaactacttgattgatcccacccttaaatctttcaaggaaaatgaacttaatctcatttgtgaagtgatccaagattgtatccatctcgatccaaagttaagaccaacaatgagggacgtgacttccaaattaaaggaagcacttggtgtgtcacctgagcaagcattcccaagactttctccactctggtgggctgaatttgagatcttatcagtggaggcgacttaa

SEQ ID NO: 114658 - DNA, 729 bp, Glycine max
  Peptide Sequence Number=SeqID_231436
atgggcgattaccatttcgtgtacaaggatttagaaggggcttctactcaatgggacgatattcaaagaaagctcggaaatttgcctccaaaggcacccgctttcaagcccccacctttcacccctgcctctgatgatcaacccaaagacaaaacatggatcgattccaaaacctccgaggaactcgaagacctcgaagacaacctcgatgatgatcgcttcctccaagaatacaggaagaagaggctggctgagatgcaagaggcagcaaaagtattgaggtttggatctgtgattcccatttcgggatctgatttcgttcgagaggtgtcacaagctccatctgatgtttgggtggttgtcatcctatacaaagaagggattcctgaatgtgggttgttgatgcaaagcattgaagaattggcactaagatatccttcaacaaaatttgtgaagataatatctactgattgcataccgaactacccggatcggaatcttcccactttgttggtgtacaacaatggagcagtcaaaggaaattatgtgggtttgcatagtttcgggcgaagatgcactcctgaaggcaaggaggttcctgcagagggttgtgaggaatatagaatgagggaggaaaatgatttgctggcaggattgctccttgttttttacaacggcttggagatcaaggaagtgagacttatcgagcatgaaacagatgaaaaatag

SEQ ID NO: 114659 - DNA, 324 bp, Glycine max
  Peptide Sequence Number=SeqID_231437
atggtgtcaattttgattgtcgttttggtggggagggttgggttgccgccgagtggatgggggtttcgtcagcagcaggaggatgaggagatgcttgtcccgcacacgaatttggctgagaataatcaccaacccatggaagggccaggtgctgtaaactttatcatagatcatggagagttggattttgtgtttgtccaagataggaaggttatccatcttttgaatcctgattgtaaatctactcaacgactcaaagaggaagagaaagataaggccatcagcattggagttaagccatatttatgggtaacatattcataa

SEQ ID NO: 114660 - DNA, 624 bp, Glycine max
  Peptide Sequence Number=SeqID_231438
atgccagctgagttgaagccttctaatgtgggtcttgaacaagaggcgcaattggtgcgtggatggaaaggttctttgaatggcaccaatggcaaaaagtggcgcaatggaagttatcattatccaccctctattaagtacattcacttgcatgaatgtgacaaattctctttaagcttttatgttccctttctctctacagcttgtgacagtcttcttatggaaatcttctgtaggtctccaggttctgttatcccgcttcataatcaccccggaatgactgttttgagcaagcttcttattacttgtaaggtcatatgctgggtttactctgggttcgatgatccatctcaagcaagaccagcaaaacttatgaaagattgtctgatgagtgcaccctgcaacacaacagttcttcatccaagcaaaggtggcaacattcattgtttcaaagccttaaccccatccgctctctttgacattctttcccctccttactcatcagaagatggaagacactgctcatatttcaggaagtcaactaggaaagatcttccaggtgttgagcatgatcagctgagtggggtaaagccatctgaaataacctggtcagaagagatctaa

SEQ ID NO: 114661 - DNA, 228 bp, Glycine max
  Peptide Sequence Number=SeqID_231439
atgggtccctcaggagacaaagatgccttgcagtggttgctgaattttgagaaatccaatgaacctagatggagttgggttggaagtaatgtgaacttggatcgaaagtgtcacttgacgttatatagaaaaagtaaaagaagcagcttcctttctacgcaacaacacatttgcgtaactgatcagcgcaactccattccagagcaccttaacaaggggaaaaattag

SEQ ID NO: 114662 - DNA, 666 bp, Glycine max
  Peptide Sequence Number=SeqID_231440
atgtcagaagggtatgaaattcataacaatgaggaaacttcatcgggatgttcccagaaatgctcttcatttgacttgaatgaagaattagcttgcagtactgaagataacactgatacaaaagagtgctatgagctcacaacaaccaatgagaaagcaaaggatgagggcacttcagcgaatggaagtagcatatcatcaagagaaggaaatgagagaagaggaacaacggtaagacaatatgttagatcaaagatgcctaggcttcggtggactcctgagcttcatcattcatttgcgcatgctgttgaaagacttggtggtcaagagagagctacacccaagttggtgcttcaactgatgaatgtgcgaggactcagcattgctcatgtcaagagtcacttgcagatgtatcggagcaagaaacttgacgaggctgggcaagtactaagtcaaacgtacaggtcaaaccaggaagtagttcgtagacctctgatactccatcagtccataagtcctcaacaacatcttaagatgggaaatggtggaattattctagcaagtaatttcaacaaacatagtcatttcccaagtctcctgcagccctccttctccctatcacgttcacttacaaacgacaccgattcaaggttcccattgatataa

SEQ ID NO: 114663 - DNA, 472 bp, Glycine max
  Peptide Sequence Number=SeqID_231441
gcaccagcattggtacatcaatcatcaagcttttagaataccaatagcttcaggccaaattcaaccaaaggatacacgcggcagaattgcccccatgagaccaagccaattgcttgaagagaaaaggtggcctccgttagaaattttgaacaatcatcaatcgaagttccaaaagttaccttccattgattctcctaaaattgggtcacaagctattcaaccagctgaatggagtagttttatgaacaacacaagcatcatagattatctatcgaacaactccaatgaacctcgcaacaattccaacagcttaaagctagaatttggtcctccatttcggattaagaaagacgagcaacaatttcttgatttgcaactgggtttgagtcacacatgtacagttggaaccgatggcaagatggatcattatagagaaaccccagaaatcagcactaagctttcactttcttag

SEQ ID NO: 114664 - DNA, 249 bp, Glycine max
  Peptide Sequence Number=SeqID_231442
atgatggaaaagggagccgcatctggcttattagctaggacaagggaaggagtatctatcggtatcaggctttgttgttgtcaatgtaacaacacgtgtaacaaagcaacaaacaaaaacgttaaagtgttttgtggattgcaccaactaaaagtcctagtcttcatgtcatgcaaacaacaacaaaggattaatcagattcaaatattaaattattcgattaatagttgtcagatggacaaacagtag

SEQ ID NO: 114665 - DNA, 355 bp, Glycine max
  Peptide Sequence Number=SeqID_231443
atggcagcagaatttgttggtggtgctcttctttctgctttccttcaggttgcatttgacaggctcgcttctccgaaagttcttgacttcttttgtccaaggaaacttgatgaaatgctgctcagcaagttgaacatcatgctgctatccattgatgctccggctgatgatgcagaacaaaagcagttcaatgatccacgtgtgagaggatggctttttgctgtcaaagatgctttgtttgatgcagaggatctcttggatgaaatagactatgaactcaccaaatcaaatgatgttgacatgcttcaagaggttgatattggagttggcattagcagtgctgaatcgatgccag

SEQ ID NO: 114666 - DNA, 1230 bp, Glycine max
  Peptide Sequence Number=SeqID_231444
atgaagaacaaggctatcttgcctccagccagtgaggttgtgaaacctaacaaaagttctcatattagatcttttagcccagttcctgctgtaaagaagataaaaacaaagaaactcctttgcacccttcaatccttttgtagatcagcattctctagtgatattgttttcaacatatttacttattacaatcatgaatattttctgcaggcttgggaggcaattcacaagagcaaatcaagctctagggctgcatcacctgacaagcaagagggtaaaccgaaatggaccagtggatcaaacagatttacctactttggtgagttgctgccaggtagactctctccctttcgtcgttcaagagctgctgctgctggtatatctccatgtcgaagtaaacctcaatctccctttcgtggtgctaagttgcctggtgatactaaagaggctgagaattatatgtttggcaaggtgaaattccacagtggtgtgcttggaaatgttcatgatgtgctatcccaaggagccaaaagaacttcatattcagggaatctcacaattgaaaagacattgtacgtagatactgccagtacagccaaattatcatcttcaaatataagttctttagatatcaatcagagggtagatactgtggttgcagacttagacagaagcagggggaaaggaagtaattcctcctttggatcttctcaagtgataaagcaagtacatgctgtggaagaaaaggtcacgtttgatactgatgtgttaagttctttggattccattccaccaagtttgtatagttatttgaatcttgcagccaaagaaaacaaagatttaggattgacaactgatcaaaatattagccaaaaacctgtgtccttgcaatctgtgcaagggacatttgctgaagattcaaagaccaacacccagcaaattgtgttagctaatgattcaggaaaaggtagtgctgaatctattgtgtcttctcttcccccacctttgccaaaatcaccttcggaatcctggctttggcgtgccttgcctttagtttctgtgaagaattctttcctgcactcaagtcaaggtactcaatccaaagctaaaaggcatgattctaatacatctggtaatctcaagtgggaaacaatagtgaaaacttcgaatttgcatcatgatcatgttcgctattctcaggaactacccacacgcaaatctcagcactaa

SEQ ID NO: 114667 - DNA, 195 bp, Glycine max
  Peptide Sequence Number=SeqID_231445
atgtttgaaatcctgactgtaggaaatgtgtatccaaagaggcttgatggccccagtcaagcagtgacaacaaacacaaacattcacagttctgagggtagctctacctttaaaaaaaacttcgtaccccattgcccagaggctcttcgctatgcgaagaaggaggaagatggtcttgtgacggttgtagagtaa

SEQ ID NO: 114668 - DNA, 2352 bp, Glycine max
  Peptide Sequence Number=SeqID_231446
gatatagaggcaaacaaccgaaaggttcaggtatatggtagaaattatacatttgtggagactagatggaagaaactccgtgttggtgatatcattaaagtgtataaggatgaatactttcctgctgatcttcttctgctttcatcaagctatgatgatggggtttgttatgtcgagactatgaatcttgatggagaaactaatctaaaattaaagcatgccttggaggtgtcaattcatcttcaagatgaaaaatctctccaaaagtttaaggctgtggttaaatgtgaggatcctaatgaaaatctgtactcatttattggaactttacaatatgatggtaaagaatatcctctttccttgcagcagatcctgttaagagattctaagctgaaaaacactgattatatctatggcgttgttatctttactggccatgatacaaaagtcatgcagaactccactgatcctccgtccaagagaagcaaaattgagagaaaaatggataagataatctacatcctcttcagtaccttggttttgatatcctttattggttctgtcttttttggtgttgagaccaaaagggatattagttctggcaggtatagaagatggtatcttcgtccagacaacacaacggtgttttatgatcctagaagggcaacacttgctgctgttcttcattttttgactgctctcatgttgtatggatatctaattccaatatcactttatgtgtccatagaacttgtgaaagttctgcagagtattttcatcaaccatgaccaggaaatgtattatgaagaaacagataggccagctcgtgcacgtacatctaatttgaatgaagaacttggtcaggttgatacaatattgagtgataaaactggtactttgacatgtaactcgatggagtttgtcaaatgttcaatagggggcattccgtatggccgtggtatgacagaagtggagaaggcacttgctaggagaggaaaagatgtggaatctgaagttgatgggggatcatctgatttgttgggtcagagtaatgactttgtggactctcggcatccaattaagggctttaactttagagatgagcggataatgaacgggcaatgggttaatgaaccatatacagacttcattcagagattctttcgagttttagctatttgtcacacagctattccagatgtagataaagagtcaagagaaatttcctatgaagctgagtcaccagatgaagcggcttttgtcatagctgcaagggagcttggttttgagttttttgcaaggacacaaacaagcatatcattgcatgaattgaattatgaaagtggaaaaaaggttgacagagtgtaccagcttctgcatgtcttagagttcagcagttcccgcaaaagaatgtcagtgatagtgaggaatgaggaaaatcaattattgctcctatgcaagggtgctgacagtgtaatgtttgaaaggctctcgcaacatggaagacagtttgaggctgaaaccagggatcatatcaaaagatattctgaggctggtttaagaacccttgtaatcacataccgtgaacttgatgaagaagaatataagttgtgggacaatgaattttcaaagatcaaaactactgtaacagaagaccgagatgcgctggtggatgcagctgctgataagatggaaagggatttgattcttcttggtgctaccgcagttgaggatagactgcaaaagggggttcctgaatgcattgaaaagctcgcccaggcaaaaatcaagttatgggtattaactggagacaagatggaaactgcggtcaacatagggtatgcatgtagtttactaagacaagacatgaaacagatagtgatcactctggattcaccagatatcctatcattggaaaaacaaggggacaaggaagctctatcaaaggcctctattgaaagcattaagaagcaaattagagaaggaatctcgcaaatcaagtctgcgaaagagagttctaatacaactgggtttggcttgataattgatgggaagtccttggattattctcttaacaagaatttggaaagggccttctttgagctggcaattaattgtgcttctgtcatatgttgccgatcttcacccaaacaaaaagctcgtgttacaaaattggtgaaattgggaacagggaagacaatattatctatcggcgatggggcaaacgatgttggcatgcttcaggaggctgatattggagttggcattagtggtgctgaagggatgcaggaggcatttggaagagcttgtagggagtttgagtttaaggaaatagcttataagctcttctag

SEQ ID NO: 114669 - DNA, 294 bp, Glycine max
  Peptide Sequence Number=SeqID_231447
atgcaggttacaagattggttaaattgggaacagggaagacaacattttctattggtgttgcagcattgcagcatattgcttgcttgttaaatgcgatgcttctgcatgttgaaacggaaagtgatttttcaatagctcaattccattttctggagtgtttgttgttggtacatagccactggagtcacaggaaaatatcaatgatgctctatgaacaagctggcttgaaattgttcagaaaagtcggtttctaccaatttagaagcatgatattatacggagaaagcaagtag

SEQ ID NO: 114670 - DNA, 693 bp, Glycine max
  Peptide Sequence Number=SeqID_231448
atggctgaaaggagattgaatattaatgcccctctcatgtctgtgagacgctcttctgccacaccaccatccttaactgaagcaaagaagaagattctagagaaacgccacactcttccatactacaaatcagacacatcctcagatcaggtaacagaacctgttgcagtacctttcaattgggagcatatccctggaagacgcaagggtaatggtggatctgagcctcaacctcctaaagccaattcaatcactccaagcccaaggcttcccccaggaaaatcaatcaatgctaccaaacaaacattggaaaaggaaagtaagactgcaaataaatttaagtcctcaaataaatcaaagtctttcaatgttagtgtggtgaaggtagactctgacaaagagagaaaagcagagaaaatagttgagagcagaaggtctaatgtgaagtttgatgacgatgatgataatgatgcttattctgatgcccttgaaaatctgtcacctacagaatcattctccatgaactgtagtgtgagtggtgtaagcgggctagataatctggatgcaaacaagttcggaaccttttccacagatcaacagactagagactttatgatgagccgatttttgcctgctgcaaaggctatgaccttgcagcctcctcaatattcttcaaaaaagcaatctgtacta

SEQ ID NO: 114671 - DNA, 3429 bp, Glycine max
  Peptide Sequence Number=SeqID_231449
atgcgcgaggaggcgctcaagagggagaaggaggagactctgaaagccatcgctaagaagaagaaggaggaagaggaagcagcgaaggatgctccgcagcaacagcagcagaagaggaggaaccgctgggaccagtctcaggatgacggtggtgccgcggcggcggcggcggcgaagaaggccaaaacctctgattgggacatgccggacaccactccggggcggtgggatgccaccccgacgccggggagggttaccgatgcgacaccggggaggaggaaccggtgggatgaaactcccactcctggtagagttgcggattctgatgcaacacctgcaggtggtgctacaccgggtgctacacctgctggtatgacttgggatgctactcctaagctttctgggatggctactccaactcccaagaggcaaaggtcgaggtgggatgagactcccgctactatgggaagtgctactccgttgccaggtgctactcctgctgctgcttatactcccggtgttactcctgttggtggaattgaacttgctactccaacccctggggctttacaaggctccattactccggaacaatacaatttgttgaggtgggagagggatattgaagagaggaatcgccccttgactgatgaggagcttgatgctatgtttcctcaagaggggtataaggttttggatccccccgcatcctatgtgcccattaggactccagcgaggaagcttcttgccactcctacgcctttggggactcctctttatcaaattcctgaggagaatcgcgggcagcagtttgatgttcccaaggaagcacccggtgggttgccgtttatgaagccagaggattaccagtactttggggcactgttgaatgaggagaatgaagaggagttgtctccagatgagcagaaggaaaggaagattatgaagcttctgcttaaagtgaagaatgggacgccaccgcagaggaagactgcattgaggcagcttacggataaggctcgcgagtttggtgctgggccgttgtttaaccggattttgccattgctcatgcagcctaccctggaggatcaagagaggcatcttttggttaaggtaattgacagggttttgtataagttagacgaattggttcggccttttgtgcataagattcttgttgttattgaacccttgttgattgatgaagactactatgcgcgtgtggagggcagagaaataatatctaatcttagtaaagctgctgggctggctactatgattgctgctatgcgacctgatattgataacattgatgaatatgttaggaacactactgctagggcctttagtgttgttgcttctgcacttggtattcctgcactgttgccattcttgaaggctgtgtgtcagagtaagaaatcatggcaagctaggcacacagggattaagatcgtgcagcagatcgccattttaattggttgtgcggtgttgccacatctgagatctcttgtggaaattatagagcatggtctgaatgatgagaatcagaaggtgagaacgatctctgcattgtctcttgctgctcttgctgaggctgctgctccttatggtattgaaagctttgactctgttttgaagccactgtggaagggtattaggcaacaccgtgggaaggtgttggctgcatttctgaaggcaattgggtttattattccgttgatggaagccctgtatgccagttactatactaaggaagtcatgctcattctgattcgtgaattccagtcacctgatgaagaaatgaagaaaattgttctgaaagtggtgaagcagtgtgtgagcactgagggtgtggaagctgaatatattagaaatgatatcctacctgagtttttcaagaatttctgggttaggaggatggctctagatagaagaaactataagcaacttgtggagactactgtagagatagcaaacaaagttggtgttgcagatattgttggtagaattgttgaggatcttaaagatgagagtgaaccttataggcgtatggttatggagactattgagaaggtggttactaacctgggggcatctgatattgatgcacggctggaagagcttctgattgatggtattctttatgccttccaagagcagaccagtgacgatgctaatgtgatgcttaatgggtttggtgcagtcgtaaactcacttgggcagagagtgaagccatatcttcctcagatttgtggtactataaagtggcgattgaacaacaagagtgcaaaggtgagacagcaagcggcagatctcatttcaaggattgctgttgtcatgaagcagtgccatgaggaacaattgatgggtcatcttggtgttgtcttgtatgagtatttgggagaagagtatcctgaagttttaggatcaattttgggagctctcaagtcaattgtcaatgttatcggtatgacaaagatgactccacctattaaggatttacttcccaggttgactccgattttgaagaataggcacgagaaagtccaggagaattgtattgaccttgttggtaggattgctgaccgtggagctgagtttgtaccagcaagagagtggatgaggatttgttttgagttgcttgagatgctcaaagcacacaagaagggaatccgtagagctacagtgaacacttttggatatattgcaaaagccattggaccacaagatgtcttggcaaccctattgaataatctcaaggtgcaggagaggcagaaccgtgtttgcacaaccgtagccattgcaattgttgcagaaacatgttcacccttcacagttttaccagcattgatgaacgagtatcgcgtgccggagcttaatgtgcaaaatggtgtgctcaagtccctctctttcctatttgagtacattggtgaaatgggaaaggattacatctatgctgtgactcctttgcttgaagatgcactcatggacagggatttggttcacaggcagacagctgcttctgctgtgaagcatatggctctgggagtggctggtttaggttgtgaggatgcactggttcatttgctgaattatgtctggccaaacatttttgaaacttctcctcatgtgattaatgctgtgatggaagcaattgaagggatgagggtagcgttgggagcagctgttgtactgaattattgtctacaaggactcttccaccctgcacgaaaagttagggaggtatattggaagatctacaactctctctatattggagcccaggatgctcttgtagcatcgtaccctgccttggaggatgagcagaacaatgtttacagcaggccagagttaatgatacatctgcattgccaaaatgctggtgagatggatgagtcagttaagaggttgcagaattaccaagattga

SEQ ID NO: 114672 - DNA, 582 bp, Glycine max
  Peptide Sequence Number=SeqID_231450
caagatttagagactccaacaataaaagccatgcttaacacctaccatgcctccaaactctcatcaaaccagtgtggttctagccttgtgcaaacaatagatgcacctttacctctcgtatggtccctcataaggcgctttgagtatccacaagggtacaagctctttgtgaagaagtgcaaccttcttgatggggatggtggcattggaagcgtgcgtgaggtcatgatcacatctgggttacccgctggtgttagtgtggagaggttggacaagctcgatgatgacaagcatgtcttgaagtttagcatcattggtggtgatcacaggcttgtcaattatagttcaacgattactttgcatgaggaggaagaggaatacggtgggaagacggtggcgatagagtcgtacgcggtggatgtcccggcggggagtagcggcgacgatacgtgctcttttgctaatactatcatagcttgcaaccttaggtccttggctaagatcacagaagaaaaggtggtttcaagctgtcagaaattcatttcattcgaggaatccaagtacaaaaatggcaaaacataa

SEQ ID NO: 114673 - DNA, 261 bp, Glycine max
  Peptide Sequence Number=SeqID_231451
atgaacagtttgatggttggaaagctgagtattcttcggaacaaatttaggagagatactcgaacttttgctccagactcagagatattggaggctttacaacaaatttctgtaggaaaacttggacttgatcaagagactggtccagaagatgtggaaattttatctgcagcagatgctgattccttggccagagctcttttacttaatcaaaatcctccttcacctggaaatccaactctcatctttttaaagcagtag

SEQ ID NO: 114674 - DNA, 222 bp, Glycine max
  Peptide Sequence Number=SeqID_231452
atgtcgacgaacggatgtaagatagcaactataacagaaagtcgtgtgctaacacaaaatgacattcagctgatgcaagatgtgatggttgcctctgttaccaacaagggttggttaagcaaccacggcttcaaaaggactgaaggagaaacaaagttcaaactcggggtacagccatccggttggctttgtgtggctagtttagaagattttggcgtctaa

SEQ ID NO: 114675 - DNA, 350 bp, Glycine max
  Peptide Sequence Number=SeqID_231453
gtgccggagttgtcggctccagtgcagggggagagctcaccggaacaggcgttggtggagaactcatcggaactggcgttggcggtgagctcacaggtgtcacagtaggaggtgtagtcgtaggaggagtggccgcgagaggtgtggccaccggaggagtggttgttggagctggagcagcaactttagacggaggagatgctgccatgggagatgaaatggcgggaggggttgcagttggagcattgggagatgaagctggtggatatgaagtgagagaagtaacaggcgcagttgattttggtttagaagaggctatggttggggatgctatcaacacttttttttaa

SEQ ID NO: 114676 - DNA, 1044 bp, Glycine max
  Peptide Sequence Number=SeqID_231454
atgccggacttccacgactccctcctcaccaccacgccgccgccatcgcgccccgtccccgtccgcgaggactgctggtccgaggaggcctcctccacgctcgtcgacgcctggggccgccgctacctcgagctcaaccgcggcaacctccgccaaaaggactggcaggacgtcgccgacgccgtcaacgcgctccacggccacaccaaaaagacgcaccgcaccgacgtccagtgcaaaaaccgcatcgacaccattaagaagaagtacaagatcgagaaggctagggtttcggcctccaacggtactctctcttcctcttggcctttctacgagcgcttggacgctctaatcggccctaattttagcgcgaagaaatcaacctcttcgccgtctccgtcgccgccggtggctcttcctttgctgccgcatcggaagaaccagaaccaaaaccagaacccttcctcttctcctgcgattgcggtgccgccgacggccgtcgctctgccgcagaagcgctcctcggcagcggcgatggacgagggttacttcagaaggaattactccgccgtggctgccgcggcggcggcagcggaggctgatgaggacgatgaggaggaagacgaggaggaggcggaggatttggaggaggaggaggaggaagaatgtgaagaggaagggagagggagcgaagtggaggaaggggataaggagagggaagggatgaggaggttggcgaaggcgatagagaggtttggggaagtttatgagagagtggaggcgcagaagctgaggcagatggtggatttggagaaacagaggatgcagtttgctaaagatcttgaagtgcagaggatggagatgtttatggacacacaggttcagctcgagagaattaagcgcggtaaaagatctggctctaatgtgttttgttttcaacgaatgaatgatgttttggacttgaggataagtgggtcgctagaggattattctccactgattgaaatagagccatgcatgttttgggtagttgttgtaggctaa

SEQ ID NO: 114677 - DNA, 1350 bp, Glycine max
  Peptide Sequence Number=SeqID_231455
atggagaagaaaagcatggttaagaagagagcacactgtttggtgttggcatatccagctcaaggtcacatcaatcccatgcttcaattctccaagctattggaaaatcaaggggtgagaataacacttgttacaacccgtttctactacaataacttgcaaagagtgcctccttctattgcccttgaaaccatctctgatgggtttgacaaaggtgggcctggagaggctggagggtccaaggcctatttggatcggtttaggcaagttgggccagagacttttgctgagcttcttgagaaacttggtaaatcaaatgaccatgttgattgtgtgatttataattcattgttaccttgggcactagatgttgccaagagatttgggattgctggagctgcatatcttactcaaaatatggctgtgaatagcatatattaccatgttcaattggggaagttgcaagctccactcatagaacaagagatttcccttcctgccttacccaaacttcatcttcaggacatgccttctttctttttttatgaagatttgtctttgcttgatttggtagtgagtcagttctccaatatcgacaaagctgattggatcctatgtaacaccttctatgatctggataaagagattacagattggtttatgaagatttggccaaaatttaagaccattggaccaaacataccatcttacttcttagacaaacaatgtgaagatgaccaagattatgggattacacaatttaagagtgaagaatgcatggaatggctagatgataagccaaaaggctccgttgtttatgtatcgtttgggagtttagttaccttcggtgaggaacaaatgaaagaactagtttgttgtttgagagagtgctcgaattatttcttgtgggtggttagagcttctgaacaaattaaactccctaaagattttgagaaaagaacagacaagggtttggtagtgacatggtgtccccaagtaaaaattcttgctcacgaggctgtgggatgttttgtgacacattgtggttggaattccatattagaaaccttgtgcttaggagtcccaatagttgcaataccatgttggtctgatcagagcacaaatgctaagcttattgcagatgtttggaaaataggaattagagccccagttgatgagaaaaaggttgtgcgacaagaagctctaaaacactgtataaaggagataatggataaaggcaaagagatgaagatcaatgcccttcaatggaagactttagctgtaagaggtgttagtaaaggtggaagttcttacgaaaatgctgtagaatttgtgaatagtttattataa

SEQ ID NO: 114678 - DNA, 183 bp, Glycine max
  Peptide Sequence Number=SeqID_231456
atggcaccattcactccgttgaagttgccgctgctgctaacgctgtttttcgcgttgagccagaaacagagtctctgttccacgctcaagagcgaagaaggcttggcgctgctggcgttgagggagagagtggtgagtgacccgcaggggactttatcaagttggagtggcgcagatggagac

SEQ ID NO: 114679 - DNA, 1062 bp, Glycine max
  Peptide Sequence Number=SeqID_231457
atgaaatttgggaaagagttcaagacccatttggaagacaccatccctgagtggagggacaagttcctttgctacaaaccattgaagaagcttctcaaacagaaccttccttcaatcactaccgccatcactgatatacccatcaatctccctcttcaccttctccaacaaccctcttcgccacaacttcttcaggcttggttcgtgaggattctcaatgaagagcttgaaaagttcaatgatttctatgtggacaaagaggaagagtttgttattcgcttccaggcacgcgttgttatgggtatatgcatgcttacggatgtctggtaccatggagtagtagatgaaaatgatatggttttgcaattaagacttatgagaggcactcttgtggcactgacaactttcaaggagctgaaggagagaattgagtgtcttaaagaaaaaagcagccagggtgaagtgtacacttctgactgtgaattcagtgaagaaatgatggacatcaggaaggacttggtcaccatccatggagagatggtgctcctcaaaaactacagttcattaaactttgcaggactagttaaaattttgaagaagtatgataaaagaactggtgggttgttgcgtctgccttttacacaacttgttcttcgtcaaccttttttcacgactgaacctctcacaaggttagtccatgaatgtgaggaaaatctagagctgctctttcccctgcaagcagaagtaatccaatctactccccctccagaaaatcagtctagaccaccggtagatagcgcaacaaatgccttacctgaggcatcctcaactcttggggatgaaactgtgtacatatatcgtagcactcttgctgctatgagagccataaagggtcttcagaaagcaagctccacctccaatccattttcgttttcatccctttttagcaaccaagatggtgatggtactggtgctgtaactgctgaaaactctgccgcaaattctccagctaccttgcagaatgaagaaagcgttggtaaagaggaaactgattctgtgtag

SEQ ID NO: 114680 - DNA, 1374 bp, Glycine max
  Peptide Sequence Number=SeqID_231458
atggaggagaaaaacatggcaaggagagcacactgtttggtcttagcatatccacttcaaggccacattaatcccatacttcaattctctaagctattggaacatcaagggtcaagaataacacttgttacctaccgattctatcaaaacaacttgcaaagagtgcctccttcttttgcaattgaaaccatctctgatgggtttgaccaaggtggaccaatacatgctgagagccacaaggcctacatggatcgctctactcaagtggggtcagaatctttagctgaacttcttgagaaacttggtcaatcaaaaaaccatgttgattgtgttatttatgattcattctttccttgggcactagatgttgcgaagagttttgggataatgggggctgtttttctcactcaaaatatgactgtcaatagcatatactatcatgtccacttaggaaagctacaagttcccctcacagaacatgagttttctcttccttccttgccaaaacttcagcttgaagacatgccctctttcttgcttacatatgtggagcatccatattatcttgatttttttgtggatcaattctccaatatagacaaagctgactgggttctatgcaatacattctatgagctggataaagaggtagcaaattggattacaaagatttggccaaaatttaggaatattggaccaaacataccatctatgttcttggacaagcgacatgaggacgacaaagattatggtgtggcacaatttgagagtgaagaatgcatagaatggctcaatgataaaccaaaagggtctgttgtttatgtatcgtttgggagtatagctatgcttggtggagagcaaatggaggaactagcttatggtttaaatgagtgctcaaattactttttgtgggtggtcagagcctctgaagagattaagctccccagaggttttgaaaagaaatcagagaagggcttgatagtgacatggtgctcccaattaaaagttttagctcatgaggccataggatgctttgtgacacattgtggttggaactccacattagaaactttgtgcataggagtcccaacaattgcaataccacattggtcagatcagaccacaaatgcaaagcttatggcagatgtttggaaaattggaattagagctcaaactaatgagaaaaagattgtgcggcgagaaacactaaagcagtgtataagggatgtaatggagagcgaggaaggcaaagtgataaagagcaatgtcattcaatggaagactttggctttaaaggctattggtgaaggtggaagttcttatcaaaatatcatagaatttacaaataacttgttttgttcacaagcttcatga

SEQ ID NO: 114681 - DNA, 600 bp, Glycine max
  Peptide Sequence Number=SeqID_231459
atggaacagattatgagaagaaaagcacactttggtttctttagaagggaatgccattttacaatctacattctaatgcatatatgttactgttttgaaggtcgctcaagtttactgatggatttgattcatgaaattgagatgagcagtgaaagtcatttgaaagatggaagtgcaacatcctttcagggctttagaccagcacatttggagatccttttctatgtaaagatcaatgtggtcacacttgaaactccagtatcaacattaagaggcttgctcttggcttcaaatcatgatcacttgtctttcagcaagaaagagctgtggaagcttcttgaacttgatggcattctcaaaaatcatgaggaagtcactgcaagaaatgcatcaaaggagtacttaaaggtggttggtatttcatactttggcaacacagatgaggttaatagactcatggataaggtggaatcagccttcattaagcactttggaaatggaaatcgcagaaaaggaatgactgctgactggctgctcacttgctctcattgtgacccttatggtacccataaattcaagaaaacttctaaatacaaatag

SEQ ID NO: 114682 - DNA, 268 bp, Glycine max
  Peptide Sequence Number=SeqID_231460
atgggaatgaggcgggtcgggtacgagtattgtctccccaatcctttatcccgactcctcaatatatccccatactcgtacccgatacccgacgagtttgagtttattgtctcatccccgtacccgtcgagtatcggggtcgggacgggtctagtaatcccataccagtacccgtacccgacttttggttatcggagaaaacccgaacccgtacccatacccggtcaactcgggtattacccgtcaaagtcgggacggattcaggcgg

SEQ ID NO: 114683 - DNA, 264 bp, Glycine max
  Peptide Sequence Number=SeqID_231461
atgggagaatttgcatttcggggttttgatgaggccatatatgtcacgcaccgtcgttgccacacccaaggagaggacgttggacttgacggagcagccgggaggaccatagccaaagaggccagtgacatcgttgtagatcttgaaataggggatgtagaaaaggcagcattcaagggtgttcaccacagattgacagaaggcctcgtgggtgtcggagctgccaaggaaggagcgctcaatagaggtttttttcgagcttga

SEQ ID NO: 114684 - DNA, 399 bp, Glycine max
  Peptide Sequence Number=SeqID_231462
atgacgccaggatggaaggagaaaaagggcacaaaagatagacatgtgatcagtacttatcttttacagacaaagtgtgagttcccagatctcaatcctgattacatgccaccaaatttcagcatcaatggaaaaggagccttgtatctggaaagacaaggaaggcatatttggatgaagaatcttctagacattactttaaacattacttttcctccattgctctcatgggttcctgaatacgtgttgcaaaacattgtacaatcgatttgtgatgcaaaggttggttgttcacaggtcctcgaaaattacgcggaggatatcaataatggatttgctgttggactgttagcagattataactcgttcaagaggaacaaggccagatattcggtgtaa

SEQ ID NO: 114685 - DNA, 165 bp, Glycine max
  Peptide Sequence Number=SeqID_231463
atggcctttccggaagttaagtccacttacattctcgggaagagaaacaagaatgagggagcaagaggagatgtcgtcgcgtgtgatggtcatcgtggggggtggctgttgaaggagatgccatcatgggaggtgttagaattgaagggagaaggaaggtgttag

SEQ ID NO: 114686 - DNA, 309 bp, Glycine max
  Peptide Sequence Number=SeqID_231464
atggtgtttggtaacaattatccttccaaaaggatcattttgcaagagtatttatacccttacgaaatgcctgttccagaaacaggttcaaaagagtggataaagacttctacaacgttgagttcaacttgctttgtaccttcaatgagtgtgggaagaagagttggagaagagaataactggaaagggggtctagacttgcgttgtgggaagaagagaagaatggttgtggctacggagaaagaagaggaagaaaatagaaggataggttggagttttcaaaatatgaaaaggttgggatatatttaa

SEQ ID NO: 114687 - DNA, 210 bp, Glycine max
  Peptide Sequence Number=SeqID_231465
atggaatttggaagatgtgtgttcccaacaaagttaaggtctttttgtggaggactgctcagggatgcctgcccacgagatgtaatttgcagttttgcggtgtttcttgttcagcctgttgaagctgatgcaatggctctttgcaaggccatgagctgggttcatgacagcacaatcagaatcagaagtgggttctactattatgaataa

SEQ ID NO: 114688 - DNA, 1143 bp, Glycine max
  Peptide Sequence Number=SeqID_231466
atgtcaggaaatattcccaaaggtgcgttcctgttacccctcacactgtttctcatcttgctactccttcctctgttcagaaacttcattcaaccatctccgaagacatatgccaccaacttggaaaccaaagaaacaagaagatgcaacatattttccggaaactgggttccatatcccaaagaaccttactacaacaacgaaacctgcccttttatattagaccagattaattgcatcaagaatggtaggcccgacagagatttcctcaaattaaggtggaaaccgcatgattgtgagcttccactatttgatgcaacacagttcctggagctagtacgaggaaagtcaatggcctttgttggggactcaatggccacaaatcaactagagtccttactgtgcctcataaatactgttgcacatcctgaggatattacagcgaaatatacatccaacgataacatatttttcagatggtggttcgtgcttgattacaattttacagttacaacaatgtggtcaccttttttagtgaagttcaacgactcagatcccactggtcttggttcctatagcccaacgaagctttatctagatgaagcagatgaagcatggagcagcaaaattaaagattttgactttgtggtcttctcatcaggacagtggttcttccgaccattaacgttctacgagaataggcaagttgtcgggtgtcaaaaatgcgagaacagttcagagcttaactactatgggtacaagaaggcgtttcgaacagcttttaggacaatcagaaagcttgaagggttcaagggattggcttttttggtgactcattctccggaacactttgagaacggggcgtggaatgaaggtgggagttgtaaccgaacaaagccattggaagaaaaaggggtttatgaaaatggtgatattgtggaagcattgcatcagatacaattggaggagtttaatatagcgatagaaaagggtttgcggtttggtttgatagatataactgatgcaatggggatgaggacagacgcacaccccggtaggtttaggcctgtggggggtgctgttgacacttggaatgagtttttgctgtatttgatgaaactggaagctgaaaaacatcgttaa

SEQ ID NO: 114689 - DNA, 171 bp, Glycine max
  Peptide Sequence Number=SeqID_231467
atggggtgtgatttcatgaactccatgatggcgatggtgaagagagacaatatgttgaagtctagaaagcaacttggtggctatgtagaactttgtggtgctagcgaggccgccaatggcaaacatgattttgatgccatcagcaagacccacctcttggtggctaagtag

SEQ ID NO: 114690 - DNA, 333 bp, Glycine max
  Peptide Sequence Number=SeqID_231468
atggctatgaggtccgatggacacccctgtagatatgggaaagtagttgataaaaatgtgactatcaatgactgtgttcactggtgcatgacaggtccaattgacacgtggaatgagtttttgctctatgtcatgaaattggaaggggaaaatgaactttggggtgtatataatatataccacggtcttaggattgctgtgactcttggatttacaagaatcatagtagaatcagcttcaaaggttcccattcatttacaagtcattaccacctcttttaatttcatgcaggtcttcaataacaaatatatgaggacattttcgatactgtga

SEQ ID NO: 114691 - DNA, 291 bp, Glycine max
  Peptide Sequence Number=SeqID_231469
atggatctcttttcctccctctttaatgtttattggttgtccctaggtgaggtaagggaagctcactttcttattttggaccctggtcctcctccccgcttgacatttccgcaccaaatctgtgctttgcgctcaacatcccacctccatgatcagcaccatcgtcacgacactcaagaccaaaaaggagttgcgcgaccacctccaatccagtccgcattatgcacaacccttaccctggtgcgactcagaaccatgcgcaccaacctcttcatgagagaggggatatga

SEQ ID NO: 114692 - DNA, 309 bp, Glycine max
  Peptide Sequence Number=SeqID_231470
atgggagaaccgccagtcaaactggcgagttcgtggcaggagagcacagcctaccttataggctgcgtgtgcaggctacgtgctgctgtaggagagacaggcgcagagggaagaactcgccattggtgcaggcgagttgcaactttggtgcagggaagaactcgccagtttgactggcgagttgagcttcaaatttttttttttataaaacgcgagatatgggactcccgtgaagttttgaatcttatttgcactgtcctaacactacactatgtattcttcatacgtgctttgaattgctattcttaa

SEQ ID NO: 114693 - DNA, 273 bp, Glycine max
  Peptide Sequence Number=SeqID_231471
atggctaccattgcgttatcaagtagatatgggagcaagttagcatatgacaccggaatttggggtgaatcctacaggcttttcgctgcaaaattcatttcttggttggtgttttttttggaatggcagtcacagcatgggtttctccctcatcctcaccctctttatttgccccagttttctcattcgtctaagcaggatgatcaaatttgcctcttttcggacccacatcgatcctttcactggcaaagaccaaatccgcaaagcttttga

SEQ ID NO: 114694 - DNA, 414 bp, Glycine max
  misc_feature (5)..(5): n is a, c, g, or t
  Peptide Sequence Number=SeqID_231472
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccccccatcatagattacgttgcacccacgtacacaccaattccccccacccccatggcggattacgtttttcctagtgcttcgaatatggactacacttcaccgattgtccaaccagatgatttcctgagcaatgtttttggaactgattatggcacgccaacatcagctcatgtatacatgcatagcctatag

SEQ ID NO: 114695 - DNA, 252 bp, Glycine max
  Peptide Sequence Number=SeqID_231473
atgagtatcgcatcttccaccgcttcaaccagaatgagatatccaattgtaagaccacctgcaatcatccaattcagagcgactttgcacaatgaccagaaatacccctattctaccatgaacaatgggcaccgaattacccacaagaggttcggttcaaatacaatggagcaacctacccaatacgagtccaacaacaccgaggcagatatttttttgcagatggactcgcaaacgtcagggcaaatttaa

SEQ ID NO: 114696 - DNA, 483 bp, Glycine max
  Peptide Sequence Number=SeqID_231474
atggccgaggagtctcaagggattaagctgtttggtgcaatgattacattgaaccgtggggaagtaaacaaaggagaaaagggaagcgaatatgagagggtggagaagagagcagagaagataataccctgtccgagatgcaagagcatggaaactaagttctgttacttcaataactacaacgttaatcagccaaggcatttctgcaagagctgccagaggtactggacggctggtggggccctccgaaacgtcgcggtgggcgccggtcgccggaaggttaagtcaccgtgccatggagccggtgtctatgaaagtacttctgaagatgaaaacaagtttgagatgggtcagggacacgttgccatgcccaacactggtttccggcagatttttcaggccaagcggcagaggatcacctcagatgcagatatagatgaaatgttggtcaaaggacaaagagatatagaattgaaaaagtaa

SEQ ID NO: 114697 - DNA, 198 bp, Glycine max
  Peptide Sequence Number=SeqID_231475
atggctagtttggttgaggtgcattgttgtggtggctcgttggccgtttgtggttctcgtcatggttggggtactcacgacgataacgacaacaatgacaacaccaccaagaagatgatccacaaaatggtgaagatgaacaaaggggtcacggcagcacaacaaatacaaaagaaagcaacacgaggaaaggaatga

SEQ ID NO: 114698 - DNA, 357 bp, Glycine max
  Peptide Sequence Number=SeqID_231476
atgaagaggaagaaagagataaatgcaagagtgataagagaggagagtctgaataaaaagtttggggaccctgcgggaggttcagagtttgcattggagaaacttcaaagttatggtggtggtgatgactttgttggtgatggtggagaagaagaggggtggtggaagaaaggggttggaggaggaggaagaagatgggtttgtgcctatgccggggtcaacattctggcgacgtggattcgtgtggttgggccttctggtttggaccaccacgaagaagaggggtggtggaaggaagaggttggaggaaccacacaccgtatttttaacttttttttttttaaatcctacatgtaa

SEQ ID NO: 114699 - DNA, 252 bp, Glycine max
  Peptide Sequence Number=SeqID_231477
atgggaacaaggatttgtcatcacacgtgggagactcaagttggggatataccatttagagatttgtcctcacacggatgcataatgaagaatgtaggagtcaaaatgggcgccccactaatgaaaaatcttgagtttaaaaaggtggaaaggttttgcacaacaagcaccaagtgcagtgccaccaaagggataaaagaagttgataggttgatgacattgatggctcttggttgcaattttatccaatga

SEQ ID NO: 114700 - DNA, 1494 bp, Glycine max
  Peptide Sequence Number=SeqID_231478
atgtctactccttcatcatcatcatcttcttcttctatttgggtgttgtctaacataaaacttcagttctttggccgcatcagaaggtttctccaatccaaagcaaccaaaaagcgttatgacccctctgatcggtttgacacagctaagagcaaagttgaacacaacaacaaggttgaaaatcttgaaacagttcaagttatggagaagcataaagaggaggaggaagagtctgtgatcatgttgcagagaactgtgaagatgcttcactttggaagctgggaagagaaggaggtggcagcaaaggagattgaaaagttagccaaggaagatgttaaggttagaaaattgataacagaacttggggtggtgccggtgttggtatctatggtggcgtcgccggtggctagccgccggcgagcagggttgacggcgttgatccacctagctgatggaacctacacttggtttggccttctcattctttattacacaaattgcaccaatcccatcaaaagaagaaaatatgaattgaacaagaaaacttcaactgtaggagtagtattatttgtttctgacctaactttgactgagttgaagcatgctttccttccttacctgacgtatctattacgttctttcttcaggaacaaggctttgatagtggaggcaggaatattgtccaagcttcctaagacaattgaccttgtagatgaatcaacaacaagtaaattggtagagttgcttttgtcattgtcatctctagcaaacactcaattccctcttgccatattagactttctaccgttacttagaaacattcttgagaaaggctcaagttttgacaccaaaaattcatgtttaggtgccttacataacctatcaactgtgttagagaatgcatgccctttggtttcaagtggggtggtccctatcctcttggaagtatcctcaataaaagaaatttcagagaaagcacttgccactctagggaacttatcagtgactttgatgggaaagaaaacaatagagaacaattcaatggtgccagaaacctttattgagatcttgtcatgggaagacaaacccaaatgccaagagttgtcagtgtatattttgatgattcttgcacatcaaagctcattgcaaagaaagaaaatggcacaggcaggaattgttccggtgcttcttgaagtggttttattggggagtaatttggctcagaagagagcaatgaaactattgcaatggtttaaggatgaaaggcaaacgaaaatgggtccacattctggtccacaaacaccaagatttgcaatggggtcacctgtgaatcaaagagaagcaaaagaagggaagagattgatgaagagtttggtgaaacaaagtttaaataggaatatggaaataataacgcagagggcaaatgcagcaggggagtcttctaaattgaagtctttgattattagcactagttccaagagtttgccttactaa

SEQ ID NO: 114701 - DNA, 315 bp, Glycine max
  Peptide Sequence Number=SeqID_231479
atgaggaaacgagaattagaaggtttggtgaataagaaggcagaacgacaattgcttaaatacgttcgtatcgccggaaaagctaaaggatcaactggtcaggttttattacaactacttgaaatgcccttggataacatactttttcggttgggtatgactgcgactattcctcaatcctattttgttcctattcatttttgctgcaacaaaaaaagaggaagtgtcccaccagcaaaaatcagaaatagaagaagcatgagagacaacgaagtctgcacaagagttgttctctctgtaaatgtgaccaactga

SEQ ID NO: 114702 - DNA, 252 bp, Glycine max
  Peptide Sequence Number=SeqID_231480
atgaaggcgagccctggtgcagcggtaaagttgtgccttggtgacttgttggtcatgggttcgaatccggaaacagcctctttgcatatgcaaggtaaccaaaggtgtgatatgttcatcaaggagtatattgcttggcttaagatcacaatgcactactttgaatggagagtaatggtgcagataggacattccctcagctacatcactgcagattcttaccaattgaaccacattcaatctttgtcttga

SEQ ID NO: 114703 - DNA, 1128 bp, Glycine max
  Peptide Sequence Number=SeqID_231481
atggaatggaatgcaaagaacatttcagttcaccccgttaagtggatcactactactctgtctctgctctgcctgttttggttcttgtccctgcaccaagcaagagctgcaaagttccacaatgtgagtggcttgagagggaataatctagttgtagcaaatgggtgcaatttgttcctgggaagttgggtggttgacacttcttatcctctctataactcttcaacatgccctttcattgatccccagtttgattgccaaaagtatggaagacctgacaagcagtacctcaaatacgcttggaaacctgaatcatgtgccttacccaggttcgatggtgtggatttcctgaacaggtggaggggtaagaagataatgtttgtgggtgactcactgagtctgaatatgtggagatcactgacctgtgtgattcacgcgtcggtgccaaatgccaagaccggctttttgagaaatgaatcactgtccactgtgaccttccaggactatggactaactatacagctataccgcacaccgtatttggtagacataattcgagaaaatgtggggccagtgcttacattggactccattgttgctggaaatgcgtggaaaggcatggacatgctcattttcaactcgtggcattggtggacccacactggaaaatctcaaggatgggattatattagagatggacacaatctggttaaggacatggaccgtttggaggcatacaataaaggtttaaccacttgggctaaatgggttgaacagaatgttgatccttccaaaactaaagtcttctttcaaggcatttctcctggacattatcaaggcaaggattggaaccaaccaaaaaaaacctgtagtggagagcttcaaccaatatctggatcagcatatccagcaggtctacctccagcaactaccacattgaacaatgtgttaaggaagatgagtactccagtttatctacttgatataacactcctctcacagttaaggaaagatgctcacccttctgcttatagtgggtcccataaaggcaatgactgcagccactggtgcctaccaggattacctgacacttggaaccagctcctatatgcagttcttaccagatga

SEQ ID NO: 114704 - DNA, 340 bp, Glycine max
  Peptide Sequence Number=SeqID_231482
atgcccaagcaaattccgaactgcgagagcctcaacggtactctgatcagacaacctcaggcacctggaactaccgagaacacgaacaatctcagcagtgcttcctccatcgtcggaaacggggagaacgtgagcgacgcgggtggtgaaattcttgagctcctcgacgacgccgttgaaggcggtcccaccggaaaagacgagcagagcgggctgagggtagccattgaagacgaggaagaagaaaacgatgatgagaggattctggtacaagttgggaaggagaggggaagggtattacagaagcgtcgtactccactatgtgccaccttcaaattag

SEQ ID NO: 114705 - DNA, 2310 bp, Glycine max
  Peptide Sequence Number=SeqID_231483
atggtagctggcaaggccaagctctcgatgggttttcccaagtccccggcgccccctactcctccgcattcaacccccggaaggtcctccttcacgcgctctttcggtgcatacttctcacgctcctcctctcaggttcaaccccgcccctccgaagtcctcgacctcctccgtctcgtcgaggacctccgcgagagagagtctcgcctcaaaacagagcttctcgaacacaaactcctcaaggaaacactcgccattgttcccgttctcgagaacgagatttccataaagaactcgcaaattgaaagcaatgccaagaagatggaacaactggaggctgagaatgagaaactggggaacgagctccaagaactgaagctccgaatgaaagaagagaaaacagagaatctgagaaaaatacaagctttggagaatgagatagcggagctcaagaaaacggcgtcggatcacgtttgcaaggcgctggtaaacaacgagcattcttcgcttgaatgcaagtcgttggaaaacgacgagcatttgcaaacgacgagcattcttcaagcacatttggaggtgccagtgaggccaaattttattaggagtttaaagaaaacggcgttggattatagaagcttgaaccacaaacagtttgaagctactgttgttgttgcggattttaaacaagaggtggcggaaagtcaaaggccgcgccgtgactcggaggaactcatcgattctattgagtccaacttaaccagatcacgtgcgcctcgtgttcccaaaccgccgccgagacggtctttgccttcttcgactctgcattcttcttcctctgattctaagaacggcaatgttgaaaaagagcctgtgattttacaacttccgagggtggcgccgcctcctccgccacctcctcccatggctgcgtctaaggctgctccgcctcctccgccaccgccgccgaaggggagtaggcaggtttcggcgaaggtgaggaagataccggaagtggtggagttctaccactcgttaatgaggagggaatcgcagtcccggcgggaatcgctctccggcgtggtggaagtgccgcctgcggcggcgaatccacgtgacatgatcggcgagattgagaaccgttcatctcacctgctcgcagtaagtgtgtgtcctgattttgcagaaaattgcgattttgccactggtgtcagtgtcaaatgcaaagtacttactaacataaaaaccgatgttgaaacacaaggagactttattcgatgcttaatcaaagaagtggagggtgctgcatttacagacattgaagacgttgtgctctttgttaaatggcttgatgacgagctttcttatttggtggatgaaagagcagtgctgaaacacttcgattggccagagcagaaggccgatgccctgcgtgaggctgcgtttgggtattgtgatctgaagaagctagaatccgaggcttcgtcgtttcgtgatgatcctcggcagccatgtggtccagccctcaagaagatgcaggctctctttgaaaaattagagcatggggttttcaatatctcgagaatgagagagtcagcaacaaatagatacaaagtcttccacatacctgtccaatggatgcttgataatggttttgttagccagatgaaactggcatctgtgaaattagccatgaagtacatgaagagagtctctggtgagcttgagacaagtggtggtggtggtcctgaagaagaggagctcattgtccaaggagttagatttgcatttcgagtacatcagtttgctggagggtttgatgtggagacaatgagagcattccaagaattgagagataaagcgaggtcatgcaatcttcaatgtcatagccagcaacagaaattcttttgtagtgacattttgcttgtgaataccaatagaatggccatcattttaccgggccatgaatctcacgcacgtcatgtccactccctccccctccctagccagcgttatcatgaggatctcagcagcctcacgcaactccggcttggcgatgccactaggtgggacgagagggagggcaatggccatgaaggacacaagggcagggagtgccacggggtccagccctgccttggaggcatcaagggaagagatggtggtggcaaagtacgtaggcagcgtgagggggaggcgctccgaggtgaggttgaagccgagggcggcagcagtggcgaggaggtggcggtgctacggtgcggcagagttggcatagtggttcacgaagtggtacgacgcagcggtcgatga

SEQ ID NO: 114706 - DNA, 519 bp, Glycine max
  Peptide Sequence Number=SeqID_231484
ggaagagggacatggttgggcccaccactagtggacgtgcctgacaagctaccactagtggtcgcgcctggggccccaccactactggtagcgcctggggccccaccactaatggtcgtgcctggcaggccaccacttccacccctgtcccatcgtcctgtcaagccacgccacgtgtcgcgttctggtggaacgcgcccctcagaaaactctaatcctaatatcctccatccccatttgaccgcaatggtagcgggcaaggccaagctctcgatgggttttcccaagtccccgacgccccctactcctccgcattcaacccccggaaggtcctccttcacgcgctctttcggtgcatacttctcacgctcctcctctcggtgcatatcaaaccaccaaaacaatgcaaacgaaatgaatgaaaccaccaacctgataaaaagcgtgaaccctcaatcacgagaatgcaggggagggaagagcaaaccgcaaacagttaaaaaaccctacaagcagtaa

SEQ ID NO: 114707 - DNA, 927 bp, Glycine max
  Peptide Sequence Number=SeqID_231485
atgacaagggactggtcaaatctgcctcgtgaccttgtttcacaaattgtgagtggtctagggcttattgactttctcagtttccgtggtgtttgcgaagattggcgcgtggcttcttccacactttcctctgaagttaaagaatctcttaggtgtgatccttggtttctcatctatgaagaagaggaagattctcactctcagtgttcccttctgagccctgagaataaacgctacaccatcaacatcccagaactgcatggagcagcatgccttgcatcatataaaggatggttacttctctttcgccacggttcgttgttcttctttagtcccttttccagggcaacaatagagcttccaaattgtcctttcgctgaagcaactaatgagcatgttgcagcgttttcatctgcccccacttctaaagattgcattgttactgttgtcaaccgcatcagtgattctgagttggaactcttcttcatttgcagaggggagagtgaatggtccacgcgctgctatgatggctataagcttagtacaatgacaacagctttgttttgtgaaggcaaggaatttcactttctggacgtggataatcgattggctatctttgattctgaaaccaaagaatggaacaggtacaactatcgtatatgtcgtgaacgatcaagggatcaacctgcatcatcggttagaacattgagctatgtggtacgtaaaaacgtttttcaggataagaataccagaaaaatggggttattagaagaaaatgattcgatttctacatgcgggactgcaattccacaccctaaaggtgaatttcatcggatcgtgattaagagtgaaagcattgaggcagcagcaactcaacctgaaagccgtcatcttaaaggggattattgcaaaatgttggctaagtga

SEQ ID NO: 114708 - DNA, 204 bp, Glycine max
  Peptide Sequence Number=SeqID_231486
atggttacttctcttttgccacgggcaacaatagagcttccaaattgtccttttgctgaagcaactactgagcatgttcaagcactttcatctgccccaacttctcaagattgcattgttgttgtggttaaccgcattagtgattctgaattggaattgtttaggaatcgccgtggggagaaccaatgggttcggtttaagtag

SEQ ID NO: 114709 - DNA, 397 bp, Glycine max
  Peptide Sequence Number=SeqID_231487
atggggatggaggatattaggattagagttttctggttggtggtttcattcatttcgtttgcattgttttggtggtttgatatgcaccgagaggaggagcgtgagaagtatgcaccgaaagagcgcgtgaaggaggaccttccgggggttgaatgcggaggagtagggggcgtcggggacttgggaaaacccatcgagagcttggccttgcccgctaccattgcggtcaaatggggatggaggatattaggattagagttttctgaacgcgacacgtggcgtggcttgacaggacgatgggacaggggtggaagtggtggcctgccaggcacgaccattagtggtggggccccaggcgctaccagtagtggtggggccccaggcgcgaccactagtg

SEQ ID NO: 114710 - DNA, 264 bp, Glycine max
  Peptide Sequence Number=SeqID_231488
atgacgtggatgactcttcttacttcccggctcgaagtttctttgaatcaaggagtgacagttcgtgaagagcagggcttttccacgatccttacagcttcgtgtagtgttgaagagatgtcgcgggtacgatataagcttgttttagtgctgatgtttggtaatggtggttgtagggaagacagggtcatcaatgagttctttgtgaataacaactgctacattgttgacttggctgcaaacgagtcagtggttatttcttaa

SEQ ID NO: 114711 - DNA, 2085 bp, Glycine max
  Peptide Sequence Number=SeqID_231489
atgggctacgattatcatatccagtatcgctcagggagccataatcaggcagcagatgccttatctaggttaccggaaggagcttctcaagcctttctcattctctccgtcccttgtctcacttttttagatgagctccatgaccagtcacgcacgaattcgacctttcagcaaaagatgcttgatgttcagaatcatcccgaccaccaccctgagttctccattgctgacaaactgctgttgtataaaggccgtatctggttgccttccgatatacccatcatcaccaccctgctgacagagtatcatgccacccccaccggtggccacgccggcgtcgccaagaccgtggctcgtctcatgaccaatttttattggcccggccttcaagatgacgtctctcgctttgttgctcaatgcgttgattgccaagtcaccaagtacgaaactaagaagcttgcagggcttctctgtcctcttccagtacccagtcaaccctggtatgacttatctttagacttcattaccagcttaccggcatatcgtggcaacaccgtgatccttgttgtcgtggaccgcttttctaaaggtattcatctaggaatgttgcctcagagccactcagccctcacggtggccagattattcttggaaatagtggagctattcaaggccagtggaactcagctccggatgagttcagcctatcatccccaaagtgatgggcataccgaagtcatgaacagggttacttccatgggtggagtggtcctaaacacctcctggatggcgaacactggcactaccccatatgaaatcacttttggtcgtcggccattcaactttccggaatatcttgcaggttcctcgaaggtcgatgctgtagatgacctcttaattgaaagggataagacattccaattaattcataagaagctgttgaaggcccagagcaagatgaagctttacgcggacaagcatcgcagggatgttcaatttgttcctggggactgggttctggttcgtcttcgcccttaccgacagtcctccgccaaaggggatccctcgaccaatgtgaaattggctcgccgctattatggcccatttcaggtcacggctaagataggaccagtagcatatcgtgtgaactttccggcaggtgtacgcattcacccggtgtttcactgctccaacctcaaaccttttcggggcgagcccggatccactcctgcaattcctttaccacccaatttccatgagaatcagccgcttatatttccccttgccattctgggatctcgtcgcgcaacagctgagcctcacaacccttggcaggttttggtacaatggcaggggctctcaccggaggagacctcgtgggaggattgggaccagctccgtcaggactatcaccttgaggacaaggtgatcctgcaaggaccgggggatgatacaggtatagggtatgaagaagaagatgctgaggaagaagaagatcagagttcagctcaagagaagaaaaaagggattaacagtgggtctaatttggttgagggcactgttcaatctacagaatttcatgggaaagaaaatgctggcatggtgaatggaaaaaaatcacttatttcattcatgtcatgcattgtttctgaccctcaaaacgctatagagacttggaagtcaccgggaggcactatttcccctgctattgctaacatctcttccttgcaaattgttcatctttctggaaactgtctggtgggtaacattcgaaaggaattaggctatttggtacaggttggacaactcagtttgtctgggaattttcttcaagggcacattccatccgagtttggttcacttcataacttgtactaccttgacttgggaagtaatgattttgaaggagacattcccccaaacctcagcttcgtatttctttcgtctaacaagctagtaggccaacttcctttagctcttgcaaactctaccagccttaaatggcttcatttggagttcaatatgttgagtggagagcttccttctaagattgtaagtaattggctacaactacaattcctttag

SEQ ID NO: 114712 - DNA, 261 bp, Glycine max
  Peptide Sequence Number=SeqID_231490
atggcgcccccacctccagctgaccctaacaagaagaatgtgaattcctttgctcaaatgttgcaaaagggagagattgaaggagatggttgttggaaaaaggagaggaactttgagcagctcatggaggttgttgggaatcttaaacataagaatgtggttgagctggaggggtatttgccacccaaaatcaagactgaaaatattgagttgaaggggactccaaaaccaagaaaagggtgtcaccttatttcagaataa

SEQ ID NO: 114713 - DNA, 1191 bp, Glycine max
  Peptide Sequence Number=SeqID_231491
atgaatagcagcatagcgaaaaaatggcgacaactcagtggccaagatcattggaagggtctgatagaccctctggacattgatctccgccgctacatcatactctacggcgaaatggctcaagcggcatacgatgctttcaacacggagaaagcatcaaagtatgccggaagctgcagatacgccaaaaagagtttcttctccaaagttgctttggtgaatggcaacccctacacgtattccgtgacaaagtttctgtatgcaacgtcggaaatcgacgtccctgatgccttcatcataaagtcgttttctagggaggcttggagcagggaatcgaattggatagggtatgttgcggtggccacggatgaagggaaagcggcgttggggagaagggacattgtgattgtgtggagaggcacggtgcagacgttggagtgggttaatgatcttcagtttctgttggttcctgctcctaaagtgtttggtaagaacactgatcctaaagtgcaccagggttggtactccatttacacctctgaagaccctcgttctccctttaaccagaccagtgctagaagccaggtcctaagtgaggtgagaagactggtggagctatataagaatgaagaaataagcataactataaccggtcacagtttaggtgctgcaattgcaacccttaatgcggtggacattgttacaaacgggtacaacaagccaaatgatccatctctcaaggcttctccagtcactgccattgtgtttgcaagcccaagagttggtgacataaactttcagaaggttttttctggctataaagatctgacaaccatacgcattcgaaacgagttggatattgttccaaactaccctcttgttgggtattcggatgtgggtgaggagttgaagatcgatacccgaaaatcgatgtacttgaagagtcctgggaatccttcaagttggcataatttggaggcttacttgcatggagtggcaggaacacaagggagcaaaggaggattcaatttagaggttcatcgcgatattgcacttgtgaataagaccttggatgctctaaaagatgaattgcttgtgccagtgtcatggaggatcgaaaagaataagggtatgtttcaacaaaacgatggttcgtggaagctgatggatcatgaagaagatgacttttga

SEQ ID NO: 114714 - DNA, 682 bp, Glycine max
  Peptide Sequence Number=SeqID_231492
atgaggtgtaagaaacacttaccggacctcacaagcaccatcggcgtgtgcgcttcatgcctccgcgaacgcctccagcctctccttgcagcccaggcccaatcagaacgttccaccaattccgacgtggataataataatcatcgtcgaagaaagcccaagctcaagcccgaagaaaaccctctgccgctcaatttcccgcgctccgtgtctccctacgtgactcaccggaaatccgactgcgaacgccgccgggaaaggctattctacggcacgccgcagatgaacgctgccgcgtgcgacggcggagcagcgtcggagaaccggagacacggtggaaggttctggatcctctcgaatttattccgagccagatcgaacaagaccgaatcctcgccctctcatcctccgccgtcatggttctcgacaatccttcacgcgcgccggcacaataagtgtcggcacgcggatcgaggattgtcgccgttgacagaggtggagaatttcaccgaattctctgctgacacagcgcaagaccgatcggactcgggaatttcgtcggaggattcgccggcgaagcagaatccgacgccggagacggcacaccggcgatcgcggatgggacccgccggaaaaggactcgcgagtatggcgttttgtctgagtcctttggttcgggcag

SEQ ID NO: 114715 - DNA, 2451 bp, Glycine max
  Peptide Sequence Number=SeqID_231493
atgacgagcatggagagcttgatcggcttggtgaacagaatccagcaggcctgcaccgtgctcggcgactacggcgccgccgacaacagcgccttctcttctctctgggaagctcttccctccgtcgctgtcgtcggtggccagagttcggggaagtcttcggttttggaaagcatcgttggacgtgactttcttcctagaggatcaggaattgtgacgaggcgtccattggtgttgcagcttcataaggttgacggtagagcgaaggagtatgcagagtttcttcacatgccagggcaaaagataaccgattatgcatttgtccgtcaggaaattcagaatgaaactgatagagtaacggggaggacaaaacaaatatctcctgttccaattcatcttagcatttattctccacatgttgtcaacctaactttgattgatttacctggattaactaaagttgctgtagagggacagcccgagactattgctcaagacattgaaaatatggttcgatcttttgttgagaagcctaattgtattatactggcaatatctccagccaaccaagacatagcaacttctgatgctattaaactttcgagggaggtggatccctcaggtgagaggacatttggagtgttgacaaagctggatttgatggacaaaggaactaatgcattggatgtccttgaaggaagatcttaccgtctgcaacatccctgggttggtgtagttaatcgatcccaagcagatatcaataaaaacgttgatatgattgttgctagacgtaaggagagtgagtattttgaaactagtcctgactatgggcacttagccaataaaatgggttccgtataccttgcaaaacttctctcacagcatttggagtcagtaattagggcacggatacctaatataacatctttgataaacaaaacaattgaagagcttgaatcagagatgaaccaaattgggagaccaattgctgctgatgctggggctcaactatacaccatcctagaactatgccgcgcatttgatcggatattcaaggagcatctagatggaggaattaatttgatcctttgctttttttcagaaaaactactgtgtactgctatgcaaaggcatggcaaagatttaatgtacccacctgaatatggtaaagcaattttgaatgatagttatggagtcagctccttgtctgattcacaagttgaaaggcgaccaggaggagataggatctataatgtctttgacaatcagcttcctgcagcgttacggaagcttccatttgaccgacatctttctcttcaaaatgtaaggaaagtggtatcagaggcagatggctaccagcctcacttaattgccccagagcaaggttaccgacgcctcattgagggagctctcggctactttagaggtccagctgaagcttcagtcgatgcagttcactttgtcttaaaagaacttgtgaggaaatcaatagctgaaactcaggaactgagacgtttcccaactctccaagccgaaatagctgcaggtacaaatgaggctttagagaggttccgtgaagagagtaagaagacagttatccggcttgtggacatggaagcttcatatctcactgtggagttcttccggaaacttcctcaagaaatggagaaagctggaaatccagctaatcagcctaccccaaatgtggatcgatatggagaagggcattacaggaggattggatcaaacgtatcttcctatatcggtatggtatcagacactcttaggaacactattccaaaggctgtggtttattgtcaggtcagagaagcaaaactgtcattgctaaaccatttctacacacaaatagggaagaaagaggctaaacagctatcacagttgttagatgaaaaccctgccttgatggagcggaggcaacaatgtgctaaaaggcttgaactatataaagcggcaagggatgaaattgattctgatagtgatggagctaatgattgtttcttgtccgtcgagaatggcaattcggtcgaacgaactctagtgcagaccaagagtgaaaatataagcctaaagacttggaattactttctgcaccctcttcttgcttcaagcaccatcaaaacagacttgaatggatgcagatacccttccccatgcacctcaacaccaccacctccacccccacagaccccctcccctccgatgatgccatcgtctgtgttgtcaacaaatgctttgagggcattctcacagtccacaccaaattgtgctcatccctcgccctatgttagctacctcatcttcatttctaacatgcttgccttcctcaccaacaacggaatggttatgcctttggaaagtgagacgaaggataaggagaagtttggtagggttttaggtttggggatgggatcgatttcatatgagggatga

SEQ ID NO: 114716 - DNA, 459 bp, Glycine max
  Peptide Sequence Number=SeqID_231494
atgattcagaatatgattaaagaaggaaaaattgttccctctgaggtaacaattaagctcttacaaaaagcaatgcaggaaagtggcaatgacaaatttcttattgatggttttccccgcaatgaggaaaaccgggcagcatttgagaaagtgacaggaatagagccagcatttgtcttattttttgattgccctgaggaagagatggagaggcgacttcttagtaggaaccagtcatcacttgagacttttttctcaattataataaagggtagagaagatgacaatattgaaacaataaggaagcggtttaaggttttcttggagtctagtcttcccgtgattaattattatgatgcaaagggaaaagttcgcaagattgatgctgcaagacctatcgaagaggtatttgagacagtcaaagcaatttttggtccaaagaatgacaaggctgattga

SEQ ID NO: 114717 - DNA, 240 bp, Glycine max
  Peptide Sequence Number=SeqID_231495
atggagagcatctttggacacgcattgacaaagtcattggacgtgaaagctcacgaagctggtttgcatagcttcgatatgtattcgattaggacgaaaagatacttgatgcaatatactttgaagcggaatgcactctccgccatacacctcatatttcacactaacacgtctaagccttcaacgtatataagtgacgagtattgttcggccataattatcgtcaataaatccgcttaa

SEQ ID NO: 114718 - DNA, 165 bp, Glycine max
  Peptide Sequence Number=SeqID_231496
atgtttagcttgcatccataccttggaaatcgccagtcaaagttgcgatttcagcacaggctcgaaatcgccagcttcaccggcgggacgctcctcaacctgaaatcgccagccgcagcagcgggttgccatccacgtgtccgttgcccacgatgtcgccaataa

SEQ ID NO: 114719 - DNA, 252 bp, Glycine max
  Peptide Sequence Number=SeqID_231497
atgaatacctttctccctatttggggtatatctttattaactaccatagacattccattgtgcatgcataggttgctaggaagtagctttcttactcgtgttgctcaagtcttggttgttgcatttagaaagaaaaatgcctcttttggtagtagtggtttcataggcttgtatgaggttcctggcagacagcctcctatcaagggaagtcgaaagattactcatgttgatgaggtagcagtgagttcatag

SEQ ID NO: 114720 - DNA, 225 bp, Glycine max
  Peptide Sequence Number=SeqID_231498
atggctgaacaagctttgaccttttataaaataacagtactttctacatgtagtcgtagaaagactacaacttatgaatgtgctggcgtaagcaacgatgtagaaatcagatatttctctacatcgttgctaaggagagaaacgatgttgaaagcacaagttattacatcggtgctgacgagaaacgatgttgaaagcgccggttactacatcggtgttgactaa

SEQ ID NO: 114721 - DNA, 828 bp, Glycine max
  Peptide Sequence Number=SeqID_231499
atgtgcattaaatcatcctcttcatgcatcttggaggagatgcaacaatctggtggtttctcggcttgtccactcggtttcacccttgataaggaaagacagatcaatagcaatgaattaatgggaagcatgagtctgatcaatgcagcaggcaacaattcatcgaattctaggccttcatgtacctattgtgggaaagataatcacactattgatagatgctacaagaagaatgggttttctcataattatgcttccagaggaggaaagggaactcaaagcaatcctggcagaggaaattcaggagtaaaaggaaacaaggtctgcacatattgtggtttttctaaccataccataaatgattgttacaagaagcatgggtacccacctggacataaactttacaaggttcaaaatccaaacatcaataatgctagtagtataagagaagaaggtgatggttcacccttagatcgaaatcaagagacacgaaatgaagatgtaagattaactactcaacaatataaagccttgatgtcattaccacaacaacctctagtccaaaacaattcacaaataaatcagattggtacagctactaacaaaggtagtatattatctgttacttgcagtgttagcaagactagccaagatgagtggattcttgattctagagccaaagatcatgccacagccttcccacatttattttctttatgcaagaaaataaaacctataatggttaagcttcttaatggtcatacacttactacaatccttgtaggcagaatccagattactcagtttttatacctagaagaatcttaa

SEQ ID NO: 114722 - DNA, 267 bp, Glycine max
  Peptide Sequence Number=SeqID_231500
atgggaggcgagaggaattttaatggaggggatgggatgggagaagaaggaaagggaggcgagaaacattattgcatgatggggttcactaagaaccttgtcctcaagtgggatctaggaaattttagaaggcaactagcagaaaagttgtttaagtcatgtgaaagtgcaataggcgaggaaaaacaagattttaccatattcctctctagctattcatgtataaaagacattgtgggaatgaagtatgaggtatcgaagggttga

SEQ ID NO: 114723 - DNA, 153 bp, Glycine max
  Peptide Sequence Number=SeqID_231501
atgctagagaatcttcaggttcctccgtcgacaacggaatcgaccccagtgctgaagtgctatgctccacccaaccagaggaacgtttctgccaacaggcgcaaatcatctgttatatatctaagagttgaactcgaaaaactcaaatattaa

SEQ ID NO: 114724 - DNA, 2377 bp, Glycine max
  Peptide Sequence Number=SeqID_231502
ttcgccgaatattaccaccatgagctccaaagtgaattagataagcttcgaggactttatcctcgtgctaatatcatctatgctgattattacaatgctgcattcactttatatcgtgatcctaccaagtttggttttactgatcttaaagtctgttgtggaatgggaggtccatacaattacaacacaacagcagattgtggcaatccaggcgtgagtgcttgtgatgatccttcgaagcatattgggtgggataatgttcacttgactgaagctgcatatagaataattgctgaagcaaccatattggcagcatgcccttacaaatcaatcttcagcttcggtgattcatttgcagacactggcaacttgtattttagctcccacccaccttcccatcactgctttttccctccctacggtcaaaccttctttcaccgggtcaccggacgctgctccgatggccgcctcataatcgatttcatcgctgagtcactgggacttccactgctgaaaccatatttgggaatgaagaagaagaatgttgttgggggagcaaattttgctgttattggagccacggcgttagacttaagcttctttgaagagaggggcatttctatccctacccattattctttgacagttcaattgaattggttcaaggaactgcttccttctctctgcaattcttccgcagactgccatgaagtagttggaaactcattatttcttatgggtgaaattggaggaaatgatttcaactatcttttatttcaacaaaggagcatagcagaggttaaaacatttgtgccgtatgtgatcaaggcaataacttcagctgtcaacgagttgattggtttaggggctcgcacgctcatagttcctgggaatataccattgggatgtagtataacgtatttaacaatctatgaaaccatggataagaaccaatatgaccaatatgggtgcttgaagtggttaaataagttcgccgaatattacaaccaaaagctccaaagtgaattacataggcttcagggacttcactctcatgctaatatcatttatgctgattattacaatgccatattgtcattatatcgtgatcccacaatgtttggtccatataattacaacgcatcagcagattgtggggatccaggagtgaatgcttgtgatgatccttctaagcatattggatgggatggtgttcacctgactgaggctgcatatagaataattgctcaagtgctactactactacttgctgctactgtcactgcttgctacacctcactcttcagcttcggagattccctcactgataccggcaacttgtacttcatttcccctcgtcagagccccgattgcttgctccctccctacggacaaacccattttcatcgccccaatggacgatgctccgatggacgccttatcctcgatttcctcgccgagtctctggggcttccgtatgtgaaaccgtatctgggtttcaagaacggcgcggtgaaacgcgggaatattgagcagggagtgaattttgcggtggccggagccacggcgctggaccgcggtttctttgaagaaaaggggttcgctgttgatgtgaccgcaaacttttctctgggggttcagttagattggttcaaggaattgctgccttctctctgcaattcttcttcaagctgcaaaaaagttattggcagctccttatttattgtgggagagattggaggcaatgattatggctatcctttgtctgaaacaaccgcatttggagatcttgtgacttacataccccaagtaatatctgtaatcacttcagcaatcagggaattgattgatttaggggctgtaacgtttatggttcctggaagtttaccacttggatgcaatccagcctatttaacaatttttgcgactatagataaagaggagtatgaccaagctggctgtttgaaatggttaaatacgttctatgaataccacaatgagctgctccagattgaaataaatcggcttcgagtgctatatcctcttaccaatatcatttatgcagattatttcaacgctgcattggagttttacaattctccagaacaatttggtagatctatcctcttagctttttgtgtcatatcaacgtttctgggttgcaacttgcaaagtgatactaggatttactttgatgtcattacagggtttggtggaaatgttctcaaagtttgttgtggaggtgggggtccttacaattacaatgaaacggccatgtgtggggacgcaggagtggttgcttgtgatgatccttcacaatatgttagctgggatggctatcatttgaccgaggctgcttatagatggatgaccaaag

SEQ ID NO: 114725 - DNA, 2260 bp, Glycine max
  Peptide Sequence Number=SeqID_231503
caaacctttgattgacattaaagttaagctgcaggaggctagagaaaagctcactcatgctcagatggagctaactctagacagactaaacaaagacaaaatagacagaaccaaggactgcactgaagcagtcattaagtggattgagatggaagaacagatgttgcagcagagagccaaaattcgttggcttaggcttggggatggcaacaatgcctatttccacgcctctcttaaagccaagtacacccaaacgtccatcaagaagctgtacatgaatgatgggaattttgtcaccactcaaaaagagatcaaggatgaaattatgcggttctatggggatcttatggggagagaggagcctaatttggacagtgtggatatcaatataatgagaaaaggctgccagctgaattttgaccaaaggaagtatcttattggtagaattactgatgaggagattgacaaagcgctcaagagcataggggatcttaaggtgcccgggattgatggctacggggcaaaattcttcaaggatgcctggagcatcattaaaagtgattttacagatgctattagggagttctttgaaaaaggaaagatgtatgagcccatcaacactagcttggttatccttatccccaaaaaccaggaggcaaagtatgctcgtgactatagatcgatttcgtgctgcacaacgatatacaaggtaatctctaaagtgttaactaccaggctgagtagagtcataaagagtattgtccatcaaagtcaagcgacgtttgttccgggccagaaaatccatgaccaaatcttgcttgcgtacgagttaatccaagggtacgagcgtaaaggaggtacgccgcggtgtatgcttcagttagatatccaaaaagcgtatgatacagttgactggaaggctttagagctcatcatgagagaggtaggcattcctagacaattcattaattgggtgatgaagacggttaccatagtaacttacaagttcgtggtgaatggagagtatacgcatagtctgaaagcgaagagaggcctgcgacagggagatccactttctcctttactgtttgtcattgtcatggaatatctgcacagatccctccaagagttaagatatacccctaactttaactttcatgctaagtgcgagaagttaaacatcattagcctcagttttgcagatgacgttctaatgtttactagaggggataagatttctgttgatctacttatgcaggctttcatgaatttttctaaatctactggccttgtgataaacccttccaagtgcaaagtgtattttggtgcagtggaaagttgcataaaagaggagattaaacacatcactgcatttcaggagggatctctcccattcagataccttggtgtccctctcaccgggaaaaaattatcggttaaccattatatgagcttaatcgataaaattgttgctagaattactcattggagcgccaagttacttagttatgcaggtaggcttcaactcattcggagcaccacctatgctataactaactattggatgacttgtttcccattccctaagaaagtgattaaaaaaatcaatgccatctgtcgatcatttctctggactggtggaactactatctctaggaaatctcccatctcttggaagcaggtttgtaccccaaagaatcaaggaggtcttaacttgattaatctggaaatttggaatgcagtaaccatgatgaagcttctttggaatgtgtgcaataagaaggacagtctatggattaagtggataaattgttattatatgaaaaatggcgacgtgatgtcaatgggaataaaagattcttgctcttggattttaaaaggtattctgaagcagagacaaaagattcaatctcttactagctggagtactttgttgcaaaaggatagatttgtgtcgaagataatgtacaatgaattgcaggatgtttccagtagagttccttggaggaaattatttttctccaacctggctagaccccgtgcaaagtttgttttctggactgcctgtcatggcagacttgccactaaggatgtttggattcagatcttggaatggcaaaagattaaccaccagccaaagaagtggattgaggagcttagctgggcgatggcgcagggtaaaggaaaggggcatagagcaactttactcaaaaccgcattaaccgagactgtgtatgagctttggaaatataggaatgaa

SEQ ID NO: 114726 - DNA, 216 bp, Glycine max
  Peptide Sequence Number=SeqID_231504
atggctggactctgtttagttgttagtgaaaaggcctgttattttgtacgtacagaggatgatctgactgaagcaattgcaaaagctactggaccacagaaagattcactatgttttatagaagtttttgtacacaaggatgacaccagcaaagaattgctggaatggggatctcgtgttgctgctgctaacagtcgtcctcctaatcctcaatag

SEQ ID NO: 114727 - DNA, 630 bp, Glycine max
  Peptide Sequence Number=SeqID_231505
atgacacggggacggggacagccgccaaagaagaaggtgtttgcgtcgccgaagaatcgtgagggtacgtcaccaagatctgacaatggtgaaacgccaccggagggagaagaggcatcggaggggaagaatgatgatgagatcccaagggaaaccctaattgatgtggaagacggagaagcgaagaaaatgaaggaaactgagcacaacgaggtgcctaagctctggactgatatcataagcggaaatagggtcatggagaatggaatgcagctcagttacgtggccccgaaaaaggtagatggaggttatgaggtagaaattgaagatgaagacgtggaggaggaactcaaatattgggaatcagctctgataatatatgtgataggaggtgagttgagcatgaatgcagtgaaaaattttatgattaagttctggaattttattcagctaccggaggtgtattacaatgatgaaggctatttcatccttcggttcaaagctatgaaggacaaggaagaggtgctgaaaagagggccatacacgatccaacgcatgactatgttcttaatcgagtggaaagaagacttctccatggagaaggacatgatgcgcactctctccatctag

SEQ ID NO: 114728 - DNA, 474 bp, Glycine max
  Peptide Sequence Number=SeqID_231506
atgataggaaaaccgatgtttacggatgaatgcacagcgaacaagcttagagtcagctatgctcgcattcttgtggaagtggatataacccaaaaaatggttgatgtcatcaccattaacaaaaaagggcagaggagacaacagaaaatcgagtacgaatggaaaccgttgttttgtgaaagatgtcaaaagattggccacaggtgcaccaattcagttaacacaaaacaggggcaaaggaaacaatggagtataaagtcagttgaagctgatgagcccaagacaacaacggaaactactatcgaagagtgtgagatccctgaagctagtcacagaggtgagtggaatgatgttaacaaaaggggcacagggaaaaagagaaacaaccaccttgtgagagcagtgcattgtgagaatggatttggtgccttagagattgggaatgatcatctagggcctgttgataacacatga

SEQ ID NO: 114729 - DNA, 393 bp, Glycine max
  Peptide Sequence Number=SeqID_231507
atggtgattcttgcaaaggagccttgtgctgaagtggtagtaactcagactggctcagaccatccaaatgaatctattcatgtacttcatgttggaaagatgaggatgaagctctgtaaaggaaagacaacaattgccaaagaatactattctagtttcatgcagctttgtggagttcgaggaggtgggaatgctgcagcacaggcagtcttttggcaaccaaagcaaggcctttcttttgtattagcttttgagtctgagcgagaaaggaatgcagccatcatgcttgcaagaagatttgcatttgactgtaatctatcatctacatcctacactctaccctttaagattattcttgctggacctgatcacaaagctccattagaaacataa

SEQ ID NO: 114730 - DNA, 555 bp, Glycine max
  Peptide Sequence Number=SeqID_231508
atggtggaggcctctggtaatcgattaccagtctgtgtaatcgattacacagaggaatgggtcactggtaatcgattaccagttaggtgtaatcgattacacagtgcatttttgcagatcatgatggcggcacagctaatccatgatcgagtagagatggagtgcctagagggagcttgggagactctcgaaggcaacacgaggtgccgatttcggggcaccattcgattcacggctacttctttggtgcatccagatgaacctgcacgaacgcttcagcgcacgatggagtggatactacccacgcctacaccatatcgtctagtggagccagtccaagtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagattctacggaggatagtggcccgggggagatggcgatcagcggaggctcttcatcatag

SEQ ID NO: 114731 - DNA, 150 bp, Glycine max
  Peptide Sequence Number=SeqID_231509
atggataagggcgtctacgatggacaattagtccttattgatgatatcccaaaggatgcatcgttgagtgtgcaagattatgaggatgccaatgatgaaaagggtgaagctcatggtgtagatgctcaaaatgacgatgaagattcttag

SEQ ID NO: 114732 - DNA, 267 bp, Glycine max
  Peptide Sequence Number=SeqID_231510
atggctttaactcaacacctccaaggctttttggggattatcaaattgaaagccaatctaagaaaagttgagagcttcctcaacttcaccttaaacgctaacatcactctagctagcgcaaatgcatatttgaagggacgtgtttccaattttgaaggagagatgaaagccattgagttgtcaatgattaagggtgttacaaatgacatcaaagaagacttctctcctattatggtgtggttcgaggacaaactaggcaaaaactag

SEQ ID NO: 114733 - DNA, 597 bp, Glycine max
  Peptide Sequence Number=SeqID_231511
atgaaaaagggatatggcatgctagtgctccttgaaactcaggctattgatgtttccaaatgccaggaaaaagtaagagaaacaccaggcaatattgagaattctatgaagctggaagcagctgaaacaaagctgcaagacctgaagacaaacatggccatattgggaaaagaagcagctgccgcaatggctgctgtagaagcacagcaacaaaggttgaagcagaatgtgcctatcattaatgagtactccaaatacttgatcagcttgagggaaagaaaaataatatcagaacgacaacaaagtaaagcccctcttacacctagtgtggataacaacatgacaccacccccatcatatgaaaaagtaaatggtgtatgtgcttatcaagcacataatggctcaacagatagtatgggttacttcttaggagaggttttatttccctaccatggcaaagctgattctattgcttcgaatccaatatgggcttttaatgcagccaggaaaggcattcctgtgagttcaaaacccaacaaaagtaccttaaatgaattgatcactcttcaaaaagcattcaattccaaaggaggttga

SEQ ID NO: 114734 - DNA, 489 bp, Glycine max
  Peptide Sequence Number=SeqID_231512
atgattaatgcaaactgtgtgcaagaatcattgcattcagtctcaaacgggaatctaagttttgttggaaaccttgagaaggagcagagaagaaaaggctatgctggggaagaaggttctatgttaatgttgttggagggagaaattggggttggagtagaaggatcagagctgggaggggatggacatggaggagccggaaccataaaggaagcttacaacattggcggtcatatcataagtgcaaatgcaatagaacaagcgatattttgcttccaaacaccccacattggtcggggttgtttaatggtaaggataaaaaggtggataataaagttgtatcaaagtaggcaaagatataagcttgataagcttttgtcttatctagtgtttggagaggttatggggatggcagtaactagggcaggggtggtaacagaagcattagtggcagcgatggtattggcagcatcagaaaaggaagaataa

SEQ ID NO: 114735 - DNA, 222 bp, Glycine max
  Peptide Sequence Number=SeqID_231513
atgacggatgaggtttggggtgtcgactcaagtgacttctctaattttttggatcacctacaagagaaggtgaccgataacataagggtagccgatggcaaggtgggcactgttgaaaaaaattcttgtgtctcttttgaaaaggagactgaagagaagggtgaagggtcatttgaccactcgcttaaggaagtacccccaaagtgttggcgtgttcaatag

SEQ ID NO: 114736 - DNA, 222 bp, Glycine max
  Peptide Sequence Number=SeqID_231514
atgaacatgctgcacatagttgagccctatgtgacttatggatacccaaatcttaagagtgtgaaagaacttctttacaagagagggtatggaaagctaaacaagcaaaggacttctctaattgacaactccatcattgagcaggtattgttaattcacaattctgtattactagctggagtgctgcagtggcttttcaaagcaatagaaccacatgaatag

SEQ ID NO: 114737 - DNA, 435 bp, Glycine max
  Peptide Sequence Number=SeqID_231515
atggcacgcaaaccgaggcaggattttagcgtttcaaaggtcagatttttctcactgtttgtggctgagtatgagtcacaatcaaaagggaaagtgagcccttcttgctccactcaaatggagacatttacttggatgttggggaagcttgggaggattgatggggacccggtgttgagagagacgaggatatgggctacgtgggagtacgtgagctcagttagaggtgggcaacaggggatggtgggtttatacgcgctttgtggatgtggaaaacttgttgtgcaccatcgcccgaccgccacctatggtacctggagatatgtcgcgggggtcaggagaccttggggacgtcaggcgagctcctggcagtcaactgataaaaggaacaaagaccacaaagcaaggaggcttgtggtggctgaccagctgtga

SEQ ID NO: 114738 - DNA, 531 bp, Glycine max
  Peptide Sequence Number=SeqID_231516
atggatcagaataaacactgcagggagggtgttcatagtagggatggatggggagtgaatggaaatacattgataacaaaatacgggatagttgaagctctagcagttcaattgactcaaagggaaggggaattaatacaagagaagtctgaggtgaagaagctaacaaattttcttaagcaggcttctgaagatgcaaagaaacttgtgaatgaagaaagagcttttgctcgttttgaaatagaaaatgccagagcagcagttcagagagtggaggaagcacttcaggagcatgagagaatgtctcaagcttcagggaagcagaaattatcaaataagaaaaattcttcaataatcatgatattgattggttgcattgaaaatataactgttgatattgcagtgctgcatcaagatctggaacagttaatgaaggaagttcaagaggcccggagaatcaaaatgctgcatcagccaagcaagaggttggactggagccttggaggtggtgatgaaattcttgagatatga

SEQ ID NO: 114739 - DNA, 495 bp, Glycine max
  Peptide Sequence Number=SeqID_231517
atgacgaggatgacccgtgattttggggatactatgcaaaaagatgcagtgccggcggtgtcggctgatataatatttgcttctcttcggtttcctaattacaaaatcggagttaacaatcagatcatggagacaaaggatagtccaaaagtgctatctatgaaggaggttgttgcgcgagagactgcacagctgttggaccagcagaaacgtctgtcggttcgcgatcttgccagtaaatttgagaagggtttggcagctgcagctaagttgtccgaagaggctagactcagagaagcagcttcactggaaaagcatgttcttttgaagaagcttcgagatgcactgcaatccttaaaagggagagtggcaggaagaaacaaggatgatgtagcagaagctattgctatggttggctccttttttagatcaggcttttcaaatttattcagttatttgataaataattcatatgaagctgataatataatgtaa

SEQ ID NO: 114740 - DNA, 186 bp, Glycine max
  Peptide Sequence Number=SeqID_231518
atggagaagctggatctgaaattagcaactgggtacttaaatccattaattgacagtgaagcattgttgtcgatctacatcaaggagcaatgcattaaacatgacaaccacgacacgacttcatatttaaaaaaagatgtttttaaggagcacatagatggaaatcattattaccatttaccttag

SEQ ID NO: 114741 - DNA, 588 bp, Glycine max
  Peptide Sequence Number=SeqID_231519
atgacaaggccaaagatttatctcttcggtgattcaatcactgaagaatctttctcggttggtggatggggtgcttctctcgcccaccatttctctcgcacggctgatgtggtgctaagaggttacagcggatacaacactcggtgggcgttgaaggtgttggagagggttttccctgcgtcacatggcggtgacggtggaaccggaacagcgccaattgctttgagtgttttctttggggccaacgacgcttgtgttccggataggtgttctgcttttcaacacgtccctctccatgaatacaagcagaatcttcactccattgtttccttcttcaagagttttgactcttgcggagttgataagcgtgctttggttgcgtatattgcatgtcacgaaagggttaattatttgtcatttggtggggtcaagtgttatgatgattttctggtcaatatggttgtggggtttcatgaattgagaagtgagaggtggtttcagctaacacacgtgcgtggccgtgggtatgggaagtgtggttgttgtttgccacttgaccataagatacgctgtcataagggaccctga

SEQ ID NO: 114742 - DNA, 1567 bp, Glycine max
  Peptide Sequence Number=SeqID_231520
atgaaaaatgcaatattccgacctttcttctcgtcgcgtggcttctgcacttcgctcatctcacaccatcaaccatttccgcaaaaccatgacttcattcctccctctacttcgttttccaatgctctgcagctttacattaattccgagactccttcccacggccaaaagatccattccagcattctgaaatctgggtttgttccaaacacaaatatttccatcaaactacttatattgtacctcaaatgtaattgcttgaggtatgcacgccaggtgtttgatgatttgcgggacagaactttgtctgcttataattatatgattagtggctatctcaaacaagaccaagttgaagagtctcttggtttagttcataggcttttagtgtctggtgagaagcctgatggctttactttttcaatgattttaaaggcgtctacttctgggtgtaatgttgcgctgcttggtgatctgggtagaatggtgcatacccagatccttaaatctgatattgagagagatgaagttctttgtactgcactgattgactcttatgttaagaatgggagggttgcttacgcgaggactgtgtttgatgtgatgtcggagaagaatgtggtatgttcaacatccctcatctccggttacatgaatcaagggtctattgaagatgctgaatgtatatttctgaaaacgatggacaaggatgtggtggcatttaatgcgatgatagaaggctacagcaagacatctgaatatgccatgagatctcttgaagtttacattgacatgcaaaggttgaactttaggccaaatgtttctacatttgccagcgtaattggtgcttgctccatgcttgcggcatttgaaattgggcaacaagtacaaagtcagcttatgaagactccattttatgccgacataaaactgggaagtgcccttatagacatgtatgccaaatgtggaagagttgtggatgctcgaagagtttttgactgcatgcttaagaagaatgttttttcatggacatctatgattgatggatatgggaagaatgggtttcctgatgaagcacttcagctatttggaaagatccaaacagaatatggcattgtgcccaattatgtgacattccttagtgctctttcagcttgtgcacatgctggacttgtagataagggttgggagatctttcagagcatggagaatgaatacttggtaaagccaggaatggagcattatgcttgcatggttgatctgttaggtcgagcagggatgctgaatcaggcttgggagtttgtcatgaggatgcctgagagaccgaatttggatgtgtgggctgctttacttagttcttgcagactccatggtaatttagagatggcaaaattagctgcaaatgagctttttaagctgaatgctactggaagaccgggggcatatgttgcactatctaatactttggcagctgctgggaaatgggaaagtgtaactgagcttagagaaataatgaaggagagaggaatatccaaggacactggccgaagttgggttggagctgata

SEQ ID NO: 114743 - DNA, 972 bp, Glycine max
  Peptide Sequence Number=SeqID_231521
atggagaatgcagatttgattgcgtttacttacgctgctatgctatgctacgatgttgatgcaatattggggaaggataatggaagggttgggaagggagagaatgagcaaagagttttgggggcagaatggtatttttccttagagggtcgttcttctccgcattggaagcggaatcaccattctgacctccttactcgttacactactttccccccttttcgccttgcagcagtgatcgagatgctgggaaagacgaggaaggtttcggcgcgtggcgaatccgtggcggcgaactacgccttcggtccctccgaagatgacgtaatcatcaagcacaggcttctcacgcgcaccaccaccaccaggggcgaccctcccttgaagaagcttcagaagaagttcacctcgttcgtctccgaagtggacaaggacgaagacaacaactacaacgaatgcgacaagctcgccagagcctttctgcaggagctgacgacattcgagattcctcttctgaagagcaaggcgattgtggaggccaacattagggagaaggagaatttcaacgagttgaaggaggaaatgaatcgccagatcctgcaggcgcaggatgacattgaggatctcaagaagcagcttgaggagagcaaggttgagagaaggcacaaggaggagtgcgaggctattaggaagttgattgccatgcagcccccgaggtccgagactatgaaggttatttcagagttggagaacgaaattgccgctttggacgccgagaacacggctggttcgaggttgttggagctcaggaagaagcaatttgcgctgttgttacatgtggttttaagtgggaaaggttggcctgacactaattttggatcagtagtgactggatttggaatggatggctggggaaagacaaatgagttacttgtggaaacggacagctggcaacatggagtggagaagtaa

SEQ ID NO: 114744 - DNA, 240 bp, Glycine max
  Peptide Sequence Number=SeqID_231522
atgtgttgttgctctgaagactgtgagtgcaggcctcttgggtttttgttgggcctgccttttgccttcttgtctctcctcatctcccttgtgggtgtggttgtttggatagttgggttgcttttgacatgcatatgcccatgttgtctttgtgtgaccatcatagttgagtttgctctggcgctgatcaaggctccgatagtggttatggagtggttcatctccaagattccatgttag

SEQ ID NO: 114745 - DNA, 1062 bp, Glycine max
  Peptide Sequence Number=SeqID_231523
atgggttcaggtgattggtttaagacaataattagcttaagaaaatcaaaacaaggtagatcaaagaaagcaaaggctgcatcaataccttctattaccaagtatgataatttattttgcatgagagccattgtaatgagaatgtttctctctctatctggccacattttgagacagggtatcttagctcaagagaaactaaatgcatcaaagtcaaacagctatccaggaaaagagtctggtggtttagcaaatggtactaaaagtgaaaaccttgtgtcagctggggtgtcagttgaaactattgctgcaaaaaggatccagactgcattccgagcttataaggctagaaaagctttacgtcgcatgaaaggatttacaaaactgaagatcctaacagaaggtttctctgttaaaaagcaagccagtacagctataacataccttcattcatggagcaagatacaagttgagattagagctcgccgaatctgtatggtaaccgaagacaagatcaggaggaagaaactggagtctcaattaaaactggaggcaaagcttcatgatctggagatattttcttccaatgctctctctaatggatctgcacttttatctgtttatttgatgaaggttgaatggtgtggtggttctgaaaccaaggaggaaatccttggaaggatacatgacagggaagaagcagcagttaagcgtgaaagagccatggcatatgccttttcccatcagtggagggccaactctagtcagagccaattgctaggtaattatgaacttagcaaagctaattggggttggagttggaaggaacgctggattgctgctcgtccatgggaaagccgtgtccctagcttatccatcaccccgaagaaatctcaacacaagcagccaagcccgagcaaagttcagaaggataagaacacatcaacacctaaaactcccgtctcggttaaacctccttcagccaacgcaaaaggcacttcaaaagctaggagattgtcttatccaacaactgagaaaactgtggttcaaggagtgcaatga

SEQ ID NO: 114746 - DNA, 672 bp, Glycine max
  Peptide Sequence Number=SeqID_231524
atgggttcgaacagtacggagacaggaggtattcataattcgccctcttcctctaatgatctcatcaccaaatcaaaactcaccgttttgaagaagaataagagagcagcagttctgatctgcgtcttcgaaggcggcgatgggaatctgcgagtatttctcacccagcgggcttcctctctctcaacccactccggtgaggtttctttgccaggtggcaagagagaagaaggtgatgctgacgatgtgcaaactgcgctgagagaggctaaggaggaaattggcttggacccttctcttgtttctgtactcactcttctcccaccctttcatactaagtatggtgttacaataatacccgtggtaggagtactgtccgacaaagatgcattttctccaattttaaattcaactgaagttgaagcaatatttgatgttccattggagatgttcctcaagaacgataacagaagagccgaggaaagagaatggatgggggagaaacatcttgtacattattttgattatgaggatgggaataacaagtatgtgatatgggctataactgctgcaatcttgattagggcggctactcttttacttcagcgaccacctgcttttctagagcagagacctaaaatatggggaggaatgactgaaaatggcatatga

SEQ ID NO: 114747 - DNA, 690 bp, Glycine max
  Peptide Sequence Number=SeqID_231525
atggtgctgctggtcactgcgacgctgctgggtgcggttgctggtcgctgcttcgcggggtcatgctgctgccggtcgtcgctgctggtagtggtggctgctgggtgcgggtgctggttcgctgctgttctgtttctgttcgtggctgctgcgcttttcaaaatatattatcgggtagggttgggtcagggtagaggcttcaatgtacaaattaattattctgaggaacctgtccaagactatgttcaagctgctgtttcaacagtactcttgatccatgagcgggagcctgcaggagacgttctagtgttccttactggacaagatgatattgatgcttctgttcagttacttaatgatgaggttcaaactactggaaagcactcttcaggattgattgttttgcccctgtattcaggactttcacgcgctgaacaggagttagtgttctctcaagcccctcgaggaaagagaaaagtgatcatttctactaatatagcagaaacatcactgacgttggaaggaattgtctatgttgttgacagtggattctctaaacagcggttctacaatccgatttctgatattgaaaatctggttgtggcaccaatctctagagcttctgctagacaaagagctggtagggctggacgagttcgaccaggaaagtgttacaggtgtagtagttag

SEQ ID NO: 114748 - DNA, 819 bp, Glycine max
  Peptide Sequence Number=SeqID_231526
atgagggaagttgtcagaaaggaggtagtcaagctattaaaggctagaatgatatatcctatttcagatagccagtggatgctggagagactagcagaccaacaattttattgttttcttgatgggtactcaggatataatcaaatcactgttaatcctgaagatcaagagaagataacttttacttgtctcttcgatgtttttgcttacagaaatatgcctttcagtctctgtaatgctcttgctacatttcagcattgtatgcttgctattttctctgatctcgttgagaagagtattgaagtgttcatggatgacttctctgtctttggctcttcttttgatttatgtctttctaatcttgacactatagtgaagcggtgtgttgaaacaaatcttgtgcctaattgggtgaaataccactttatggtgattgaaggcactgtattgggtcacaaaatatttgttcatggcattgaggttgacaaagccaaggttgaagtcgttgaaaaattgcctctgccaacaaatgtcaaaggcatcaaaagctttctaggaatgctgggttttacaaaatttgatttggaaatcaaggataaaaatgggagtgaaaatcatgtagctgataatctctctagacttaccattgatgaggtgaccacacaaggtcctgaaattcaacaagagtttccttatgaaaagttgttcaacattgcaaaaaggccatggtttattgagatgaccaatttcaaagcagctagtgcactccctgatgatctcacttggcaccagaaaaaagaaatttctcagggactctaa

SEQ ID NO: 114749 - DNA, 291 bp, Glycine max
  Peptide Sequence Number=SeqID_231527
atgtacaaagataagtggacccaaccttggcccatgggctcagaaatctaccctgaggttcatgagaaccctaggaccttcttcagtagctctagcccaatcctcttggagcttcttgctcatggctcggtggttcctccaagtgatctcctccgtgaactcaggataatcaccctctactatttggactcttctttccttgaggaagaaccaatctttgatcaaatcaaaatggtgttggtgctcttagttgttcatcaacaacaaaatttgcaagtggagatgtgctag

SEQ ID NO: 114750 - DNA, 267 bp, Glycine max
  Peptide Sequence Number=SeqID_231528
atgggtaaggaagaagatgaacagcgactcggcgacgcgtcggagaggaagagttggaaaagtttgaagcggcaaagactcggcggagaaaggcctccacgtggtgtcgaactcggacggtggtggcggaaaggagaatgcttcacgaccgccacttggagaccgcgggggaacatggaagaacttcgtaaacgacgacgacgatgctcgctggttcccaccgcgggttcgacgcgtcagtggcaaggtggtggatttgtgatttga

SEQ ID NO: 114751 - DNA, 2319 bp, Glycine max
  Peptide Sequence Number=SeqID_231529
atgcatttcctttcaactattcctcaaacactagcaatgatttggctcttttatttactcatctctcttggtctcattagtggctaccaaaatgaagctacaaatgcaaataacaaagttatatctattggggctatcattgatgttaattctcgcattgggaaagaacagcaagtagccctggacattgctgctcaaagttacaatagcacttcaaggacctacaagttggctctctattttcggaactccaccaaggatcccctcagagccatcactcttgttgaagagatgatttataagcaaaaggtgcaagtgattatagggatgcacaaatggtcagaagcagctctagtggctgaaataggaagccaagctcaagttcctatcatagcatttgcagaacctacaattaccccaccattgatgacagagcgatggccttttttggtgagactggctaacagtagtacaacatatatcaaatgtattgcagatatagtgcaaacttataattggcagagagtagttgccatctatgaagatgatgcatatggtggagattatggtatgctagcactgctatctgaggccctccaggatgtaggttcaatgattgaataccacttagttcttccacctatttcttctctacatgatccaggcgggcttgtacgtgaagagttgcttaagttgtggcaaacacaatctcgtgtgttcattgtgctgcaatcttcatttgaaatggcgattcatttgtttaaagaagcctcaaaaatgggactcgtggacaaagaatcagtttggatacacccagagagcataactaatttgctggactctgtcaacaagtcttctatttcctatatggaaggagctttaggaatcaagacctactactccgaaaacagcactgagtaccaagattttgaggctcaattccggaaaaaattttggcctaagaatgctgaggaagataatcgctacccaggattttatgctttgcaagcatatgacagcattaaaattgtgactcaagcagtagacagaatggccggtagaaacactagcagcccaaagaatttactaagagaaatactgtctagcaactttcttggtttaagtggtcaaattcaatttgaagatggacaactcctgcagaatcctattttgaggatagtaaatgtggctgggaggagttacaaggaagtatgcttttggagtcaacaacatgggttcaccacaaacctccctataggacaaggtggatataatgttgcaggtaatacaaaatgtttcaatggtgtacgttggcccggggatctgaagcatgatccaaagggctggaaaatgcctactaaacaaaatccattgagaatcgcagtccgaaacagaacctcattttccaagtttgtcaactatgatcagaataaaaaaatatatagtggattctgcattgatatttttcagagtgtgctcccccttttggggtatgacttgccatatcaatattatcccattgatggaacctataatgatttggttcagcttgtttataacaagacttatgatgctgtcgttggggacatgaccatactagaggaaagaatgcagtacgtggattttacagtgccatatgcagaatcaggattgtcaatgatagttccatcaaagtcagaagagtcagcatggatgttcacaaagccctttacctgggaactgtggatggttacaggtgccattttgatttacacaatgttagcagtttggtaccttgagagagaatccaatcctgagtttcatggcaattggaagagccagatcagtacagctctttggtttaccttctcgtctctgttcttcgctcatagggaaaaaatgagttgcaacttaactcgtatggtgatggtctcatggctcttgctagttctgatccttacttcatgctacactgctagtctttcttcaatgctcacagttaaacaactgcaaccaaatgtcacagacattcagtggttgaagaggaacaacatgaaaattggttgtgatggtgactcatttgttcggtcgttcctggagaaagtagaaaattttaagcctgagaacatcataaatgttactgatgaatacaactacgatggtgcgtttaaaaataacagtatagcagctgcctttcttgaactcccatatgaaaaggtgttcataagtgaatgctgcaacagatacattggtttcactcccagaaccagatttggaggactgggctttttattcttttcttcttcccaatctattaataacaaaattggattcttctaa

SEQ ID NO: 114752 - DNA, 249 bp, Glycine max
  Peptide Sequence Number=SeqID_231530
atggctgagaagattcaggaattgcgacagagttattctaatccctttcctttttcttggcgttttaccttcttatttgttgaccacaatggtgacactgcgatggtgggggccacagacacaatgcgacggttcaaggagcaacatcgtccttatgaaggaggtagtgtacgaatggtggatgggaaaaatagaaaggtagaagaggaagttaaaacaaaagagcgtcctgtcgaaaatcacctttga

SEQ ID NO: 114753 - DNA, 2781 bp, Glycine max
  Peptide Sequence Number=SeqID_231531
atgaattttcatgcccaaacttacaaagcaggtaaatatcttttgctttggccttctctaaaaatcttgcttctcctattcaagtgccttattggagctcaggttgcctacagtttccaaaatacaagtgttggcgtggtaattgatgccaattcagaggttggaaaacaacagaagagagccatgcatattgcagctcaaactttcaataataactcaaagaatcacaacaacataatccttttcttccacgactctggtggaatccctttacaagcagcttcagctgctgaagaactaatcatgaagaagaaagttaaagtgattgttggcatggggacatggcaagaagcagctctagctgctgaccttggaaacaaagctcaaattccaattatttcattttcttctccttcaatagtccctcctttaatgcaacatcgttggccttttttgattcaaatggctaaagatcaggctgcacacatgaactgcatagcagatattatccacgcgtacaactggcagaaggttatagctatatatgaagacaacccttatagtggtgattctggattgttaagcctcttttccgaggctctccaaaagggtaacgcgcagattgagaaccgattggttcttccacatttcacttctttatctgatccaaaaggggttgttcttgatgaattgcttaagctgttgccactaaaatctcgtgtttttgttgtacttcaagcatcattccctatggtaactcacttgttcagagaagccaagaagattggattcttggggaaagattcggcttggataatcaacgaggggatcacaagtatgttggactttgcaaataaatctgttttatcctctatggaaggtactttaggaatcaaaacctactattctacaaattctactgcttatactcatttgcaggaaaatttccaatctgagcatgctgaaacagcaggcactaaaccaggatcagatgcattacgagcttatgatagtgttataatcattacagaggccttagagaaaatgaatagaaaatctagtaactcaaagccaagggtgttcttggagaaaattttatctagcaattttaatggtttaagtggtaatataagattccaaggaagtcatctatccaacactgcagtattgagagtcatcaatgtggttaatagggaatacaaggaattggacttttggaccccaaaattcaagtttgctggatctcttgaaatactgaaagacagagagacaaggggtgattatgctacaaataacttagctggcccagtggtttggccaggaggcctaatttctgctgatcctattggatggaaaatgcctacggatacagaacgtttaaaagtggcaattcccacaaaccctgcttttgttaattttttgaaggaagactcccaaaagcaatatagtggtttctgtattgatcttttccacgaggcacggaaaattctgagtgacaagtattctgggatgccttatgagtttcacccctttaatgaatcctatgataaacttctacagaatgtcataaacaagtcccatgatgttattgtaggagatgtaacaatacttgctgaacgatcaaaggatgtgtggttcactcagccatacactgagtcaggcttatcacttattcttccaatagagactgaagggtcagcatggttgtttatgaaaccttttagctcggaaatgtggatcgcaactattggaatcctcatctacacaatgtttatcgtatggttcctggagcatcacttgaatccagattttggtggaccattgaaaaatcagatcagcacaacactgtggtttgctttttcttctctattttttgctcataaggagaaaataaacagcaactctgcacgagtagtagttggtgtatggctatttcttgtgtttgttctaacctcaagctacactgccaatctttcgtcattacttactgtcaaacgattgaaatctggaagagatgttgagtggctaaagcaaaacaacttatcagttggttgtgataacagcagttcgtttgtaaagaactacatgataaatgtgtataatttcacaccacagcaaataatagaggtggatggtgaacatgacattgtggataaattcaaaagcaaaaatatttctgccctctttcttgagagcccgtatgagaaggttttcttgaataagtactgcaaggattacactgcaattacagctacctataaatttggaggactgggctttgtatttcaaaaaggatctcccatggcaaaagacttttctgaagcctttttaacactagcggaaaatggagcactaaaaactttggaagagaaatggttgaccccttccaaggaatgctcaaacggctcaacatctccagaaactgagagcctgaccctccacaacttttggggtctctatatcatatgtgctgccatatccaccatatgctttgtgatggccttattgaaaaatcacttaaataagcataaccatattgaagaggaagatcaacatcaagacagtgcaacagctgatgatgatagtgtttggaagaaagcactcagaattggtacaggcttttacaataatgtgaataacaaaactttaggtagagctgcaacttttggtggaatgcagcttacacgtcgccggaattcctcaagatggcagagcataagcacttctgatgatgtggctaatccacagagttctcaatcagcagtcaaagatatgctgtaa

SEQ ID NO: 114754 - DNA, 2745 bp, Glycine max
  Peptide Sequence Number=SeqID_231532
atgaattttcatgcccaaacttccaaagcactgtcaaatcttttgctttggccttctctaacaaccttgcttctccttattattggagctcaggttgcctacagtttccaaaatataagtgttggtgtggtcattgatgtcaattcagtggctggaaaacaacagagaagagccatgcaaattgcatctcaaagtttcaataattattcaaagaatcataacataaaccttttctttagtaactctgggggaatcccattacaagcagcttcagctgctgaagaactaatcatgaagaagaaagttaaagtgattgttggcatggggacatggcaagaagcagctctagttgctgaccttggaaacaaagctcaaattccaattatttcattttcttctccttcaatagtccctcctttaatgcaacatcgttggccttttttgattcaaatggctaaagatcaggctgcacacatgaactgcatagcagatattatccacgcgtacaactggcagaaggttatagctatatatgaagacaacccttatagtggtgattctggattgttaagcctcttttccgaggctctccaaaagggtaacgcgcagattgagaaccgattggttcttccacatttcacttctttatctgatccaaaaggggttgttcttgatgaattgtttaagctgttgccactaaaatctcgtgtttttgttgtacttcaagcatcattccctatggtaactcacttgttcagagaagccaagaagattggattcttggggaaagattcggcttggataatcaacgaggggatcacaagtatgttggactttgcaaataaatctgttttatcctctatggaaggtactttaggaatcaaaacctactattctacaaattctactgcttatactcatttgcaggaaaatttccaatctgagcatgctgaaacagcaggcactaaaccaggatcagatgcattacgagcttatgatagtgttataatcattacagaggccttagagaaaatgaatagaaaatctagtaactcaaagccaagggtgttcttggagaaaattttgtctagcaattttaatggtttaagtggtaatataagattccaaggaaatcatctatccaacactgcagtattgagagtcatcaatgtggttaatagggactacaaggaattggacttttggaccccaaaattcaagtttgctggatctcttgggggtgattatgctacaaataacttagccggcccagtggtttggccaggaggcctaatttctgctgatcctattggatggaaaatgcctacggatacagaacctttaaaagtggcaattcccacaaaccctgcttttgttaattttttgaaggaagactcccaaaagcaatatagtggtttctgtattgatcttttccacgaggcacggaaaattctgagtgacaagtattctgggatgccttatgtgtttcacccctttaatgaatcctatgataaacttctactgaatgtcataaacaagtcccatgatgttattgtaggagatgtaacaatacttgctgaacgatcaaaggatgtgtggttcactcagccatacactgagtcaggcttatcacttattcttccaatagagactgaagggtcagcatggttgtttatgaaaccttttagctgggaaatgtggatcgcaactattggaatcctcatctacacaatgtttatcatatggttcctggagcatcacttgaatccagattttggtggaccattgaaaaatcagttcagcaccacgctgtggtttgctttttcttctctattttttgctcacaaggagaaaataaacagcaactctgcacgagtagtggttggagtatggctatttcttgtgtttgttctaacctcaagctacactgccaacctttcctcaatgcttactgtcaaacgattgaattcaggaagagatattgattggctaaagcaaaacaacttatcagttggttgtgatatcagctcctttgtaaagaattacatcataaacgtgtatgatttccatccgcagcaaataatagaggtcaacggagaagatgacattttgaataaattcaaaagcaaaaatatttctgccctctttcttgagagcccctatgagaaggttttcatgaataagtactgcaaggattacactgcagttacagctgccaataaatttggaggacttggctttgtatttcaaaagggatctcccatggcaagagacttttcaggagccattttaacactagcagaaatgggaaagctaaaaactttggaagagatatggttgacccctccaaatgaatgctcaaatggctcaacatctccagaaactgagagcctgaccctccacaacttttggggtctctatatcataagtgctgccatatccaccatctgcttcgtgagggccttattgacgaaatggttacatgacgaccacaaccattatcatcatgaagagaaagctcaacttcaaggcaatataactgctaatgatgataatagtgtttggaagaaggcaattataatcagtacaggcttttacaatactatgaataacaaaactttaggcagagctgcaacttttagtggaacacatcgtcagaattcctcaaggtgggagagtataagcacctctgatgatgtggctaatctacagcgttctatgtcagctgtcaaagatatgctgtag

SEQ ID NO: 114755 - DNA, 153 bp, Glycine max
  Peptide Sequence Number=SeqID_231533
atggaagaagatgagttgtacaggttcgttgagcgcaccgcttcatctcatcaagcgcaccgcttcagcccatccgctgagcgagaaaagagcgctatgcgaaaattcactaatagactagagcttgaagcaggagccgttctaagagcttga

SEQ ID NO: 114756 - DNA, 405 bp, Glycine max
  Peptide Sequence Number=SeqID_231534
atggggggatttcatcagcagactctccttccccgtggagaaaacaccgagactttttcaagtctcacaagttatccagaactacgtaggtctgagttcctcattggaggatacgtaggagcaaaagcctcgcttttgtcgaccgcgccgctttctgttaccatgacccaagagctggtagcccgcggagacaccttacggttatccgcacctcgtcattcagtgaccccaagtgtgattgatgagcagaggccaatgtggtcatctgcgccttttccggagatgtcagcattttccgatggagacttttcaagtctcacaagttatccagaactacgtaggtctgagttcctcattggaggatacgtaggaacaagagccttgcttttgtcggccgccccataa

SEQ ID NO: 114757 - DNA, 582 bp, Glycine max
  Peptide Sequence Number=SeqID_231535
atgacagaattttcaaataatctaatgcagatgttccagaaaggctcgccactggccagagacgtgtcaaaagctatattacatctctcagaaaaaaaagcagagctgaagagattggaagagaagtggttgattacctcaccggcatcatgctccaacgtgacctccgatgatacggacagtttgaagctgagaagtttatggattctatatgtcatctcaggtgccacttccaccatttgtgtgctactatcagccatccagtctctagtaaaatcctgtcaccaatgtcaagcagtggcaccagaaggcaatgacacaccaagtgatcataaagtgtgggaaaaggtgattacacatgcaaaacagatttttaacaaaaagatcaataattcaagtgaggcacaggaacaggttgtgactgattgttctttgagatgggatcgcgtgaacatgactgtttcccctgagcatcagcaggaaatggcttctccgctacccggaattttaatgctaccttctccacccccagaggttcagatgacaactcatgatttaggaatcaccaacacttcaaagtag

SEQ ID NO: 114758 - DNA, 639 bp, Glycine max
  Peptide Sequence Number=SeqID_231536
atgagaaaatctaattcaacacaacgattcaacgataaagatgaattaaagatgcaattgcaattggtgccgccgtgtagggttccacgtgtgggagacatacatagaattgagacctcgacctcgacctccactgttactgtgagaagaagaagaagaagaaacgcagtgactactgcaatgagagcggtggttcagcgcgtggcctctgcctccgtcgaggtcgaaggccgcatcgtctccgagatcggccccggccttctcgtcctcgtcggatccacgactctgattccgacgccgacgccgattacattgagtcagtttacgttgtatggattcctgaagggtaacaaaccggattttcacgttgcgatggcacctcagagagccaagccattctatgcctctttagttgacagggataaaaaaggaacagcattgggagaggggtgttcgcaaacgttgacaagtgtaccgattcgtacaagtagtataaaacagctcttagacctttcagctcctgaaggctcgcttagcgagactgactccctaagcgagagatttttcaacccactaagcaaatgtctcgctaagcagctgagtggatccgtctcgctgagcgagtcatcagctacttga

SEQ ID NO: 114759 - DNA, 1446 bp, Glycine max
  Peptide Sequence Number=SeqID_231537
atgtcgaagctgctgcttctacccactcctcccctcaccacctccattcaccgcttcaacacttcatcttcggcttctgcccttcaattccaatgccgattctccctttctcttctctctcgtctccaccactctcccacttccttccgctccctcgtgcgtagaacaagagaccttccccttcgcgctttcgattcctcctccgatgccaatagcgaagaaaaagaagaagtaaaggaaaatgaagagggcgttgacaaccggagtggaagtaggattgccgacgaggattatccgagcggccagtttgacttcgaaccggttaccggatggagaagcttcctcgtcaagctcaagatgctagtcgcgttcccttgggagcgtgtccaaaagggcagcgtcctcacaatgaagcttcgtggccagaaaaaggttatgcactcacagtgtaacacagtcttcgcatttgtagaaagttttcaaacgacaatttgtgattggatgatgatatctgatcaagtgaagagtaggttctctccaggactttctctgcctcaaatttgtgagaattttttgaaagcagcgtatgatcctcgtatttctgggatctatcttcatattgatagtttaaattgcgggtggggtaaagtagaagaaattcgaaggcatatattggatttcaaaaaatcaggaaaatttgttttggcttatgttcctttatgccaagagaaagagtattatcttgcatctgcatgtgaagagatatatgccccacccagtgcttacttttctttgtttggattgactgttcaagcctcattcctcaaagcatgccctacatgtgtgcgtgtgtgtatatgtatagccatgggtgtgtatattctagaaagggacttactaggcgttttagataacataggaattgaaccacaagtggaaaggattggaaaatacaaaagtgcaggagatcaactagctcgaagaaccatgtctgaagaaaattgtgagatgctgaccacgttacttgataatatctatacaaattggctggataaagtctcttctgccaaaggaaaaacaagagaagatattgagaacttcataaatgaaggtgtttatcaagtagacaagctgaaagaagagggactcatatcaaatataaactatgatgatgaggatgtgaatacatctcaagcaaagacgattactgccatgttgaaggagagacttggagtgaaatcagataaagatctgcgtatggtggattacaggcacccagttccttctgctccttctcccctccaccataatcacatccagaaagttaggcgagatgagggatggagagagagaaagagagagagagagaggtctcgtgagagagggagacagaatgtgagtgagagagagagttctcgagagagagggagatacagagtgaggtag

SEQ ID NO: 114760 - DNA, 474 bp, Glycine max
  Peptide Sequence Number=SeqID_231538
atggccaaagttgaagcttcaaaccaaaagctttcaggcttttatgtgtttggagactccacggtagacccaggaaacaataactacataaaaacaccttttaggagcaattttccaccgtacggaagggacttttccaaccaagttcctacagggagatttaccaatgggaggcttgccactgattacattgcttcatacgtaggtctcaagaaagatgttcttccaccttatttggacccaaacctcagaattgaggagctgatgacaggagtcagttttgcctccgctggttctggctttgacccacttacaccaagcatgacaacttgtagtgctggtccaaaaacagtctctttcaccattagttttctcctactttatgcatctagtcatatttactgggacatatatttgggcacccattatcttattgtacacctagtgatcatcaagaaagagaaaaacttatag

SEQ ID NO: 114761 - DNA, 849 bp, Glycine max
  Peptide Sequence Number=SeqID_231539
atggagatagagttatttttaatttttttgggggttccctatatgtcctgggtcatcctcctgttacgagacttcagtcagagtggaagctatgcatggggagttgtcgccctagtgcatacgtatgatcatttgaatgatgcttgtaaaagcagcggtcgacagcttgctggttacatcactttattacagtgttggatatatgagcattttcccactgttcatgagagcgtgattgatccagagtatgatgagatgtcaccacgtgcctgctggtggcttactacgaaggcttattcgaagggattcccagcttcgacgtaccagacacgtatagatgcactgatgatccttgatgtatgttggatgccttatggtgagcatcgaggagttagggcgtttgacctcatttcatgctttcagggtgagcttagatgggaccctgttgtggtcacacatcgaccagagaggatggtggatgcattactcggaccatctagcagcagggggacaaatttgtcttatgcttggctagcagttgatccgcccagacatccacctatcccacaccatgacacatatgtggagccagatatccctgtggtccctgcgacaccagaagctggaccttcacatgcaccttctgatgtggagcaacctagacatgcagtggatgcgtgccaagtgattgcagaaaggttggagcgtttactcaacctaaggatagtcactgtaggcacagagatacatgaggttatggaagactgcatcaggatcgctaggggtgtcacaacagatggaagtgtttatgttagggcgcaacgaagacggtgcacggatcagtcgtag

SEQ ID NO: 114762 - DNA, 240 bp, Glycine max
  Peptide Sequence Number=SeqID_231540
atgaaattcaaacacaagcgttatgcaacaattatactaagacttaagcctacatgcaatgtggtaccatttttcagtgaaaaacctcgtcgggcgcctaggaggagaccagtcagggtcacgctgttttgcgagaatgctccaaccatgtgggatcggcacaggcttacaggagcactcaaaccggatgacccccaaggcctacactctgaacagtctgtcagtgcctctccctcctga

SEQ ID NO: 114763 - DNA, 118 bp, Glycine max
  Peptide Sequence Number=SeqID_231541
atggtatatggtgtccgtccaatcgttgatgagtatgacaagttaatagagtatgtttgcttggagggtttggattgggaaatggcagaaaagctacatgaggaaatgaaagggagtg

SEQ ID NO: 114764 - DNA, 261 bp, Glycine max
  Peptide Sequence Number=SeqID_231542
atggaagcagaaacgcaaacaacacaacaaaagggagaagaggtttacctcgacagtcgacaagaagaaccttcaaagcaccacgaacacaacaacaataatgctgaagaagaacaaaagaaaaagataaatcgggcgtgggctgaacaagaagaaggggcactcgcaatcgcggaagaagaagaggctgggtgcacaaatttttttaaaaaaagacaagggtattttagacttttatcattaagtgctgggtgcacctag

SEQ ID NO: 114765 - DNA, 129 bp, Glycine max
  Peptide Sequence Number=SeqID_231543
atgcggcactgggctcttgattcgatgaaccaaacggcgcagcattattgttgttgtgttcgtggtgctttgaaggttcttctcttccgacaggacatgcattgtgctactctactgtcgactgtcgag

SEQ ID NO: 114766 - DNA, 798 bp, Glycine max
  Peptide Sequence Number=SeqID_231544
atggatattcatagtaatcatggtgcaacttctgaagggattcttgagaatgtgtgggccaaaattatgagcagtgatggagcagatggaagaaaaggtgatgcagcagaatcttcaaactcttgggaagaacttcctaaccttgatggaagagaagggtccatggaaattctacaaaggcttccaagtttagggaggtggatatcaatgggagctgatttctgggaagaagttttagatggtattattctacctaacacaagcaatagagaagattctagccataacaacttggaaattggaagtgctaatgaaactcgtaacaaggtggaagatgctctgagaatagagaaggcaattacaaaacactacaggggagttaggagaaggccatggggtaaatatgctgcggagattagagactcatccaagaaaggtgctagagtttggctaggaacatttgacactgctgaagaagcagctttggcttatgacaaggctgctttgaggattagaggtccaaaggcataccttaatttcccacttgagaggggtgcaaatgctttagcatgtgaccacaaaggaactaatcatcttgcttgcacatgcatagggaacaaagaaaaattaatcaactccaggaagagagcatcaatggaaagggaagcatttgatgatatggtgaatgaacaacctgcaacaaaaaagttggaatgcatggtagaaaatgaactaggtgcttttgtatttcaggacctaggaagtgattatttggacagtttactgtcttctttttga

SEQ ID NO: 114767 - DNA, 252 bp, Glycine max
  Peptide Sequence Number=SeqID_231545
atgtcaaacaacacggtgaatagtgatgatgcaatgcataggttgttgtctatgatgtgtgcaactgcatactaccacaacctacctcacgatgggacgacgaaagcatatatggataagccaaagcattcgtctcctagggagaaaatgagtggagtcacaaccaatgtttattcgaggaaaacattagaaaaaccaaaaagagctttcaatctctttaaagacaactttacgacactagtgatcagttga

SEQ ID NO: 114768 - DNA, 486 bp, Glycine max
  Peptide Sequence Number=SeqID_231546
atgtctctcactaacagagacttagatgttagggccaaagtggagaggctggaaggtcaactacaagtcaaagacaaggacatagcgactattactagaacagtggacgcttatgagtcaaaaaatcaagaactggtggcagagaatgatgatttaagagcattattgagatcaatgcaaagattcgcaattttagaaaacaaccaggcacaaactgattatgaccaagtggatcgactaatcaaccaaagtgagatcatccatagttcaagtgcaaatgcagttttcagaagtgacaagaaaaaatcgatactgttgaatccaacaatgatgctaccagacataatcaccgcaatacaatcatcaattagagatgatgatgttacacctataattactgcattttggtatcgttgtcatatataccaattcaatggccgtgttgagtatagggcaattcaaattattgacaaagaaggtgtttag

SEQ ID NO: 114769 - DNA, 788 bp, Glycine max
  misc_feature (697)..(697): n is a, c, g, or t
  Peptide Sequence Number=SeqID_231547
atgacttccccttcagagggctacacgccctcgcctttagagggttatacgccctcacctacagaggactacacgtcctcccctttagagggctacacgccctcgccttcagaggactacacgtcctcaccttcaaaggggtacacgccctcgcctttagagggctatgtgccatcacctccagaggactacacgtcctcgccttcagaggactacacgtcctcaccttcagagggctacacttcctcgccatcagaagactacatgtccttgccttcagcgggctacacgtcctcaccttcagagggttgcacgccctcgccttcagaggactacacgtacttgccttcagagggctgcacgccctcgtcatcagaggactacccgtcttcaccttcagagggctacaccccctcgtcactcagaggactaatcgtcctcgccttaagagggctatatgacctcacctttagagggctacacgcccttaccttcagaggactgcatgtcctcgcctacagagggctacatgtcctcaccttcataaggctgcacgtcctcgccatcagagggctgcacgtcctcaccattagaggacttcacgtcctccccttcagagggctacacgccctcgccttcagagggttgcacgccctcgccttcagagggatgcacggcctcaccttcagagggccgnacgccctttccttcagaggactacacgtcctcgccttcagagggctacatgacctcgccttcagagggctacacgcactcgcctttaaagg

SEQ ID NO: 114770 - DNA, 174 bp, Glycine max
  Peptide Sequence Number=SeqID_231548
gggatggaccaaagcagtgcgcttagtaggatgacccttcactcagcgcaaatgcacaactcatccttcttccagattcttcctcgcgctcagtcgaggagtgttgcgtctagcggatggcttgctaagctagaagattggcttagcgagcggatgaagatcaacatttcataa

SEQ ID NO: 114771 - DNA, 795 bp, Glycine max
  Peptide Sequence Number=SeqID_231549
atggtctttggtgacggggacggggaaatctttaaccgctttaccatcgccattgacgtggtggcgcacgagctgagccacggtgtcaccgagaccgaagccgggctaatctattttgaacagtcgggtgcgctgaacgagtcgctgtcagatgtgtatggttcgctggttaaacagtaccatctgaagcaaaccgccgataaagcagactggctgattggcgaaggtctgctggcaaaaggtattaacggcaaagggctgcgctcgatgtctgaaccgggtaccgcctacgacgatccgctgctcggcaaagacccgcagcccgctcacatgaaagatttcatcatgacgcgcgaggataacggcggcgtgcacctgaactccggcatccccaaccgggcgttttacctggccgcgacggcgatcggcggctatgcctggaaaaagcgggttccggaactgacggatgacgccgtggttgagctggcccgggaaggcggcgtcgcttttattcctaagctgagcggccagcgtaccatcgcgctttcgtccctcaacgaggcccagcgccagcgtctggtgagcatccttgagcaggcctttccgcgcggccagccgccgggacaggcctcgtcacccggcagcggtgaccagcgctatttccgcatccagattatctggaccgggcaaaatcaggcgcactacaccgatatcatcgtgctggtgccggagcaggaagcgcccgagtcgctggtcgagctgtggaagaaaggcgaaggctgcgtgtgtgattaa

SEQ ID NO: 114772 - DNA, 276 bp, Glycine max
  Peptide Sequence Number=SeqID_231550
atgaatgctctcctagaacctaagcttttgaatcctagaaaaaccatgatttattggcagcctaaccccattacaagcctagaaagttcttcagattcaatttttgtctctagaatatgtccattggatttaatgatgaaatatgtgcaatttcagttgagctcagctcatcagtgggctaagcgcgcatccaccgctaagtgcagtgatgagaatcctgaaactggccaaatacaggctaaatgcccaagtggagaaggacggaggcctaagtga

SEQ ID NO: 114773 - DNA, 803 bp, Glycine max
  Peptide Sequence Number=SeqID_231551
cagcgatctcggccgaaggcagcgcctcaccctgcaggctggccgcagccgccgccaccgcctgccgcgacaccgccgccaaccgggacggcgcggccacggtcgagcgcgccagccagccgcgcagcgatcgccaccaggccggcgtcatcgccgcccgccctgtcgttgtggtgcccttgccgtcactgaccgccctgcctcttcacgcgaatccggccacccgccgtcgtcgcagcatcggccgcactttcatcttctttaaccggaagttcgccgctgatcgcgccatcggagacgccatgctattcgaaaccctcgccaccaccggccacgaacaggtggtgttctgccacaaccacgacgccggcctgaaggcgatcatcgccatccacaacaccaccctcggcccggccttgggcggcgtgcgcatgcgcccctacgccagcaccgacgaggcgctggccgatgcgctacggctgagccggacgatgacctacaagaatgcactggccggcctcaacgtaggtggcggcaaggcggtgatcatcggcgaccccaaagtggacaagaccgaggtgctgttccgtgccttcggccgttatgtcgattccctgggcgggcgctacatcactgccgaggacgtcggcaccgacgtcaacgacatggagaacatctacctggaaagccagttcgtgaccggcgtgcaccaggtccatggtggctccggcgatcccgctccgttcaccgcctacgtgcgctgcagcactgatggcgtcgatgcgcttcaagttcggccatga

SEQ ID NO: 114774 - DNA, 422 bp, Glycine max
  Peptide Sequence Number=SeqID_231552
atggttatgggggatcccatcagcagactctccttccctgtggagaaaacaccgagactttttcaagtctcacaagttatccagaactacgtagaggcggcggacccgatgatacacggagataccttacggttatccgcacccttttgtcatccagaggcggcgggcccgatgacaagcagagaccaagtttggtcattctgcacccttgtatcatccagaggcggcgggcccgatgatacacggagataccttacggttatccgcacccttttgtcatccagaggcggcgggcccgatgacaagcagagaccaaatttggtcattctctctctttcgaatttgctgaggaatttcgcaaaggtttcgaccgttcttcgacgttcttcattcgttcttcatcgttcttcgatcttcaacgg

SEQ ID NO: 114775 - DNA, 495 bp, Glycine max
  Peptide Sequence Number=SeqID_231553
gcaaagtttgatatcgcagaagctacgaaggtgaagacgaaggttatgtcaacagtagcgacgagatggcggcaatttaagtccacattgactagcaaatttgtgtttgctaagagtgaaggtcaacaaacgcaggatgttgtgacaaaatatggactagatcctgaagcgtggaaacaatttgaagaaacccggctcacacctaactgggagggtattaggaaacgagcacaatcaattcataaacacaacgactgccctcacgtactttcacgtgggggatatgatttgcttgagaagaaattgttagacgagaaacgaaaaaggatacaagaggaagcattgttgagtgaaaattcagcaagtcttgatgaacccccatctccaataaaaagacatgttaagtggaaggttgctcggaccagggctgttggcaatatgacatctgagtccgcacaggaaattgcagataaaatagactccttagaagagcag

SEQ ID NO: 114776 - DNA, 618 bp, Glycine max
  Peptide Sequence Number=SeqID_231554
atgtcaatcagcctcacactacagtcatgggatttgagaacaatgacaagagaatttgggttgaaagaattatgcaggcaagcagaaaaaagggatgttagcacagctctgtctgttattcaatccaacactacagctgctacattcttggcctcagtctctttgactctgtgttcccttattggagcttggattgccaacagatccaacattttcttccagagtcaattaatctatggtgacaccagtccaaacactatttccatcaagtacatttgcctattaacctgcttcctcgttgctttctcatgctttgttcaatcagcaagacactttgttcatgcaaactatttgataagcaccccagatagttttatcccagtgagtagtgtggaaatagcagtcatacggggaggtgatttctggtcacttggtcttcgtgccctctattttgctctagatttgctgctttggttctttgggccaatacccatgtttatttgctcagtggttatggtgctggttctcctttatcttgactctaattcaaggcctttgcattctaatcagtctcagggaaaccaatttcagatggcgaagagaggaggctttaactag

SEQ ID NO: 114777 - DNA, 522 bp, Glycine max
  Peptide Sequence Number=SeqID_231555
gacccacctggagtctcttctgttcacacaagctctacattttgcactaccaacaaagacttatcaactgagaactgtgtaccgtgcaatacaaaggacttgcagcccatgaccgaggatgcagcacgcacaatgcttcaacagtggaatttggttaatgaggatggtgtgttgaaattgaggagatcatggaaagtaaagacttttaccaaaggattggaatttttcaggataatagctggtcttgctgaagctgaaggtcatcatcctgatcttcaccttgttggctggaataatgttactatagagatttggacgcattctgtggagactcagagcaattacatttgtgaattgcatcaaagagctaatatggctatttcaaatcccctgcctaccccaatggttcctggactgaagctatcagctttgggtgggctgacacagaatgacttcattctagctgctaagatcaatgagcttaatttgcatgacttgctaagacggaagacttctaactga

SEQ ID NO: 114778 - DNA, 192 bp, Glycine max
  Peptide Sequence Number=SeqID_231556
atgtgcctcttgggagacttggaaaacctattctacccagggatactgaaaataatctgtgggaaggaatgcattcgcaaaagggagatggaagacattgatattccaggtgtactttccaatgggagagagatcactgttaagaggctttccaagaactctgagcaagggctgcaggaggttcaaaactga

SEQ ID NO: 114779 - DNA, 3496 bp, Glycine max
  Peptide Sequence Number=SeqID_231557
ctctgcctttccttcccaaatgttagacacgcctcctatcagtccaaagaaatcgtccagctctcctaagcatgatgctggttctggcactgtcaccacagaccctaccttgaatccttccagtccttattttattcacccaagtgagggtccttcttctgtctccattacgccgattcttgacgggaccaactaccattcctggtccaaagcttttcgtatggctcttatttctaagaacaaaatggctttcctattaggtactctccctgttcctcttgttgctgacccacttcactctgcttgggagagatgcaacactctcattatgtcctggatcctcaaatctatttctccttccattgctcaaagtgtgatatttcttgagtgtgccgtcgacatttgggacgaccttcgtgaacgtttttcacaaggtgatcttcttcatattgcagagctccaggatgaaatttacggcatgtctcaaaacaatcgcaccgtctctgagttttatactgcgctgaaaaccatgtgggaggagcttgacaactatcttccctttccggtctgtacctacgacgctaagaaataccatcagcaggacttcatcattcgcttcttgaaagggcttgatgatcgtttttccgttgtctgctcgcagattcttctcatggatccccttccgaccatcaaccgtgtcttctcgatggtggttcagcaggaacgacaacttcgcgttccttcctctgcttcaccagagcctaactccttcgtgaatgctgctgtcaattcattccaaggcaagggtcgtggcggttatggctctacctcaaccattaaaggcgctgtctcctccaagaagtgtgcgtactgtcatcgcgccgggcatacagtcgatgtttgctggggaaagcatggctacccaccgggacatccacgctaccccggacgccctcgtttcaacaaccgtgactcctcttcttccgcaaacagcgttgccgtcgatgaagtggtggaaggcggttgctctgactttggcacctcctcttccaaccctatcaatttaacccaggcccaatatcaatctctcatggcactcattcaacctatgcaactgaaatcaacttctgatagcactgggcctcattctccacaccaggccaaccttctccatgccatcccaaatggcccaaaacgtgtctctgagtctaatggggccactgatcatataacttcatctttagactatttcacatcttattctaaaataaagcctattaaaatcaatcttcccaatggagactctgtcacagcttacttttctggaactgaaaggagtatgttacggatgattggtttggctaaattaaagcaaggtctctaccaattagatgtcaatcaagaagccaaggctatcctacctaccacttccttcaccaacaaaaatgttgtctgcaccatctcatcttctaatctttggcactataggctaggtcatctttctggaaatcgcttgaatattagcaatagagcttctaaagtgtttgacttggttcatatggatatttggggccctttttccaaagtctctattcatggtgaaaaatattttcttaccattgtggatgattatagtagatacacttgggttgtcttgttgaaatctaaatctgagatgggctacgccaaaaatttgacccaaggtccaaacaaggagtttttcttggttttcaaactagaacaaaagcagcctaatcttcctctccttctcgacaaacctccttctcaccatcacctattccagaattcacaaactccatttcttcacctctttccacctcacatccttctccaattcactcttcaacaccttaatcttcacctaacaaccaaattcctttcgttcctagacgctcatcccgtcctcaccaacctcccgttcgtcttgccgattacatctgcgtctgccttgtcttattcccatgtctcagagtctgatcgccattatctcatgaacttctcctccgagatcgagccccgtaactatcaggaggctatttctcagcagtgttggcatgatgctatgcgtgatgaaattgcagctttgaaactcaataatacatgggaaatagttgatactcctgctaatgtcaaacccattggatgcaaatgggtttacaaaattaaaaggaactctgatggcagcgttgagcgttacaaagcacgattagtcgccaaaggattttctcaagtagagggtattgatttcttcgagactttttcacccattgtgaagatgaccaccgtttgtgttatcttggcccttgcttccatttaccgttgggatcttcaacaactggatgtcagtaacgcttttcttcatggggacctttcagaagaagtgtatatgagtattccaccgggattacaaggtcatggatctcctcagtgttgtaaattgaagaagtccttgtacgacctcaaacaagctagccgcaaatggtacgaaaaattctctactttgcttatgtcctctggttatcaacaagctcactctgatcatagtttgtttgtaaagcattataatggtacaattacagctttattgatatacgtggatgacattgtcttgactggtaattcacttactgaaatggcccaaattaagagtattcttcgctctaattttcgaattaaggacttaggaccattaaagtattttctgggcttggagttcaacaccctggacagttctatgaggcttcgtcaaaatgactccagtgattttcttgatgatcccttgtcttatagacgtcttgttggaagattaatatatcttacaacaactcgccctgatattgtttatgcaacccaacaactaagccagttcatggctcatcctactaagtctcatcttggtgcagcaaggagagtccttcgatacctcaaaagctgtccaagcaaaggtctattcttcaaacgagattctcctacacatctcattggttttagcgatgctgattgggcaacatgtgttgacactagaagatccataacagccgaatacagggctcttgcaaccagcacttgtgagttacaatggctgtcctatctccttgatgacctcaagattactcgtaccaaatctgcagttctatactgcgacaatcaaagtgctctttatatagctgcaaatcccgtgttccatgagcgcacaaaatacctagaaattgattgtcacctcgtccgtgaaaagtctcaagcaggcgtgatgcgtttgctccctgttccttcttgttatcaacttgcagacatgtttaccaaagccttgccacctcgctcattcacctccaatgtatccaagctggagttggtagatctctacacaccaccagcttcggacattatgcgcaaacgactggtgatttctgtgaaggagggtctggctccaggattgggtgcccaacattgttccattagtgttctccattcatga

SEQ ID NO: 114780 - DNA, 3525 bp, Glycine max
  Peptide Sequence Number=SeqID_231558
atggaacctaagaatgaggagttccagtctggatctcaatcagtaattcaagaccatatggatggcatgcatactatcagaagaccatctgactataacatgtcagatgttaaacctgtacttaattattcaatacagacaggtgaggaatttgctcttgaattcatgcgagatagggtgaatctgaggaagcctgtattttcaaatgttagtgattccaattccaattatgcaactggttgtatggaactgaaaggcgtattaggaatcagtcatgcagcatctgaaagtgggtctgacatttctatgctttcaaaagccgagaaaggtccaacagagtttaacagacagagtacatcattacatggagagggaagcaattatgggtcaattcgatccataccaagaacttcattgaatcaggagaatagtcgattcgtatgtgagtatggctcttctgttggttctgacagctcatcaacaatgatgaagtgtctctgtagctttggtggcagaatattacctcgaccaagtgatggaaagctaaggtatgttggaggtcaaactcgtattcttcgtctaagaaaggacatatcttggcaggagcttttgcagaaagcattggtaatgtataatctggttcatgtactaaaatatcaacttcctggggaagatcttgatgctttggtatcagtatcctctgaagaggatttgcagaatatgatggaggaatgtaatcttctagacaatagagaacgctctcaaaaacttaggttgtttttgttctcattgagtgatttagaagatgctcagtttgttctcagtagcattggtggtgattctgagatccaatatgttcttgctgttaatgccatggactttggatcgataaacagctcaaccccactaggtgtcagtttttcagcagatgatctaaatgaattggaaaggcaaactgcggagagggagactagtagagttgctgcagaatctataggtgtcagcaatgctccattgactaataaatctgattcttcattgactattcattcttcacaaccagttctaccaaatgcctcaaatgcttatgaaatcaatcaactgtcttatggtgaccaaatgatgcaagtttgggaatatagtcgtcaatattttattcaccatggccttaattccagtcataaccctgttgttggagagacttctattcctatggctcctcatctgctgaacagccaacaaggggttctgaatgaagataatctatctagtggattacaaatacaaaattctcagttatctacagtgcaggtgaaacaaggaagtgaccctggtaaagttttatcctcagaaaccccatccccagccatctcacagcctattgatagttacttgaaaagtaattttcctgaagcaccggttgtagttagcatgcctgaggggcttccaccttcattgccttcaacaaaaaaggttcagcacaaggattatgaacaggtctcttctacttctagcagtgcatttgttccttcttatgttgattcccacaccaatgcaattgatttgagttgtcttcatcctcctccgcttcctgagagagtttactattcagaaagaactccgagggagcaagtggagttactgaatcgttcttccaagtcagatgacacacacaattctcaaattcatgtgtcagatttactttccgatgtcaacccagagaatccagtaacagaatctggtgacaacttgcatgatggtaaaatgttaaatcctactgaggaattgggtactgtggcaaagcccttgcttgcagatggccttaccattgacaatgggttttccaaaaatcaaatgagcaaaccattgcctgatacaaacagtctggttaagtcaaaactttctgagcacacagatcctgaattgaagtcagtgttgccaagcaatgaaggaactgaaaattatcgtaaagataaccacaccaagctcttggttgatgaaaccgaaaccaaaggtggtaaatcagatcttcctgctttgcatcatgtttcctctgggaagcgtcttgatgatctagcatccaatcttcctgagattgattggggtgaagcctcagggaaggaatccaatgatggttgtatggtacaagaactacctgtatctgtaactgggaacataaccaaagatatttatcaagatttccctccaacggttgtttctgaacaatctcaaggtgatattcttattgatattgatgatcgatttccccgggaaatactttctgatatgttttctaaagcaatacttggagaagatccctccagtctacatccacttcccggagatggagtaggcttaagcataaatatggaaaatcatgaacctaaaagatggtcatattttcataagttagcacaagaagggattgataatgtctctctaattgatcaggatcatgctggtttttcacctgtgataggaaaagcaggagataatagaacccatcatgttacactgctaacaaatgatggacatcctctacatcatgaagattcccatcttgatttcaatgaagaaaatcaagaggacttgcatagaaggattggaactgaaaccactgttctgaagtctaattataatcaatcccaacttaaggaaaatgagagtatgcagtttgatgctatgatggaaaatctaagaatgcaagagtcagagtttgaggatggcaaatttgatgcaaaaaatagcaatctacctccacttgattcttctttcggagatttaagtactgtgcaggtcattaagaatgaagatcttgaagagctgcgagaactaggttctggtacctttgggactgtgtatcatggaaaatggagaggaacagatgttgctattaaaagaataaagaagagctgcttcactggtcgatcatctgagcaagagagactgactgtagagttctggcgggaagctgacattctttccaatcttcatcatccaaatgtggttgcattttatggtgtggtacagcatggaccaggaggaacaatggccactgtggcagaatatatggtggatggttctcttaggcatgttttacttcgcaaggataggtatcttgatcgtcgcaagaggctgataattgcaatggatgcagcttttggaatggaatatttgcactcaaaaaacattgtgcatttcgacttgaaatgtgacaatttgcttgtaaacttgaaagatcctttacgaccaatatgcaaggttggtgattttggcttatcaaaaattaaacgaaataccttggttactggtggtgtgcgtgggactctaccttggatggcaccagaacttctgaatggcagcagcaacaaggtctctgaaaaggttgatgtgttctcctttggcatagtattatgggaaattctgactggtgaggagccatatgctaatatgcactatggtgcaattataggtaatatcttatgctcttcttttatctgtactgtagtggagcctgaactttag

SEQ ID NO: 114781 - DNA, 495 bp, Glycine max
  Peptide Sequence Number=SeqID_231559
atgtgggagggcatgcatgcatatgtgcatgtcatattgaccctcatcacctacatacatgatccaaatgcaaacaccctcctctctcccccacttggccctccatcaatgcaaggcagcaagctgcatgatattacaacacatcacccaaccaaaccccacattatatatactatcattctccttatatgtggttcccaaccactcctagaccataacataacatcttccaaaaatttacttcatcttcttatcttaaccaaacagggccccagaaagcaacttgagaggcgcgtgcagctcacgcgtcatgtcatccgtctcatttgcacgcgccccaatggtgaggaggctactttcgtcatttcggtggaggtgggccccgctcgagggttaccaaaaggaactagaccggtctttgtctccatcagaggctgtcggctaccgtcaagtgggttaagatcggacggtcacgattcgtcaaaactcaattaa

SEQ ID NO: 114782 - DNA, 1609 bp, Glycine max
  Peptide Sequence Number=SeqID_231560
atggatgaaagtgttaaccacgatttcgccatccgaaggtattgccctgcaagaatggagcaagagcaaggaggagataagtgccaagaccaagaggcactagttttttatgacactgaattatgttcttctgatgctaccagcagcactccttgtttggcttcatctgaggttgatgactttgttgatagcttcatcaacatggatcagtatgagtacgtgaatgaagatcaagggttccaagagaagcatcgaagttttgaccactttgtggtgaatgatgaggatgaggctgatgcatactccattgtgaatggtgtctttgaatatgttccaaccaccttggaggattcagaattggagatctatgaagatgtcacaacagccatgttggaggaagaggttgcaatgaatggctctttttgtgctatacctgagtttgttgtgccttgtacacaagaggccaatcttggtgtggaccaagggttagacttggttcacatgcttttggcctgtgctgaagctgtggggtgcagagacaaccagcaggcagagttgcttcttagcagaatttgggctttggcaagtccttcaggagactcgctgcagcgagtctcctactgttttgccaaaggattgaagtgtaggttatcactgcttcctcataatgtcattgcaaatgctacactttccagtatggatgtgcctttcattactagggagaataagctggaagcttttcagcttctgtaccaaaccacaccttacattgcctttggtttcatggctgcaaatgaagccatatgccaagcatcacaaggaaagagctcaatacacattgttgatttaggaatggagcatacccttcagtggtcttccctaataagggccctttcttcaaggcctgaagggcctccaacactccggatcaccggattaactggcaatgaagaaaactcaaaacttcaagctagtatgaatgtgcttgtggaagaagcaagctcattgggaatgcatcttgaattccacataatttctgagcatttaactccatgtcttcttactatggagaagctgaacttgagaaaagaagaagctttatgtgtcaatagtatcttgcagttgcacaaatatgtcaaagaaagtagaggctatctgaaggaaattcttctatcaataaagaagttaggtccaactgcacttacagtggtagagcaagacacaaaccataatggccctttcttccttgggagatttttggaatcactgcactattactcggccatatttgattctcttgaggcaagtatgacaagaaatagtcaacacaggatgaaaatagagagattacattttgcagaggaaattcagaacgttgtagcttatgagggtccagatagaatagaaagacatgaaagggtagatcaatggagaaggcaattaggccgagcaggatttcaggtaatgccactgaagtgcactagtcaagttagaatgatgctttctgtttatgactgtgacggatatacattgtcctatgagaaaggaaatcttttacttgggtggaaaggaaggccagtaatgatggcttctgcatggcaagttgcaa

SEQ ID NO: 114783 - DNA, 1158 bp, Glycine max
  Peptide Sequence Number=SeqID_231561
atggggttgatcgatctgaacaccacggaagatgatgaagctgctccattatctgcttcttctccagcttcatattcttcttcttcttctcactcggggataagcacttctgcttcaaccttggttgttcctcctactcctccttctgtgtgcttggaactgtggcacgcgtgtgcgggccctttgatctctctgccgaagaaaggaagtgttgttgtgtacttgccacagggacactttgagcatgttcaggattttccggtcactgcttatgatatcccaccccacgtgttctgtcgtgtccttgatgtcaagctccatgcagaggaagggagcgatgaagtgtattgccaagtgttgttggttcctgaaagtgagcaagtggagcaaagcttgcgggaaggggaaattgttgctgatggggaagaggaggatactgaagctatagtgaagtcaacaactccccatatgttctgcaagactctcacagcttcagacaccagcactcatggtggattctcggtgccccggcgagcagctgaagattgctttcctcccctggattacagtcaacagagaccttcacaagagcttgtggcaaaggatcttcatggcttggaatggaggtttcgacatatatataggggccaaccacggaggcatctgctcacaactgggtggagtgcatttgtgaacaaaaagaagcttgtttctggagatgctgtgttgtttcttaggggcgacgatggagaactgagattagggattcgcagggcagctcagttgaaaagtgctggttcgtttgcagttccctctggtcagcaattgaatcctgcaactctcaagggtgttgttaatgcattatctacaagatgtgcatttagtgtttgctacaatccaaggttcagctcttcagaattcatcatacctgttcacaaattcttaaagagccttgactgttcttattcagttggaatgaggttcaggatgcgttttgaaactgaagacgcggcagagcgaagatgcactggattaattgctggaattagtgatgttgatccagttagatggctcggatcaaaatggagatgcctactgctcattttggaaagatacagtccatactcatccggagatttgcagctcatgattttctag

SEQ ID NO: 114784 - DNA, 291 bp, Glycine max
  Peptide Sequence Number=SeqID_231562
atgagcaagagcttgagagttgagataccatcaaacactaacaataacaatcgattattatatttaactaaagtagctaatttctcctcacataaacaaaaccctacaaaggaaggctttgataggagtagatttgtaagatgcttaccgtggtgggcggaaatagctttgatggtcgcagcttggattgggcaaaatcagaaggcaaggcctatggtggccgaaatctatctccgtggcggcggagcagagagagtgagggagccaggtcgagcaaaggccccagagtga

SEQ ID NO: 114785 - DNA, 1071 bp, Glycine max
  Peptide Sequence Number=SeqID_231563
atgttattagctctgatgcttttttttttatcgcttttggggaggactagtggatttcaggtagcatcaacacatcgaccatgtaccaaaggactatggttgtggagtgcaccgttgaagaggactgcccttgatggaacagagtacaatctcctgctattagacagtgaaggaatagatgcttatgatcaaacgggaacatacagcacccagatcttctccttagctgtccttttgtctagcatgttcatttataaccagatgggtggtattgatgaggctgcccttgatcgactttctcttgtcactcagatgacaaagcacattcgtgttagagcatctggaggaaggagttctacatctgaactgggacagttttcccctatttttgtttggcttctaagagacttctatttggacctcgtagaagataacagaaaaataacaccccgtgactatctggaaattgctttgaggcctttccaagggagtggaaaagatataactgctaaaaacgagattcgagattccattcgggctttattcccagatagagaatgcttcactcttgtgcgacctctgaacgatgaaaatgatctacagcgacttgatcagatatcgttggaaaaattacggcctgaatttcgatctagcctggatactctgacgaagtttgtttttgagagagcaaggccaaaacaagttggggcaactatgatgacaggtcctgtgttgattggaatcactgaatcttatctggatgctctcaatcatggtgctgtgcctacaatttcttcctcctggcagagtgttgaagaagctgagtgtcgtaaagcttatgattctgctgccgagatttatatgtcctcttttgactgtactaagcctcctgaggaggctgctttgagggaagcacatgaaaaggcagttcgaatttcaatggcagcctttactgctagtgctgtaggggttggttcagtaagaacaaaatatgaaggcatgctgcagaaattcctcaaaaaggcatttgagtgccatctccttgaagctcaaccttgtcctaaaagttga

SEQ ID NO: 114786 - DNA, 873 bp, Glycine max
  Peptide Sequence Number=SeqID_231564
atggatcagttgccagtgctttgcaagagccaagaactgagaccaaagtttgggcgaatcctcaacaaagcagcacaaataggtctcaagggtccggttggtaaccttggtttatctgtcagactctgggtggtgggcacttctataggacaaggtagtcccatggattcaaaacagttctcgccaaaaatggctaacaaagagcttatcccgatcactgctaatcgaatggggcatgtcgtgcaacatgtcgaagggcatgacaaggaactcaaaatggctatcagcagttcgaaaagctattttgaaagcatcttttggtgcaattgggatatgaaacctatccttgatagttatggcattgggagctctataattaacacaaaaatgccaagtgtcatctttcttgcgaaccaaaagaacagggaaggagaaagggctgacgctaggtcgaatgatgccctctttcaacatctcttgaatcatgtgtgtcatgatcttctattgacagtgagggtaacaataaggcttgacattcactggggtggagtcgggcatagggtccaagttagcggtatcaaggttggtagaagggttaatggaagggaactcggcaaccggaggttgcataatattatgagtgcttccagaatctatgagtatggtaacaaccaactcacgatcagactggagtcagtagaaactacaactaatggccctggattagtaggatccgtagtagaggtgttggcttcttcctcatcaattgggttttcttcggatagtaatagacaacagggttggatggggatggcagtttgggtagtgtttggattagaggtgggaggtgcaggtccaaggaatttaggttga

SEQ ID NO: 114787 - DNA, 1055 bp, Glycine max
  Peptide Sequence Number=SeqID_231565
gaaacttcattaatttcattacttgctttggaagtgtagatccacggaggtttcagctcactcgtcagacaccatttggaaagcggcatcttaactattggagtaacaattctgtaatgtattggcctgtctgtcttgttagacaattttatagatctgtccccaaggttgattacttcactcttagacatggattcatcatggcccatttttcagaagaaagtaactttgatttccaaaaatatatagaacgggctctggagaatgattttggagttgtcgtgggattaagctggtggatttggatcttctctgtactttacatattcttcaatgcaaatgcattctacagccatttctggctgccttttattccgctaatggtgcttttattggtgggaacaaagctacaaagcataataacagatatgtgtttggatagtcatgacaaatcccatatgatcaaaggaactttgcttgtgaggcccagtgaccactttttctggtttggatggcccaagctgctgcttcatctcattagcttcatattgtttcagaattcctttcaactagcatttttcacatggacttcgatccgattcggcatcagatcatgctttcatgaagaaattgagaatatcatcataagggtagctatggttgtttcagtacaaattctttgtggctatgtaacactaccactttatgctttggtaactcagatgggtacctcgatgagaaaagttgtgtttacagagaatgtgattagaggaatccaaatttggcaggataaggccaagaagaatatggctcttaggaatccatattcacaaggcacaagcttagacacttcgctttcacttgaaacttcactagaggcttcgccttctttcaggcttggtgcatcgctctccaattttatggatcgtccattagatgttaataagcacatgaatgttaatattacacaaggagaaatagtgagtgaacaacaagaatccgagaatcaggcatcaaatctaagttcatttcaaggatttaacctgcaactttga

SEQ ID NO: 114788 - DNA, 201 bp, Glycine max
  Peptide Sequence Number=SeqID_231566
atggtcagagatgttgacaaggccagcagatccagggacggtgtcggtggcgaccagcaaagaggcgggagaggattttttcatggtgtggttggcgacgacagatggaaggtcgtcggtgtggtggtggtgggtatcgccggcgaagtcagaatgagcagcaggccctatgagcaacaaaagagagtagggaatttgtag

SEQ ID NO: 114789 - DNA, 787 bp, Glycine max
  Peptide Sequence Number=SeqID_231567
atgtttaggaaccccaacagagcaatcgaaggaggagctctagagagcaccagaaacatcacaattgataatggagaaggcttgagcgactacatcaagcatttggcatctcagcaaccgaatactgatgaattctttgtgtctgagttcttgaagaagatgggtttagcatcttcccaatgctacaacttctctgcttctgtctgttcatggcaaggggtttcttgtgatgccaatggagaacatattgttgacttagtcttttctggtatggacctttctggcactatgcctgacaacaccattggcaagctaagcaaacttcaatctttggatcttagccacaacaaaatcactggcttgccttcagatttctggagtttaagctctctcaagagccttaacctgtcctccaatcagatttctggctcattgactaacaacattggcaactttggtttgctagaaagcattgacttgtccagcaacaatttctcagaggaaattcctgaagctgttagctcactgctgagtctgagggtcctcaaacttgaccacaacaggtttgcacacagcataccttctgggattctcaagtgccagtctctagtttcaattgatgtttcttcaaatcagctgaatggaacacttccagaaggttttggcgctgcttttcctaaacttagggtcttgaacctttctgggaataatatgtatggtcatgtttcagatatttctgggttacagtccattgtgaatctcaacatatcagggaattcgtttcagg

SEQ ID NO: 114790 - DNA, 455 bp, Glycine max
  Peptide Sequence Number=SeqID_231568
atgggggagacacatgaaattccccaccacaatctagctgacttcgagccttggctcggatatgccactgaagggcaagcagttggtggtataccctttgaaaacactttggagggccctcagtatcacccacaactacacctcttgcattccacgacaagtaaaaaccctaatgctatggcagaaatgggaaagttggatcatctagaggaaaggctcagggccattgaaggaggtgaagattatgcctttgctaacctaaaagagttgttcctagaacccaatatcatcacccctcccaagttcaaggtgctggaccttgacaagtacaaggggactacttgtcccaagaaccatctaaagatgtattgtcagaagatgggggaatacgcaaaagatgaggaattgctaatacattccttccaagaaagtcttactggggtagctgttacctg

SEQ ID NO: 114791 - DNA, 1289 bp, Glycine max
  Peptide Sequence Number=SeqID_231569
gatcttcaaggactacatgtcctcaccttcagaggactatacgtcctcggcttcagaagactacatgtcctcacctttagaggactacgtgtcctcaccttccaaggactacacatcctcgccttcagaggactacacatcctcggcttcagaggacaacacatcctaaccttcaaaggactacacgtcctcgccttcagagggctacacaccctcgccttcagaggggtacacgcccttgccatcagaggactacacgccctcaacttcagaggactgcacgtcctcaccttcagaggactgcacgtcctcaccatcagaaggctgcacgccctcaccttcagaggactacacgtcctcgccatcggagggctgcatgccctcaccttaagaggactacatgtcctcaccatcagagggctgcacgccctcgccatcagaggacttcacgtcctcgccatcagagcactacacgtcctcgccttcagacggctacacgccctcgccttcagaggtctgcacgtcctcgccttcagaggactacacatcctcggcttcagaggtctacacgtcctcgccttcaaaggactacccgtcctcctcttcagaggactacgtgtcctcggcttcagaggactacacgtcctcggcttcagaggactacacgccctcggcttcagaggactacacgtcctccccttcagaggactacatgtcctcgccttcagagggcaacacgccctagccttcagaggactacacgttctcacctttagagagttgcacgtcctcaccttcatagggttgttcgccctagcctttagagggctacacgccctcgctttcagaagactacacatccttaccttcataaaactgcacatcctcgccttcagaggactacacgtcctcacctttaggggactatacatcctcatcttcagagagctacacgcccttacctttgtagggctacatgccctcacctttagaggactacacgtccttggcttcaaagggctgcaaggcctcgccttcattggactacaggccctcaccttcagaggactacacgtcctcgccttcagaagactacacgtcctcgccttcagagggctgcacgccctcgccttcagagggctgcatgtcttcccttcagagggctacacaccctcgcctttagaggactacacgtcctcccattcagagggctacacgccctcgcctttagaggactatacattctccacttcagaggactacacgtccttgccatcagaggactacac

SEQ ID NO: 114792 - DNA, 816 bp, Glycine max
  Peptide Sequence Number=SeqID_231570
ttgcatgccctcagcttcagaggattacacgtccacgccattagaggactacgcgtcctcaccttcagaggactacacgtcctcgccttcagagggcctcacgccctcgccttcagaggattacacgtcctcaccttcagaggactgcacgtcctcgccaacaaagggctacatgccctcaccttaagaggacttcacgtcctctccttcagaggactacacatcgccgccttcataggactatacgtcctagccatcagaggactacacctcctcgccttcatagggctacacgccctcaccatcagagggctacacaccctcaccttcagagggctacacgtcctcgccttcagagggctacacaccctcgaattcaaaggactacacgtcctcgccttgagaggggtacacgtcctccccttccaaggactacacatcctcgccttcagaggattacacatcctcaccattagagggctacacgtcctcgccatcagaggactacatgtcctcccctttagagtattgcacgtcctcctctttagagggctacacgccctcgccttcagaggactacacgtcctcccttttagaggactacacgtcctctccttcagaggactacacgtcctcgccttcagagggctacatgcccacaaagggttacacatcctcgccttcaaaggattacacctcctcgccatcagaggactacatgtgctcacctttagagggctacatgtcctaaccttcagagggctacatgccctcaacttcagaggactacacgtcctcaccttcagaggagtgcat

SEQ ID NO: 114793 - DNA, 477 bp, Glycine max
  Peptide Sequence Number=SeqID_231571
atgggcttgttcgtagttgttgggcaaaatattgtgcttgcaggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggctgttggcacattcgtcgcatggccgacacatcttgttagggaagtaactaatgaggtggtcgtaggacccgataagcctccatcaaagtctgttggagagccgaacaggttaacatctgtggccacagatgacccattgggagaattggttaagaagtcatatgtggtttacacaaagccaatggagttggcatgggacggggcgaaatttgggttatctaatgcctcaaatggttttttcatcacacatgcagatgtgactgaaataattttaggtgacaaatgttaa

SEQ ID NO: 114794 - DNA, 522 bp, Glycine max
  Peptide Sequence Number=SeqID_231572
gcttttcgtcttacagacagcaaaaaagaatgtttatacggaaaaccactcgggtatctccgcatgtcagcgtgactcaaatgtcagtatgacagatcttgtgagcgcggaaaatgacataaatctccgcgtgtcaacgggcttgtcggccgcgattgacgaagtgcgcagaagacgatgtcagtcttcgcatgctatcaggcttttcgtcttacagacagcaaaaaagaatgtttatacggataaccactcgggtatctccgcccgtcagcgtgactcaaatgtgagtatgacagatcttgtgagcgcggaagatgacacagcaaaaaagaatgtttatacggataaccactcgcgtatttccgcccgtcaacatgactcaaatgtcactttgacagatctggtgagcgtggaggatgacgttaatctccgcgtgcttttcgtcttacagacagcaaaaaagaatgtttatacggatgaccactcgggtatttccgcccgtcagtatgacataaatgtcag

SEQ ID NO: 114795 - DNA, 177 bp, Glycine max
  Peptide Sequence Number=SeqID_231573
atgacgacacaaatgcaatgcatgaatgacgacacaatatgggtatacatgcgtgagagcatgtggttgatggaaagaaacatactagacgaacaagcatgggacaatgacaacatatcatcaaagagaaaaactctagatgaggtttcactgtcatcaagcaagtcggtgacttag

SEQ ID NO: 114796 - DNA, 606 bp, Glycine max
  Peptide Sequence Number=SeqID_231574
atggtgggatggtgggtcaactgcccattttttaaaacttatttgaaggttacaagcactggaatatctcaacctctatcaggatgtgttgatggcatcatcgaccctccatcccccgtcagacgccacgattcctttgaggagcaggcgtcacaaggatccttcgtcccccatcgacgtcaggatgttctcactattgctattggatgtccagagcaccctggacgtgtccatgttgctggagccggtgtcaccatcatgaaatactttagatcggctccacggatgtcccgcaactcttcctcgttgcctcttgaagaattgcatcagctgacccagcaaatcagggaccaactagaggagttgatcacagaaaaagtgactcgacagcttatgacatcattcagccagatgcagtcccactttcggtcccagatgcaatctcagggacttgcactgcctccggagcctctggttggttcctcaggtcctcgagtaagcacaattgagagttgtgttgatccctcaggaaacgatcctgagacgggtgactcagacaggtgcggcttatacatcgaagcaaaggtgggtgtggaggaggtttaa

SEQ ID NO: 114797 - DNA, 911 bp, Glycine max
  Peptide Sequence Number=SeqID_231575
caccaaactgtaacaaagcgctggatgaaaaatcggcggatgtggtcagtttcctgtccggtgacggcaaaaccaccggctttgctacccagaacagcaattacctcgatcagattctgggcaccaatggttccgtgcagaacgctaccgatggtattaacaagacgctaaaaaaactgtctgacgattatgaccgcgagttaaatatgtacgccaaatcgggcattcaggcctacgcacaggtcggtttagagagtgccgtgttgagcgccagcccacatcagctggtggtaatgctgtttgatggcgcgctcagcgccatgaagaaagccaccattctgatggatcagggtgatattcccggtaagggtcaggcgctgacgaaagcgataaacatcattactaacggactgcgagctggcctgaaccatgaagttggtggcgaattgtctgccaatcttgacgatctgtatgaatacatgacgcgccgtctgctggaggccaatctgcgtaacgatccgcaagcgattgcagaagtcgaagcgctgttgagcaacattgcagaggcgtggaagcaaatcggccctaaccaacagcaggactctaacgcgatgctcgcgcaggccagaggtggccagtgggatgacttgatcgcttgtgagatgacttatctgcgaaatgtagagagcgtgacgcgcgatcaggatactaatgctttgtcttccggattacgcttaaagatccgtccgatgctgaaacaggtactggataatgaaagcgagataaaaaccttactaactcagcgcatggatgaactgcgatcgctggtgcaaacgacgtcgcaacaacaaaaagtcacctcagcctatggccgcttctctaacaaggtactctacccggggaacctttaa

SEQ ID NO: 114798 - DNA, 447 bp, Glycine max
  Peptide Sequence Number=SeqID_231576
atgcataaggcattacgggccaatgcacctctcccttatcctcacctcgtcaccctttttcttcatcatttcaaaattcctttggaagatgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagcttttgtgggtgaccgatttgatgctatggatactcccctggatgccatggatgctcacttcgatgggatggatacgaggattactcgacttgaggacgatatgagcttcattaggcgttgcttcgatccaccagccaacccttag

SEQ ID NO: 114799 - DNA, 477 bp, Glycine max
  Peptide Sequence Number=SeqID_231577
atgccaatctccccctgcagatggatcgcacccacaaagacacccggtggacccgaagaagtccaacagggccctggggaatcacacccacaaagacacccagtggacccggagaagtccaactgggccctggggtttccagctttggttacaggcctttgtagtcctacagggtgcctgttccccccgacaaggtcacgtcatcatgacatagacacccagtggacccgaagaagtccaacagggtcttggagttgtcaagctttaattacgggtctctgtcagttctacggagtgcctgtcacctccagcaagggcatcaggccccctactaatcgagctttcatcaagaagtactgcgtccccaggcaggcgcagggcgaaacaccacagccgcctggggatggccagcagcgggcaacagacgcaccgccatcacctctagagttcaactcagctcatccacaaaaaggttag

SEQ ID NO: 114800 - DNA, 291 bp, Glycine max
  Peptide Sequence Number=SeqID_231578
atggggatcgcacccacaaagacactcaatggacctaaagaagtccaacaggccctggggtttccagctctggttacgggtctctgtcggccctacagggcgcccgttccccccagcaaggattgtgcccgtaagacacctagtggacccgaagaaggccaacaggggagtgcctgtcgcccccagcaaggtcatcaggccccccctactaatcgagctttcatcaagaagtactgcgcccccaggcaggcgcagggcgaaacaccacagcagcattgggatggccggtag

SEQ ID NO: 114801 - DNA, 411 bp, Glycine max
  Peptide Sequence Number=SeqID_231579
atgacggtctccagagggcgccggtcggacttctgcctgggcgacaacaccggcagggcgcacagcactggagcggggtcgcaacggcggggccgtgacgcgaagggcgaccgtggcggccaccgagaagacaagcgtaggccgggccccctggcttcgataggcgggcccggcttgggtctctggcaagcaagggttggcaccgcgcgccgtatcatgcgcgcatgcgctgggcaggaacaccgggatgatcgccacgccgacgcccagcaggcaccaggcgacaatgggcagccagcgcgccaggcgttgggcgggttccggtgcacgacggccaccgatccacagcagcagcgtgagcaagtcccagtgcataggcgagagcgacgatcaccggatgcacatggatga

SEQ ID NO: 114802 - DNA, 471 bp, Glycine max
  Peptide Sequence Number=SeqID_231580
atgcaggccggcggccggcagcgcgcgcactacctgatcgaccagctgagcgatctggacgcgcagcagcacggcgacctgcatacccgtgcctggaccgcctacgtcaacaccatcccgcccgagcgccagccggcctacccgggtgacctggccatcgagcgccgcctgaacgcgatgatccgctggaacgcgatggtgatggtgctgcgtgccggcaagcattccaatgtcggcggccacatcgccacctaccagtccgcggcagtgctgtacgacgtcggcttcgatcacttcttccgtggccgcaccgacaccttcgacggcgacatgatctacatccagggccactccgcgccgggcatctacggccgcgcgtacgtggagggccgcatcgatccggcacggatgacaacttccgccgcgaagccggccgcgaaggcctgtcctcgtatccacacccacgcctga

SEQ ID NO: 114803 - DNA, 342 bp, Glycine max
  Peptide Sequence Number=SeqID_231581
tttttaaagttcttagatgatcatgaaggtcatggcccaattacagttctatcgacccatggtagaataaaggaagctcagggatcttatctgccatcggtcagcaattctttcaaggcttcaaagttagttattaaccaaccggtgatggagattcaagaattcaatgaagggcttgcagagttgggcattgaggcccggtcagtttttaaatcccatggtgaagggagtacacaactttcaggttctatccaattatcatcaaaggaaccattctttggaaaggctgaggcaaagactattgatgacattaacaccatctctgaagtcatcatcttatag

SEQ ID NO: 114804 - DNA, 249 bp, Glycine max
  Peptide Sequence Number=SeqID_231582
atggctggggatttctcagcaatccttcttataggcaaggacgcggccggaaaggccgaggcgttttcccgatcacgaggtcaccatgacagagatgatttccgctacggtattgctgtttttaattatggatccgctgggcaacctgccgattttcatgtcggtgctcaagcatctggaaccgcgccgccgccgggtagtgctgatccgcgagctgctgatcgccctgctgatgatgctgatcttcct

SEQ ID NO: 114805 - DNA, 1083 bp, Glycine max
  Peptide Sequence Number=SeqID_231583
atgaaaaacgttggtttcatcggttggcgcggaatggtcggctcggttctcatgcaacgcatgacggaagagcgcgatttcgatgccattcgcccggtctttttctccacctcgcagcacggttccgccgcgccggccttcggcggccagcagggcacgctgcaggatgcgtatgacatcgacgcgctgagcgcgctcgatatcattattacctgtcagggcggcgattataccaacgaagtttatcctaagctgcgcgccagcggttggcaggggtactggatcgacgcggcctcttcgctgcgcatgcaggacgacgccatcatcatcctggatccggtcaaccacgcggtgattcagcagggcctggacaacggcatcaaaaccttcgtcggcggcaactgcaccgtcagcctgatgctgatgtcgctcggcggcctgttcgccaacgatctggtggagtgggcgtcggtcgccacttatcaggcggcctccggcggcggcgcgcgccacatgcgcgaactgttgacccagatgggcatgctgcatgccgacgtggcgaaagagctgcaggatccggcttccgccattctggatatcgagcgcaagcctgatcccgtggatcgacaagcagctcgacaacggccagagccgcgaagagtggaaaggccaggcggaaaccaacaagattctgaacaccggcagcgtgatcccgctgaccatgcgcgaactgacgccggcggcggtgaccggcacgctgaatacgccggtcggccgtctgcgcaagctgaatatggggccggagtacctgtcggcgttcaccgtgggcgaccagctgctgtggggcgcggccgagccgctgcgccgcatgctgcgtattctgctgtaaacccgcacttcctgggggctggctactttcagccccctaaagccttattttccacttttttgttcgccgcgtccgcgtcgggcaacgtcatcgcaagccctgcttcaatgagctgtaccccgcatatctcctcgtcggccgccgcatgccggcgccgccaggctggcagttttcttaatgaagaattttcctga

SEQ ID NO: 114806 - DNA, 788 bp, Glycine max
  Peptide Sequence Number=SeqID_231584
caaagaaggagcatctgtcaactggtttcctcgatggaaggaaggaagaaccggacggagttcttatttcatgcagaggattttcaaatgttcccttgatggggataaggggttgcatcagttacaatcccgttcttgctataagacaacttggctaccctatgagaggggaaccactaaaggaagagctcgcacctattattgcacgaggtttcaataagaccaacgtggaggcacttcagaaggtccgcaaggcgtgggagactgtgcaaaagaaggacaaaaaactcaggggcagtaacaatgggcctatctgtggctactgtaagtggttgaaagcccatgtgcaaggtttggattggctcccgagtttgagaaccgctaaaagggaggaagttgaggcaccggaggaagacgaagaggtgcaagcccttagggcagaactcgagcaagcccaaaacagtcaaagaaaggggctcgtaagggaagagcacggctgggaacaagttccgaggggctctgtggggcagttaacaacgagcttaagctccagagagaggaaagggaccaatcgcggagtagacagtttgatcttgaaggatgaggtgaagccttgctcgaggtccaagagaagtttgtctcagcggttatgcgagacagagaccaatatgttagccatcatcaacaagtatcaagaagaagtaaatctagccacaacccatgagcatagagtggcggaggagtatgcccaagtgtacgcggaaaaaaagaggctagaggaagggtga

SEQ ID NO: 114807 - DNA, 429 bp, Glycine max
  Peptide Sequence Number=SeqID_231585
atggcagaagaccacccacagaggatgacgctagaggactactctagccttgccacacctcagtacttcaccagcatagccagaccagatgtgcaagcgaccaatatttcatatccacattccctcatccagctaattcaagggaatctatttcatggtctgccgagtgaagatccatacatacgcacacctggccacatacatcgagacttgcaacacggtgaagatagcaggagtgaagcgaaaagatggcttcactcattcaaggggaatagcctgcggacgtgggaagagatggtggagaagttcctgaagaagtacttcccgaagtccaagaccgctgagtggaaggtggaaatctcatttaatcatgtagaagaaaatacaaataataattcaagcacgctcaacaaaagtgttcataagtaa

SEQ ID NO: 114808 - DNA, 228 bp, Glycine max
  Peptide Sequence Number=SeqID_231586
atgtggaatgctaccgtgttcggggtgtttaataaagagttttccttgtacatagagcgtgaagatctgtctgaaatagcacacggtggtcaatgtctcggtatctcttttatacagttgtggattctgcatatgactgagacaagtatgcgagcggggaatatcgatgtgtatggattccttgagccacagtcgatccagagatttggacaatcacaatttgaataa

SEQ ID NO: 114809 - DNA, 405 bp, Glycine max
  Peptide Sequence Number=SeqID_231587
atgatacgcggagataccttatggttattcgcacccttttgtcatccagaggcggcgggcccgatgacaagcagagaccaagtttggtcattctgcacccttgtatcatccagaggcggcgggcccgatgatacgcggagataccttatggttatccgcacccttttgtcatccagaggcggcgggcccgatgacaagcggagataccttacggtcatccgcacccttgtgtcatccagaggcggcgggcccgatgatacgcggagataccttacggttatccgcacccttgtgtcatccagaggcggcgggcccgatgatacgcggaaatacccgagtggttatctgtataaacattcttttgctatctgtaagacagaacgcttgatagcatgcagaggctga

SEQ ID NO: 114810 - DNA, 486 bp, Glycine max
  Peptide Sequence Number=SeqID_231588
atggtgcaacccaaaccaagtgttggccttaaggggagacctcaccaacatgctttcactttcttaacttcttgcatttcaaaaaaatcaaaggcttgggttactaggcctaaatcatattttggcatttatcctaacttctgcatcctgtccccacatcaaaaaaatggcaatcatacatgcacaaacccaatctataagcaacatttacaaacttatgtgcaaacaccattgaggaatttcaccgagcacttggtgggcgcacttttgggtaccaacaacaggggatgggggcaatgtggcttgccccattgtcgcaacgtgcccttttgcgagcgagcgaaggcgaggctcacgggtgcgctttccaaaggaggaaagatgcgcggagtcgccaccaacgtttatttgtggaaaacgccgggaaaaccgaaggaaaccggtcaaaatgaaaattctaagttcgggagttgtatttacgtttga

SEQ ID NO: 114811 - DNA, 515 bp, Glycine max
  Peptide Sequence Number=SeqID_231589
gcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 114812 - DNA, 971 bp, Glycine max
  Peptide Sequence Number=SeqID_231590
atggccccacggcaggctttcagtgtagcgctgcctgccgggcttgccaagcgccgggccgggacggcggcaggcgttgatctgccgccgcccccagccggttcaggccagcgcctggcgcagcagatcgcccgcgcgctgtaccgccacgccagtggaaacagccacgccctgcaggtggatgcaggcatggatcatccccggcagccgctccagcgtgcagtcgacacccgcagcctgcaggcggtgcgcgtactgctcggcctcgtcgcgcagcggatcgtgctcgcagctgagtacggaggctggcgccagtccctgcagatcacccagataggcctgccagcagcgctgcatcagttcggcgctgaggtagtagcccgcggcgtagtcgcggtaggaatcgctgcccatgccggcatccagcgccgggtacagcagcaattggtggcacggttgcggcagggcccgttcgcgcagcagcaggcagcaggcggcggcgaggttgccaccggcgctgtcgccgccgatcgccaaccgttgcgggtccaggtcgaggcgctcggtgttgtcctgcaaccactgccaggcgtcggcgacgtcatgcagtggaaccgggaacgggtgttccggcgccagccggtagcccacggccacaatcacgcagccactggcattggccagcgcacggcagggaccgtcatagaccgccaacgagcactggaaccagccgccgccgtgggcgaacagcagggccggcgctggtccgtcgggcaaaccttccggtgtgtagaggcggacgtccagcgcctgcccgtcgcgtgcgatcaccgtgtgttcgatcacatgcgcaaccggctgcggcgcaccctgcaactgtggcagcgcgctctcgctgatcgcccgcagttcgcgcagctcctccggcagcggatgcgccgcgacggcgtcgacaaactgctgcagccccg

SEQ ID NO: 114813 - DNA, 432 bp, Glycine max
  Peptide Sequence Number=SeqID_231591
atggcttctaggaagagaaaggcccctgcctcaggatctcaggcccaatttgaccgattaagattcacatctcaggaggcctgggatcgctattctgatattgtgattggtaggaagatcttgcctgagagaaatgtcatgatatatcataaagaatttgatgagttcaaggctaagctcgagagaaggaattggcacaaggagctgaccaatttcatggatggaagcattgatgttgcaatcgttaaggagttctatgctaacctctatgatccagaggaaaactcacctaaatgctttgaatacttttctgaagacccatgtgatcatagaggaaggggaagagctacctttatactccagattctatcgtctaaggccagatccacaggaactagcagcccgattatgcatccctgggaggggatttga

SEQ ID NO: 114814 - DNA, 498 bp, Glycine max
  Peptide Sequence Number=SeqID_231592
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactcccccaggaattttaattgcacttttattcatcactgtaggaattgggttcaagcttttccccagcccctttctcatcaatggactcctgacgtatacgaaggagtgcgatgctacatagttggttctcatccttcagagactacgagtataataggagcatccgtcaacaaaaggatcaccctaagatga

SEQ ID NO: 114815 - DNA, 132 bp, Glycine max
  Peptide Sequence Number=SeqID_231593
atggagaacgtaaacggacacgcgaaattcatcgagtgggacccacttgcacagaagtctgtacctgccgtcggtgttgtcctatccattccattccaccacgggaaattccaactcactgctctctcccat

SEQ ID NO: 114816 - DNA, 438 bp, Glycine max
  Peptide Sequence Number=SeqID_231594
atggctatcttcagaggaggatttgatgattatatcatcaatgtaaacttgcataaatgtgtctataaaatcatgaaacatggaattcatggccctttgataagtggtgtcgcaacctacccttcggcgggagggcgacgcgtgactcgcgggttgcgtgttccacgaaaggaatacgcgcggagtcgccaccaacgtttatttgaggaaaacatcggaaaaaccggaaaagacgcgatctacgaacttttaagtgaaaggttcgggagttgtatttacgcacggggaagagagaacgtaagtgtggacattacgatctctcgggtgtcgacaagcgggctttgctcctacgatctcatgcatgagaatcgactacgagtctgcaagcgtaagcctgtgattatgcttgacgtcatgtacgataagcaaagacgttaa

SEQ ID NO: 114817 - DNA, 570 bp, Glycine max
  Peptide Sequence Number=SeqID_231595
gttgcatgccctcacctttagagggctgcacgccgtcgccttcagaggactagacgtcctcgccttcagagggctacatgccttcgctttcagaggactacacgtcctcgccatcagaggactacacgtccttgcctttgccttcgtagggctacacgccctcaccttcacaggactgcacgtcctcgccttcagagggctacacgccctcacctccagagggctacacgtcctcgcctcagaggggatgcacaccctcgtcttcagaggactatatgtcctccccttgagaggactacacgtcctcaccttcgaagggctacacgcctttgccttcagaggactacatgtcccccttttcagaaggctacacgctctcgtctttagagggcgacacgtcctcgccttcagaggggattgcgcccgcaagacacccagcggacccggagaagcccaacagggccctagggtgtccagctctggttacgggcctctggattgcgcccgcaagacacccagtggacctggagaagtacaacagggtcctggggtttccaactctaattacgg

SEQ ID NO: 114818 - DNA, 261 bp, Glycine max
  Peptide Sequence Number=SeqID_231596
gctcatgagaaccttagggccttctcttacatctctggcccaatctttttgaattcttctatccaatgcccttggggagtaggattgcatcaggcacaaaccatccagaaacaaaacattgcccctcacgtgttgtcttgtgggggttatgaatttctagaaaagaagttgatggaggagaagaaaaagaaacaactgaaggaagctgctaaatctggaagcacttacaccgtcattgattgtaaaagcaaagcttcatga

SEQ ID NO: 114819 - DNA, 693 bp, Glycine max
  Peptide Sequence Number=SeqID_231597
atggtgtttcaatcctacgcgctgtttccgcacatgagtgcgctcgaaaacatcatgtacggcctgcaatcgtccggcatgagcaaaaaggaagcgcaggatcgtgcgcgcgaagggctgaaactggtcgggctggagagtcaggggcagcggctgccgtccgaactctccggcgggcagcagcagcgcattgcggtggcgcgcgcactggtgctggagccgcaggtactgctgctggatgagccgttctccaatctcgacgagcgcctgcgccgccgggtgcgcacggatattcgtgatttgcagcagcggctgggcttcacggcggtgtatgtcacgcacgaccaggaagaggcgctggcggtgtcggataaaattattgtcatgaaagagggcgatattgctcagcagggcgcgccggaaagcctgtatcacgcgcccaattcggtgttcatcgctgactttatgggcgaagccaatattctgccgtgcgaagtcgaacaggtagaaggcagcgaagcgctggtgcgactcggcaggcagcgctatcgcgtgcgcggtaacggcgtcgcgaccggctccgcgcagctgtcggtcagaccgcagttcattaccctgcacagcggtgctgaaggcgcactgcgcggcgaggtgacgcatgccaactggctgggcgatcacatcgaatacgag

SEQ ID NO: 114820 - DNA, 663 bp, Glycine max
  Peptide Sequence Number=SeqID_231598
atggctccaaagaaactctctacgaagaggtctagaagagacgccataggagaaggatccagtgctaccccagagtttgatagtcatcgtttccggagtgtcaagcaccatcagtgcttcgaggccatcaggggatggtcattccacaaggagaggcgtgtccagctcagggaggatgagtatacggactttttggaggagatagctcgcagacgttggacaccgctagtgactcccatggccaagttcgaccccgagatagtcctagaattctatgctaatgcctggcccacggacgatggagtttgggacatgcgctcgtgggtgaagggtcagtggattccctttgacgcagatgccctcagccagttcctgggaagccatcgcccagctgttgtgcataccagagtaggatttcacccggaccgctgcagggaggcgggtgcggatcatgcgcaccagcatgaccactttgacccagacatgggtgacactgctgctcagcaacgtatgacacctactaggcaccctctggacccaaataagtccaatagggccctggggttttcggcactgatcacaggcctctaccaatcctacggagttcccgtcaccccaggtgatgcacatcaggccgcaggcataccgccaccacctcggtag

SEQ ID NO: 114821 - DNA, 135 bp, Glycine max
  Peptide Sequence Number=SeqID_231599
atgaaatttggtggagctattccgtttctcattcctatgacgaggggtgggggtcacaacccactctttgaggattcacctagtgagtgtggtggtggggccaccactgtgagatatgggctaatctctaagtga

SEQ ID NO: 114822 - DNA, 453 bp, Glycine max
  Peptide Sequence Number=SeqID_231600
atggagaagatgaatgtgcatataataacaaagggacccctaagggtacatagatcacattcaatccttaaaaataaaactaaccaactgtcgcacgaagaacacagaacaagaaacaacatagggattgatcacggttgcgattcgagaaaaagccattttggggcggttgaagctcgcccaggcgagctaaagcttagccctgaagtaatgagcttggccaggcgagttggttgcttagccatgaagctatttcatggcccagacgagctagatgctagcctaggcgagttagggtctggaaaaatccaaagaaaaagacccttttgcccccttccttggtatctttttgttttcttgatcaaaacactaagtgattccttgcttcgcacaataactggtgtcaaccaccataattcgactaataagaataaaaatatcagcgaacgatag

SEQ ID NO: 114823 - DNA, 384 bp, Glycine max
  Peptide Sequence Number=SeqID_231601
ggtacatcctttgtggtacaagtagagggtacatctacttgggttgttgtgactgagaacaagagagggtacatctcttgtggatcaattctagtggaggttacatccactaggttgttcaaagagaacaagggagggtacatcccttgtggatctttgcttgtggagaccttgacatctcttcatcttccttcgaaaaatcgcttctcatgttatatgggttgccccttttcttgcgtcaaacccacttaccttaccccctttgcctttatggaccaaacatttaccttcacagagagggagcttcgacagcagcagcacaggagtaagaccgaaagagtgaggtatgtgagcaagaaaggagaggaacgggcacagaattga

SEQ ID NO: 114824 - DNA, 480 bp, Glycine max
  Peptide Sequence Number=SeqID_231602
atgaagtccttgatcatgtctgttctcagtgtttctactcaaattggttcaagaagataccttggccttccttccatcattgacaaaattaggagagttgttttttgctttctaaaggatagaatatggaagagaatcaaccaatggtccggaaagcacttatccaaagcagctgcaaccgatgtagaatgggtaggtttctacagcggttctaaggcaaaaaccgatgttgaatggtacatgacaacaacaaaaaaagaagagagaaatggaaacactgatgtgtgcatgaatcagtcctacgacagacaagggcacaaagaaagagttttgttgaaacccaaccaacaaacaggcattagtgggtcaccagaaaacacagggcttaacaaaggaaaaacaatagcgaatagatggtcaaacaagtggacagattggaagtgcaaatgttttccttttagtttaatgaagtttccataa

SEQ ID NO: 114825 - DNA, 309 bp, Glycine max
  Peptide Sequence Number=SeqID_231603
atgattgtgatgatttctagtctgagttacagatgtttggttgtagggaaaaaggtgagcaaagctcctaagatacaacggctggtcactcccctgaccctccaaagaaatagggcaaggattgcagataagaagaagagaattgccaaagcaaaatcagaggcagcagagtaccagaaacttcttgcctccaaaaaaataagcctagttcaggtttctgttttaacttctgagtgtctagttaagcattgctgctataatagtgctatggaactgaggaagtttcaacttgcacaaaataatacttaa

SEQ ID NO: 114826 - DNA, 276 bp, Glycine max
  misc_feature (101)..(101): n is a, c, g, or t
  Peptide Sequence Number=SeqID_231604
atggtggtcacatacaaagactggcatgagatgttaccgtatgctttgcatgggtatcgcacttcagtgcgtacttcaacaggggcaaccccctttctctnttggtgtatgaggatgaagcaggctttcgacaagaaggttcgtcctcgtgtgtttcaagaaggagatcttgttctcaagaaggttttatctttccaacccgactctaggggcaagtggacgcctaattacgaaggcccatatgtcgtcaagagactttctctggtggtgcactga

SEQ ID NO: 114827 - DNA, 658 bp, Glycine max
  Peptide Sequence Number=SeqID_231605
atggtaaattggaggaagaagaataataccataaaagggttgatcatgaatggaaaatggagtgaggaacctttgcttgtgaaggaagaggtcatactaaaagaagggaccttcaagaccattaatgaagaagcaaacgacatgcttactcaagctttttcggaagaggaaatcaaaggggcggtatgggagtgtgatgcaaagatcttgacattgaggttgaagagggttatgggagacatcatagatgagagacaatcgacgttcataggggaaagaaataatttggatagggtgttgattgcgaatgaaatagtccatgaagctaaagtcaagaaggagggattcattgtcttcaaggccgattttgagaaagcctattactcagttaaatgggatttcttgacatacatgttgcataggataagattttgtcagggcttaagtggtttgattagagtggtggagccaaagagtctaatacaaggggtgaagataggtgacagatgtgtgaaggtctctttacttcaatttgtggatgacaacatctttttcctcaaagatgacatgaatgaatcttttagtttgaaagcagctcttagaagttttgaaattgcatcgggcttaaaagtaaatatccaagaaagtagtgtgacag

SEQ ID NO: 114828 - DNA, 192 bp, Glycine max
  Peptide Sequence Number=SeqID_231606
atgaatggaaaaagtgaagcttggacatcatttgtctgcatgacattcacaccactcacaaaaagaattttaaaaagggagatagataaaaagttgaagaagtcagagaccttaatatggctggactttggggagtgtcctaaggttcaagatgaaaaaatggaggaccttgacatggacttgatggagtag

SEQ ID NO: 114829 - DNA, 450 bp, Glycine max
  Peptide Sequence Number=SeqID_231607
atgccgatctccccctgcggaagtatcagtaggtcatgccatcgtgacataggtaaggatcgcgcccacaaaacacacagtggacccggaggagcccaagagggccttgggatttccgactctggttacgggcctttgttagttctacagggtgctcgttccccccagcaagggatcgcgcccgcaagacacccagtggacccaaagaagtccaacagggtcttggagttgccagctctgattacgggcctctgtcagttctacggagtgcctgtcgcccccagcaaggccatcaggccccctactaatcgagctttcatcaagaagtactgcgcccccaagcaggcgcagggagaaacatcacagcagcctggggatggccagcagcgggcaacagacgcaccgctaccacctctagagttcacctcagctcttccacaaaaaggttag

SEQ ID NO: 114830 - DNA, 336 bp, Glycine max
  Peptide Sequence Number=SeqID_231608
atggaggccatgaaagagcaaatgaccacaatgatggagaccatgatgagcatgaagaagataatggaagtcaatgcggttgcaattgccgctaccagcgctgttgctaaagtgaacccgatgcccccatctggcctcaaccaaatgaatcatccaacctcagatatggtaggtaatgatttgggaagtacgagcatcccccattatgcgcaaattcaaaacaagcacgccttcctgccatatggcttgcctcccaactatacaccacccaatgtggcgtacactcccaatgagaatgtcaataactccacttcgatactcattgagagccaataa

SEQ ID NO: 114831 - DNA, 286 bp, Glycine max
  Peptide Sequence Number=SeqID_231609
gtatctccgcgtatcatgtgtgcagaatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaggggtgcggataaccgtaag

SEQ ID NO: 114832 - DNA, 255 bp, Glycine max
  Peptide Sequence Number=SeqID_231610
atgacgcgtggtggtaacccgggatcgttgaatcacaacatcggttttatgaccgtctttgaagggcggcttttctacatcggttgtctagctacaaccgatgtagaatgggtaggtttctacggcggttctaaggctgaaaccgatgttgaatgggtaggtttctacatcggttatcagtcaaccgatgtagaaaatgaaagaatgggcacgaatggaaaggtttctacatcggtcttcaatcaaccgatgtag

SEQ ID NO: 114833 - DNA, 171 bp, Glycine max
  Peptide Sequence Number=SeqID_231611
atgggatgtagtgggcggagaggttcaaagaacctaagggaattagcgagtggtgactacccaacatttgatgcactcatttggcgcagtgaacctcacgtagagaacactctcacagagttaaattacattgttgctcagtgcacggtgcaattacattgtccctattag

SEQ ID NO: 114834 - DNA, 858 bp, Glycine max
  Peptide Sequence Number=SeqID_231612
atggccaagcagcgatttgacatgctcacagcttacagcactgggacccatggtggaatccatgacttgccggggttaccagctggagttaagtttgacccaaatgaccaagaaatattagaacatttggaggcaaaagttgcgtctgatgcatgcaagcttcatcccctaattgatgagttcataccaacgctcgaaggcgagaatgggatctgttatacacacccagaaaaactaccaggagttagcaaagatgggcagatccgccatttctttcacaggccctcaaaagcatacacgactggaacaaggaaaagaagaaaggttcacactgatgatgaaggaattgaaacaagatggcacaaaacgggaaaaactagagcagtttttgcatctggtggtgcagtgaaaggttttaagaaaatactagtactctacaccaactatggaaggcaaaagaagcctgagaaaacttactgggtgatgcatcaataccatcttggcaatactgaagaagagaaagatggagaactagttgtttcaaaagtcttctaccaaacacaacctagacaatgtgttaatcccattatcataaaggacccgtacgaaaaaatgttgaatggtggaagtgtccaagacagcacaaatacatcaataactaaaactactgcaactcttttggattgctacaatgctccttacatagattatgatcatgcccatgcgagtcataatagggaaagttcctcacaactaataattcccagctcggttgttcaggttgatggctcttatattcgctcaacaatggatgcaaagaaagcaagatttgaaagtaacactgggaagagcttctag

SEQ ID NO: 114835 - DNA, 180 bp, Glycine max
  Peptide Sequence Number=SeqID_231613
atggtgaaggagttatcaattcaattgatcatcggattgtacgctaagtgtccgacactagggtgcggacctggctcggacggttgcccaagaaatttgtgcaccgtgcttcccccctcccctccctccctcccctcttttaatccattcctcgtctccttcgtatcttttcttatctaa

SEQ ID NO: 114836 - DNA, 1674 bp, Glycine max
  Peptide Sequence Number=SeqID_231614
atgacgaggagagcacaggaaccagcagcaattattataggagtagtaacacccgcggggaaaatagcagggcccgttgagtggctcaaaggtgaagaaataaagcccacgttgccacgcacgatggcagtccattacaagcgattgagacaacatttttgcggcataaacatatacacttccattctcttcgcgacaatcgtaccaataacgataacgatgttgcactcccaaaaaacaagtaaaactttgttcaagtggccaaagcaaatcacaaattccctagttgtgcagttaatcaaggcagaaaaggacgtgcacaaagctgtgaacatgtttgattctgcaactgctgagtatggtaatgggtttcgtcatgatcatgaaacttttggtcttatcatctctaggttagtcactgtgaaccagtttagaccagcggaagggatgctggagagaatgaagcaagaaaaatgcatggttacagaggacatatttttaagtatatgtaggggttatggacgcgtgcataggccccttgatgccatcagggttttccacaagatggaaggttttcagcttaggccaacacaaaaggcataccttacaatacttgatattcttgtggaggaaaaccatgtaaagagggctattggtttttaccgtgagatgagagaattgggtattccatctagcgttgtttctctcaatattttgatcaaggccctctgcaaaaacaaggagactgttgattctgctttacgaatatttcaggagatgcccaaccgtggatgtcagccggattcatatacgtatggtacattgattaatgggctgtgtagactcggaaatatcagtgaggcaaaggaactattcaaagagatggagcaaaaaggtttttcagcttctgttgttacctatactagtttgatacatggcttgtgtcagtctaataatttggatgaagctataggattgcttgaagaaatgaaaagaaatgacattgagccaaatgtttttacttatagttctctgatggatggtttatgtaaaggtggtcattcatcacaagcaatgcagttattagaagtaatggacaaaaagcaccatttgcctaacatggtcacttatagtactttaatcaatggactgtgcaaagaaagaaagcttcgtgaggctgtggagattcttgacaggatgaggattcaaggcttgaaaccaaatgcagggttgtatggaaaaatcataagtggcctctgtgctgcaggcagttatcaagaagctgcaaacttcattgatgagatggtgcttggtggtatctcaccaaatcgagcaagttggagccttcatgttaggatgcataacatggtagtccagggcctttgtaataatgttgatccacctcgtgcatttcagttgtatcttagtatgcgcactaggtgcatctctgttgaaattgacacttttgattgtttagtcaaatgtttttgcaagagaggagacctgcacaaagctgctcggattcttgaagagatggtattagatggttgcattccagatgagggagtatggaatgtagtaattggtggactttgggaccggaaaaaagtgagagaagccactgagcaattgctggttgagctgcagcagaagtttgtcgaagctgaaagttga

SEQ ID NO: 114837 - DNA, 3003 bp, Glycine max
  Peptide Sequence Number=SeqID_231615
atgctgcaactgcttcctgtcttccttcttctcctcctggaacaagcgtctttgatttctgggctgaaccaagatggtttgtatctgtacgagtggaagcaatctcttgacgacccggactcctccctctcctcctggaacaaccgcgacgccaccccttgcaactgggccggcgtcacctgcggcccaagcaacaccaccgtcaccgcacttgacctctccaacttcaacctttccggcccattctccgcctccctcctctgccgcctccccaacctcacctccatcatcctcttcaacaactccatcaaccaaaccctccctctccaaatttctctctgcacccccctcctacacctcgacctctcccaaaacctcctcaccggcttcctcccccacaccctccccctcctccctaacctcctccacctcgacctcaccggcaacaacttttccggccccatccctccctccttcgccaccttccccaacctccaaacactctccctcgtttacaacctcctcgacgacgtcgtttcaccttctctcttcaacatcacgaccctcaaaacgctcaacctctccttcaacccttttctcccttcacccatccctcactccctcggcaacctcactaacttagaaacgctctggctcagcggctgcaacctcgtgggccccatcccggaatccctcgggaacctcgtcaaccttcgcgtcttggacttctccttcaacaacctctacggtcccatccctagttcgctcactcgcctcaccgctctcacgcagattgagttctacaacaactctctctccgctgagtttcccaagggaatgtccaacctcacttcgctgaggctcattgatgtttccatgaaccatttgagtgggaccattcctgatgaattgtgccgtttgcctctcgagagtcttaacctctacgagaaccgcttcaccggcgagttgccgccgagtattgcagattcacccaacctctatgaactcagattgttcgggaacaagctcgccgggaagttgccggagaatttggggaagaatgctccgttgaagtggcttgatgtttctacaaaccggttctccggcgggattccggagagtctctgcgagcatggtgagttggaggagttgttgatgcttgagaatgagttctccggggagattccggcgagtttgggcggctgtcggaggttgtcgcgtgtgaggttgggtacgaaccggttgtccggcgaggttccggcgggtatgtggggtcttccgcatgtgtatttgcttgaactggggaataactcgtttagtggtccaatcgccaggaccattgctggggcgaggaatttgtcgttgttgattttgtccaagaacaatttctccggtgtcattcccgacgagattgggtggttggagaatcttcaagagttttctggtgctgataacaacttcaatgggtcgttgcctgggagtattgtgaatcttgggcagcttgggactcttgatcttcacaacaatgagctctctggggagcttcccaaggggattcaatcgtggaagaaactcaatgacttgaatttggctaataatgaaattggtgggaagattcctgatgaaattggtattttgtcagtgttaaattttcttgatctttccaacaatgaaatttctgggaatgttcctcttgggttgcagaatttgaagctcaatctgctcaacttgtcttataataggctttctggaaggcttcctccactgctggctaaggatatgtacagggctagttttatgggtaatcctggcttgtgtggcgatttcaaaggcttgtgtgatggcaaaggggatgatgataatagtaagggttttgtgtggattctgcgagctatttttatagttgcctctttggtgtttgttgttggtgtggtatggttctacttcaggtataggaatttcaagaatgctgggagatctgttgataaatcgaagtggacgttgatgtcgtttcataaactgggttttagcgaagatgagatcttgaattgcctcgacgaagataatgtgataggaagcgggtcgtccgggaaggtttacaaggttgtgcttaccagcggggaatctgttgccgtgaagaagatatggggcggggtcaaaaaggaaatagatagcggagatgttgagaagggtcatcagtttcgtcaagacagttcttttgatgcagaggttgaaactttgggcaaaattaggcacaagaacattgtcaagttgtggtgttgctgcaccactagggacagcaagctattggtttatgagtatatgccgaatggtagtctgggggatttgctgcatagcaataaaggagggttgttggattggccaactaggtacaagatagctgttgatgctgcagaaggcctctcttatttgcatcatgactgtgttccttcaattgttcatagagatgtgaaatctaacaacatcttgttggatggggacttcggtgcaagagtggcagattttggagtagctaaggtagtcgatgccaccgggaaaggaactaaatccatgtccgtcatagctgggtcttgtgggtacattgcaccagaatatgcatacacgcttagagtgaatgagaagagtgacatatatagttttggtgttgtcatacttgagttggttactggaaggaggcccatagaccctgaatttggggaaaaagatttggttatgtgggcgtgcaacaccttggatcagaaaggtgttgaccatgtgatcgactcgaggcttgattcttgtttcaaagaagaaatttgcaaggtcctcaacattggtctcatgtgcactagtcctcttccaatcaaccggcctgcaatgagaagagtggtgaagatgttgcaagaggtgggcacagagaaccaaacgaaacctgccaagaaagatggaaagttgtccccttattactatgacgatggttcggatcatggaagtgttgcttag

SEQ ID NO: 114838 - DNA, 840 bp, Glycine max
  Peptide Sequence Number=SeqID_231616
atgaaggctgtaacagtgtctgagggatcagtcctgcaaaatcgttttggtgtttttaaacattcggaatggataggaaagccgtttgggtctaaagtagtcagcagtaagggtggctttgtgtacttgttagctcccacaccagaattgtggactctggtattgaaccacaggactcagattctgtacattgcagatattagctttgttatcatgtacttggagattgttcctggttgcgtggttcttgaatctggaactggaagtggatcgttgactacttcgcttgcaagggcagttgctccttcaggacacgtctatacgtttgatttccatgaacaaagggctgcatcagctagggctgattttgagaggacaggtctaagcagcttagtcactgtgcaagttagggacattcagggtgaaggatttcctgatacctttactggcatggctgactctgtatttctggatctacctcaaccttggcttgtcatcccttctgctgcaaaagtattaagacatgatggcacactgtgctctttctctccttgtatcgaacaagtacagcgaacatgtgaaacactccgaacctgcttcacagatataaggacatttgaggtactcttacgcacatatgaagttcgggaagagaaaatgcaaagcttatgtggggatggcaatggttctcttcctagcaagaggagacaatgctctgatggaagctatgtactaagcagcagcagtccatctatttcttctgtcatggctagaccttgtggtgaagctcgaggtcacacaggctatttgacatttgcaagagttaaatcactctcatga

SEQ ID NO: 114839 - DNA, 219 bp, Glycine max
  Peptide Sequence Number=SeqID_231617
atgctaacacaaataaactctagagtggtgaaacgtcttaagaagaatcaggttgctccatctccactctttgctaccaccaccttttcccccatctttttaactcggagcctgcagccagagttagagggaaatcaagcacggctcaatcatcgaatcatagagaacacatacagaagaaggaaaagtggaaccctggaagctgatattgtagggaag

SEQ ID NO: 114840 - DNA, 621 bp, Glycine max
  Peptide Sequence Number=SeqID_231618
atgaggggtggttccttcggtggaatatttggtgatgatatatttagttcatttggagaaggaaggaccatgagtcggcaaggtacacgcaaagcacctcccatcgagaagacattgccttgcacccttgaggagctctataaggggactaccaaaaagatgaagatctctagggaaattgttgatgccagcgggaaaactttgccggtggaggaaatcttaaccattgaaattaaacgtgggtggaaaagggggacaaagattatgttccctgagaaaggaaacgagcagtcaaatgttattgcttcggatcttgtgtttgttattgacgagaaacctcaccctgtgtttaccagagatggtaatgatttggttgtgacacaaaaggtgtcacttgcggaagctctaacgggctatactgtccatctttcaacactcgatggcagggttctcaacattcccgtaaacaatgtgattcatccaacctatgaagagatggttcccagagaaggtatgccaattccaaaagacccttcaaaaaggggtaatcttaggatcaaattcccagcaaagttgacgtcagagcagaaagtcggaattaagaaacttctgccgtattga

SEQ ID NO: 114841 - DNA, 186 bp, Glycine max
  Peptide Sequence Number=SeqID_231619
atggacactgggtgtagtagtgataacaaaattgtcgacaacagtggtggaggcaatactaatgggattagcactggtgatgacaacaatgatggcattggtgtagtggcaaaggttgtggcagtgttcgcaattatggtggtaataaatagtggtgatggtgaaagcagcagaggaggttgttga

SEQ ID NO: 114842 - DNA, 471 bp, Glycine max
  Peptide Sequence Number=SeqID_231620
atgcagggcaaagaggaaaatgatgaaaatgaaaagaaagatggagaagatggagatgaggatgaaaatgcacaagaggaggatgaagaagatattaatgatgatgattataatcaggactcaagatggttctctctcatctctatgatgtataataatacattttatcctcaaaaacttacccagcaaaattttcaaattgaagttaaagaagatattcagaaaacacctttaatttttaagttgatagtggaggcaagcttcttagctgtagcagtatatcatcttgatcttcccctcttcttcataggagaaattaagtctctcattaacataaataaccttggcaaattgggctttatgattgtgcaagatcctgcagatccaactgatgattcattagctatccacaattgctttgccccttctgaccccaaacaaaatataaaaccgaaaaagataaaagagtag

SEQ ID NO: 114843 - DNA, 5085 bp, Glycine max
  Peptide Sequence Number=SeqID_231621
atggaggccgaggcagagaacaacgacgtgaagaaggaagaaaacagcaatgataacaacaacaacaacaacaacaatgaaagtaacagcaaaattgggaattcgagtgagggtctgagcaagcccaagcgtcagatgaagacgccgtttcagcttgaaacgctcgagaaagcttatgctgttgagaattacccgtcggagactatgagggtggagttgtcggagaagttggggttgtcggatcggcagttgcagatgtggttctgtcaccggcggttgaaggacaagaaggagttgccgtcaaagaagccgcgaaaggcagcggcgttgccggattctccggtggaggagcccaagttggggcctgaagtgggtgttgaatatggatccgggtcaggttcggggtccagcccgtttgcccggtcggagttgaggaatgtggtgcctcgggggtactatgagtcaccacagactataatggagcttagagcaattgcttgtgtggaggctcagttgggggagcctttgagggaagatggacctattcttggagtggagtttgatccgttgccgccggatgcatttggggcacccttagctgttacggaacagcagaagcggccaagtcttgcctatgacagtaaaatatatgaaagacacgatgctagggcaaataagccatggcagagcagagttgaggcaagatttagggtttttgtgaagatgactgaagtttgggcttgtgggtcttggacaatttgggctcacgctatagcaaggacattccatgaatacccttttcttccaaaccagtctggcattagatccgatgtttatggacaactgaacctacctcatttacatgatccaatggatggtcctaccagaactccttttccccttggaaatgaacagcaacccagagttcatgctccccaaagtcattcttctcatgttcgccttttgtctcaacagcaggacaagctagtgattacctatccatctcctcctcgagacaatgatgttgcacccaaaagggaacctcacacaaacataaccagcactggaatgaactcccatcttactgatcacccaattgttggacaagacaatccttatgctttagctggtgggcaagtttcccataacgatgcagtattgaggatggagaggaaacgaaagagtgatgaaaccaaagttgcaaaggaagttgaagcctatgaaatgaggatgcgaaaagagcttgagaaacaagataacctcagacgaaagagtgaagagcgaatgaggaaagaaatggaaagacaagatcgtgaaagaaggaaggaagaagagaggttgatgcgtgagaaacaacgagaagaggaaagatcaaggcgtgagcaaagacgggaaatggaacgaagggaaaagtttttgttgaaagaacatttaagagctgagaaaaggaggcaaaaagaagagatccgcaaagagaaggaggaagagaggaggaaagctgcccttgagaaggcaaatgctcggagaatagctaaagaatctatggagcttatcgaggatgaacaactggaattgatggagttggctgctgcaagcaaggggctttcatctattattcatattgatcttgatactttgcaaaaccttgaatcatttagggattcgttgtgtatatttccacccaagagtgtaaagctgagaaaaccatttgctatccagccctggattgactcagaacagaatatcggcaaccttctcatggtttggagattcttgattacttttgctgatgtacttgatttatggccttttactcttgacgagtttgtacaggcatttcacgactatgattctagattgttgggtgagattcatgttgttcttctcaaagtgataataaaagacattgaagatgttgcaaggacgccttctacaggattagggatgaaccagaatggtgctgctaatcctggaggtggccatccagagattgtggaaggagcatatgcatggggctttgacatacgaaattggcagaagaacttaaatcaattgacatggccagaagttttccgacagttagcattgtctgcgggattaggaccacagctgaagaaaagaaatattacatggtcatatgcaattgataaagacgagggaaaaagttgcaaagatataatttctacacttcgtaatggttcagcagctgaaagtgctgtggccaaaatgcaagagagaggtctgttagctcctcgaagatcaaggcaccggctaactcctggaacagttaaatttgcagcttttcatgttctctcgctggagggtagtaagggtttgacagtactagagcttgcagaaaaaattcagaaatctggtcttcgggacctgacgaccagcaaaacacctgaagcatcaatttctgttgctttgacaagagacactaaattgtttgaaagaattgctccatcaacatattgtgtacgagatgcattcagaaagaatcctgctgatgctgactccattctttcagaagcaagaaagaaaattcagatatttgaaaatgggtttctagctggtgaagatgctgatgatgttgaaagagaagaggagtcagaaagtgatgaagttgatgaggatcctgaagatgatgatttagtaaatccttcaagtgcaaaccaaaattctgaacagtatgaggacacaaacatttgctcatcaaatggaaaagaaaatttgggtcacaatgtagatcttattcaaaaagagtttgatacagatctaccttgttttcctaagaatggttcgaaggatgctgattgtccaatttctgtcaccagacagcctgttgcttgtgaagatttaaatgctagcaatcttgatcaagataatatggaaattgatgaaagcaaatctggagagtcctggattctagggcttaccgaaggagaatattctgatcttagtgtagaggagcgtctaaacgctcttgttgcattggttggtgtggcaaatgaaggaaattcgatccgtgttgttcttgaggatcgactggaatcagcaaatgctctgaagaaacaaatgtgggctgaagcacagatagataaagttcgtctgaaagatgataatattagtaaattagattttccatcacttactgggaataaagttgaaacaccatacacttatccagctatggagggcaacctaagcccaatgcttgacattaatattaacaatattaataatgaagcatcacccagcactgcagaaaaccaaaaaggagatcctgtagcacagagcatgcctatggagaagtgctcatcaattcaagattttggctcaggtactggtgcagatatctctcagactcaggtatctgcacaatattcgaaaagatcacgttcacagttgaaatcttatattgcccacatagcagaggagatgtatgtctacaggtctttaccccttggacaagatcgcagacgtaaccgatattggcagtttgttgcttctgcttctagcaatgatcctggttcaggcaggatctttgttgaatatcatgatggcaagtggaggcttattgattctgaagaggcctttgatgctcttttgacatcattggattcacgtgggatcagggaatctcatttgcgcttaatgttgctaaagattgagaattcctttaaagaaaatgttcgaaagaggaatgcatgttgtgccaaaaatggaagcaggggcgaattttctattaaaattgaagctaatgaagcatgttctatccctgagcacaatgctggatctggcagtcctagcagtacccttcatgacttgaatgctgatccatctgaaacttcatcatccttcaaaattgagcttgggaaaactgagagtgagaagaaagctgcattgagaagattgcttaaggtcctgttggcctgtatggaggtatctgttctttctgaagcatttgaaacaaattggatcaatgatgttaggaagcactggggcataaagttgagcaaatcatcttctgttgaggaacttttacagatattgaccctttttgagagatcactacggcgagattttctgtcgttgaacttctctacaacagatgaattgttgggatcaagcagtatgtcagaacgttctgtgcaggcttcaactgatcctgaatctgttgctgtgcttccatgggttccactaacgactgcagctttgtctctcaggctttttgagattgattcatccatcagctatgtaaagcttgaaagacttgagccttgtgaggagaaagaagcaagagaatacataaagcttccatcaagatatactcacatgaaatctaatagggaggttgaaccagccgaatttgtccatgatgaattcactaaagataaatctgttcctaagaaaattgtacgaaatggcaacaaacgtggtcgagggactaatgaacaaggacggggtaaaaagctggctaaaagagtgtgcaattctaaacgagatggtggtcgtaagaatgctaaggtcactgacaatctaagtcacagattaaaacagcaggctcgaggaacacaaggacaaggtgctgggcgaggtcgccgaaccataaggaagcggagaatgggaaagagagctgttgaagatttgttgcttggccatacgacagccagtcatagctacaagattgatagagaaccggtgagaaacttggatgaggaatgggatggagaaaaggcgagtcccatgactccggtacacattggggtggctgctgacaatagtaacagtgctgaagaggtggagtctgatgacgacaatgctcaagctgtggaatatgatcaaggaaactgggaggtaggttttaatggtgttccccccaacagatggagtaggggtttggttggaatgagtgatgaagatgtggatgcttttgaagaacttaatgacaatggcattgaggagaatgaagaggaagattcagaagcagatgttatgagtgagggttcagatgggatcccaaatacggtagtaaatgttggaggctcagactcggctttgtccgaagattcttctgattag

SEQ ID NO: 114844 - DNA, 300 bp, Glycine max
  Peptide Sequence Number=SeqID_231622
atggttagaattaccccagaatggtgcggagataaactcatattggaagaactatatcagattagagattctgggcacagaaatgccgagtacggtctaaaggtagtgattcccgtatggatggggagaagcctcgggaacacactgaacttctcattctgtagcatccagaaatacccctacttcacttacctgtttgaggaaatcaagcatgctgatctcttaattttatacactgttaaattttgttcaagcatgaacgcggtgcaattttatctatgctcccacatcgaacagtga

SEQ ID NO: 114845 - DNA, 303 bp, Glycine max
  Peptide Sequence Number=SeqID_231623
atgaagtatgctttaaggaatttggtgatagtgttaagcaccgaaggttatgcaagtggtggatccccacccaatagatgctccaagtgttttgctaattgcatcgctggtgattctactttacttttcttagcaatctccacattctttgagttagtttgtatcatcgtatatgcaatctacttcaccaaattgcccatagtgaaatattaccgttcaaaagcaatgtcagagggatcaaaaaatgttgcagttgaccttgctattgttggtgtgacaccttctatcccgacatatatataa

SEQ ID NO: 114846 - DNA, 1341 bp, Glycine max
  Peptide Sequence Number=SeqID_231624
atggcggcaacggcacgatctcggcctggactggcggaagcgatcggggagcgtcgcgcgaaagcggagagaatgttcagcttaatggacgggtttctgaagaacgaccctctcactcttcaaaaggatattctgaatcatgttgagtacaccgtggccaggtcacgctttagctttgacgattttgaagcgtatcaggctttgtcacacagtgtaagagaccggttgattgaacgctggcatgatactcatgtttacgtcaagagaacaaaacctaagcgcctctacttcctttcgcttgagtttcttatgggtcgttccttgtcaaatagtgtcatcaatcttggcatccaggatcaatatgcagaagccctaagccaacttggatttgagtttgaagttgtggcagagcaggaaggagatgccgccttaggaaatggtggccttgctcgtctatcagcatgccaaatggattctttagcaactttggattatcctgcatggggttatgggctgcgatatgaatatgggctgtttcgtcagatcatagtggatggctttcaacatgagcaacctgattattggctgaactatggaaacccttgggagatagaacggattcatgtaacatatgaagtgaagttctatgggactgttgaagaggttgagatgaatggagaaaaacatcaagtttgggtccctggagagacgaacataatttcaaataattttagatctatgcctactgctacctgtgttgcattacttttagacttgtggaatgtgcataatgttgatgaggaacttgttcttcctgaattacaggtagaagctgtggcttatgacaacccaatacctggttacgggacaagaaataccatcaaccttcgactatgggcggctaaacctagtaataaatttgatttggaggcctataacactggagactacattaattctgttgtcaacagacaaagggcagaaactataagtaatgttttgtaccctgatgaccgtaatcatcaggggaaggagctgagattgaaacaacaatatttctttgtctcagcatcgttacaagacatcatccgaaggtttaaagaagcacataataactttgatgagttgccagataagtttacatattttcttaatgttcctgtcatggtgagaagtgattctgttccattaggatttatggagttttcaggttatcccaggctagacatgggttattctgagtttttagggagagagaaaagaaaaatggagaaagaatgctttggcagtgtccagtgtttacagaattatgaagaatctaaggagaggattctcttttga

SEQ ID NO: 114847 - DNA, 456 bp, Glycine max
  Peptide Sequence Number=SeqID_231625
atgggtgacattgtgaatgaacagtggattcaagttcagcatcttgagcaggctcttcacattaccaaaatgaggactttaaaggctcaaaggctaacaagtgtaacaagatgcacattcatgaagtttatcaacgtccttcttgatgatcttcgggcacttcattcatatgtatttggtgaaaggactatagtcagttcactcatctcacagactttggatcagttgaagagatgctcttcattgaccaaaaaatatcaccatcagcttcaaggttttatcaaagatctgatggagagaaatgaattgactgcgtctattgcaaatgatgaattagtcttcttcctgctacaaactgctgacaactttcttcgaacatttctgcttcaagaatgtttctcagtgatggtggactactgtagttttgatcttgtatcagtgtatggttgcaagtag

SEQ ID NO: 114848 - DNA, 231 bp, Glycine max
  Peptide Sequence Number=SeqID_231626
atggtaatgaaaaatacagatgagatacatgtatgtatgttcgctcttatcgagaaaaaaaagttcgggaaattgagagagatgggcatggaatggaagcacgcgttgccggggcagaaaggtgcatttgtattgggcagtgggtcctatgctatgggtgtgctaaagggaaaagccagagttgcacgggcttatgctattgttttggtcccacttgaattggatatttga

SEQ ID NO: 114849 - DNA, 957 bp, Glycine max
  Peptide Sequence Number=SeqID_231627
atgaggcttgctgaatacatcgaaacaatgagtggtgtgaaggtcagtttggatgctatgtttgatgttcaggtgaagcgtatacatgaatacaaaagacaattgcttaatatacttggaataatccatagatatgattgtatcaagaatatggacaagaatgacaggaggaaagttgtaccccgtgtttgcataattggtgggaaagcagctcctggttatgaaattgctaagaagattatcaaactttctcatgctgtggcagaaaaaatcaataatgacactgatattggagatcttctgaaattggcaagttttaagtcacaactgttcatttgtgtttttatccctgattataatgtctctgttgctgaattggtaataccaggggctgacctttctcaacatttaagcagaggtggagcagggggttgtgctgggtatgagttgaatatgagcccacttggcactgcaggacatgaagcttcaggaactgggagcatgaaatttatgatgaatggatgtttacttttagctacggcagatggatctacgatagaaataattgaagaaataggatcggataacttgtttctctttggtgcaaaagtgcaggaagttgcagaactgcgtgaaaaaggatctactttaaaagtacctctacaatttgctcgcgtgttaaggatggttcgagatggatattttggtcataaagactacttcgaatccttatgtgacacggtggaaattggtaatgatttctatctgcttggccctgattttggcagttaccttgaggcacaggctgctgccgataaagcatttgttgaaccagagaagtggatcaagatgagtatccttagtgttgctggctctgggagatttagcagtgacagaaccattcaagattatgcagagaggacatggaaaattgatccctgccgatgccctctctga

SEQ ID NO: 114850 - DNA, 888 bp, Glycine max
  Peptide Sequence Number=SeqID_231628
atggagctcctatgggagcttgccttcaccatagctctttctcttttgcttccattggttttcctcaaactcctctctgtgaccccaaacttggaagcaaatgagaaagtggctcttcttgggcgtgatcatgatcatggaattaaatctgattccaagagttgggaaacggataaagttgttcgaattggtgggaaaattgatgaattcagagacaagccgatagtgggaaaattaatagtcccagaaattgtggatgtgagttgtggatcgcccaagatacacaattcagagaagattgatgagtacagtgtttacgacgaaattgaactcgtggatttggcggaggatcctgttgtggatgagggtaatgatggggttgttaatattgacgaagttgaggtagaattgatggagtgtgattctagagagaacaaagttgaagaggttgagatctcgcagtgcgaaagaaattataatgagattgatgaatctagtatgaacgaggaaattggtgaaaacaagggctcggtggtggatgaggatgattgggaaggaatagaaagcactgaattagagaggcgttttggtgctgcagttgtatttgtcggttccaagagcaatgctaatcttagcaatgatgtgaagatgaagcttcatggttatcaccgaattgctactcagggtccttgccatgaacctcagccaatggctctgaagttctctgctcgagcaaagtggattgcacggcgacaacttgggattatgagtccagaggaggccatggaacaatttatcagccttctatcagaaagcattcctgattggattgaagaaaatccttatgataatgctaaaccggcttctgcaactaaccttgtgatttga

SEQ ID NO: 114851 - DNA, 867 bp, Glycine max
  Peptide Sequence Number=SeqID_231629
atgtcgaaggcgcgtgtctacacagatgtcaatgtccttcgccctaaagagtattgggattacgagtctctcacccttcaatggggtgatcaagatgattatgaggttgtgcgaaaagtgggcagggggaaatatagtgaagtttttgaaggcataaatgtcaatagcaatgagcgctgtataatcaagattctgaaacctgtcaagaaaaagaaggctttggattactgccattctcaaggcattatgcatagggatgtcaagcctcataatgtcatgatagatcatgagttacgaaaacttcgcttgatagattggggtcttgctgaattttatcatcctggaaaggaatataatgtccgtgtggcttcaagatactttaaggggcctgaacttctagttgatttgcaagactatgactactcattagacatgtggagccttggctgcatgtttgctggaatgatatttcgcaaagaacctttcttttatggtcatgacaaccatgatcagcttgtcaaaatagctaaggtgcttgggactgatgaactgaatgcatatcttaataagtatcatctggagcttgatcctcaacttgatgcacttgttggaagacacagtcgaaaaccctggtccaaatttatcaatgcagataatcagcatcttgtgtctcctgaggcaattgattttcttgataagctccttcgatatgatcaccaggacaggctaacagctagagaagcaatggtttcttcttttgcactgcaatctcaaatcgtcagccaaaactgtcaaatagccactggaaccctttatagccaccctgttcttgtacaaccagcctatcctgctttgttctccatttag

SEQ ID NO: 114852 - DNA, 450 bp, Glycine max
  Peptide Sequence Number=SeqID_231630
atgattatagtggtgatcaataacgacgatggttataaagatatcagcgatggttgtggtggtaacaacaatggtggaggtggtaatgcaaataatggtggcaatgataatgtggtggtggtagtggcattgatggtggcaaccaatggtggtggtggtggtggtgatggttatggaggtggtattagtgatggtgacggaagtgatattgttgatagaggtggtggtagtaataatgttggtagagatgctaaagacgatgatggtgatgataatgataatggtagtggtagttgtggtggtgacaatgggatggatctagagacaagggtgaaagccaccgagaagtcgaaaattagagatgttgcaggggtggttgtcgtgatgatggcaatggtggtggcaacaaaaaatatcatgtcaaatgtgaaaaatgtgttttttaaatga

SEQ ID NO: 114853 - DNA, 243 bp, Glycine max
  Peptide Sequence Number=SeqID_231631
atgggaggaggcaatgggcaaaaggcaaagatggctcgcgagaagaacatcgagaagcagaaggccgcctcaaagggaagccagctggattcaaacaagaaagcaatgtcgatccagcagcattggaactctttactgaacatcaataatgttgtgattgatgattgcagtgcaagggagcatgctgaagccaaacaccctaaatctgatgtttatgcttgttttcctcatctcaaaaagtga

SEQ ID NO: 114854 - DNA, 1569 bp, Glycine max
  Peptide Sequence Number=SeqID_231632
atggaactctcttcctcctttctactctccccaaaaccatgctcatccccgccacctaacttctctttctcatcctccctctccccatttccaattcaactcttgatcagaaacggaaactccaaattcccccaaaccccccctttccgaattatcgcggtggccttggagccgcaacaggacttccccagcgggaacagtccccagcgtctcctcaaggaactcgccgaacgcaagaaagcaacttccccaaagaagggtcccccaaggaggttcattctaaggcccccaatagacgataacaaattagcagaaaggtttctcaacagcccacaactttctctcaaatcgttccctttattaagttcgtgcttgccttcgtcgcgcctcaacaatgcggataaattgtggattgacgagtacttgctcgaagcgaagcaagctctgggatactctctggaaccctcggagacgctcggggatgataatgataaccccgcgaagcagttcgacacgctgctgtacttggcgttccagcacccgtcgtgcgagaggacgaaggccaggcacgtgcggtccgggcattcgaggttgtcttttctgggacagtacgtgctcgagttggcgctgacggagtttttcttgcagaggtatccgagggagtcgccgggcccaatgagggagagagtgtttgggttgatagggaagaggaacttgcctaagtggattaaagccgctagcttgcacaatttggtatttacgtttgatgatatggataagataaggaggacggagaaggaaggtcctgtcaagtcagtattttgggctttgtttggggctatctatctttgttttggtatgccagaagtgtatcgtgttctttttgaagtcttcggaatggatccagatgccgaagattgccaacccaaattgcgtagacaacttgaagatgtggattttcctcctgcagatgctctgtttgaacacccaaggctattcagagcttgtgttcccccaggaatgcatcggtttaggggcaatatatgggattatgatacaagaccccatgttatgaaaacacttggatatccattggaaatggcagacagaatcccagaaattactgaagccaggaacatagagcttggacttggattgcagctttgtttcatgcatccatcgaagtacaaatttgagcatcctcgattttgctatgagagattagaatacgttggccaaaagatacaggatttggtgatggctgaaagattattgatgaagcatttagatgctccggggttatggctacaagagaggcaccgtcatcttcttatgaacaagtattgtggaagatatttgagggccaaacatctccaccgggttattatatttgatgataaggttcaagacacttatgagcataaccggagaaagagaaacccagccacaacagctgttcaacaagctcttcatgggctttcgtatcttgtttatgggaagcgtgatgtgaggcgtctgatgtttgaggtttttgactttgagcagatccagcctaaagaagtagtctaa

SEQ ID NO: 114855 - DNA, 321 bp, Glycine max
  Peptide Sequence Number=SeqID_231633
atgaacgcgctaagcgcgccagctgcgcttagccggttcatcacaactggcaaatttttagatttccagatgatcgcgctgtcgcaacgtgcccttcgcgggcgagcgagggcgagtctcacgagtgcgctttccaaaggaggaagatgcacagagtcgccaccaacgtttatttgtggaaaacgtcggaaaaaccgaaggaaaccggtcaaaatgaaaattctaagttcgggagttgtatttacgtttgaggaaggtcgacaaaagcggggcttttgctcctacgtaccctccatcgaagaggaaatcagacctacgtag

SEQ ID NO: 114856 - DNA, 213 bp, Glycine max
  Peptide Sequence Number=SeqID_231634
atgcacagcggaagacgaagagcaacaagcaccaacggtgacagaggaagaggaacaagcaccaacggtggaagagaaacaatcaacgagcaccaacagaggaagcggaagaggaagacgaagatgaaagaggaagaggaagacgaagaagcggcgtcggaggagaagaagcggcgtaggagacgaagaagcggcgcacggacaaaaaattga

SEQ ID NO: 114857 - DNA, 563 bp, Glycine max
  Peptide Sequence Number=SeqID_231635
atgaatacatttagttccgaaatatgcagtagtgggtgtgagtctggttggactctatacctggagaattctttccttaaccagaatgctgctgcttcacatagaggtggaactgaggggttttatgaggaggaacacaaagacaaaagattcaaaggtgaggaggaggacttgtccatggtatctgatgcttcttctggacctccacatttcccagattatgatgaggcttacttcaatgaagaagtcaatggttgcttttattcagcttccaacaaggcagtgaagctggccaagagtggtgcaaagaagcagaaagttaaagaaaatcaacaacaccttcaagatcagcagcatctgccttcttttcttcatgacactgctagctctcctgtcgttgacttttccactaacagtgttaatgaggccaaccaacaaacttccatagggagtatgctagattattcacaaggtttttctgcaacttattttgagggaagaccatcattccaaggagaacactttggtttcttacaatcaggaaatgagcttcaaggcaacaa

SEQ ID NO: 114858 - DNA, 222 bp, Glycine max
  Peptide Sequence Number=SeqID_231636
atgggaatagaatttaagaagatcaaacctcccaacacgaatcaggaaggttccaacgtgtggaatgttgatgctgctcttaaatttttattgggggcacagggggtagttaactttctgaatcttagtgcatctcctttctggttttgttacgggtggatgtctgataccgttgttctgtgcctcaccaagttcaatgaattcatttcaaaaataaaatag

SEQ ID NO: 114859 - DNA, 141 bp, Glycine max
  Peptide Sequence Number=SeqID_231637
atggccgaccagcaggtgaccaagtccgaagccaaaggtaagcaaaagtactatgtccgtgatcgacaagtcatcaagcgtccagctcaagatgttaaagaagcgctactaggaggaaacctagtagtgaaaataccttag

SEQ ID NO: 114860 - DNA, 267 bp, Glycine max
  Peptide Sequence Number=SeqID_231638
atggcaatgaagaaagaagctagagtggtgaaaaaaggttttcaatggaggattgacaatggtaattctatttatgcggggcccaaccttggcttaagaatgaaagtaggagatttaattgatcacaacatttgtgcttggaagaaagatctcatgaaggaaaactttaatcaacttgatgctgaaaaaattcaatctctcccactcttgaacatgatgcaaaatgataaggtattctggaaattctcccctacagtgaatatatag

SEQ ID NO: 114861 - DNA, 400 bp, Glycine max
  Peptide Sequence Number=SeqID_231639
ggatcgcgcccacaagacaccttgtggacctgaagaagtccaacagggccctagggtttccagctccggttatgggcctctgtcagtcctaccgggtgcccgtccccccagcaaggtcatgccatcgtgacatagggatcgcgcccacaagacacccagtggacccggagaagtccaacagggtcctggggtttccagctctgattacggacctttgtcagttctatggagtgcctgtcgcccccatcaagggtgagacaccacagcagcctgaggatggccggcagcgggcaatagatgcaccgccgccacctccagagccccccagctcatctataaaggttggagcgttgcctacaacccgtggccgaccagcaggcgaccaagtacaaagccaaag

SEQ ID NO: 114862 - DNA, 378 bp, Glycine max
  Peptide Sequence Number=SeqID_231640
atggccacaatgatggaggccatgatgagcatgaagaggataatggaagccaatgtggttgcagttgccgctaccagcactgttgctaaggtgaacccgatgcccccttctgatctcaaccaaatgaatcatccaatctcagatatggtgggcaaagatttgggaagtacggacggccctatgatgtgcaaattcaaaacgagcacaccttcccgccatacggcttgcctcccaactatacaccacccaatgtggcatacactcccaatgaggatgtcaataactccgctcccatactcattgagagccgacaacctcatcttgtacatgtctctcaacccatgggggagatacatgaaattccccactataatttag

SEQ ID NO: 114863 - DNA, 138 bp, Glycine max
  Peptide Sequence Number=SeqID_231641
atgtatcgtgggccccgtggctcgttcggtgtagaaggtcgatcgaaagtcggcccgtccgggcaggcagaaggaatatacactaatgcaccggatcccatcaaaactccgcagttaagcgtgcttgggcgagagtag

SEQ ID NO: 114864 - DNA, 327 bp, Glycine max
  Peptide Sequence Number=SeqID_231642
atgtgcgcttcctcatcaaggtggagagccttcatgtccaactccaaggttgaagcctctcaagtcaaggcacaggccaagaagtccttggctctagagcccagaacccaaatcaacaagttggaggcgaagattccttgggtaacggagagggataggaatagggatacggaacattgcagcagcaaagaggaagagcagaggaaaacttggataatgaaggagcctcaaggctgggtgcccaatgctacaatggagctaatgctacttgtggtctcgctcaaggctcaggctcattgctcacatgccaaatcttcgcatgggtaa

SEQ ID NO: 114865 - DNA, 282 bp, Glycine max
  Peptide Sequence Number=SeqID_231643
atggtcgcaggaactaacaaggaaaggagcaggttggtgagagagactgagagtagtgggaggtggtcggatttgtatcgcactgcggaacaatgtattttaaatcaatttcacaaattaaggcaattcaaagaaaataaagctgcccatattccgacaaatcaccacctaaccaccgcaaataaaaacgctaaccacaaaaataaatgcaagtttcatttaagacagacaggcgcgtgggagagaaagggttgcccgcaccacagcgcagccgtaggataa

SEQ ID NO: 114866 - DNA, 237 bp, Glycine max
  Peptide Sequence Number=SeqID_231644
atggcttcaaaaagtgtaactgagaccgcgataggaaccttgaattggcatatcaaatatcacttagtccttgatgccacatggttgcatctcgtgctttctgtccaatttgttggaaatgccaaactcttggtctggaattcttacaacaacaactccactgacgattttatgccatatgatcatatcctctggtttattgatttagcaaactggtgtcagaagtcaaacagctag

SEQ ID NO: 114867 - DNA, 2292 bp, Glycine max
  Peptide Sequence Number=SeqID_231645
atggaggcgaagaacaaagtgaagatcgatgattctacagcggagtctccaacttcggtccttgaagacgaggctgtctgtgccccaaaagaagaagttaagttggaggaagaagtgactgcagacatcaaagatgatgggacctctcttatatcgaaaacaatggtggaggaggaagagaatttaattgaagctaggatgaaggaagaggaggtacagtgtgaggaggtacctgaccttaatgacacacagtttaacaaattggatgagcttttgactcaaaccaaactgtactctgagtttctgctggagaaaatggacgacatcacacttgctgtgggtgaacaagagaatagggaagagcaagagagcaatccttctgcaaagaagaagggctgtggatcaaaaagaaaagctgcttcccagtacaatactaggaaggccaaaaaggcagtcactgccatgctgacaagatcagaagaaagtgagaagactgaggatacgaacatgactgaggaagaaagagttgagaaagagcaaaaagagctcatgcccttactgacaggtggaaaattgaagacttatcaactgaagggtgtaaagtggttgatttccttgtggcaaaatggattgaatgggattcttgctgatcaaatgggtcttgggaagacaatccaaacgattggatttctctcacatctaaaagcaaaaggtctggatgggccatacatgataattgctcctctatcaaccctctcaaactgggtgaacgagatttctaggtttgcaccatcactccctgctgttatctaccatggtgacaagaaacagagagatgagatccggaggaaacatatgcctactagaacaattggcccggaatttcccatagtcataacttcttatgagattgctttaaatgatgccaagaaatatttcaggtcatacaattggaaatatattgttgttgatgagggacacagactcaaaaactcacaatgcaaattagtgaaggcattgaaattcataaatgttgaaaacaagcttcttttaactggaactcctcttcagaataacttggctgaactatggtctctgttgaacttcattttgcctgatatttttgcatcccttgaagagtttgagtcatggtttaatctgtcagggaagtgcaataatgaagcaactaaggaagaactggaagagaaacgaagatcccaagttgtagcaaagcttcatgccattcttcggccctttcttctacgtaggatgaaatctgatgttgagattatgttgccgcggaaaaaggagattattatctatgcaaacatgactgagcatcagaagaatttgcaggatcatttagttaataagacgttggggaactatttgaaagaaaatatgtcaagtggactttctgttcctgcaattatgattcgtaatttggctattcaacttaggaaggtgtgtaaccatcctgatctccttgagtcagcatttgatgattcatatttgtatcctcctttggaagagatagttggacaatgtggaaaattccatttgcttgatcgattgctgcaacgtttattttcaaggaatcacaaagttcttatcttcagtcagtggactaaagtgttagatataatggattattattttagtgaaaaaggctttgcagtttgcaggattgatggtagtgtgaaactggaagagaggaaacaacagatccaggacttcaatgatgtaaatagcaattgtagagtttttcttctttctactagggctggtgggttgggaatcaatctcactgtagctgatacatgcattctttatgacagtgactggaatcctcaaatggatttacaagccatggatagatgtcatagaataggccaaactaaacctgttcatgtttacaggctctcaactgcccaatctatagagggtcgcatgttgaaaagagctttcagcaaattgaagcttgagcatgtagtgattgagaaaggacaatttcatcaagaacgtacaaaacctgccagtatggatgaaattgaggaagatgatgttttggcattgcttcgtgatgaagaaacagccgaagataaaaagatacatacagatattagtgatgaagacctggagaagctcttggatcgcagtgatcttatagtcaacgactcaaacgatgataacttcaaagctccagtcagtgcctttcctcttaaagggccggggtgggaggtggtgattccaactgcgactgggggcatgctctctactcttaactgctag

SEQ ID NO: 114868 - DNA, 1380 bp, Glycine max
  Peptide Sequence Number=SeqID_231646
atgaattgtatgagaatgatgtggtatattcagatcacaaaaggcaatgcctatactcatcaaccatggaatcataataactattacaatagtgggcaacatccgagttattacggaggtccacatggggaccatgttgtgaggatgcaacaaaatggaatgggccctggtggcggtggtgggtggggtgcaccacccccacctccgatgatgatgaatagtgctgactttagctcaaattactcgacaggaccgccccctttgcctcctccctcaccaacccttgctctaggcctcaaagggggcaccttctcttatgaggaattagcagctgccaccaacggattcaatgatgcaaatttgataggacaaggtggattcggttatgtccataagggtgttttgcctagtggaaaggaagtggcagttaagagtcttaaagcaggtagtggccaaggagaaagagagttccaagctgagattgacatcattagccgtgtccatcatcgccatctcgtatcacttgttggatactctatttctggtggccagaggatgctggtctatgaatttattcccaataacacattggaatatcacctccatggaaagggtaggcctaccatggattgggcaactagaatgcggattgcaataggatccgctaaagggcttgcttatcttcatgaggactgtcatcctcgtatcatccatcgcgatatcaaagctgccaatgtccttattgatgatagcttcgaagcaaaggttgctgattttggattggctaagttgactactgataataatactcatgtatcgactcgtgtcatgggaactttcgggtacctagcccctgaatatgcatcaagtggaaaattgacagagaagtctgacgttttctcatttggggtcatgctattggaactcataactgggaagcgacctgttgatcacacaaatgccatggacgacagcttagtagactgggctcgaccacttctgactcgtggactagaggaggatggcaactttggagagttggttgatgcatttttggagggaaactacgatgctcaagaactgtcaaggatggcagcttgtgctgctggtagcattcgtcattctgccaagaaacgtccaaaaatgagccagattgtaagaatattggaaggagatgtctcactggatgacttgagagatgggattaagccggggcaaaatgttgtttacaactcttcacctagctcaaatcagtatgacacaatgcaatacaatgctgatatgcagaagttcagaaaggcagtgttctctaatagcgacgaatttggcaccagcagtggctccagtggtgaagtgagccagaagcagcaacggctctag

SEQ ID NO: 114869 - DNA, 1686 bp, Glycine max
  Peptide Sequence Number=SeqID_231647
atgggggacaacaacagcaacaacgatgccttcatgcgcaaccaaaacgccgccgttcaggcccgcaccaaagcgcagaaccgctccaacgtccttcagctcaaactgattggacagagtcacccaaccggtctcacagcgaacctgttgaagctcttcgagcctaggcctccgttggagtacaagccacctccggagaaacgaaaatgcccaccgttatcagggatggcacaatttgtgagcaagtttgccgagcctggcgagccagaatacgctccacctgtcccagaaactgagactcctgcacaaaaaagagccagaatacacaagctaaggcttgagaagggagctgcaaaggctgctgaggagcttgagaaatgtgatgagtcctatattgcgaatttgctaatatttcatgattttatgttctctggatgccattcttatattggcttctatgcagatgatccacataatgacccaaatgtgtcgggagatccatacaagacattgtttgtggctaaactcagttacgagaccactgagagcagaatcaaaagggagtttgagtcatatggtccaatcaaacgggtagtggcaccaccaacttccatagaatggatttttaggtattggttccagtttccacttagttcctctgttgatttatgtggattaagagatcttctgagggcttgggttcctctaggaattatgttagcagtaggtatagtatctaagaatacatccctggttcgattagttgctgacaaagatataaataagcccaggggttatgctttcattgagtatctgcatacaagagacatgaaagctgcttataaacaagctgatggtaggaaaattgatggtagaagggtgcttgtggatgttgagcgtgggaggactgttccaaattggagaccccgtcgcttaggtggtggacttggtaccactagagttggagggagcaacaacagtctcgttctgaagaaccgagagtgcgagaggaccgacacgctgatagatcatctagagacagggaaatatcacgtgaaagaggtagggacaaagacagagaacgggagcgatcacgtgaacattctcatgaaagggtcagggatcgtgatcatagggaggataggcaccacagagaccgggataggaacagggacagagaccgagacagggaaagagatagagatcgtgggcgtgatcgagatagaacacgggaccgtgatcgtgagcgagggagggaccgtgatcgggatcgagaatatgatcgacatcgtgagagggatagagattatgaagttggtgaccctgatcgaggacgctcacgtgatagggagtctgattatgatcgtgttgaatctaaacatggggaaaggaatcatgactatgaacctgaggatgatcgtggtaggcataaccagtatgaacatggacgtaggcatgcagaccctgatcatgaccctgagcggtatgaccactacaatcatggagatgaccatggtgaccattacaatcagtatcgtgaccatgatgggatggaagatgactaccatgctggacgtgcaacatctgaatcgcatgaaaaggagagaagtcatgatgtggaccgtgaatatcaacgctcagagagatcacattcccgggagtatgattattaggacttgggcatag

SEQ ID NO: 114870 - DNA, 576 bp, Glycine max
  Peptide Sequence Number=SeqID_231648
atgggggaaaaaactattgactctacttctaaacatcgggaacaacatggagaggcaaaagatgttgttagaagaaccttgaagaccaagattaaacaattaactaatcaaatccttgttgagagagggcaatcagtcaaagaaaaaattcaaagacattgggagcatcttgagcttttgttttcaatagtcatgtcaataatatttgaaagggggtctttggaaaccgagaaaaatgtcaatatgctttcttcaagaattcacaatcctttatgtaaattaagtggctttcctaaaggtattgtggagaagaatcaaatcaacaatgttgacttatcaccaacaaaaagcattaggattccacacacggataaattaccacaatatacatcttgggtatacgtggctagaaatgagagaatggtcgatgatcaatcggttatcgggaaataccaaatgtaccatgataaaaataaaggtgaaatggtgatatgcagtgacaatgaggaagagatagtagatcccgaggatgtcaaacatgaattcactgaggttgaagacaaatttttgcggtaa

SEQ ID NO: 114871 - DNA, 525 bp, Glycine max
  Peptide Sequence Number=SeqID_231649
atgaccaaaataagaagcacgcttcctacgccaagcactgctccaactatggccttgctgctaccgtcaccgccactgtcattaccaccaccgttgctactgccactgccactgccagagttccttgaggacggtggagagtctaaggatttgtgtggaggagacggtgattcaaaggagggtggagaatgtgatgatccgggtggagaaggtgactgtgaggacccattaggtgatggagggcttgggctgtttgatgttggaggggaaggagagggtggtggtgatgatgaagatgatggtggtggcgacaggggtggtggcgatgatggaggtggtgatgagggtggtggtgacgatggaggtggtgatgagggtggtggcgacgatggaggtggtgatgacggtggtggcgacgacggaggtggtgattgtgatggtggtgatgagttgtcagagtcatcaggggtggagttatcaggtgttgcattatcagggctagagtcatcaggagaagagttatga

SEQ ID NO: 114872 - DNA, 181 bp, Glycine max
  Peptide Sequence Number=SeqID_231650
gccatcacttcctagatctgcaaccttcaagcccaacacggtcgcgtttcagaaggctctcgaacctcgccagcagcttgtgaatgctttcttcgcggtttcatgcagaatcgctttcttgttcatggttaaagaatcaccatcaaaacagagaaaggaagaggagaaagcattgttcgcg

SEQ ID NO: 114873 - DNA, 423 bp, Glycine max
  Peptide Sequence Number=SeqID_231651
atgacgcttgaagaatatgggtgtactgaggaggtattgaatgtcgttaaaaaatttgttaagactactaattcagaaattcaggagaggtatgaaaaactcaaggaaaagaatatggagattctagaccaacattgtgaagattgtcattgtagaggatgtgaaaatcatcttggattatgtttggaaaaaagcttgagtgttactttagaaactttcaataatcttttatgtcgacaatgtctgatctttgattgtcctatgcatggcattaataaacctttagtataccatagtgaaaaccaaccagtttggcttgaacctgaaggtgataagaaaccatgcagtgatcaatgttacctcatgttaaaggatgctaggattttgtcgaaaaattcaactcaatggtcttttcaagataaa

SEQ ID NO: 114874 - DNA, 462 bp, Glycine max
  Peptide Sequence Number=SeqID_231652
atgacttacaaagtcactcttaaagacaaccgaaaaaatatgacttacaaagtcactcttaaaggcaaccgaaaaaatatgacttacaaaatcactcttaaaggcaaccgaaattttagagcgacagaaagaaagagggagaagtttgccgacaatgcatcggctgaaatatgggagggagaaagaaaagttgaggaaatgcttctcaactgggggaaggctaatgataaaattgagggaaaggtcctcccaaatagtggagggaattgcaagaggttgaaagagaccagctggtttcctggtctcgtatttcgtctgttgacagataaggcattggaatacatagtggtagacatcatccctcatgtcaatccagaagaaattttgttggagttgttgcagggtttttgcaattcccacatggttgtcctaaggggtggaatggaattcctccaacaataa

SEQ ID NO: 114875 - DNA, 153 bp, Glycine max
  Peptide Sequence Number=SeqID_231653
atggggagcaggactgcaggagttatggctgtggctgaagaagcagcgcgtgaaatggacaaaaggctcatcaccactcgctttgctggtacttatgacctaattatctctgccacttctaaacctctactaaacctcaagccttattgttaa

SEQ ID NO: 114876 - DNA, 1002 bp, Glycine max
  Peptide Sequence Number=SeqID_231654
atggggaacaacgtggcattgcggtggcaaaacatgttaacgtggatgaaggcacaaacagaggacaaattggcaacccccacagttgcatcgcgcttaaacgagcttcgctttctgctttacctcgttggatgccctcttatacctcttcaggaagcatcaacggcaaagtatatagtgcaacaatatatagcagcaacgggaggacagccagcattgaatgcggtggatagtatgtgtgtgacagggcagatcaagattagtgcatcagatttttaccacactggtcaaagcattgaggtgaagaaaacctccgaagagatgggagggtcgttctgtccggttgtaaggtttgttgcggcagcaatggcaaggtctcgtggcgccattcctctaaccaacaaacccccgttcaaagaggtgcccctagacctttacgtcgtttccttcagggcaacggctaacttatttttggacgctgcatgcataggagagaaaataatcaatgatgaagagtgcttcatcttgaaattggaaacaagtccagcaattcgtgatgcccaaagtggcccaaactttgagattatacaccatacaatatggggctactttagccaaagatctggtctcttggttcaatttgaagactgtagattacactcaatgagaaccaaagatgacaatgacattttttggcaaacaagtttagaatcagtaattgaggattataagtatgtagatgggataaatgtgtcacacagtggcaagactcgagttacagtttccagatatggcgaacaatcagctaaccataaaaaagaattggaagagagatggaagatcgaagagttgcaatggcctactcaagggtctaagaagaagtcaaagttggcgagcattataatacaagaaagcgccaacacgttccatgcctacatcctcgaagttgatagtggctacgacttcttcataattgttgtcagctacacgtgctatcactag

SEQ ID NO: 114877 - DNA, 1443 bp, Glycine max
  Peptide Sequence Number=SeqID_231655
atggaaaacgggggatgccatagaaggctcaacaagtatacctgtgccactgtgttagcagcttctattgtctctgctatgtttggttatgtcacaggagtgatgagtggagcattgatattcatacaggaagatctccaaatcaatgacctacaaatacaactcttagtaggcgcgtcacatttgtgtgccctaccaggtagcttggttgcaggaagaacatctgattacataggtcgctgctacaccatcactctcgcttccatcgccttcttattgggctcaattctaatgggctacggcccatcctatccaatcttaatgattggaaactgcattgttggagttggtgtgagttttgcaatggtagtagcaccactctacagtacagagatttcacctccttcttccagaggctttttcacctctctcccaacactttccgtcaacacaggattcttgcttggctacatgtcaaactatttcttcgaaaaattgcctcataaacttggatggcggatgatggtggctgttcctgcaatcccttcactttgcctaatcattctcatgctgaaattggtagagtctccaaggtggttagtcatgcaaggacgtgtaggtgatgctttgaaagtgcttttactaatctctactacaaaggaagaagctgaacaaaggttgaggcaaataaaatgtgttgttggaattgatgaaaactgcaccctagacattgctcaggttccacagaaaaccagtagcggtaaaggagctttgaaggagttgttttgtaaatcttcacctcctgtgcgtaggatatttattacagctgttggacttcatttgttcctgcggattggtggaagtgctgctattttgttatatagtccaagggtgtttgagagaacaggaatcactgacaagagcacgctcatgctagccactgttggcataggaatcagcaaagttgtgtttgcattcatatcaatattcttgtctgatagatttggaaggaggattctcttgctggttagtgcagtaggtgtgactgtgaccatgttggggttaggtatttgcttgaccatagtggagaaatccatagaaaagctactttgggcgtcatgccttaccgttattcttacctacatctttgtggcttctatgtctattggaataggacccgtgacatgggtttatagctctgagatatttccccttaggttcagagctcaaggcctcagtgtctgtgtgattgtgaacagaatgatgaccgtggcagtggttacaagtttcatttcgacttataaagcgataacgatgggtgggattttcttcatgtttgctgctatcaatgctgtggctttggtgttctattactttttgcctgaaactaaagggatatcattagaagatatggagactatctttgaaagaaattctaattaa

SEQ ID NO: 114878 - DNA, 216 bp, Glycine max
  Peptide Sequence Number=SeqID_231656
atgacggatttgtggtttccgtctacggtagggacaatgttttcgcaagctcacatttgtgactgttccactgtcattgaggatacaaatcctgtgctagtgatagcacgtgtagctgacaacaattatgaagaagtcgtagccactatcaacttcgaggatgtaggcatggaacgtgttggcgctttcttgtattataatgctcgccaactttga

SEQ ID NO: 114879 - DNA, 1494 bp, Glycine max
  Peptide Sequence Number=SeqID_231657
atggagatcgagcggggtaacaataatgagcacaaaggttcaagatatgccgttgcatgtgcggtagtcacttccatgatatccattatatttggttatgatactggtgttatgagtggggccctgatattcataaaggaggagctaggaatcagcgacacccaacaagaagttctagctggcatcttaaacatttgtgcattgtttggttctttagttgcaggaagaaccgctgattacattggtcgacgctacacaatcaccctagcctctattcttttcatggttggttcagttctcatgggatatggtccaaactacgcaattttaatgactggaaggtgtgttgcgggtattggtgtcggttttgctcttttgatagcaccagtttatgccgcagaaatctcctctactaaatcccgaggctttgtaacctccctacccgagctttgtattggcattggaattttacttggttacatagtaaactacttgtttgggaaactaattttgaggcttggatggagattgatgcttggtattgcagcagttccttcacttgctttggctttgggcattctggcaatgccagagtctccaaggtggttggtgatgcaaggccatttgggaaaagccaagaaagttctattacaagtttcagacacagaagaagaagctgagcttcggttgaaggatataaagagtgctgccggcattgacgagaattgcactgaggaaatagttaaacttcctcaaaaggacaatggtgaagcggtttggaaagagttgattttcaggccctcttattctgttcggtggatgctgattgctgctgtggggattcacttttttgagcatgcaactggaattgaagctgttatgttatacagtcatagaatctttaagaaagcaggtgttaccagcaaggacaagctcttgctcacaaccattggagtaggccttacaaaagtcatttgcttgataatagccactttttttattgacaaagttgggagaagacccctcttgcttgtaagcgttggaggaatggtttgtagccttggggtgttaggattcagcttgaccatggtggatacatcccacgaggaactcttgtgggcattaattcttagcattgtggccacttatatctatgttgcgtttttcaatcttgggcttggacctatcacgtgggtctatagctctgagattttccctttgaagttgagggcacaaggagcaagtataggagttgcagtcaacagactcaccaatgctgctatttccatgagttttatatcaatctataatgcaattaccataggcggggcttttttcatgtttgctggtatatctgttattgcttgggcgttcttctactttttcatgccagaaaccaaaggcgtggccttggaagagatggagatgcttttcagcaaaaacaagggaaataatgtaactactacagaaatcgacctgaggcagattctctag

SEQ ID NO: 114880 - DNA, 1419 bp, Glycine max
  Peptide Sequence Number=SeqID_231658
atggaaaacggtattggtgaaaatgaaaacagtcatggaagtcttaacaagtatgcctgttcctcagtgatggctgcctctattatctccgctgtatttggttatgttgttggagtgatgtctggagccctagtattcataaaggaagatcttcaaatcagtgacttgcaagtgcagctacttgcaggcatgttacacttgtgcgcactaccgggatgcatggctgcaggaagaacatctgattacaaaggtcgacgctacaccatcattctagcatccaccatcttctcgttgggctccattctaatggcctggggtccattctatctaatcttaatgattggaaattgcattcttggagtttccgtgggttttgcactcatcatcgcaccagtttacagtgcagagatttcacctccttcctacagaggctttctcacttctctcccagaactttccatcaacataggactccttcttggctatgtctcaaactacttctttgaaaaattgtctcttaaacttgggtggaggatgatggtgggtgttcctgctattccttcactttgcctaatcattctcatgttgaagttggtggagtctccaaggtggttagtcatgcaagggcgtgtaggtgaggctaggaaagtgcttttactagtttccaatacaaaggaagaagctgaacaacgcctaaaggaaataaaaggtgttgttggaattgatgaaaactgcaccctaggcattgttcaagttccaaagaaaactcgcagtggtgcaggagctttgaaggaactgttttgtaaatcttcaccaccagtgcgcaggatactgatttcagctattggagttcatgtattccttcagattggtggaataggggctattttgttatatggtccaagaatctttgagagaacaggaatcagtgacaagagcaagctcatgctagccactgttggcattggagtcagcaaagttatattcgcattcatatcaatatttttaatggatagagttgggaggaggattctctttctggttagtgcaggaggcatggttgtgaccttgttagggttgggtgtttgcttgaccatagtggagcgatccactgaaaaagtagtgtgggcaataagctttaccattattgtaacctacctcgttgtggcttttatgacaattggaattgggccagtgacatgggtttatagtacagagatttttcctttaaggtttagggcgcaaggccttggtgtctctgtggccgtgaacagaatcacgaatgtgatagtggttacaagtttcatttcagttgataaagccataacaatgggtggggttttcattctgtttgctgctatcaatgctttggctttgtggtactactatacgttgcctgaaactaaaggaagatcttag

SEQ ID NO: 114881 - DNA, 846 bp, Glycine max
  Peptide Sequence Number=SeqID_231659
atggaggcatcaactttagtttataatgtatgcctagaggcaatgaccatggttaaagttatcgccttgaaacctagaggtcatagttgccttatagccattaccttacttcctggcttgaagacatgcttggaagtagctagggcttttcaagtttcaaattttgtgtttcctaataaggaaggatgtttgttattagacatgcagaaaggattgagctgcacttttgagtttatgaccaagaaatgtcatcaagatcacgaccgcaacgaaaaaaaggaaaacctaaaaagttcaattattctcgaaagtctgctggcctcccacctagatggcgaaaaattgcttatgggcaaaacttgtgtaataagcaatatactccttgtgggtgccatggaatatgtggaaaggaatgttcctgtcttgttaatggaacttgctgtgaaaaatattgcgggtgttcaaaacactgcagtaatcgatttagaggatgccgttgcacaaaaagtcaatgcaaaagtcgatcatgtccatgttttgcagccaaccgtgaatgtgacccagatgtttgtcaaaattgttggttgcggtgatgactcattggggaggctacctcgacatgaagatgctaagtgtggaaatatgaatcttcttttagggcaaaaagaaaggaacccaattagcaaaaatgtttgcctaggagagtacacgggtgagctaatccctcctaaagaagcagaaaagcgtgggaaactatatgatcgcataaacacttccttcctttttaacctcaatgaccaggcaagtgtcttgatcaactacattttctctcgagccttgttctag

SEQ ID NO: 114882 - DNA, 1644 bp, Glycine max
  Peptide Sequence Number=SeqID_231660
atggagataggtggcgaaaaagatcagttcaataaatatgcttgtgcatgtgctgtagtcgcttccatgatatccatcatatttggatatgataccggtgttatgagtggagccatgatattcataaaggaggagctcggaatcagcgacacccaacaagaagttcttgcaggaatcttaaacctttgtgccttggtaggatctttagctgcaggaagaacctctgattacattggtcgacgctacacaatcgccctagcctctgtccttttcatgggtggttcaattctcatgggatatggtccaaactacgcaattctaatgttgggaaggtgtgttgctggtattggcgtgggttttgctcttttgatagcaccagtttattctgctgaaatctcctcagctaaatcacgaggctttctagcttccctacccgagctttgtattggtattggaattttacttggttacgtagcgaactacttcttagggaaattgactttgaagcttgggtggagattgatgcttggtattgcagcagttccttcacttgctttggcttttggcattctggcaatgccagaatctccaaggtggttggtgatgcaaggccatttaggaaaagccaagaaagttttgttgaaagtttcaaatactgaacaagaagctgatcttcggttcaaggatataaagattgctgctgggattgacgagaattgccctgaggaaatggttaagctcccacagaagaaccatggtgaaggggtttggaaagagttaatagtgagaccctctaattctgttcggtggatgttgattgcagctgttgggattcacttttttgagcatgcaactggaattgaagctgttatgctatatagtccaagaatctttaagaaagctggagtcaccacaaaggacaagctcttgctcacaaccattggagtaggcctcacaaaaatctttttcttgataatagcctcatttttgcttgacagatttgggagaagacgcctcttgcttacaagcaccggaggaatggtttgtagccttgcagtgttaggattcagcttgaccatggtgcatacttcacaggaaaagctctcatgggccttgacccttagcatagtggctacttactcatttgttgcttcttttaatattggacttggacctgtcacatgggtgtatagctcagagattttcccttctaagttgagagcacaaggagcaagtattggagttgctgtcaacagagtcatgaatgctgctgtttccatgagtttcatttcaatctataaaacaataactataggtgggacttttttcatgtttgctgctatatctatattagcttggttgttcttctattttttcctgcctgaaaccaagggggtggccttggaagggatggagatggttttcagcaaaaattatagtaggaatgtagctgcagaaactgatcagaggcagaacgcgataatatttaaacctattttgcaccaacatgctacaagcctacaactttatccacactacaagcaagttgctagaaaaagtaaaacaacgagtatattaactgagcctggcaagtcaacttctaaaagacaagttgctgattacatacagttcggagcaaaatga

SEQ ID NO: 114883 - DNA, 1791 bp, Glycine max
  Peptide Sequence Number=SeqID_231661
atggctggagcactgatattcataaaggaagatcttcaaatcagtgacctacaagtgcagctcctagcaggcatcttagacgtgttcgcagtatcaggagccatggctgcaggaagaacatctgattatataggtcgccgctacaccgtcattctagcctcactcatcttcttgttgggctccattctaatgggctatggcccatcctactcaatcttaatcattggaagatgcattgttggaattggtgtgggttttgcattgatcatagtaccagtttacagcacagagatttcatctccttccaagagaggctttctcacctctctcccagacctttgcatcaacttggggttcttgcttggctatgtctcaaactacttgtttgaaaaattgcccctgaaacttggatggagaataatggttgctcttccagcaattccttccctcattctagtcattctcatgttgaattcggtagagtctccaaggtggttagtgatgcaaggacgtatagctgaggccaggaaagtgcttttattagtctctaatacaaacgaagaagctaaacaacgcttgaatgaaatagaagtttctgttggcattgttgaaaactgcaccctagacattgttcaggttccaagggaaactcgcagtggtgcaggagctcttaaggaactgttttgtaaaccttccccacctgtgcgtaggatactaattgccgccattggggttcatgtgttccagcagagtagtggaatcgagggtattttggtatatagcccaagggtgtttgagagaacaggaatcagtgacaagagcaagctcatgctagtcactgttggcatgggaatcagcaaaactgtgtcaacattagttgcaacatttttgttggacagagttgggaggaggattctctttctggttagttcaggaggaatggttgtggcactgttagggttaggtgtttgcatgaccacagtggaaagttccactgagaaattattgtggacaacaagcattgccataattgctacctacgtttatgtggcttttatggctattggaattgggcctgtgacatgggtttatagcactgagatatttcctttgagattgagggcacaaggaattggcatatgcgtggctgtgaacagaactacgaatttggcagtggtcacaactattaatgctttggcttggtgtttctactactttttgcctgagactaaaggaagatcattagaagatatggagagtatctttggggaaaattccaaatcgaagtacggtcactcaaaggtaacagctgcacttgaagataagcacaaggaatatagcaaaacggaattcagcaacaacataagggaattggggaaactatcagcagttggtcataaccaattactgagggaatattcttcagctgctggaggcttgctacacgaagtccttggaagtaattgggtttctttgatgttctcttgggcctgctatgggtttgtcctatattgctatcaacaccctttcctggaaaaacaatcttgccctcaaggttgtggattgtggacaaagtgccccaatgttccaaggtggtgtcctctggtggtaagcctagccattggaccaacaccagcttggatgcggggaatgaactgtgatgtggcttcagtaaggagacatcaaacaccaggtgaattctggtggagtccggtagttggagttgataagcaccagggatgccaagttcctggatcccgaaggggccatataatcgcttgggcaacttag

SEQ ID NO: 114884 - DNA, 1386 bp, Glycine max
  Peptide Sequence Number=SeqID_231662
atggctggagcactcttattcataaaggaagaacttcagatcagtgacctacaagtggggctcttggcagggatcttaaatgtgtgcgcgctacctgcatgcatggttgcaggaagaacctctgattatctcggtcgccgttacaccatcattctagcttctgtcatcttcttattgggctcccttctaatgggctatggcccatcctattcaatcttaatcattggaagatgcattgttggaataggtgtaggttttgcattgatcatagcaccggtttacagtgcagaaatttcatccccttcctacagaggctttctcatttctctcccagacgtttccctcaactttggactcttgcttggctatgtctcaaactacttccttggaaaactgtctctgaaacttggatggagaaccatgttggttgttcctgcagttccttcacttgttcttgtcattctcatgttcaagttggtagagtctccaaggtggttaatcatgcaaggacgtgtaggtgaggcaaggaaagtgcttttattagtctctaatacaaaggaagaagctgaaaaacgcttgaaggaaataaaaggtgctgctgggattgatgaaaagtgcacagaagacattgtccatgttccaaagcaaattcgaagtggtgcaggagctcttaaggaactgttgtgtaaaccttcactaccagtgcgtaatatactagttgcagctattggagttcatgtgttccaacaggtttgtggaatagaaagtattttgctatatagtccaagggtgtttgagaaaacaggaatcatggacaagagcatgctccttctagccacggttggtatgggaattagccaagctgtgtttacattcatatctgctttcttgttggacagggttgggaggaggattctgttgctgattagtgcaggtggtgtggttgtgaccctcttaggattgggtttttgcatgaccatggtggaaaactccaaagaaaaacaattgtgggcaatgggttttaccattgtttttacctacatatttgtagcttttgtggctattggtattggacctgtgacgtgggtttatagctctgagatttttcccctcaggttgagagcacaaggtcttgccattggtgtgactgtgaatagaattgccaatgtcgtagtggttaccagtttcatttcaatttataaaaagataacattaggcggtactttctttatgtatgttggtatcactgcgttggcttggtggttctactactccttgcctgaaaccaaaggaaggtcattagaagatatggagacaatctttgggaaaaattccaagtcggagatacaagtgaagcctgagttatggatttcatgcatgaaataa

SEQ ID NO: 114885 - DNA, 276 bp, Glycine max
  Peptide Sequence Number=SeqID_231663
atggtggatgtccaagatggccactccctcatggcactaatcttggcaaggtatggggccacgcctgaagctgacacaatgtgtctgagcagtgttggtcataaccaactgctgagggaatattcgtcagctgctggaggcttgctacacgaagtcccggaggtctcttttgctgagcctaccaatatgtgttgcctcgttgaccaatggaaacattatccaaaggttcatctgtttatggtggaatatcgtaagtaccgaggcaggttcttctaa

SEQ ID NO: 114886 - DNA, 697 bp, Glycine max
  Peptide Sequence Number=SeqID_231664
aactgcgctcgcggattgcacaaccgaacccggcgccaaagtgaagctgggcctgatccgcgacggcaagccgctcagtgttgaagtgacgctggataagagcacctcttcctccgccagtgcggagcttatcgctccagcgctacagggggctacgttgagcgacgggcagttgaaagacggaacgaaggggatcaccatcgacaccgttgagaagagcagccctgccgcacaggccggattgcatcaggatgacgttatcattggtgtaaaccgtaatcgcgtgcagtccattgctgaactgcgcaagctgctggaaggtaaaccggctgtgattgccctgcagctcttacgttctattgtcatcggtttgattgtcgctggcctgctgctgctggcgctgccgtctttacgtcagttcaataaactgtcggctccccagtttgatagcacggatgaaacaccggccacctataaccaggccgttcgccgtgccgcacctgccgtcgtcaacgtctataaccgtggtctgaatacctcagcccataaccagctggagatccgtaccctcggctccggggcgttacttgtggggtcggatagcctgaccgacctggctgttctgaaaattaacgctacgggcggtttaccggttatcccgatcaaccgtaaacgtactccgcatattggtgacgtc

SEQ ID NO: 114887 - DNA, 337 bp, Glycine max
  Peptide Sequence Number=SeqID_231665
atggatgactggaacattccagaaatccctcaggatcaactatacgttcctgagacaataaaagacaaacacaactttgattacataatcaaaacaatagaaaacaatattcctctaggacaagaagtaggggaagaatttcatttactttcaaaaaattcaatttatgaacatagccgtaagtataaatatctacacatcggttgtgtacaagtagccatcaagcccttaattgatatgggcatagatgcagcagttttaatgtgtctaagagacattaggcataaccaatttgaagactccctaattggaacagtcgaaaccagcctaggacaag

SEQ ID NO: 114888 - DNA, 1212 bp, Glycine max
  Peptide Sequence Number=SeqID_231666
atggagattatgaggctacttcggtctgaatcaggaagcacaaagtgtcagagtaagacaaaacagaactcaaattcttctgaacgaaaagctcctttaaaaacatcagcatcaaatgttggcaaacccatttccaatagcctcaagtccttcaccttcaatgatctaagagaggccactaagaacttcaggcaagaaaacttaattggagaaggagggtttggatttgtctacaagggatggatagatgagaacacatgcactccaacaaaaccagggactggaattgtagtggccatcaagaaacttaaaccagaaagctttcaaggccacagagaatggctggcagaagtcaattatctaggccagcttcaccacgaaaatatggtgaaacttattggttactgcacagatggtaaaaacaggcttctagtttatgagtttatgcagaaaggaagtttggaaaatcatttattcagaaaaggtgttcaacctattccatggattacacggatcaacattgcagttgctgttgcaagaggattaacatttttacataccctcgatacaaatgttatatatcgtgacttgaaggcttccaacatcctacttgattcggtatgtgacactgaaagtttggcttgtagatttgtgaagaaaaccgcacctgctgttttgcatgatttcaatgctaagctttcggattttggcttagcaagagatggtcctactggagataacactcatgtttcaacaagagttattggtactcatggttatgctgcacctgagtatgtagctacaggtcatttgaccccaaggagtgatgtatacagctttggagttgtgttgttagaattactaacaggaaggcgtgtagttgaagatgatagacctggattttcagaagaaacactggtggattgggcaaggccattcttgagtgatagcagaagaattttgagaatcatggattcaaggttgggtggtcaatactccaagaaaggagcacgggctgcagcagcacttgtactacaatgtctaaatactgatcccaaatatagaccaactatggtaactgttctagcagaattggaagcactacattcctcaaattcattcccaaggaccccaaaatctggaactgagaatcatacaacagagcattctagtcattcccacaagtcagctacaagtagtaacaaactatga

SEQ ID NO: 114889 - DNA, 1950 bp, Glycine max
  Peptide Sequence Number=SeqID_231667
atgtctcctgcatcccgatccaagtctaaagacaggaagcctagcaaggaagctcagaaggcttctgcaaagcctacaggatctggtaatgtagcagctggagttccagccagtgcatataaccccttattaggaacattccatactctggacatgtcaccgacacctacctcaccaatacattctaatggtcgttttcggaacatagatgagacagatgaacatcctgtcagctcagtggttgctggtgttgagtatgattctgtttctaacaatggtagttggtctggtgagtccgaagaacataaagagaaaagttctaatgtttctgttcgaccggaatcagtaccaggagctgataatgacaagcgagagaaaatccgccagaagaatgagagaaaacatcaacggcagaaggaaaggcgagcacaggaattgcatgagaggtgtactggttatcttatgtcaaggaaacttgaggcactttctcaacagcttgtggcaatgggattttctcatgaaagggcaacaatggcactgatattaaatgaaggtagggtggaggaatcagtagcgtggctgtttgaaggtggtgaagatgcagatggtaacaaggatacaaacataggtaggggcaatttgaaaattgacatatcaggtgagcttgctcggattgcagacatggtaaccaagtatgattgctcaaaacaggaggtcgaaagagtgattgttaattgtgagggtgatcttgatagggctgcagagaccttgagagagttcaaacttgatccaccatctgctccaccaaaaccagaggaaactggtgatcctcctattattaacaatgttaagcagtcaggagttgcaagtcagaactcaaggccacaaacaaaacctgttcctttaccaaatcaacccaaaaaagatgacaaggattttaactatacaaaggctgcattgacgattggagtatcttcagattctagcaatagaaatacgcaacctctaaagagaatccaacctaagtctgaatgggcaaagccccaacaggctactgtaccagctgataaaaggtggccaagtgcagaatctaatccttccatttcttattcactggcatcaccgttgcaaatgtcaccccaacctgctaagtccgaagcacaatatatgcctgctggaggtgattttaagaaccttcaacctggagtagccagggaaccattaatcatgatgcagcagccccagactgtaaatgaagagcaagttccagccacaagcatgatctcatcacctcctgaaatagccgctggtcggtatccaactaacagttcagatgctgtcagatctaataatggctttatatctcatgctcctagcactagaagcctcagtccaaactatctcaattccaatcaaatggaccaccaacttcagtatcaacctcaacaacagtttgttggtagcagcagcaattcagtagatcatcaagggaatagaatttggaatagaacagatgcaattgcaccacttgctgctgctacttctctaggactcttttccggtctaggatcagcaggctcatcaggggcttcttctccagtagactggagcactggtgggaccgtgcagtttgattatacaaacatagactggtccttggacagaagtttagcttcaccaaggtcgaatggtttatggctaggattttcaccgttttcaaggagtagtagtgctcagatgtatgactcaaatgctttaggagttgttgctgaatcatctatgagaccagtgcccacaaataggagcatgaatgctcccaggcctggattgcaagatggagtagcttctgctgagacatctgctgctggttcccgggagtggggttctccatttgaagggaaagatctttttagtttaccgagacagtttgtttcttctccttctcagtaa

SEQ ID NO: 114890 - DNA, 264 bp, Glycine max
  Peptide Sequence Number=SeqID_231668
atgtgtatcctaaaccgccaccaacttagtaacacacaagaacaggttatctcgccaaaaaatcatcatcatcatcgattagttcctcttgattccctttctctctggcttctacatccatcgccacaccgccgaccacgtcctccaccgcctctcacctccgacaatgaagacaacgatcaaagcggatttgagacgacgacaaagaagcagaaacaaatgtccaggtctgtcaatgactgctccaatgctccaatgtattaa

SEQ ID NO: 114891 - DNA, 720 bp, Glycine max
  Peptide Sequence Number=SeqID_231669
atggctgtcaccttctcagatcctcacaccgaagagggcatcaaatccctcgatcaattcctttctgggaaaacctatatctctggggatcaattgacaaaggatgatatcaaagtgtatgcagctgttgtggaaaagccaggagactcttttcctaatgctgctaagtggtacgatgccgtctcttctcaacttgctccaagcttccctgggcacgctcaaggggtaagattcagtggcgctgctgctccagctgaagctgcacctgccaaagcggaccttgcacttgcagttgctgttctgacagcaggcaattctgctccagctgccactgctgaagaagatgatgatgatcttgatctctttggtgatgagacagaggaggataagaaggcagcagaggaaagggaggctgctaaaaagcctgccaagaaaaaagagagtggcaagtcttctgtccttctcgatgttaagccttgggacgatgagaccgacatgaagaagctggaagaggctgtccgtagtattgagatgcctggtttattgtggggagcatccaaactagttcccgtgggatatggtatcaagaagttgcagatcatgatgactattgttgatgaccttgtatcagtggacactcttgttgaggaacgcttgacagttgagccatgcaacgagtatatccagagctgtgacattgttgcattcaacaaaatctaa

SEQ ID NO: 114892 - DNA, 495 bp, Glycine max
  Peptide Sequence Number=SeqID_231670
atgcctgaaaacagcacctttgagcaacaagataattcagataaacaagttatgcatccgccacatttgcaaattatgcatcgttcccacgagcagcttcaagactcgctaccaaatgattatataaagtttcagggtgattacatgtcttgtgatgataaatgttcaagtggcatttccctgccatcatttgacgatgacttattgagaatgggagaggatcctccgactcagactcatgatcaatactatgaaccacgttctccacgcagcaatggctatttggaatccatattttgcccaccaccaaagattgtggaaggatcagatgattgttccatgcaaggagagtcaagtttaggaaacggagaaaatttagaccccattatgaatcaagatactttaggtgacacttgggtagagaattatgacaaggatcaatacgctcttaaggatactttattcagcattatctaccccttttttccacactaa

SEQ ID NO: 114893 - DNA, 168 bp, Glycine max
  Peptide Sequence Number=SeqID_231671
atggctcccgaagaactgaagcagttgactcaacaaatcagggaccagcaggaggagtcgatcacagaaaaaatccaatcacagggacttgcactacctccggagcttgaggttggtgcctcagctgctcgtgtcacacaaaggggagttgtgttgatccctcaatga

SEQ ID NO: 114894 - DNA, 318 bp, Glycine max
  Peptide Sequence Number=SeqID_231672
atggatatcataggtcaaaacaaggagtggatttttagcatatttggtgagaactatcttaaggctataagatactggggaatgtaccttcttggtgttcatttgggaactatcttatcttcggaagccattcctctggatttagaagtagcagatggcaatcttgtttggatcatgtctacagctttgaacttattcccttttcatgatccccatgttaggttattaactgtgcttctagacaggcatgttgaaagaatttctcggagaatgtgcaaccttccatatgttactatggtagtgactgacaatctacag

SEQ ID NO: 114895 - DNA, 239 bp, Glycine max
  Peptide Sequence Number=SeqID_231673
gtggccttgttggtgcttgcgcgcttagcgcaactctggctcgcttagcgttcattagtgaatttcaacttagcgctcgtcttttcgctcagcggatggactcaagcggtgcacttagcgagattagccctcgcttagcgaacatgcacagctcatccttcttccagattcttcctcgcgctcagctaaaggagtgttgcgctcagcggatggatcgccaagccagaagattggcttag

SEQ ID NO: 114896 - DNA, 336 bp, Glycine max
  Peptide Sequence Number=SeqID_231674
atggactcccaatcttccgacaagatgacacaattaatcttttggcctgaagacatccacacaagaggaccaccaaacttaccaacaatgaccaagctagaaccaattggtttaatggacaactctcaacctcttcaaaggaggcagagggagattgtggatagatttgggatgggtctcaacgtggcaagaagggaggcagttgagaagattcatgcaatcttccctaggaagggaccaatcaccaaagccatgagcaagaggctccaagaggattgggctagagttgttgaagaaggccctagggttctcatgaatcttatggtagatttctga

SEQ ID NO: 114897 - DNA, 552 bp, Glycine max
  Peptide Sequence Number=SeqID_231675
atgaattggatgattgttgaaagttttgacggtgaattgggcaaagtttcatgtgagttgagagataaagtggaatttagcttgagatcactttttgaggagtatagtgacgatgaaaatgagtttgaagctagctcacatgaggctccactcaatgaaggaggtcatgatgatccttatggtaaattcaggttgattcccaattctttcaagcatggcaagagatgtgcttgctatatctgtgttgattatggcttgagtccaactttaatgccagaggaagagttcttcatccatatcattgttcgcttacactgcaaatggtggaagcacttgtttgcatgcaagattgaatcaaaggaccaccatcaccattgccttcgaataaagttaattgaggaatttttggagtttgagagagttgaagaagttgctcaggtggccagatcctatgtcttgctagttgctaccagaattctcaaacttatttttagacagtgccatcttggacacatgcgcaaggtgttcaacggctcagggcccccattttga

SEQ ID NO: 114898 - DNA, 546 bp, Glycine max
  Peptide Sequence Number=SeqID_231676
atggagggcgttttggggttttccggcgatggcgtagccgacgacgaggatgtcgtggaagcggccccggtggtggaagatgcggcggcggaaggcgtcgaggaattcgaggacgaggggcttgaggtcggcgcgggcgaggattttgaagatggagacgaaggtggcgcgggtgtggtggaagtggggctggcggccggcccagtcgaagaacttgaggcaggggagaatgtcgcggcgggcggcgccggcggagagcgcggcggagaaatcctcgtcgtcgggggaggagaggatttggtggatgcggttcaggagggggaagttgaggctgaggaagatgatgatgctagagaagtgtatggagcatggtcagagcacgggtcgagaattgaggagatgaaggatttggatctgagacggtgtttgggttccattgcattccaagtgtttgtgtttatgtctctgtgtgtatccatacctgcgacttctcagtacttcttacttcgggggttaagggtttatggggggtttcaccctccgtaa

SEQ ID NO: 114899 - DNA, 1968 bp, Glycine max
  Peptide Sequence Number=SeqID_231677
atgcgcttccacggcctagacctcgattccttcgcctaccacgtcctgttggaggccctcgtcgagaaaaactacctcaacgcgtttgacatcatcatgaggcaaattcgcgccaggggctacgagaatcacatgacaaatgtcattgttgttaagcatttgtgcaaggagagaaggttggaggaggctgaggattttctcaatggtttgatgtgtcgtggggaggagttaaaagggcctgaagtgagttttttaattgatgcattgtgtgagagttataggtttgagcgtgcggttgagttggttaagcaatttgggagctctggattggttccgttggatcatgcttatggggtttggataaagggtcttgttcggggtgggagggtggatgaggcattggagtttttctctcagaagaaggactctgaagggcttttgcaggagaatcggtttcgcgaggtgtatgatttgttggtggatatgaatgagagttgcattcctcctgatgtggttaccatgaatgctgtcttatgcttcttttgcaaagtggggatggcggatgtcgcatttgagttgtaccattcgaggtctgactttgggttgtctctcaatcacttggcttgcaagtatttgatacttactttgtgctgggatgggggcgctgaggaagcgttcaaggtgctcagaagctcagctcagcggagttattttcctgatgggcggacattttgcacacttgcgagtgctttgtgcagggagcacaagattgatgagatgaaggagttgttgtatcttgccgtggggaagaatttcgtgcctcctacgtcaatgtatgataagtacatattggctctgtgccgggctgggagagtggaagatggttatttggtacatggggaacttaagagtgttgctgccaggacatcgtatgttaagatgattaagagttttgttaagtctggtaggggagatattgctgctcggcttcttgttgaaatgaaagggaagggtcataaactgattcgtccatggtgtagagatgttatttgccgcttgcttgaaatggataattcaagagggcgctttttcaatttactggagatgctgactcgttatcaacattcttgtcagacttacaactttttccttgacggagctggacatgctatgaagcctgagttggctagggaagtatttgagttgatgcaaaggaatggtattaagcccaatttgtcttctcttattcttatgttgcatgtttatttactcagtgggagaatttctgatgctctgaatttttttaatggtgtacggcgccagggtttggcaactaagaagttatatgttgccttgattactggtctctgcaagttcaataagatagacatttcacgtgagtactttttcagcatgttaagagttggattgaatccaagccttgaatgctatgagctacttgtgcaaaagctttgctcattgcaaaaatatagtgaagcaatacatatcattaatgtatctcagaaaatgggacgtccagtaagttcttttattggcaatgtacttctttatcattctttgatttcaccacaactctatgatacatgcaattatttaagaggtgcggaagagggggtattttctggtaattcaacactttgctggatgattggtgcattttctggtcgtctcagagtgagccattatattgcggacctggaaagattagtagagagatgctttccacctaatattttcacatacaatctgttgttgaaacaagtagccaagagtgatatggacaaagctcgtttgttgtttgctcggatgtgtcaaaggggttatcaacctaattgttggacatatgatatcatggtacgtggtttctcaattcatgggaggaaacatgaggctaggcggtggcttgaagaaatgttccgaaaaggattttatgatgaaaatcaatag

SEQ ID NO: 114900 - DNA, 288 bp, Glycine max
  Peptide Sequence Number=SeqID_231678
atgtggcgtcttctagctgcagtggcaagaaaccttcagaacacaagaaagagttccaaggtggcagatgagagcatgtttgaagcaggaaacggtgtagagctatttggacatgagaggggcagaagacaacatggttgggggcttgtgtgtagcattcttcaagcccccatatcaatactctcatgtgtttctcagcctcaggttaataatggctctgatggggtttgggtaactggggaattctcacaagtgtctgaaatgaaccatctcatggaaatattgtga

SEQ ID NO: 114901 - DNA, 1377 bp, Glycine max
  Peptide Sequence Number=SeqID_231679
aaagagaccaattatcaatcatcaggagcgaacatggcagagtgggtcaatgcagaagttaaagaagtgaaaaactggaccgacgcactgttcagcctgcgcgtcacggcgcccatcgacccttttaccgccggccagtttgccaagctggcgctggaagtcgacggcgagcgcgtgcagcgcgcctactcctacgtcaacgcgccgcaggatccgctgctggagttttatctggtaacggtgccggaagggaagctcagcccgcgtttgcaggcgttgcagcctggcgatcaggtaatggtgaccaaagaggcggccggtttctttgtgctggatgagatccccgactgccagacgctgtggatgctggcgaccggcacggcgatcggcccgtatctgtcgattttgcaacagggcgaagggctggagcgcttcgacaacattgtgctggtacacgctgcgcgctatgccgccgacctgagttttctgccgctgatgcagcagctacagcagcgttatcagggcaagctgcacattcagacggtggtcagccgcgagcagatgcccggttcacttcatggccgcgtaccgcagctgatcgagagcggagaactggaaaacgccgtgggcctgccgatgctcgccgataccagccacgtgatgctgtgcggtaacccgcagatggtgcgcgatacccagcaattgctgaaagagacccgcgatatgcgtaagcatttcaaacgtaaacccggtcacatgaccagcgagcattactgggccgaagcaatgaagaatctgccagtcgcgctgctgctcagcgtcgcactgacatttcccgcctgggcggaggacgcgcccgcgcaggatcgcaacgatcacctgcctgcggcgccgtatctgctggcgggtgcgcccacctttgatatgaccatcgcgcagttccgcgaaaagtacaacgccgccaatcctgacctgccgctgcaggagtatcgcgccatcgataaccgcgatgacaagagccacctgacacgcgccgccagcaaaatcagcgaaacgctgtatgcctctaccgcgctggaacagggcaccggcaagattaaaacgctgcagattacctggctgccggtgccgggcccggatatgaaagcggcacagacacgcgccatggattacatgactgcgctactgcgcttttttgtgcccggtttgtcagcggaagagggacacaagaagctcgatggcctgctcagcgccggcaagggcgcacgctatttttcccgcaccgaaggtgcactgcgctttgtggtcgcagacaacggcgacaagggactgaccttcgccgttgagcccatcaaactggcgctcgctagcccctga

SEQ ID NO: 114902 - DNA, 1240 bp, Glycine max
  Peptide Sequence Number=SeqID_231680
atggcagcgctatttcatgaatcgcgttatgcggaggaaagaatgcgacatccactggttatgggtaactggaaactgaatggcagcaagcacatggcgggcgagctgattgaaggcctgcgcaaagagctgtcaggtgtggaaggctgcggtgtggcgattgctccgccggcgatctatctggatcaggctaaacacgccatttccggcagccacattgcgctgggtgcgcagaacgttgacgtgaacctgtctggcgctttcaccggtgaaacctctgccgagatgctgaaagacatcggcgcgaaatacatcatcatcggccactctgagcgccgcacctaccataaagagagcgacgagttcatcgcgaagaaattcgccgtgctgaaggccgcaggcctggtaccggtgctgtgcatcggtgagaccgaagccgagaacgaagccggcaaaactgaagaagtgtgcgcacgtcagatcgacgccgtgctggaaactcagggtgcagcggccttcgaaggcgcggttatcgcctatgagccagtctgggccatcggtaccggcaaatcagcgactcctgcgcaggcgcaggcagtacacaaattcattcgtgatcacatcgcgaagaaagatgccgctatcgctgaacaggtaatcattcagtatggcggttcggttaacgacaaaaacgccgcagaactgttcacccagccggacatcgacggcgcgctggtgggcggtgcgtcgctgaaggccgatgctttcgcggtgatcttcttccgccgaaccgcgattcagcttcagccagttgcgctccagcgccagcagcgccaggcgtccatccggcaaccgggccagcgccagcccgtatttgcccatctcaccgcgcgcatgcggcacctcctcagccagccggataaatacgctctgctgcgccagttcggcggtgctcagcgtgcgaatcagccaggtatgccgcagcagcgttgccgtctgccactgcgcattcagcttcggcgccagcgtatccagctgctgacgcacatccggtcgcaggcaggagatatgaatgtgcagctgattctgtgtacgaccatactgcgcgttgatggcaagcgacagcacgcggtcgtcgacaggcgcaccgcgcttctgcgccagcaggcggcgctgctgccaggcggcagcaaacaggttcggcgtggtgggttcgaggaggattgggctctccatgccg

SEQ ID NO: 114903 - DNA, 168 bp, Glycine max
  Peptide Sequence Number=SeqID_231681
atgcccttacggacactattcctacttccccatcaggctctgctaccagaggtcagcagaataggatcaaacggacaggtaggaaatatcaagggcacaccggagaccggcttacaaatcccaggttttcataaacaaagaaaccgaagcggcggtatagccgcatag

SEQ ID NO: 114904 - DNA, 297 bp, Glycine max
  Peptide Sequence Number=SeqID_231682
atgaagacaaagctttggagacctttgaattcactaaaagggttcaaaggatccttagaaagcattagggaaatgtccagactaggaagcaagcccagaaataagaagaagaagaagaagaaaaggcatgaggaatccagaccctctcatccagtccagtcccaaaggactcgtccacagactacttcagtcaggaagagtcaaaggcagatcgctgagaaggctacaaaggctcagaagttgagggatatgagtgaaacagaggatgaagaccctctgatcatcccaaggaagtga

SEQ ID NO: 114905 - DNA, 801 bp, Glycine max
  Peptide Sequence Number=SeqID_231683
atgcacttcacgcaccacggtctgctcgaaggtctcgccgggttcgacgaagccggccagcaccgagtaacgccgcggtgcccagttggactgccggcccagcagcagccggccctggttttccacggcgacgatcacggcggggtcgacgcgcgggtagtgctcggtggaacactgcgcgcaacgaccgacgaagccgccgcgggcaaacgccacggcgccgccgcacacaccgcagaagcgggtgcgcgagtgccagtaggacatgccgcgggcatagctgaaggcggtcgcatcggccatcgaccacagcagagcggcctggcgcaggtcgaggcgacgtggtgcggtgacggtgacgctggcggcttcaaccgagaaccacgcttgttccccgcgcaggccgaggaagatcgcggagccgggaccacccccgatgtcggcaccggtcagcgccagcggctggtcgtcatcgccggtgaaggcgcttccgtcctgatcgagcacgagaatgcgcgcgcccggccacaggcgcgccagtgcatcggcatcgtcgcgcagggcatcggcgcgctccagcggttcgccaacgaaggcaaaaccggaaagcggcgaagaagtattgggcatccggcaagcgtgccgccaatcgatgcgggtggcaaggtcggcgctgtgcgcaatctgctgttgtgggctggagggcacagagcatccacgcatggcgtggatctacggatccgctctggcaggtgcccaccttggttggcacatcctggccacagggctcttacatgctga

SEQ ID NO: 114906 - DNA, 162 bp, Glycine max
  Peptide Sequence Number=SeqID_231684
atggttcagctaagcacgcatcgctgcgctaagcccaacatcttcactgtaagcgcatgttgcagaaagatttttggtgttgcagaaagcgctaagcaccgctgctgcgctaagccccaaatacttactggaagttacaacttcaagttgggcttagtgtga

SEQ ID NO: 114907 - DNA, 243 bp, Glycine max
  Peptide Sequence Number=SeqID_231685
atgatggcaaaaccagatctggacggtggcgacgttggtgaggttggggtcatatcacgagaacgtggtgaaggaggacgagatcgattcactacgatgcgaggtgacgtagatggagttagagatgagcgcggtggtggaagcacgatcagaaacggcgacgtttgtgtatctgtttcattaagattcatacagaaccagagaaacaaaagtttggttgagaagtcccagctaacattttaa

SEQ ID NO: 114908 - DNA, 1299 bp, Glycine max
  Peptide Sequence Number=SeqID_231686
atgactgtctttcctacatcttctggattgctagaaatgaagccctttaaatctcctgaaatcttccttaattccattgtttcaagcacagttttgagtattaggacaggacaatgtgaagctgatttagttttggggggtgatgatggcaaggagtgtacctatagcaaaggttatatgaaaaggcaggcaattttctcttgcctcacctgcactccagatgggaatgctggagtttgcacagcttgttcattgtcttgccatgatggtcatcagattgtagagctatggacaaaaagaaacttcagatgtgattgtgggaactcaaaattcggtgaattctactgcaagattttcccaaataaagatgtagaaaatgttgagaattcatacaatcacaactttaaaggttcatattgcacatgtggtcgcccttatccagatccagatgctgaagaacaagtagagatgatacagtgctgtctatgtgaggactggtttcatgaggagcatcttggtcttgagtcttctgcggagattcctaaagatgatgagggagagccaatgtatgaagaattcatatgtaaggcatgctctgaggtatgcttctttctaaagttatatcctgaagaaatatgggcggctggaaagcagccagacgctactgtccaaattagcaaggacaaaggtgtcttggaagacatcctttcaacttgtcggtctgaaaagccaacttgtgatacttcatgttgttctcctaaagttgatgatgtacaagctacagttgattcaaaatctatatctgatgggaagagtttgtctcagggagaaaattgtaatggcagtatggcttcaaatcaatgcacaaaaagcaccgatttgcatgttaattgtctccttagtgttaacatcatcactgtttccccagttttacctggtaaaccaatgttcctttccaaaaattggagacttgctctatgcaaatgcaataattgtttggagttttacgagcagaagaagattgcttttctactagacaaggaagactcaatagcagagtatgagcaaatggccaagcaaaagagagaagaaaaattgcagcaacaagagggtgctgagttaagtttttttaataaacttggacatgtagagaaagtggagatcttgaagggcattgaagagatgaaagatgggcttcgtgctttcctggagtctgcagactcgtcaaagccaattactgctgctgatgtccaccagttttttgatgacattaagaacaagcgtcgccgtgtacagtag

SEQ ID NO: 114909 - DNA, 315 bp, Glycine max
  Peptide Sequence Number=SeqID_231687
atgggcaactgcatggagacatacactataggggagaaacagcagcagcaaaaagaagaagaagaaagaggatcattatcaaatgaagagaagaatggtctaagcatgaaagttgtgctgacaaaggaggaactgaaatggctgatacttgaactgaacaagaaaggagaagctggaggagtgaggttggaagaaatgctggaagagatagaaagaggcagagaagagaaggttgatcagaatgagaggggatggaagccttctttggagagcatcttggaggctcctgaattgcttgagatggacaccacatga

SEQ ID NO: 114910 - DNA, 624 bp, Glycine max
  Peptide Sequence Number=SeqID_231688
atggctgccaaacctcttactaccgaggcgattgcgcttacggaaaagaagatggacatgacactagatgacataatcaaaatgtctaaaaacccgaagaataagaagcaaagaagggttccggataagtctgcaaaggtccagcgttatatggaatcgagatcttctcttagacagggggctcttgcaaaaagaaggtctaatttccagggaaaccaatttcctgctgcagttgaagttgcgcgaaaagctgttactgctcctctgcacaatagagtccctaatcgtaatagggtggctaactggaataaaacaaggccaaattgttgggtgctagtacaaacccaccaagatgatgttgcaactagcagatttcaagttcctgtaggtcagagaagggctgctaatggaggctttgctgctaagcaaccacttccttcccctcagaagcagcaagagaatgtggatataatgccaaagcaaaagcctcagacgctggattcactgtttgcaaacatgaaggagcaaagaatgagagttttgtcaatgcagaataatgctgtgcaacgcaatggaggtggaaataggaggctcccatggggaagaggccgatttggcaactaa

SEQ ID NO: 114911 - DNA, 678 bp, Glycine max
  Peptide Sequence Number=SeqID_231689
atggagggaatgcgagacacaaagtcacagcttgaaatccaagaccaagagggtactaatattgggtcctctttgtcaaagctcatattagcaagtggcagtggcacaaacacccttgactcaattttctccaattgcccacaaacaacaaatggcagcactagtagcaactccgtgttagatgatttagaaccctttaggtcttcggggtgtgagtctttaggctcttccgtgtacctccgccaaagggacatcctccaaaaattctaccaagaaagccgaggaaatgggaacaataacgggtcttataatattcccagatccttggcaaatacgtctataaactctgtttgcaggagttcttcgttgagttgttattcgttgacgaagccttgtaagaaaaagctgtacaggggagtgaggcagaggcactggggaaaatgggtggcggaaattagactccctcagaacaggatgagagtgtggttgggaacctacgacaccgccgaagctgctgcctacgcctacgaccgcgccgcctataagctccgtggagagtacgcgcgcttgaactttcccaatctcaaggaccccaccaagctgggattcggtgactctgcgagattgaacgccttgaagtcctccgtagacgccaaaattcaagccatatgccagaag

SEQ ID NO: 114912 - DNA, 432 bp, Glycine max
  Peptide Sequence Number=SeqID_231690
atgagcaacctgaagcttattctgcaaacatttataatagacctcctcagcaacaaaaccaacaacagcagagtaattatgacctttcaagcaacagatacaatccagcagcagcagcagtcacaaaaaagacaacaagcaactgaggctcatcctcaaccttccttagaagagttagtgaggcaaatgacctttcagaatatgtgtcgcaacatgcccttttgcgggcgagcgaggcgaggctcacgggtgcgctttccaaaggaggaaagatgcgcggagtcgccaccaacgtttatttgtggaaaacgtcggaaaaaccgaaggaaaccggtcaaaatgaaaattctaagttcgggagttgtatttacgtttgaggaaggtattagcacctctcacgtttgtctcaaaggacaacaacctattttttag

SEQ ID NO: 114913 - DNA, 342 bp, Glycine max
  Peptide Sequence Number=SeqID_231691
atgactactcaagcgctcgaatcccctactacaatgcacagacttcacactagatttcagattgcacgaacgttggcccttggagtggtcctcggtgggactcagagacaggagcgaacgattcgtcgtgattactacggaaaccaatccgtagaatcggggcagcaatggagcagcagcagcggcggtgtggcagctcacggcggcgcgtgtacagcacgcgcggttgtgcgaggcggcgcgtggggcagcgtgcggcttcggctcgtgcgttgctcctcgattcttcgatctacggtcttcctcctctcggatttcacctcgtatacttcgatctactaa

SEQ ID NO: 114914 - DNA, 186 bp, Glycine max
  Peptide Sequence Number=SeqID_231692
atgcaaggtgcatggatgcatcttgacttaaaagaatacaggaaaaatgggcttgatgatagaggaatctctatatcaaacttggaaaaagcaaaggagaactcaatctcttgtttctcttcaacacaactacgtagcccttgtgattttgcggagaagaacagacaagctgatcgtactggctaa

SEQ ID NO: 114915 - DNA, 366 bp, Glycine max
  Peptide Sequence Number=SeqID_231693
atgccgccactagctctggcgagaatgctgctgatgtggctgggtgccgccagcaccaattgcggttcaaggtgtgccgccactagctccagcgagatacttgctgacagggcaacccgccaataccaatggcgggacatttgcaacgtggatcggtcccgccattggttcttgcgagaccaacgtggataccatgcatgcgaggttctgccttcacgccttcacacaccagctactagggcactggttctgccttcacgccttcacacaccagctactagggcactgtttgcagagatgatcacacatgcatcgtgtaaattgcctttaaataagagcatttgtaagaacaaaatttcacactga

SEQ ID NO: 114916 - DNA, 202 bp, Glycine max
  Peptide Sequence Number=SeqID_231694
cttgagccctcttcactcggtgtatggggtgccccatacgcttatcaaggagcagaatcgtctcaggccacggtcagaagtcaagacaagtcaatggcaaaaatcaaccaagggaggcaaatggaggataggatcgcgaccgaccaatcgtcaccccttcccggcgctaggccagcggagaacatcgctgcaaggcagccca

SEQ ID NO: 114917 - DNA, 246 bp, Glycine max
  Peptide Sequence Number=SeqID_231695
atgtacatgattagattagggttgttggctctcaatgggtatgggtgcgaagttgtcgacattctcatcgggagagtgtgcaacattgggtggtgtatagttgggaagcaagccatatggtgggaaggaatgcttactctggacctacacaaaatgggggccgcccgtacttcccaattcttcgcctccctaacctaccatatccaggactggatgtgttggatcaagtggcctcggaataattaa

SEQ ID NO: 114918 - DNA, 486 bp, Glycine max
  Peptide Sequence Number=SeqID_231696
atggatagtgtgaagtttgaaagtagggcctcaagtttagatgtttcagtagcttcggtagacgccataggacacacaaacagaaccggcaacaacaaagaacgatacagcgaaagttcagataacaaagggagtgcaagcaatgcaactctgatggccactaaactccgggggttaggtcccaaggagggggcgtcgacgtacacatctgagcgtggctgtttggcgcatggtcaaaacgtgtgtgagggcatgtccatgtccagaaaaggatgtcatcaatggtgttgtgtagattggcgaactgtgattctgacgatggtgtcggtgccggaaaaagtcgtgggacgacggtggcagttcgtcggaaatttctcaaggaacagtgtcgacaaactgaaatgtgaaccagagagaaaaggctcatggatcgcaaaaaaaaactcctctggggacagtgggtcctccgggcaagcacggttttag

SEQ ID NO: 114919 - DNA, 474 bp, Glycine max
  Peptide Sequence Number=SeqID_231697
atgaataataggaaaatcatttccgatgactatagtatatctgttgctacattagttgaaggacgcattcttactgttgctggggtgactacagctatatgctcagcacctttcgttggcctcttaaatttagtcgctctagctgtttggccaaaatgggtggtggttgccatttgtgagacgctgagaaaggttgttacatatgttgtgacaaggcctggaagagaacttttgtttactgttgtttcagaggatgagaagtataaagccaaagtatgcatagatgtcttggttcaaagacttggagatgctgcagcagctggaatgtacaaaatgctttttggtactctcaacgggaacccatcaacagttcccctttatggcctccctgtttgtttgttttggatagttacagcattctctttgggtcgtcggcaagtgcaactttcaaagcaccagatctcctctacttaa

SEQ ID NO: 114920 - DNA, 303 bp, Glycine max
  Peptide Sequence Number=SeqID_231698
atgaaccatcattcgcaatttcttatccgtcttaaacacaaaaaaccagcaagtagagctactgctgatccaagactcattcacaactcacaagccttccttcattacctaaagaaaggcaaatcctccactagctatcaatatcttacaaattggtaccaacaaagcttgagttttaaaaataacctattgcgctcaatcctcaataattcaaaagatccattctcttacatagttgtgaagacattcccacagcataaaagcaaggaatttgaggaaaagattataattgaaaggttataa

SEQ ID NO: 114921 - DNA, 267 bp, Glycine max
  Peptide Sequence Number=SeqID_231699
atggtgacaactactgtacctgggcctccaatggcactttgtggattattggtcttgggtacaaagaccatctcaccagtgattccacacctgccattgagtgtgcacattgggagaaaattgatgcccaactatgcagcgccatcaagtccaccttacaccctgcactcaagcccatttttcgaccacatggcacttgtgaatcagtttggaccaaggcatgctctgtttccactaatcacacttgtttacactaatcagcactaa

SEQ ID NO: 114922 - DNA, 414 bp, Glycine max
  Peptide Sequence Number=SeqID_231700
atggggagctcaattggtgtttggcgcacaatggttaggtgcatgggaactccaatggggttgccgtccccaccgttgtgtagtttggtggatggcaatgctggtggtggggtcactggctggaaaggtcgttggagtggcagtcagaaaagggtaaatagtcgctggaaggagttcggcgagacagaggggcaaaaatctgattccaaaaatgaaaacaagactgatgagattcagaagactgaacatactccaagaggatttccaaagtcatctactttagtgaagcttccgttttggcccatacttgaaggactctggcttatattgtcatcaacctaccttttgcatgtgtcattgttcatctggctgagtgcagttgtctcttcattcttctattttcaggttaggtaa

SEQ ID NO: 114923 - DNA, 471 bp, Glycine max
  Peptide Sequence Number=SeqID_231701
atggaatgtcgaattgtcgatgtttcccgtgttaagaccaggagcggcacatgccgtatcacccacttggccagcagagacaaaatccgccttcgacggccgtcccttcttcctcctcctcgcgatctgaaccatcccgcgcgcgccctccgctcttgccccttgcttcgtctctcttccagtggggttttcgagggtctgaactctgaaaacggtgccgaggctgaaacagcttcagccgccgctctaagcagatcgaaatggcattccgacgacgaagacgacggcgatgccgagcatgaagccagcgcctttcaggaggtgaaggaggcgaagcagaagaaatcgaagaagccgaaggtgacggtggccgaagctgcttctagaataagcgccgatgatctcgacgcgtttctcgctgagattaccgtgagtgtttcgttttcgcaattgatctgttgtttggttcag

SEQ ID NO: 114924 - DNA, 861 bp, Glycine max
  Peptide Sequence Number=SeqID_231702
atggcagacccagcaagtttcatagcaagctggttaactccttcttacctcttcatcttggtcaacctcgtcataggcaccatagccatcacttctcgcttcagttccacgcccaaaaaccaacaagcccaccacccccaaccactcagctccttcaatacccatcatcaccaacccaactgcactcagccccaactccttccaataccctcactgttgcagcgagtcacgtccttcaacctctccctccacaaacaccaacccacacctccagaaacacaacatctgcatcccgaaccccaaccccaacctgaaaagccgccggaactgcttcggactccctcactcttggagcgactcaggtccttccataatctttctctccacaaacatgtccaacccgagccagagccagagccagaacctgaacctgaaaagccggaactggttcggagtccctcgctcttgcagcggattcagtccataaacttctcccatctctacagatccgacttcagtcaccgagatgatgaggatcccgattcgggttcggatccgggtcgcggttcgggaaaggcggcggagatgaggaaatcggcgagcgtgagagggggtttgacggatagcgagtgggaggaggtcgagaagcggaggccgcagacggcgaggccggttgaaacgacgacgtcgtggagagaagacgaagaagtagacgccaaagctgacgatttcatcaacaggttcaagaaacagttgaggttgcagaggattgattcccttctccgttacagaggagtactgcgtgctactaggttggtgtggcaaagttcttgtcttagtaatcatgtcatgtttgtctaa

SEQ ID NO: 114925 - DNA, 603 bp, Glycine max
  Peptide Sequence Number=SeqID_231703
atgactgtccctacaaaccaacatgatatttttcaatgtgttcacatgttttctatgaaacatcttgaaggacattcaaaagaagaatgcagtgtcttgaaggataagatcaaagaccttatcatgctaggccttttaaaagatttcgtccataaacctcaaacatatcaatctaataatgggtacaagcaagggaaaagagcgagacggggattcatggatgatgagcaacaacttcgacatgaaagagacccttacaacaagtacggtcggtcaacatggtttctccacacaaagcgtcggacatgttgtcaattacattcaccttggttgactttaaaagcaataaacccaattcaagatgatatcatggttattagtgtcaaaatcactaactgcatagtcagaacaacactcgtcgaccaaggaagctctgttgacatcttattctggaataccttcaaaaggatggggattactgagttcaagatcctcccacacgatgacccctatttggctgtgtcggagaaagggttgggacgaaaggaagtatttggttgtataccaagtttgaccatcaaggatcattataaaaagacttaa

SEQ ID NO: 114926 - DNA, 363 bp, Glycine max
  Peptide Sequence Number=SeqID_231704
atgggtgcagagaaacgcgagggactggaaccagagaaccaaaaaaaaattcataagcttttccctcattctcacgttgcttttcttctccccttctcatccaccattgaagcctccattaaagctccaaactttgctcaccatttctactccaaattgcaaaaggaagccattttcagagtcgtgaagctcacctctacgttgtgggacttcaaatttcaggtagaaaagtgtgagattttgagggttagagaagctaaatttggggttagtgtaaatgggagtctaaagacttgtgggaaagcttggactgagcaaatgaggaaaatgagtgaccaaagtgaaagcaagagccatttctag

SEQ ID NO: 114927 - DNA, 184 bp, Glycine max
  Peptide Sequence Number=SeqID_231705
gtgctagaagcgaaacacgacaagctattctcgcattagtaatagcgatatatgctcagaaaaagctggcctcttgccaccttctgctgcctctgcaagctgctctccacatcaccagattcaccaatgagaatggcggcatgcaggatcagcctatatcgccagtagctcctacgacttcctt

SEQ ID NO: 114928 - DNA, 306 bp, Glycine max
  Peptide Sequence Number=SeqID_231706
atgtatgtgcctgagttatacagtatcagaggcaaagaagttaacatagacaatcaaaggcttgagaagggagattatagtgaagtggaggatgttgacaaagagaaggagaaggaagaaaataatttaaagaagattaaggaagtgtcacatttttttttcctcagcaaggaagtgtcacatgaatgctcgttggtgaacaagcataaggccatttggatgacagagcctgaggagatcacaaaggaggagtattatgctttctacaagagtctcaccaatgactggaagagcatttgcctgtga

SEQ ID NO: 114929 - DNA, 801 bp, Glycine max
  misc_feature (21)..(21): n is a, c, g, or t
  Peptide Sequence Number=SeqID_231707
atgttccaacctcgcactctnttagatgcaaatggttatccagtatatcataggagaaatgatggtcgtataatttcaaagaatagtgttatcattgataatagacacaacgtaccttataatccaaaattactaaaaaaataccaagcgcatgtcaatattgaatggtgtaatcaaagtgcttcaatcaaatatttattcaagtacataaacaaagggtatgacagagtcattgctgttatgctttatgatggcaatgatgagatccaaaatgctaccaaccagaaagatgagattaaagaatatatagacggcaaatacatttctccatgtgaagctgcttggagaatttttgattttccaatacatgctaggaagcctgctgttgaaagattatatttccatcttccaggccaacacaatgttctttatgaggaacatgatgatattgatgatgtcttatccaacccaagcatttcagattccaaatttttagcttggatgaacgccaacaaatgttcttcagaaggaagaactctgacttattcagaatttgtttcaaagtttgtatataatcaaaagactagatcatggcaccttagaaagaaaggatacactattggaaaacttatatgggtcccaccaacgacaggagaattgttttatttgaggatgatgcttactgcctgcaaaggagcaacttcatttgaggatattagaactattacaaatattcaataccctacatatagagaagcatgctttgccatggggtttttacaagatgacattacaagatga

SEQ ID NO: 114930 - DNA, 354 bp, Glycine max
  Peptide Sequence Number=SeqID_231708
atgcaatcacagggacttgcactgcctccggagcctgaggttggtccctcagctgctcgtgttagcacaaaaggaagttgtgtcgatcccttattgaccgatccagagacgggtgactcagacaaatgcaggttgtacatcaaagcaaatccttcccacctagttgccctattaagagtttatgagggatccacaactgttcacaatgtccctttgttgcatggccaagtgaagattggtgttgaggaggttaaagatgcaaaggctcgtgttcctgtacccactgataagttgtgtatccagcaaagccttcagataggccagatcctgaggttgatgatcccctgtatctga

SEQ ID NO: 114931 - DNA, 159 bp, Glycine max
  Peptide Sequence Number=SeqID_231709
atggtgatcttagttttcctctatcaagctggtttgatcatcacagggattgtttacaagcgagctgagaaggtgggcagtgtggagagattaagaagaaataaagcaaatagctggtgggcaaatgctaaatggaaatcagtctgtggtgggtgttag

SEQ ID NO: 114932 - DNA, 258 bp, Glycine max
  Peptide Sequence Number=SeqID_231710
atgccttcagagttatcgactgactcaaccaagacaagcaccagttctgattcatcaacagctacaagcaagattgaatatccaacttacactaatccattaatcctaccgttcactgcagtattccacaatgatatggacattatagaagtgcccactttttaccaccaacaatgggcaccagaataccctgagtttgtcaactttagatatgatggaacaatataccaaatcaggctaaggcagcatcgggcaaaa

SEQ ID NO: 114933 - DNA, 561 bp, Glycine max
  Peptide Sequence Number=SeqID_231711
gcacaatcacgaacatggtcatttctccaagcaccaaaagaaataacccttaagcttattcgtgaccccgtgaccctttcactagcctcaactgattatggccacatagttcatgacaacccttttgcaatatttgctccatcttccattagtgacatctcactcttgataaatttctcaaattctctggccatccctatcaccatagctcctagagggcaagcccactcgattcatggacaagccatgacaaatgatggggttgtggtgaacatgactgagttgaatggctttagaaatggtgatgggattatagtagtgtctgatgacacaacagctacaactattggtccatatgctgacgtgggtggtgaacaaatttggattgatgtgttgcatgcaacacttgagcgtggacttacacccctctcttggactgattacttgtacttatcggttggtggaactctctccaatgctgggataagtggccaaaccttcaggtttggtccccagatttccaatgttcatgaattggatgttgttacaggtatgtattga

SEQ ID NO: 114934 - DNA, 498 bp, Glycine max
  Peptide Sequence Number=SeqID_231712
atggattgctgccacaaaatcactaaaacttggactgcactctctactcgtttcaaccatcatcgcaaatctagggtttccggtggtccagtagccggtgccggtgccggtgaatactctgccgattgcgacggaattagtcgcggtttgctgaagcttcgagatgatgtgcaaatgtgcgggtacagagatgctgaggtcatgtggaacatgctgaacgtaactttgcaacgtgaccaaatggaagcgcccagaagctccaaaaacgctaaatttcgcaagcagagatctatttccagggttttgttttggactagccataacagcgtcatgaatatcatgaagttcttgttgggttcctttgcaccgcccatgattgcggttttggtatcttatgcgatacaagtaaccgttcactttgtagctctctgcgcagtaatgattctggcgtgtatttgtggaggtgtttcgagtagtagtcatagccgaccaaagtga

SEQ ID NO: 114935 - DNA, 1281 bp, Glycine max
  Peptide Sequence Number=SeqID_231713
atggccgtaacgagtgaagcaacagtgttacgattacgaagcaattacatgagcatgggggaagctcatagaaggatcacggagtatctgaatcgcttttccgacgcgatttcttcgcaagacggagctacgttcaagtctctcttcgctctctcttccaactccccattccttctctctctgggcgacgctctcaacctcttccaagaccccaacagactcatcaagcaatccgacaactattcccagttcgcagacatcctcgtccctctcttccgatccctcctaaactaccgccagaacaacttgctcgaagcctataacgctttcgaaaaaaccgccaatgcgtttatccaggagtttcgtaattgggaatccgcttgggctctggaggctttgtacgtcattgtttacgatattagggttcttgccgagaaggctgataaagaattggcttccaatgggaaatcccctgagaagttgaaaggcgctggctccgtccttatgaaattttttggcacccttgcgggaaaaggctctaagcgtgttggagcattatatgtaacttgtcagttattcaagatttactttaagcttggcacagttcacctttgccgcagtgtaataagaagcattgaaactgcacgcatatttgattttgaggaatttcccaaaagagacaaggtcacttacatgtactatactggtcgtcttgaagttttcaatgaaaattttcctgctgctgattataaattatcgtatgccctgaagcattgcaatcctcaaagtgaagccaatataaggatgattcttaaacatctaattccagtgaagctttcaataggcatattacctaaaaacagtctcttggagaagtacaatctacttgagtatagtaaaatcgtacaagctcttagaaggggcgatcttcggcttcttcggtgtgcactgcaagatcatgaggaccggttcttgaggtcaggtgtatatcttgtcttagagaagttagaacttcaggtataccagagattagtaaagaagatttacatcattcaaaagcagaaggacccaggcagagctcatcaggtgaagttagaagttattgttaaagcattgaaatggcttgaaattgatatggacgtggatgaggtagagtgtatagtggccatactgatatataagaatcttatgaaaggttactttgcccacaaaagcaaggtagttgtattgagcaagcaagaccctttccctaaattaaatggaaaacctgtcaattcttag

SEQ ID NO: 114936 - DNA, 945 bp, Glycine max
  Peptide Sequence Number=SeqID_231714
atgattccagcctatcgccactcagtatcttctgttatgcctctggatcttaatgaagatcaaaaccacgagttcttcagtccaattcatcacccttcctcttcgttttcttctctatcttcatcatatcctattctcttcaacccgccaaatcaagatcaagaagctcgatcatacgactgggaaacaacaaagcacttaccaagtcatgaagaagaggctgagaagattatccctactagtggatcatggggtcactcggtggaagaaagtgagcataaggtgacagtttggagaaaagaagagaggaatgaaaatcttgctgaagatggttcggtgaagtggatgccttcgaagatgagaattatgcggaagatgttggtgtccaatcaaactgatgcatacacttcagacaacaacactacgcacaagtttgatgatcataaacaacaactgtcgtcaccgcttggaattgatgataacagcagcaacaactattcagacaaaagtaacaacagtattgttagggtttgttctgattgccacaccaccaagactcctctatggaggagtggaccaagaggccccaagtcgctttgcaatgcctgcggaattcgacaaaggaaggcaagacgagccatggcagctgctgcggcggcagcattgggagatggagcagttattgtggaagctgagaaatctgtgaagggaaagaagttgcagaagaagaaagagaagaagacaagaattgagggtgcagctcagatgaaaatgaagcggaagcttggagttggagcaaaggcatcacaaagtagaaacaagtttggttttgaggatttgacattgcgcttgagaaagaacttggctatgcatcaagttttccctcaggacgagaaggaggctgcgatcctcctcatggctttatcttatggccttgttcattga

SEQ ID NO: 114937 - DNA, 249 bp, Glycine max
  Peptide Sequence Number=SeqID_231715
atggcggtatggcataacaggtttttcaaaaaatgccaccaaatagcggtggcgttgcgggtttcatatgacagccgccatagccttaacgaccgtggcagaacggcagaaatggggatgagcagcacgagcaggaacagcaacatgcgaactccagcggcaccacgcgaacgctacgcagcaccctgcaccacgacggcaacgacggcgaactccaccgcgacgacaaccccagcaccacgcacatga

SEQ ID NO: 114938 - DNA, 297 bp, Glycine max
  Peptide Sequence Number=SeqID_231716
atggagattaatagaagaacagcacaaaaatcgcataagggcaaagccagtgttgaagtttctcctgaatccatcacaagttcaattgatttcaattataatgatttctttgtgcctgtcacaacacctgtgaaagtgcaggctcctattcctgaagaacaatgtgaaattttccagtggatgctggaagagaaaagaaaactgaaacctaagaaccctcttgagaaaaaacaaattgacgaagataaggccattcttaaacatttcctgcgtgcaaagtcaattccaaagttttaa

SEQ ID NO: 114939 - DNA, 957 bp, Glycine max
  Peptide Sequence Number=SeqID_231717
atgggtcccagttctagactccaaggtctcagtgtagctttggattttcaaatgtatataagggagttgcagcctcctcacaaatccacgcacctcaactaccattttacagcctctgtgacttatgatcacaaagccattgttatgtggccagaccttattcaaaaggccaaagatggaggcttagatgttatccaaacctacgtgttttggaatggacatgagccttctccaggaaagtattatttcgaggataggtacgacttggttaagttcatcaagctggtgcagcaagctggcctttctgttcatctccgcattggtccctacatatgtgctgaatggaactttggggggtttcctgtttggctcaagtatgttccggatattgctttcagaacagacaatgaacctttcaaggcagcaatgcaaaaatttactgagaagattgtgagcatgatgaaggcggagaaattgttccagacgcagggaggtccaataattatgtcgcagatagaaaacgaatatggaacagtggagtgggaaattggtgccccaggaaaagcttataccaaatggttttctcaaatggctgtgggtttagatactggtgtcccctggattatgtgcaagcaacaagatactccggatcctattattgacacctgcaatggatactactgcgaaaactttactcccaacaagaaatacaaacccaaaatgtggacagagaactggactggctggtacactgagtttggaggcgcggtccctcgtagacctgcagaagacatggccttctcagttgcaagattcgtacagaatggtggttcatttgttaattattatatgtaccatggaggaactaactttgatcggacatccagtggcctcttcattgccaccagctatgactatgacggtcctattgatgaatacggtatgcagagtatataa

SEQ ID NO: 114940 - DNA, 882 bp, Glycine max
  Peptide Sequence Number=SeqID_231718
ttgggaagaaaagtcacaagaattgaatggcagcccgatagacacgaggcgatgaatttggaaaatggaagaacatgctctaggcctgtgatgctacatttctgtgatggctctattatgtctgcggatcatgtcattgtcacagtttcacttggagtgttgaaggcttctattcgtgatgatgattcaggtatgttgatgtttaatccccctttaccctctttcaaggccgaggctatttcaaggcttggttttggtgttgttaataagttgtttatacaattgagtgagcctccacatgagagaaaagacgaacatgaacactccaaagggttccccttcttgcaaatggtttttcactcacctcaatctgagttgaggcacaagaaaataccctggtggatgaggaggacagctaccctttgtcccatttacaacaattctagtgtcctcctatcttggtttgctggggaagaagctttggcactagagtcactcaaagaagaagagatcattgaagggatttcagacacaatttcatgcttcctatcacattcacttgagttttgcaacgggaatgtgaattctgagaagtactctcacgaatacaaggtgaaattcagtaaagtgttgaagagccagtggggaacagatccattgtttttaggctcatacagtcatgtggcagttggatcaagtggtgatgatttagatacaatggcagagccattgccaaaatgccacatttctgcttcacccccacttcaaatcttgtttgcaggggaagcaacccacagaacccattattctacaactcatggagcttacttcagtggccttagggaagccaataggcttcttcaacactattcactgtgttaa

SEQ ID NO: 114941 - DNA, 1425 bp, Glycine max
  Peptide Sequence Number=SeqID_231719
gtacatgtgttcaagacttctggtgcttgtgctgcattccttgcaaactatgacaccaaatcttccgcagcagttaaatttggaaatggacaatatgacctaccaccttggtctatcagcatccttcctgactgcaaaactgcagttttcaacacagcgaggcttggtgctcaaagctctctgatgaagatgactgccgtaaacagtgcatttgattggcagtcatacaatgaagaggctgcatcgtccaatgaggatgattccttgacagcatatgcactctgggagcagattaatgtcacccgagattctacagattatttgtggtatatgacagatgtcaacattgatgcaaatgaaggttttataaagaatggacaatctcctgttcttaccgtaatgtcagcaggccatgctttgcatgttttcattaatggtcaactttcaggtactgtgtacgggggactggactctcataagttaacatttagtgacagtgttaagctgagggttggcaataacaagatttctttgctaagtattaccgtgggtctcccgaatgttgggccatactttgagacatggaatgctggggttttaggcccagtcacacttaagggtctaaatgaggggactagagacttgtctaaacagaaatggtcttacaagattggtctcaagggtgaagccttaaaccttaacactgtaagtggtagttcctccgttgaatgggtacaaggatcattattgactaagaagcaacctttgacatggtacaagacaacttttagcacaccagcaggcaacgatccgttagctctagacatgattagcatgggaaagggtcaggtatggataaacggtcgaagcattggacgccattggcctggatatatagcacgtggtagttgtggggattgttattatgctgggacttacactgataaaaaatgccggacaaattgtggagaaccatcccagagatggtaccatattcctcggtcgtggctgaacccaagcggcaactatctggttgtgtttgaagaatggggaggtgatcctactggaatttctttggtgaaaagaacaacagcaagtgtgtgcgctgatatatttgaagggcaaccaactctgaagaacaggcagatgctagactctggcaaagttattagacccaaggctcacttgtggtgtccacctgggcaaaagatctctaagattaaatttgcaagttatggattgccacatggaacttgtggaaacttcagagaaggaagttgtcatgctcacaaatcatatgatgctcctcaaaagaactgcattggcaagcaatcttgcttggtgactgtagctcctgaagtttttgggggagacccgtgtccgggaattgcaaagaagttctcacttgaggcactatgcagctag

SEQ ID NO: 114942 - DNA, 228 bp, Glycine max
  Peptide Sequence Number=SeqID_231720
atgtcttacctgggtcagacagatatagatcgttgtcgtggcaaaatgggtggatttattgtcctctgttgtctggctttgagtaatctcgtgagacaaagttatgaagcaacatcttctaggaaaagtcgttcacttgttcaggagctgacaactggtgcagtggcttcagtcttcttgggttttgggtccttgttcctcctacttgcttctggtgtttatgtctaa

SEQ ID NO: 114943 - DNA, 2936 bp, Glycine max
  Peptide Sequence Number=SeqID_231721
gaccattctataagcctccaaagacatttccaccttctacaacagctccatcccctcagaagattaaagacattgaaccatccaaatctccaagtccgagcaccatagcattatcaccaccatatgcggttgttcccttgccatcagcagttcaagggaacaagccaccacctgttaaaacaagtccacctcaaagggaagcgcctactgttaggcctcctttctctacaccaactgctccagctccagttgcaatatcttctgacagatcaccaaaaatttcaccagtcagccaaccaattgaacatggacatttgacacctgatgtggataataggaatgcaaataacagtcaccttgcagagtcattttcaccagcaccaggtgcagtaccttctgctaatttgcccaaaaattcatcagccagccaaccaactgaaaatggaacttttcctcccaaagaggcccctgtagcagttaatttgccaaaagagtcaccagtcagccagcctcctgaacatgcaagtttgccgccaattgtccatcaaaggaatgcaaatatgggtcacaacttgaagcctgtttcaccagcctcagttgctatacctcccacaacttacaaaataacatcaatggacagtgaaccaacgacacagcatggaagcattccacctaatgttcataaaagaaattcaaataaaggtcacacttctgagacagtttcaccaggtagtacagaacctgttgcatccccaccatggaaagtggaaaatagcccaccagagacccacccaattgtcccaacaataactccatccacattaactgcaccagttacatcacctccaagtgcatttccattaaaaccaccattggtccatccgattgttccagtagcatctccatcaaaattaccagaaaaagattttggtgatgtttgcgtgcaagatgtctgcataattagacagaaaatttgctactggacatgctggagaaaatgttactttgccacacctgtttcctctcccactcctttgagaagcttcaattggaagaagggtggagcaccagttgttgcacctttgtccagaaatccaaagccacttccagctgtaatacactcccctgctcaagctcctgtagcacaaaaagcaaggcaattacatcatgcccctgagccattgatttcatctcctaaatcttcttccaataaagaatatcattatcctccattgtcacctacatcctcattttataaacatcctcatacaagggagataattggcagcccttctcctgcatcatcatctatggtttctcctcccacttcaaaacaccaagaagcagcaattcctcccttattgccaccaagaagtggacaaagacatcatgtttcaccaccaatcaactcaagttcttcagtttccccattctcttcccctattcattcaaatacgggtcaagtttcacctgctccttctccatcaatcaaatttgcatctcacccaactggaagcaccatttttcctcctaaagtagctccatctgagtcttcttcaaagagacctaagatgccactcttgcctcaagttcaagtgctgccaccgccgcctcctaatgaagattgtatatcaactgtctgcacagaaccttatacaaattctccgcctggagaaccttgcagatgtgtctggccgatgcgtgttggtcttcgccttagtgtttctctttataccttcttccctttggtttcagaactagcttctgaaattgccactggggttttcatgaaacaaagtcaagttcgcattatgggagcaaatgcagcagaccaacaacctgagaaaactgttgtccttattgatttggtgccacttggggaagagtttgataatactacagccttttttacttctgacagattctggcacaaaatggttattataaaagctttctactttggagactatgacgtgttatatgtgagttatccaggtttacctccttctcctcctttacctccttcaagccttaacatgttcaatggaggtccatattccactgatggcaataatggaaggacgataaagcccattggggtcgacatactgaagagacagcaaaaagttggacttagcagaggcataatttccactattgctgtttctgtttctttagcagttgttttatgtgctgctgctgcctgggtcatgttcaagttcagagatcatgttagtcagtcagcatcaaccccacggcagctttcaccaccttctcttaccaaagaaccaggtactgcaggatcacttagaggtgcgggtgcaggagttggttctgtttccacatcatttcgatctagcattgctgcttatacaggatctgctaagactttcagtacgaatgacatcaagaaagctactgatgatttccatgcttcaagaatacttggagagggcggttttggccttgtttacagtggtatccttgaagatgggaccaaagtggcagtcaaggttctaaagagggaggaccatcatggtgatcgtgaattcttagctgaagttgagatgcttagtcgtcttcaccatagaaatttggtcaagttaattggtatatgtattgaaaacagcttccgcagccttgtttatgaacttgtaccaaatggaagcgtggaatcctatttacatggggttgacaggggaaacagcccacttgattggggtgcccggatgaagatagcacttggtgcagctcgtggcctagcttacctgcatgaagattcaagtccccgtgttatacatagggacttcaagtctagcaacatattgttggaagatgattttacaccaaaagtatctgattttggactggcccgaacagcaacggatgaggaaaacaagcacatatcaacacgtgtcatgggaacttttgggtag

SEQ ID NO: 114944 - DNA, 219 bp, Glycine max
  Peptide Sequence Number=SeqID_231722
atgggggtggttttggccttgatgctgcagctctgcatcattgcctttgctgtgacagctcaagagttcaaagggtccatcatatctccatctccagcatttcttccagtcgttcctcctggtgaagaaacacttggtcctatttatcatggagagggaagcaaagcaccaaacctgccatcagatggagatggtatatctcatacaaaatggccttaa

SEQ ID NO: 114945 - DNA, 1929 bp, Glycine max
  Peptide Sequence Number=SeqID_231723
ccaggtcgctccgacgcaacggtgagcttagttagtgtgaagaggttccgtcatcgtcatggcccccagaatcctactatgcggcgacgttttaggccgcctgaatcagcttttcaagcgcgtctcatcggtccattcgacgccctcttgtgcgtgggtcagttcttcccggactcaccggagcagctcgaggacttcacgaaatacatcgaaggtgggtcccactttcctctcccgacgtacttcgtcggcgactacggcgtcgccgcccccaaacttctcctgcaagcttccaaggactccgccaaccaaggcttcaagatggatggcttcaaggtttgccacaacttgtactggctgaaaggcagtggcaaattctccctcttcgggttatccgtggcctatttatctggtaggaagtcttccagtgctcaacagtttggaacttacactgaagacgatgttgatgcattgcgagcaattgccgaggaacctggaattgttgatttgttcttgacatatccttcaattcatgtgcattactcacctgattcggacattcctgccggactctctgatgctgcaggcggtgattcaaccgtatcggagttagtacaagagatcaaaccacgttatcacattgcaggcactaaaggtatatactatgcccgcgaaccatattccaatgttgatgctgtgcatgtcactcgtttcatagggcttgcgtctgttggaaataaagataagcagtgctgtaacattttatttgcttctacatttcagaaatttattcatgcaatctcccccacacctgcatccaccatgtcttcaactgagattgccatgaaaaccacaaataccaccttatcaccatacacatatgaggagaaaagaacttctccaatggattcaacaaaaagatccagtgattctatctctgatcctcaatattggagatatgatgtttctcaaaagcgacaaaaacatgaagctggacacggtgataaattgtgtttcaaatttgtttcttctggttcttgtccacgaggagagaagtgcaattttcgacatgatacagatgcaagggagcagtgtatgagaggtgtttgttttgattttttgaacaagggaaaatgtgaaaggggtccagattgcaactttaagcacagcttgcaggatgagggtggtaggcttccttctaggaggcctggatctggcagcccaaatgtggagtcacatttaatcataagcattggggaaaattactacttggcactggctaaaggtccacttgttgaagaccatgtactgattataccagtcgagcatatgcctagtaccttatccatgtcttctgaatctgaaatagagctctctaggtttcagaacagtctcaagagttactgcaagagccaagagaaggaagtcatcttttttgagtgggtctccgtacgtggcactcatgccaatattcaggccattcccattccatcttccaaagcaattatggccgagaaaattttcaatttagctgcacagaagttgggatttgaatttgtgactaagaaatggggtgtttttgattttttgctacattcttatgttgttcttttatgcaactcagttgatagcatttctgaaggaaggaagtttttgaaggcgcaaattgatggggattcaagcttgttctatgctcaaatcccaggaggcacaattctgctgcatcatgttgaagagaaagagaaatttcctgcccaatttggtcgtgagatagagttaacactagtgaacatgaatcaggttctggctgggttgcttaatatggcagataatgctgattggaggaatcgcaaacatagcaaagatgaagaaatgaaaattgttgaagttttcaagagccgatttcaagaatatgatccaaactgttag

SEQ ID NO: 114946 - DNA, 420 bp, Glycine max
  Peptide Sequence Number=SeqID_231724
atgagccatgggcgcctgtatcaacaaaggataaagaacgcattcgacaagaaggtatgcccatgcaagttcaacgagggggaccttgtgctgaaaaagatatcccacgctgttaaagataatcgagggaagtgggccccaaattacgaaggacctttcgttgtgaaaagggctttttctgggggggctctagtgctcaccaacatggatgggattcctgtccgctgttattgtctcgccacagtctttaaaagaagagaatatgggtctgaggcttcagtcctcactttggggcagaatcgtcttaggcaacggtcagaggtcgagacaaggtcaaaggcagaaaccaatcaaggtacttatggacggacgcaaggagaggctagggtcatgaccaataggtcgtcatcctttgcctag

SEQ ID NO: 114947 - DNA, 291 bp, Glycine max
  Peptide Sequence Number=SeqID_231725
atgagaattactgagcaagctggtgttgtgctttctcttgatccaaaaccaatagagggtgattggaatggagtgggatgccacaccaattacagaatgttacatgtgaagaaaactggaagaggtcaaaaacgtgatatgcttacaattaagtttcttaaaaaatttatccactatgctaagcataggattcaacctgaactgactgatgaggcatctgagaacattgccacagcctatgttgagctcagaaattcaagttcaaatgcaaaggttagcattgggaattga

SEQ ID NO: 114948 - DNA, 489 bp, Glycine max
  Peptide Sequence Number=SeqID_231726
atggaagccacactaagcatgagaagattaatagaaagtaacgcaaccacagctgccgctgccagtaccactgctgagatattggggagcaccagtggcccacatcgagggtataacagaaatttctacccctacagcttaccctcgaatttcacaccgcccaccatgcatgagaacgtggatcatgccgttcccgtaacctttgaaggtcagcttcgccagcctatagggggcacccacgaagagcccaggagcaagcccaagttgacgttgactcggggaccacctccggcagcggagggaaaaggaaagctcgatctcatcgaagagagattgagagcagtcgaagggtctagggattacccttttgcttatatgaccgacttatgtttggtatccaatgtcgtcattcctcccaaattcaaattaccggattttgacaaacacaaggggaccacttgccccaagaagcatctaaaaacatattga

SEQ ID NO: 114949 - DNA, 135 bp, Glycine max
  Peptide Sequence Number=SeqID_231727
atggctaggagggtggcatatttcattcccactataaagtcaccgtgtgctctaaaaattctgttgcctgcacagatgagtatggctgttgtagccataagggttgaccccatgattacgtttcgaagagactga

SEQ ID NO: 114950 - DNA, 324 bp, Glycine max
  Peptide Sequence Number=SeqID_231728
atggttcttaaaggaattgtcgcactagtggaggatggtcgttttgatggcgtggttcaggattatggtggagaagtcgggttgggtgccatcgtccagcttcggggagaagttgaggtctttgcagagttgaacgacgaggcgttcgaagcattgatcagacatgttcttggcatcaacattgatccagaatctcttgaaatagcttccgataatgcagatgaacttgagctgctggggcttgccttgaatctccaggactgttacgttggtgaatttggcaaggatgtctgtgaatcgaaggcttcctgcttcaaatggtag

SEQ ID NO: 114951 - DNA, 2457 bp, Glycine max
  Peptide Sequence Number=SeqID_231729
atgatgcaattcttgagaggccttaatgatcaatatgctaatgtgtgttctatcattctcttaatggatctgttacctctaatcataaaagtgttttcgtatgtcgtgcaacaagaacgacaaactcttggtagtgctagtgtccttggtagtctcaatcttgaatccagagattattctcagttaatgctcaataacaagaacaatcagatctgtagtgctaagatgcactctcattgtggtaggattggccacactatagatgtttgcttccgcaaacatggttatccaccaggatataaattccataacatcaacagctcagtgacaggtgatatgcaagtcactgcaattgatcaacaaagtcaggacactcatgctccaagcttcacatctcaacaatatcaagcattgttggccttaatacaacaaccaagtcatggtgcttcctcatccacacctcatgttaaccaaattggtacattctctccatgtcttggtattagtacgtcaaccaatttaggtaatctcccacatctcttttgcaattctgtttcaaattctactgcaccttggatcttagattcaggagctacaaaccaaatgtcttcatccctagccaatttttcttcatatgtctcaatcaatcctatattgtttaagttgccaataggtcaagaagtcttagcaactcattcgggtgttgttaagttctcatattcttttcttctaactaacgttctctacattccttatttcaccttcaaccttatttccatttctaaactcccttcttctttaaattgcaaactgactttcttctctaacaaatgctttatacaggatgcgatcactaagaggatgattggtacagttgatgtggttactggtctctacatgctcaatgcctctcctatccttcattctgtcaacaacactctctccatgttacgtgtttttgggtgtctttgctacacttccactctcactactcatcggaaaaagcttgaccctcgtgctcagccatgtgtctttctcggttttaaacctcacactaaaggttatctcatttacaatcttcattcccgttcatttgaggtatctcgtaatgtgacattttatgagaatttcttcccttacttccagcccaataatgacttctctcactcttcaaacacaccattctcaaatacttttatcctttctccccttgcttatgttgatgtcccttttccttcacatgacacactttcatcctccaatattgcacctcataattcagcttctcaaccatcttcctcacaacccctcgttcctcttcgacgttccactcgtcgtacacaacaacccgcttttcttagacactatcatattgcattcacatcaactggtatcgttccctctccagatgtcaacaatgctttcttacacaatactcttgatgaagagatctatatgcagctgcctccgggtttaaaatctgccaaagctggccaggtttgtcgccttcagtgctccctttacagtttgaaacaagcaagtcgccaatggtactctcgcttgtcctctttcctactttctcatggttacaccctctcctatgcggatcattcgctctttctcaagagatattcaaattttgctttcacagctttgtttgtatatgttgatgatattgttctgtcaggaaattgcattgatgagatcacttccatcactgctcagcttgatgcaactttcagaatcaaagattttggtgatttacgcttctttcttgctttagaagtggcccgtagcacaaaaggcattaatgtatgccaacacaagtatgctcttgatctccttcatgatactggtttacttggtgccaaaccagctagtaccccctctgattattgcaccaagctctcccaagactctggtgaccctcttcctgatccatcttccaatcgtcatttgattggtaggttgatttaccttatcactactcgcccagatattgcttttgttgtccggcatttaagccaatttgtcaactcacccacaactgctcatcatcaagctatttttcgcatcattcgttatctaaagcatgccccaggctcaggtttattcttcccttccaccaaccatgctcaactcctcgcatttagcaattctgactgggctagatgtgcagacactcgccattttgtgactggtttttctgtatatcttggttcttctcttgtttcttggaggttgaagaagcaagctactgtctctcacaactctgctgagtttgaatatcgcactcttgcctcaattacctatgaaattcaatggctcacctatcttttagaagacttcaaactagttgacatctacacaaaagctttgccacctgcttcattccacaccttcctctccaagttgggaatgtctaacatccactcccaacttgcggggggatcttag

SEQ ID NO: 114952 - DNA, 171 bp, Glycine max
  Peptide Sequence Number=SeqID_231730
atgattctggtttcagggattcctcaactgtgccaatgggtctgtgtttccaatctcaaaaatggacctttttcagagcagcaccattccccctcctcctcctcacacaaacttcacaaaaagaaaaggagaagttgtttgagggaattggagaacacaagaggcacatga

SEQ ID NO: 114953 - DNA, 357 bp, Glycine max
  Peptide Sequence Number=SeqID_231731
atggcaactgaacacaagaatgccatcactggtccacagatccaaaggagaagggcaagtcctgtgtgtaaaatcctgtttcccacaatattcaaaaaagtggcctttcttaatagctcagtcaaatactttggggtaaccaaggtcatgatggcatcttgtggtgtgcaaatgagaatgcttaactgggtgctgcttatcattgctccaaggccacagcagagaaggatgcttgtgctggccataaagattgatcccatgatcatgttccgaatattttggatagctacaatgttattcttttcaatatccttcaataaaattcatacatcaaatttgaaaaatactgaatggtag

SEQ ID NO: 114954 - DNA, 168 bp, Glycine max
  Peptide Sequence Number=SeqID_231732
atggagtggaggacatgttatctggatatgacactgatacctttggggttactcataaacattggctaccatgtttggttatgtcataaggtcaggacacaggcttccttaaccatcttcggaatagatgccgatggccggtgttcgtgggttcctgccatgatcaag

SEQ ID NO: 114955 - DNA, 171 bp, Glycine max
  Peptide Sequence Number=SeqID_231733
atggcatgtgttgtatggcatgccaagtggattgttgacttgccatcaatgttgggtgacatggacgacaaattgaggtttatgaggcaaaagaggaataacggactacaaattgaggtttatgaggcaaaagagatcgagcatggcggcactagtgagggtgctcaatga

SEQ ID NO: 114956 - DNA, 483 bp, Glycine max
  Peptide Sequence Number=SeqID_231734
atgggatcaaccctaatggccaccacggccattctcctctcagctggcttggcagcagtaataagcagcacttacagtgtgaaaaagcctcttgatgatgctgtctatggtgctcacagcgaattcatggtagcactaaaatacgtgacactcctcaccatattcttgttctcatttttctgccacagtctctcaattaggttcctcaaccaattggccatcctcatttgcgcaccacaagatgcaatgtcattggtgaccccagagtacttaaccgagattttggagaaaggaacttttttgaacactgttgggaacaggatcttctactcagcacttcctcttttgctttggatctttgggccagtgctggttttcttgtgctctattgcaatgttgcccgtgttttacaaccttgactttgtttgtgggagagtaaaagcaaagatggtggtgatcaatgataaaagtgactttgcttga

SEQ ID NO: 114957 - DNA, 144 bp, Glycine max
  Peptide Sequence Number=SeqID_231735
atgcctattcctgagtatcaaattacacacaatctccaaactcaccctctacctcccaaggagggaggagaggaggaggtggcagaagatgtacaatgtggaggttggatcgcgacaggcgttgaactgaggaggctatggtag

SEQ ID NO: 114958 - DNA, 1570 bp, Glycine max
  Peptide Sequence Number=SeqID_231736
atggccggacatcagcgtctctttgatgagatcgaagctgacgcgatcgccgtcaatggcggtcaccgtcaggcagcacccgttgtgcgctaccgaggcgcccagcgccaggccgggcagcagctcagcaggcaagcgcacggtgtgggtgcggaacaactctttttcttcaatggcgacaatttctgccgtgccctgcacaattccgcttgcgccgcaaggtttaatttgccggcgcgcaaactttacacaaatggcgcagccaaatgcgatcaatgtttggcggaagtgcgggctaccgctacactagaagcgcgtcaattgctggccctcgcgatcccggtcatccttgctcaggtggcacagaccgcgatgggatttgtggataccataatggccggtgcggtgagcgccacggatatggccgccgttgctgtcggcacctctatctggcttcccgccattttgtttggtcatggtctgctgctggcattgacgccaaccgttgcgcaactcaacggatccgggcgacgcgaacgcatcgcagaacaggtgcgccagggttactggctggcggcgggcgtggcgctgctgattatggtggtgctgtggaacgccggctacctgattcacaccatgcatgacattgatcctcagctggcggccaaagcagaaggttatctgcacgcgctgctgtggggcgcaccgggctacctgtttttccaggtggcacgtaatcagtgtgaagggctgtcgaagactaagccggcgatgctgctgggtttcctcggcctgctgaccaacattccgctgaactatgtgtttatttacggccattttggtatgcctgcgctgggcggcgtgggctgtggcgtcgccaccgcgtcggtttactgggtgatgtatctggtgatgcgcttctggctgaagcgcatgccggccatgcgcgatatccgcatgcatagccgctggtcgccaccgtcgcgcgccatcctgacgcgcctgttcacgctgggattaccggtcgcgctggcgctgttttttgaggtcacgctgtttgccgtggtggcgctgctggtgtcgccgctcggcattgtgaaagtcgctggtcatcagatcgcgctcaactttagctcgctgatgtttgtgctgccgctgtcgctcggcgtcgccaccaccattcgtgtcggctaccgtctgggccagggctcagccgaacaggcccgcatcgccgcgtggaccggccagggcgtgggtatcaccatggcggcgatcaccgcgctgtttaccgtgaccttccgccacgatattgccgcgctctataccgctaatccggaagtgattaccctggcggcacagctgatgctgctggcggccatctaccagttctctgattcgattcaggtgatcggcagcggacacgcgctcgatcttctttattaccctgatcgcctactgggtgctggggctgccggtgggttacgtgctggcgctgaccgactgggtggtggcaccactggggccagccggtttctggtgcggatttatcgtcggcctgacgtcggcggcg

SEQ ID NO: 114959 - DNA, 198 bp, Glycine max
  Peptide Sequence Number=SeqID_231737
atgaattaccagagattaccaccacaaagaacaccaagaaacagcccaaacacatcaaacttgacaaatagtgagagagcatctcagaatagacaagataggatgcctgttaggacacatgccaaggccccagagacaaagctcagagagagggcagctgatcaaacatttctgagacagcttgtgccatcaccttaa

SEQ ID NO: 114960 - DNA, 162 bp, Glycine max
  Peptide Sequence Number=SeqID_231738
atggcttcaaactcccagcaatttaagaacatatcggacatcctcatcagggtattggatgcacaagctttcataggatcaaagggttgtaagtcagatggattgcctctagtcatacactatattcagcatgcacaactagttgccttcttatgcaagtaa

SEQ ID NO: 114961 - DNA, 258 bp, Glycine max
  Peptide Sequence Number=SeqID_231739
atgcaaggggcggaggaggggaggaaggggaatctggcaatgacggtggaggttttcgaggtggcgccggaggtggcggtggtcgagttttctaagtctgccggagatacgttggagtatgttaggttctgtgatgagcaagtgaggccttctctcaaagacattgtttggagctggcaggtgtggatcgagtttgtgacggtgtttgatttgaggatactagtagcaaaaataaccccgcaaattgtggaaaagtga

SEQ ID NO: 114962 - DNA, 651 bp, Glycine max
  Peptide Sequence Number=SeqID_231740
atggcgcaggagccggtgctgttcaattcgcagtttggcacttacaccaatttcaccaacctggccgatctgagcgcgctggcgctgccggggccgctgcgcgaagacgggctgccggcgggcatcaccctgattgcgcccgcctggcatgaccgggcgctggcggcgtttggcctgcgctggcaacggcaaagcgccttgccgctcggcgcaaccggccgggcattgccgccgcagcccgcgccggcgccgtcttcgggacacgtgcgtctggcggtagtgggcgctcacctcagcggtatgccgctcaacgtccagctgacgcagcgcgacgcggtgcgggtggagcaaaccgtcaccgctccctgttaccgcctgtacgcgctggccgataccgagccgccgaagccggggctggcgcgtgtggcgcagggagcggcgatccgtcttgagctatgggacatcccgctggcccgtttcggcgagtttgtggcggaaattccggcgcccttgggtatcggcacgctgctgctggcggacggccggcgggtgaaggggtttatctgcgaagcctgggcgctggaaggcgccacggatattaccgagtttggcggctggcgcgactatctcgccggcgttaagggggcatga

SEQ ID NO: 114963 - DNA, 198 bp, Glycine max
  Peptide Sequence Number=SeqID_231741
atgtcagtgaaaaaccacgtcgggcgcctaggagtacatgacaagacaaaccacacactagcaagtcaagtcactctaactaggattgacacatgcttaaaggagtactcaaactgggtgacccccaaagcctacactccgaagagtccgtcaaggcctctccctcctgatttaggtccaacccataaaatattttag

SEQ ID NO: 114964 - DNA, 180 bp, Glycine max
  Peptide Sequence Number=SeqID_231742
gtggacccttgggtactagtacctatcacctttagaggactatatatcctcaccatcagaggactgcacatcctcgactgcagagggctgcacgccctcgcctttagagggctacgcgtccttatttttagtgtgctccatatccacaccttaggagaatataaggtcctttgcccttag

SEQ ID NO: 114965 - DNA, 444 bp, Glycine max
  Peptide Sequence Number=SeqID_231743
atgaaaacatgtcggtgtcggtctgatgagaatcctgaaattggccaaatacaggctaaaggcccaagtggagaagggcgaaggcccaagtggagaaggataaagcccccgagtgaaacttttggcattttcataaaattgggtgagagtttctctccgggttccttgttgaaccaatatcagacttatcaaggtaatccttgtggcgtctacccagacttatcttccttcattggaagtggcgtctatcctgacttatcttccttcaccggaagtggcgtctacccagacttatcttccttcaccggaagtggcgtctaccctgacttatcttccttcaccggaattggcgtcatccaaaccttcgtagcctgtatcaagcgatccgctcctactcagtttcacatcacggtcgaactagaacttcggttgagctcgaattaa

SEQ ID NO: 114966 - DNA, 261 bp, Glycine max
  Peptide Sequence Number=SeqID_231744
atgtcggattcatgtgtatcacatatcgagacgctcgaaattgaacaacgaaagctctcgagatattcaaatggtcataacttttcacacggaggtccgattcaggcgcataatacatcgagatgctcgaaatggaacaacggaagctctcaagaaattcaaatggtcgaaacttttcacacgaatgtccgattcaggcgcattgatgtgaacctgagtaggagcagatcgtttgatacaggctacggaggttttggatga

SEQ ID NO: 114967 - DNA, 192 bp, Glycine max
  Peptide Sequence Number=SeqID_231745
gttgttaaaattgcaaacacttgaccagacacttgtgagcagagagaaacaccagctttgtaaggaaatgcaaagaggccggtcaaaggatcaaggaattgaagtcatggagagtgttggaatgcttggaacttacttgagaaaaattttgcttaagaatggaataattttatttgcttggggacaagcaaa

SEQ ID NO: 114968 - DNA, 177 bp, Glycine max
  Peptide Sequence Number=SeqID_231746
atggcctccatcattgtggccattttgctctttcatggcctccatttcggccttcatcttctcttgcacctcctctgcttcacccattactttagctctagcacgagttcgggaaagaatgcaatgagcaatgcaaacaatgaaaagcatggatgtatgcgaatgaagtacagttga

SEQ ID NO: 114969 - DNA, 201 bp, Glycine max
  Peptide Sequence Number=SeqID_231747
atggtggcaaggttccgtggtgtaacacatgatagagcaagaagactgttcactgttcccgtgtccctaattgatcaatacatcatggttgctcaaagggacagaaaagccgtggcattgtggaatgagaaattacatacccaaatcagtgttgattcaactgtaatgcaacaagatgctatgccatatattctagtttga

SEQ ID NO: 114970 - DNA, 189 bp, Glycine max
  Peptide Sequence Number=SeqID_231748
atgaaaaaagctattgaattaactgaacaggcgggtacaaaaggagttcaagtacaaattgcaggacgcatcgacagaaaagaaattgcacgaatggatcagagaagttttttgggtccggcagtgagactgattagatccgctgagatccctatactctctctcaagaaacatttcagatcaggttaa

SEQ ID NO: 114971 - DNA, 837 bp, Glycine max
  Peptide Sequence Number=SeqID_231749
atggcgaaaaggagcatgtgtgtttttttgtgcgtgactttgttcatggttgggttttcggagtgttcgagcacgagcacgttcctctacagcgggtgcacgcagcaacggtacactcccaactcgccctacgagtggaatatcaactcgctactcacctcgctggtgaactcagcgacgtactcggcttataacaacttcactgtggtggggtccactcagcaggacgcggtgtacgggctctaccagtgtcgcggcgacctcgccatgccggactgcgccgcgtgcgtggcgcgcgccgtcacccgcgccggcgacatctgccgcggcacgtgcggtggctcggtgcagctcgacggctgcttcgtgaagtacgacaacgcgacgttcctcggcgcgcaggacaaggcggtggtgctgaagaagtgcgggccgtcggtagggtacaaccccgatgccatggggagtcgcgacgccgtgctggccggactcgccgccgccggggggaactttcgcgtcggcgggtctggcggggttcacggcgtggcgcagtgcaccggcgatctcagctacggcgagtgccaggactgcgtggcggaggcgatctcgcggctgaagagcgattgcggcacggcggattacggggacatgtttctcgggaagtgctacgcgaggtactcagtgggtggggcccacgatgagtccaaggcccacgacaaatcgagtcatggaggtgtaaagatattttctatagttattggatcattagcgggagtagctataattattattttccttgctttcttgagcaagatttgtgggcgacagggtaaataa

SEQ ID NO: 114972 - DNA, 474 bp, Glycine max
  Peptide Sequence Number=SeqID_231750
atggggaaagtgtgcaatctatatatagatagaaaaagagacaagaacggttatagatatggctttgctaggtttgtggggattcaaaacgatttggacttttctaggaagctggatgctattaatgctggaagcatgaaactacatgttaacattccacgatttgcaatagttggagggcttggagctgagaaaaaagagagagaatatgcagaaaaggagaaaggaaacaaattgagaaagaaaaatctaaaggaggagaggtggatcctaggagatcatatgcagaggagtggttacataatagcttggtggggaaccttgaaagacctaactatgtttgaaaaactaaaggatgcaagactgtcaaaggaaggaggaaaaattcgtttgaactatctgggtgacaacatgctgcttattaagggactaaaacatgaaaaggcacaacaaatgattgatacggaggaataa

SEQ ID NO: 114973 - DNA, 285 bp, Glycine max
  Peptide Sequence Number=SeqID_231751
atgggacatgagtatttgaatgttgtgagcgggaagggggctgaaacacaatataatgaatctgacaataagggtggcaacgtggaaaatgtggcaagggaaaaatatgaaaggaacgtaactaatgggctcatcataaaggcacaacaaatggaggagagtctaaggggacaactgaagatgggctctattgctagttcagtaaatgaccaaggagcaagtgatggtatgacgcaactccagcagctcactaattcgcttgagacagatgtgccaatggagtag

SEQ ID NO: 114974 - DNA, 216 bp, Glycine max
  Peptide Sequence Number=SeqID_231752
atggtggagggatctttatatagtttgtggagggcaagaggatcaaggtggttcgactctatggtgaggtggaagcttggtaatggtgggagagcacgattttggctaggggaacaaaaacttgcttttatgtaccctagactctatatgctcactacacaacaaagagagattataagagatatggggacttggagtggacagatttggaattga

SEQ ID NO: 114975 - DNA, 675 bp, Glycine max
  Peptide Sequence Number=SeqID_231753
atggcctccaagttctcttttctaacccttcttatggagagaagaaaaccttctaaagataacaacaacaacaataatgacttagcatttgtgaaggcagctgcatgggcatggtaccaacacaactcaggctctaaggggaaaactattagcgagtttgatgctacaataactcgccgtgtgccaaggccttcacgttacaagttagaagcaatgagaataatggctcaagaagctccaagtgaagggtcacccacgattcgcgccaagaaattgtcacttcttgatgaatatgaagtacaaagcatttcaaggcaacttagtggtcttgttgcggaggattctaaatctaataatgataataagcacaacaaacttttcaagggtgccgacaattctacaaatagaaggactacgaaaaagaagaaggttagaaaagggttttggctagggcatggtgctgtttgtggtagagaagaagatgtggttgatcccggtgctttgagggttggtcgtaggttaccggcaaagcctttgtggtttagatttagagatcccattatttattgtctcactatctttctccggctagaaccaaaaaagaaggtttatatgcttccggtgagaattcagattcccagcctcaacagaaacattgtcattgaagcaaattaa

SEQ ID NO: 114976 - DNA, 1419 bp, Glycine max
  Peptide Sequence Number=SeqID_231754
atggatttccctccatactgtcgatcccaattgcgtagcaacacttaccgtgccctcgttcacctcctctctcacatttctgcttacaacgcttcaattcttgaagcttcaactcaacccgtcaacattcccgataatggcagtggtagaatggatcaagaaaaccaggaaaaggagcctaagtgctccgaagttgttgattctgattttttggatcccaaggatcctatatgccagaaggatataccggaggtccaggaaaccattgagggggttgaagacaaggatatggattttacttctaacaagatggtcctagatgatatagaacatatgatgggaatagaggacttgtctaccctagcaaatggttttgataaggagcaaaagctaatgaatgagtttgagcaggttatgaaaggaactgaggatcttatttgtgatagtgaattaatccccttgaacttggaattggataagacacgtagtgatggtggtgaagttgagttgatggattaccaatcagaagtggaggaaggagaaatttctggagacttgggaatagatggcaatttatttgatgtggcttctgcagatgctttaatattacgacagatggaagtagatgaggttcagaagcctgaaaatgtaactggaaacatgatatatccttctaagattgagaatcaagaaaaggaaaaaggctatgactctaaatcctctttggtaaatgcatttcaagattacaataataatggacaagtggagcctagaactagtggcaagaaagggattgtatgtggagttgaagtagcaatttctaaagaaactattgaatgtcagaaggaagataaaacaaagttggataatgccagtaaaaagaataagcgtggtgggaacaaaggaaaaaagaagaaagcagatagaaagaagagagcagaaaagaacaaacaactaggtgttaaaagattgcagttacagcatgtgcagaaaccaaaagttgtctcacattgtcgtcattatctcaatggaaggtgccatgagggtgacaagtgtcagttttcacatgatgtagtgcctctaacaaaatccaagccgtgtactcactttgctcgtcactcttgcatgaaaggggatgattgcccatttgatcaccagctctcaaaatatccttgtaccaattttgtgtccaaaggctcttgttatagaggtgatgcttgcttgttttctcaccaggtatcaacgaaagaagacatccctacagcttcaaatatgtgcagaccagagttgtctccacttctgtctggaaatgcaaattccagcacaccacttaacaacaatcatggctctactcctgtccagcaaaaccacttaactaattctgcaggaattcatttttgcaccagtgttgaacataaa

SEQ ID NO: 114977 - DNA, 999 bp, Glycine max
  Peptide Sequence Number=SeqID_231755
atgtcgttactctccgatctaatcaacattaacctctccgacaccaccaagaaggtgatcgtggagtacatatggtatgggattgagccggaatacaccttgttgcagaaagatgtgcaatggcctcttggatggtctattggtggttttcctgggccccagggtccatactattgtggtattggtgctaacaaggcttttggacgtgacattgttgactctcatttcaaagcctgtctttatgcagacatcaacattactggaattaatgcagaagtgatgcctggtcagtgggaattccgtgttggtccatcgctggcatctctgcgtgtgacgacttgtgggttgctcgctacattttggaggttgttagcacacgactactctcatcatcaaattctttcttttgtaaatattgcagcgaatatctctgtttgtgctaatatctctgtttgtgctaatatctctgtggtggtgctttccttttatcctcaaccgattaagggtgattggaattgtgctagtgctcacacgaattacagtaccaagtcgatgagaaatgatggtggctatgaagtcattagaaaagcaactgccaagttggaaaaaaggcataaggagcacattgctgcttatggagaaggcaatgaacgtcgtttgacaggtcaacatgagacagctgatattaacaccttcataagggtcagtctatcaggtggcatgcctaggggttgcactaatgttgttgatggtgcaagggtcctcggtttgcacgctaaaagaagtgtttggttttggggttgtataagtttatggaggtgcgcattggtgatatgtttgttaagtgttcatggaggacaaatagatgtcgatgaaggtgttgcaaaccgtggtgcttctattagggtagggagggatgctgagaaagcaggtaaggggtatttgaggaggataggaggcctgcgtctcacatggacccttatgtggttacttccatga

SEQ ID NO: 114978 - DNA, 672 bp, Glycine max
  Peptide Sequence Number=SeqID_231756
atggagagaggtaaatatttggcattggtgggaggaggggctcttttgggctctgtctctaccttctttcttcttaggcttcttcaatctcaaaaaagaggtgtatcgcagtgcagtaagaatgttactgctgacttcaatggtgttgagggatgcactattgctggaaagaaaaatgatagggtgattaatgaagatcttctgaaagatgagattgtttcagaacagctgactaggaacgttcaattttttggctttgagtctcagcagaaagtgactgcatcatatgtagtggtcattggtcttggaggtgttggtagtcatgctgcttctatgctcttgagatcagggattggcaagcttcttcttgtagactttgaccaggtttctgtttcatcactaaatcgacatgctgttgcgacaagagcagatgttggcatctcaaaagctcagtgccttaaggagcatttcttatctatctttccagagtgccaaatagatgccaaagtgatgttatatgattcatccactgaagaagaaattctctcaggccaccctgactttgttttggattgtattgataacattgatacaaaggtggcgcttcttgctgcatgtgtacgtaggggttttgaaggttctatctgcaacaggggctggtgccagagctga

SEQ ID NO: 114979 - DNA, 443 bp, Glycine max
  Peptide Sequence Number=SeqID_231757
gctctgtctgcagttttaaaagtgtgaatagggaaaacggtatcaagttgcctcagttattcaattttggtttgcctgagcaggaaaaatcctctctaaacaaagatgattacaacaaagctagtgacaccacaaaacaaaatgcaccacagactgatatattcttaactgagattttaggaaaaaatcaatctgtggcagaagaaatgaaattaaaacttccagagaaaacctccgtagatttttttatgagggatcacagccatagtaaatcagttcaagaggggaagaagtcatctgataattctcaaagttcaaagggccaaaaggcactcttatcaactctagcatttgcagctgagcatgaatctagcattaagatgaaataccctactggtggtttgccgatgtcatcagaggactcagagagaatgttttgttga

SEQ ID NO: 114980 - DNA, 657 bp, Glycine max
  Peptide Sequence Number=SeqID_231758
atggatcctccgattaagaaaaagacattgtctcgtgctagcttgagtcctcagaggaaagacaagtgcatagtttttccccttgtgaggtataatgaattccgggagcctgtttgccaggcttgtaatgtggttatgttggagtctatacgtgcacacctagcttctccggagcataacgaggtaatggaaaaactgaaagctaatgctgctggatcaactgaagataagaatgcaaagccagttactggtaccaacaactctcccaaggctaatccagaacaacctcaagacacagcatgccaactgcctgaattttcacaagatgtgcctagacatgaatcaccatctgcgcttccacgagatttttgtgatgacagtggtaaaataaggacaagatctggtataatttttttttcttggaacttccacttcttttgtaacttaaatgatagggaatacccttctgtggtgtttttctgcaaaaccttattcgtgaccttggtttcaaagccatggcttaaatacaagaagttcgaaaaaccttttcctaagtttcttgcactacctaatactcccttcatcaaaactggtatgtctcctgacccaccaagtggagctttgggtgtttacaggaaccaaagaagaattgaataa

SEQ ID NO: 114981 - DNA, 250 bp, Glycine max
  Peptide Sequence Number=SeqID_231759
cgttgttcgcctatcctccaccctcaaatcttattcggagccccatgaattgattgtcattcatgtgtcctcctccatcgagtctagagccccgcgaattgattgcctagcgttgttcgcctatcctccaccctcaaaatcttgttcggagacccatgaattgttgcctagcgctgttcatgtgtcctccaccattaagtgcggagcctccgagaaagaagaaggagagatgggagtcgtcatagactaa

SEQ ID NO: 114982 - DNA, 480 bp, Glycine max
  Peptide Sequence Number=SeqID_231760
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggatcccttaa

SEQ ID NO: 114983 - DNA, 1062 bp, Glycine max
  Peptide Sequence Number=SeqID_231761
atgcttcacttcctctgtctccaccgaataagttcccggtcccggttcaaggttggtggtgttgggagtgcgcggttggtgttcgatgaaattcccaagaggggtttgaggccaacggttgttagtttcaatactttgatcagtgggtgctgtaaagcgggggctgtggaggagggttttaggttgaagggtgttatggagagtgagagggtgtgccctgatgttttcacttttagtgctttgatcaatgggttgtgtaaggagggtaggttggacgaggggagccttttgtttgatgagatgtgcgggaagggattggttccgaatggcgttacgttcactgttttgattgatgggcagtgcaaaggtgggaaggttgatttggcgttgaagaattttcagatgatgctggctcagggtgttaggcctgacttggttacttataatgcattgatcaatggtctttgcaaagttggagatttgaaggaggctaggcggctcgtgaacgagatgagtgcgagtggtttaaggcctgacaggatcactttcactacactgatagacgggtgttgcaagtatggggatatggaatcggccttggagatcaaaaggaggatggttgaggaggggatcgaacttgatgatgtagctttcaccgtgcttatctctgggctttgtagagatgggagagttcatgatgctgagagaatgttgagagatatgttgagtgctggtttcaaaccggatgatcccacgtacaccatggagatgcaaagcgatggacatgtaccgggagttgttacgtataatgcgttaatgaatggactgtgcaagcaaggtcaggtgaaaaatgctaaaatgctgttagatgcaatgcttaatgtgggggtggctccaaatgatattacatataacattttattagaaggtcatagcaagcatggaagctctgttgatgtcgacatatttaattctgagaaaggacttgttaaagattatgcttcatatacagcacttgttaatgaatcaagtaaaacttcaaaagatcacctaaagagataa

SEQ ID NO: 114984 - DNA, 1326 bp, Glycine max
  Peptide Sequence Number=SeqID_231762
atggctctgtcttcccctgtttcactctttcaactttgcatgcttctgttttcattcttctttttcttctccttctccacttcctcctcggccaaactcaaccctaccaccgactcactctcactctctttccctctcacctcactccctctctccacagcaaaacctctaaatactaacccaaaactcagaaccctttcatcttcttcttcatataacataaaatcctcgttcaaatactccatggctctggtggttactctcccaataggaacccctccacagccccaacaaatggtgttggacaccggaagccaactctcgtggattcagtgccacaacaaaacccccccaacggcgtcgtttgatccatcactctcttcttccttctatgttcttccgtgcacccaccctctctgcaaaccccgcgttcccgattttaccctcccgacaacctgcgaccagaaccgcctatgccactactcctacttctacgccgacggcacctacgccgagggcaacctcgtccgcgaaaaactcgccttctccccttcccaaactacccctcccctcatactcggctgctcctccgagtccagagacgccaggggcattctcggaatgaacctcggccgcttgtccttccccttccaagccaaagtcaccaaattctcgtactgtgtccccacccgacaacccgcgaacaacaacaacttcccaaccgggtcgttctacctcggaaacaacccaaactccgcgcgcttccgctacgtcagcatgttgaccttccctcaaagtcaacgtatgccgaatctagaccccttagcctacaccgtccccatgcaaggaataagaatcggtggcagaaaactcaacattccgccttccgtttttcgacccaacgctggcgggtcgggtcaaaccatggtcgactccggctccgaatttactttccttgtcgacgtggcttatgatagggtgcgggaagaaataattagagtgctgggacccagggttaagaaggggtacgtgtacggtggagtggcggacatgtgtttcgatgggaatgcaatggagatcggacggctgttaggggacgtggccttcgagttcgagaaaggcgtggagatcgtggttccgaaggagagggtgctcgctgacgtgggcggtggggtccactgcgtgggaatcgggaggtccgagagattgggtgcggccagcaacatcataggcaacttccaccaacagaatctatgggtggagtttgatctcgcgaatcgaagaatcggattcggtgtggccgattgtagcagattaagtaaataa

SEQ ID NO: 114985 - DNA, 286 bp, Glycine max
  Peptide Sequence Number=SeqID_231763
atggagtatttgaacgaggattttatgttatatgaagaagaagatgaaagggttctgagttttgggttagtatttagaggttttgctgtggagagagggagtgaggtgagagggaaagagagtgagagtgagtcggtggtagggttgagtttggccgaggaggaagtggagaaggagaagaaaaagaagaatgaaaacagaagcatgcaaatggcaatatgggggagtgagagtgatgacatggggtttatttatatagccaagaggccaaataatgaaatgaacg

SEQ ID NO: 114986 - DNA, 240 bp, Glycine max
  Peptide Sequence Number=SeqID_231764
atggagagtgtggcgaaagggagggcgagaagcgaggtggttgaagaaggagaggaacgaggacggggagagggagagagggttgagggtgatgaggttgctgacgtggcgcggcttgaggtaagggaggatttgtttgagtctcgggttcttagagtaatagtccttctcgttctcggaatcgttgatggcttcgaagatttcgcacagaaggttgtggtctttgtagggaaagtgtga

SEQ ID NO: 114987 - DNA, 153 bp, Glycine max
  Peptide Sequence Number=SeqID_231765
atggatgaagacatggtttctctggatcctattgaatttcattccgaagaggaaccttataaagatcgtattgattcttatcaaagaaaaacgggattaactgaggctgttcaaacagtttatggggggcagtatgggatccgcagtaggtga

SEQ ID NO: 114988 - DNA, 225 bp, Glycine max
  Peptide Sequence Number=SeqID_231766
atgaccaagccgatgttggatcaatttcatccatgcattcataattccattgaaaacattgttgatgtcaaagttaatggtatggatggagattcatggtctttggttcgtaaccatttgcttaaagagcttgaaaaatggtatgatgagtatataaacctgcttggtggcatacacagatttgaggaattaaagcggtccctacttgttgatggattattcatg

SEQ ID NO: 114989 - DNA, 234 bp, Glycine max
  Peptide Sequence Number=SeqID_231767
atggacaacccatcccttatgttcaagaatccttacaagtcaagagaccctcggtcccttaatcaatttcatagaatgagaagaaagaaagaagaattctctcttgaagagaaggatattacaattgaagtccatggagaaactcttaatggatttgcaagtgtttgtccaatagtttcttttgagagagcatatggccatgaagttctcttggaatctttcatgtccttttga

SEQ ID NO: 114990 - DNA, 402 bp, Glycine max
  Peptide Sequence Number=SeqID_231768
atggtgggcaaagatttgggaagtacgaatgaccccatgatgtgcaaattcaaaatgagcacgccttcccgccatatggctcgcctcccaacacatgaaattccccaccacaatctagccgacttcgagccttgcctcggatatgccacaggagggcaatcagttggtggtatacccatgccaaacactttggagggccctcagtttcgcccacaaccacaacccttgcattttgcggtgggaagagcccctcctgctatggctgaaaagggaaagttggatcatatagaggaaagcctcaaggacattgaaggaggcgaagattgcgcctttgctaacctagaagagttgttcctagtacccgaacatggtcattcccaagttcaaggtgccagactttga

SEQ ID NO: 114991 - DNA, 372 bp, Glycine max
  Peptide Sequence Number=SeqID_231769
atggggtatgcaccttcaagctttgtggatttggtcttcgtcggggaaaggatcgaaacgggtcttaaaagaggcaaatttgatcatcctgctttgatgaatgagaaaactggggcaaatgaaaaggatgagaaggagggagaaacccatgctgtgactgccattcctatacggccaagtttcccaccaacccaacaatgtcattattcagccaacaacaacccttctccttacccaccacccaattatccacaaaggccatccctaaatcaaccacaaaacccacataccacacaaccaatgctaaacaccacctttagaacgaaccaaaacaccaaccaaggaaggaattttgcagcaaaaagcctgtag

SEQ ID NO: 114992 - DNA, 354 bp, Glycine max
  Peptide Sequence Number=SeqID_231770
gtcgacgtgacatacgagacttggaagcaagtccctgctgctcagaaggatttgatatgggaggatattcaggatgaatttgatatccctaaagcatctgacgccgacaaggatagtgtggatgacattgtttgtgaaaaatacaacattagcaaggagaaatgggcacagttttgtcaaacccacagagacccctcgtgggaggatgtgcggaaaaagacacaggccatccagaagcaaaacactaccccccacatgttgtctcgtgggggttatgaatatttagaacagaagctgatggctgagaaaaaaaaagaaaaaactggaggaagctactcaatctggaagcactaa

SEQ ID NO: 114993 - DNA, 252 bp, Glycine max
  Peptide Sequence Number=SeqID_231771
atgtttgcgatcttggtgacttgttggtcatgggttcgaatccggaaacaacctctttgcatatgcaagggtaaggctgcgtacaatatccctcccccataccttcgcatagcgaagagcctctgggcaatggagtacgaaatatccaaacagctgttgtggccaaggaaaccttggaaggacactgcatatatgatggaggtgaggggaattccttattctattggtattgtgataggaaccaagaattga

SEQ ID NO: 114994 - DNA, 1575 bp, Glycine max
  Peptide Sequence Number=SeqID_231772
atggccacactccaagcttcccttctctccaaaccttccctcccattcccgttcctgtctccgaaccactccccattctccctctccttcccccccacgcgccgcgtcccttccacgctcctatgttgcaccttccgccccgaacccaacccctctgaactggaacccgaacccggttcagccaacaccgaagaagaaccgggtataaattcacccgaagaagaaaaagaaggtgcagcttcggtttcagatttgggtttggaagaagaaggcgccgaggctctcgatagtggcgctgattcggagaagattgcgaatggaaggcggctctcgatagtggcgttctttgtggggctgtgggtgaaggcgagggagagtctgaagagggccttttcggagcttcttgattggtggccgttctggcgccaggagaagcgcctcgagcggttggtcgccgacgccgacgcgaatccgcaggatgctgccaagcagagtgctctgctcgttgaactcaataagcagaggtggtggattttgtttgttgagttttggttcttgagcaattcttgcattagtcctgaatctgtcatcaagtggtttgaacaaagggatcgagctgtggacagtagaggggttgcggaatatcttcgagctcttgtggtcactaatgctattagtgaatatcttcctgatgaggattctggaaaagcttctagccttcctaccctgttgcaagagttgaagcagcgtgcattgggtaactcagatgaaacttttgttagccctggaatatctgacaagcagccactacatgtggttatggttgatccaaaagtatcaaataagtcacgttttgcacaagagcttatctcaactattttgatcactgtagctgtggggtttatgggtgctgctgcacttcaaaaatacattggaagcttgggtgggattggaccttcaggagttggatcaagttcttcctatgccccaaaggagctaaataaggaagtgatgcctgaaaagaatgtaaaaacctttaaggatgtgaaaggttgtgatgatgcaaagcaagaacttgaggaagttgtggagtacctaaaaaatccatctaagtttacacgccttggaggaaagttgccaaaggggattcttttgacaggagcacctggaactggaaaaactctgctagccaaggctattgctggagaagcaggtgtcccatttttctatcgagcaggctctgaatttgaggagatgtttgttggagttggtgctcgacgtgttagatccttatttcaagcagccaaaaagaaggctccttgtataatttttattgatgaaattgatgctgttggatcaacaagaaaacaatgggagggccacacaaagaagacattgcatcagctacttgttgaaatggatgggtttgagcagaatgagggaataatattaatggctgcaacaaacttgcctgatattcttgacccagctttaacgaggcctggcagatttgatcggcatgcaaggaaggaggaaaagagagaaatgagtttcccaataatcatgttctattag

SEQ ID NO: 114995 - DNA, 348 bp, Glycine max
  Peptide Sequence Number=SeqID_231773
atgaatttgatgtatgcttatatatgttattcgtgcttttggaaacttcagcttactgcttatcatgagagcggtcatgcaattgttgcccttaacaccgatggtgcgtatccaattcacaaggcaacaatcatgccacgtggatctgctttaggaatggtcactcagcttccctcaagtgacgagacatcaataagcaagaaacagttgttagctcgccttgatgtttgtatgggaggaagagttgcagaggagcttatctttggccaggattatgtcacaactggagcaagtagtgatctccacactgctactgagcttgcccaatacatgtcttgcatctgctaa

SEQ ID NO: 114996 - DNA, 879 bp, Glycine max
  Peptide Sequence Number=SeqID_231774
atgacatttaccgatctgttcgtgcgccggccggtgctggcgctggtggtcagcaccctgatcctgctgttcggcgcgctggcgctcagcaagttgccgatccgccaatacccgctgctggaaaactcgaccatcaccatcagcactgaatatcccggcgcgtcgtccgagctgatgcagggctttgtcacgcagccgatcgcccaggcggtgtcctctgtcgagggcgttgactacctttcttcctcttcggtgcaggggcgcagcgtggtgacggtgcgcatggcgctgaaccgcgactccacccaggcgctgaccgaagtgatggccaaggtcaatcaggtgcgctacaagctgccggagcaggcttacgatccggtgattgaacgttccgccggtgaggccaccgccgtggcctatgtcggcttttccagtaaaacgctgtccacgccggcgctgagcgaatacctgacgcgggtggtggagccgatgttcaccaccatcgacggcgtcgccaaggtggaagtgttcggcgggcaaaaaatggcgatgcgcctgtggctggacagcgatcggctggccggccgcggcctgaccgccgccgacgtggccgacgcggtgcggcgcaacaactaccaggcggcgccgggcaaggtgaaagggcagtatgtggttgccaacgtgcgggtgaataccgatctcaccagcgttgaggaatttcgcaatctggtggtgcgcaacgacggcaatggcctggtgcgtttaaaagacgtcggcaccgtggagctgggcgccgcggccacggaaaccagcgccctgatggatggcgaaccggcggtgttcctcggcgtcttccctacgccgaccggcaacccgctg

SEQ ID NO: 114997 - DNA, 303 bp, Glycine max
  Peptide Sequence Number=SeqID_231775
gccattcaacttgacaacaaaatgtcatttgatacgttgaagcaagctattggaagcaagattagtctaccaaatggtaaagtggtcaaggatgcacattttcgattacctgtatcatttgttggtgattttggccactacaagccatgcatgttgcgcaatgatgaggatgaggaagatgatgacgaagaagctgagcttgttccaccaatcacaatcataccaccacacatgcaaaattttgaagaatctaattttcaagattctgaatacggccatagcttatatcgtgaagaagtctga

SEQ ID NO: 114998 - DNA, 183 bp, Glycine max
  Peptide Sequence Number=SeqID_231776
atgaatcacacgaaaagagacctcaatcccttctcatttaaccctaacagaacaaccggagaaggagctctagagagcaccaaacacaccacaattgataatggagaatgcttgagtgactacttcgagggatccttagagtatcaattgaaatgggttttggggtgtttccgccatttttga

SEQ ID NO: 114999 - DNA, 882 bp, Glycine max
  Peptide Sequence Number=SeqID_231777
atgtcaacattacattcaaacataggtgaaggattcccaacgagaggtctaccttggagcttacttgaatcatgcaatgaagacttaaagactactgtggatggtaaaactgatcaagttggtcctcagtggattgaagtaaagtggttcggtgatggcacaccattggacgtcgagaccataacaacacttcacaataaatggacaacatattttgtaaaagttcaaaacactaaatttagaaaggataagagttttttgtacaaaaatgctgcccattttgcaggttttgtgaagataaaggatgtctgtgggaagccgaagtttgttcaaactttctttcttgctcctcaggagaagggttactttgtaatgaatgatatgtttcatttcattgatgatggagtaacgagcccaaatctggtaccagtggcatccaaaacgattgacacacaaccacatctttctgcttctcttgctgagccaccagtttcagactacggcttagaggaagaagccaggaaatatgtcaactcagttcatatagatgatgatccagtggacaattacgacatacgagtttccaaagggctgctagtgttgtcagctgctccaaagcatgctccacattctttcaaaagtgctccacctccttcagagttgaaccatgtagcacagcctgctgttcagcagtcaagctctgcttctatgtatattcccgagtcagggaccgaggcagcagaaggctatagactagaagaagatgaattaacatctgtctattttggaaacttgcctgctaatgctactgaagcggagattgatcaggaattcaagaattttggcagaattaagccagatggaatattcattagggtctga

SEQ ID NO: 115000 - DNA, 600 bp, Glycine max
  Peptide Sequence Number=SeqID_231778
atgggtaagggttggggtcctggcgctgctgatgtagtgtatactgatagaagctatcattcaactgcacctagcccctatggttcgctgcctgctggtcagccaaatgctgcatgtagagctccattctttgcatgtgaactgagatggaccctagagatggtggctgatgtggaggtggcagtggtgcgcctacgaccggctgctgctgatgtacttctcaatgaaagacctattaatgggaggctggatgagctttgtgggcataaccagtaccccatagaactggcagagacctgtgatcaatgctggaaatcccagtgtcctattggacttttctgggtccaatgggtgtctcgaaggtgcgatacctacaaactggtatatggtatccgagataagctgtgctacatgaacattgatctagatcaggatagcgtagaccaactggcatttaggcggcgggagatcaaaattatggtcactaagaaggatgttgctgaggagaagcatcatccagatctaggtcaaggtggtcatgctagtgcgcatgatctgcacccaccttcctgtcacgctccatgcaaaatcatgtcctga

SEQ ID NO: 115001 - DNA, 579 bp, Glycine max
  Peptide Sequence Number=SeqID_231779
atggattctgaagctgaagcactagaacatatgaagaaaagagatagaggccatcaaagtgtgtcattggagaataagacaggagattcaactgtggtgaagatgagtgagaaaaataataatgctgatgccgacgactgcatgattcttgatgaccatgaaggagaagagcattattgtggcaaaggaacaaatgcgaggagtgtttcttttttgccaagaagccaagagaagataggagattcggctaaagttgtgatagaacaagacatgaagggaggagagcataaatatgggtttaacaacaataaacgtgagaagccagagaaggtaagggtggtggatgatgaaactggcgacaaacatgagctgtatgaagtcctaaggatgccatctagaacaaaaaaccgatgctttaagttttttactgagggcaggaggggtattataaacatcattttctacatctaccagacaccaaatccaatgcatgttaaatacactcaatactttgactatcccagcctattagaatatagattaaaggcaaattgggaaactttcaagatacaaatatga

SEQ ID NO: 115002 - DNA, 507 bp, Glycine max
  Peptide Sequence Number=SeqID_231780
atgaaaagagagttgaaggaggccatcaaaattgacttatcccaaatggcactgcaacactcacccccgattgaggcgaatatacaattattagttgcacatgtgagcacaaaggagagttatgctgaaactgttgtcaatccatcacaggaagagcatgttgctgatgtgaggcctactatggggttgtacgttcaacatgatcattctacacgcctggtggccttgggaaaagtatatgagtgggcgtccaccatacacaacgtgtcttatatagatgatgtggtcaaggattcacaaatatgtccaaagaaacaacttgaacctattcataggtcgaaaatcattgatggagttgatcccttgggtgatttgattaaaaatctgtatgatctttacgagaatcctcttatgttgttgtgggatgggactaaatttgggattccggatgtagaagcatccttcttcatagcatattctaattttattgagataatatcaggttaa

SEQ ID NO: 115003 - DNA, 195 bp, Glycine max
  Peptide Sequence Number=SeqID_231781
atgacttcctatggtgtggtcagggaagacttaaattgcctccatctagtggtcaccgatagcatcaccttcttcttggcattggatgctacgagagaagatattggtggtggtgatagcaatagcaagttcaaacctctttcaagtttcaatgttgttattttgtacctattagttcatggagcatgcgtgtga

SEQ ID NO: 115004 - DNA, 302 bp, Glycine max
  Peptide Sequence Number=SeqID_231782
atggaagagggatatgttgtttctttgagtgaagttgggcaggttcatttgcggatgaggaagatgctactggttgagtcatttgcctctcaagttcttcaagggaaggttgcagaggagcctcaactatttgctgtttctggggctgttactgttgttgttgctgctggattggtggaggaacgtatggttgggatgattcctccacccgggattgtacctgttgctggagagcataagcttcaggctgttcaattgcttcagattgttgcacagaagggcaaaggtccgcgtggtggtcg

SEQ ID NO: 115005 - DNA, 780 bp, Glycine max
  Peptide Sequence Number=SeqID_231783
atggcagagacccttcgtatggttgttgctgttattgggaatgttgcctcagtgtctctttatgctgcaccaacgtatgttaatgttacattccaccactccaaaattgtgtttgtatccgcgtttagcacgttgaacgccaaagcttcctctcaggaaaacgaggaaactctagcgttcaagggttaccttcaaaaggtaagcaacaagtgggaaaatttcccccttgtcacagttaatggagttgggattctttttgagctatcctatgttctcatttatttctggttttctacaccaaaaggaaaggtgaaggtggccatgacagcagtaccagttcttatagtgttctgtgtgattgctgttgtatcagcttttgtcttcccggatcatcgccaccggaagcttctggtgggtagcataggcttgggggtgtcaatagcaatgtatgcatctcctttggttgtaatgaagaaagtgatacaaaccaagagtgtggaattcatgccactacctttatctttctgctcattcttggccagtgtactgtggctgacttacggactcctcattcgggacattttcgtagcggggccaagtgtgattggaacacccttaggcatacttcaactagttctccactgcaaatactggaagaggagagttacggaagaacctaccaaggtggaattgcagaaggggaacaacgcagagaaattggacttggaaaatggacatggaaaagaatgtgtcacagttcctagtaacttcaactcatga

SEQ ID NO: 115006 - DNA, 328 bp, Glycine max
  Peptide Sequence Number=SeqID_231784
ggaacaaaagctggtaccgggccccccctcgaggtcgacggtatcgataagcttgatgtggttcaagccaaggtaggagggcagactaaatttgagcttgcgaaaacaagtttcgaagtgaaaagggagaatgaagtgggtgatagtgatatatggcatgggttggtgcactacaagggcgtgacggttaagagtggtggtgcatatgggtcaaaggtggtgggtcacaatgtgactatggggtggctcaatggtgttgtcaggtggatggaggttgtaaatctaagcagcttgttgatgccggctcggaggttgggtgatgtgctgg

SEQ ID NO: 115007 - DNA, 444 bp, Glycine max
  Peptide Sequence Number=SeqID_231785
atggcatcggtgtctactcagcaacagttccgttacacgcagccaccatcaaaggtgcttcatttgagaaatttgccgtgggagtgcacagaggacgaactaattgaacttgggaagctatttgggaaagttgtgaacacaaagtgcaatgtcggagcaaatcggaatcaagcttttatagaatttgcagatttaaatcaggcgatcgcaatgatatcatattatgcctcatcgtcggagcctgctcaagtacgagggaaaactgtgtatcttcagtattccaataggcaagaaatagtgaataacaaaactgcagcagatgttgctggaaatgtactgttggtaacaatcgagggtgaagatgcaaggcttgtcagcattgatgttttacacttggtaagccaatgtcaaggcaatatctgcgatggcagcttactagcttag

SEQ ID NO: 115008 - DNA, 267 bp, Glycine max
  Peptide Sequence Number=SeqID_231786
atggtttggcttcagcaaaaatggaaccagaaacgcaaacgccaccacagggagggagaagagggcttacctcgacaatgccgacaaaacccggatgagaagaagctccaaagcacaacgaacacgactcaagaacaagaagacaacatggggcgcgcacaacaaacggggctaaagaagaagacaggggcgcaggggctcaagaagaagaaggggctgaagaagaagaacaggctgaagaagaagagaatcagagtcacggcgtga

SEQ ID NO: 115009 - DNA, 291 bp, Glycine max
  Peptide Sequence Number=SeqID_231787
gtcttttcagcctttgggtttgtgcataagattactacttttgagaagacagcaggattccaggcattggtgcaattttcagatgcagaaactgctacctccgcaaaggatgctttggatggaagaagcatacctaggtacctgcttcctgaacatataggaccatgtggccttaagatcacatattctggacattcagacttaagtgtcaagtttcaaagtcacagaagcagagactacactaatccttaccttcctgttgctcaatctgccatggagggaagtggacag

SEQ ID NO: 115010 - DNA, 318 bp, Glycine max
  Peptide Sequence Number=SeqID_231788
atgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccagggggtcgcggaccgaccatagaaaccctggttcaaaaaagcggaacgcattag

SEQ ID NO: 115011 - DNA, 825 bp, Glycine max
  Peptide Sequence Number=SeqID_231789
atggagatcaagcaccagctggccgtgctggactcccgcgctgacttcctgcacatcgacatcatggacggtcactacgttaaaaacatcaccctgtcgccgttctttattgagcagatccgcccgcatacccaggtggcgatcgatgtgcatctgatggtggaagagccgaccgactttattgaagcggtggccaatgccggcgccgattacatttgcccgcacgctgaaaccatcaaccgtgatgcgtttcgcgttatcaacctgattcgcagctacggcaaaaaagtgggcgtggtgctcaacccggccacgccggtctcctttatccatcattacattcatctgctggataaaatcaccgtgatgacggtggatccgggctatgccggtcagccgtttattccggagatggtgcagaaggtacaggagctgaaggcgctgaagcaggcgcacggccaccgctatctgattgagatcgacggttcctgtaatacgcgtacctacaacacgctggtcggtgccggtgccgaagtgctgattgtcggtacttccggcctgtttaatattcacgaagatctcgccaccgcgtggaacatgatgcgtgagagcattgatgaagcgcagggcctggcgcagctgggcgcagcagcccgatgcgctggccgcactcgggcagctgattgcggaaacgctggagcagcagccggtcagcggtgtaatgctcggcctgccgggcattctcagccgcgatcgtcagcaggtgatttcactgccgttcattcaggcgctcgatcatcagccggtagcggcgctgctgagtga

SEQ ID NO: 115012 - DNA, 546 bp, Glycine max
  Peptide Sequence Number=SeqID_231790
atggctggtactgaaaacggatggtccggtggcggcccgcgcccgcagtttcggctccgtcgccgcacctgccaccaccgttctcttcgcgcttggcggcgttcttctgtggcttggtatcgatggttatcgcttcacctcggaagtcgtgaccgatggaccgtccaatcccttgtcaaagacggtggagattgcaaccggggtctggttctccaattatgcagcgcatccatggatgatgctggcgccggccctcggccttgtttttccgctcgtcgcattgctgttgttgacgctgcgccgggaggtgatggcgctgcttgccagttcgctcgcaatcttcggcatcatctcgacggtggggctcacgatgtttcctttcatccttccgtcttcggtcgatccgaaatcgagcctgacggtatgggatgcatcctccagccatatgacgctgttcatcatgctggtcgtcgccctcatcttcatcccgatcatcgtcgcctatacgtcatgggtctatcgcgtgctgtggggcaaggtggatga

SEQ ID NO: 115013 - DNA, 214 bp, Glycine max
  Peptide Sequence Number=SeqID_231791
atgcatgaccagcatggcgacggatacaagcccgcagagaatggcgtaggggttcagaagttcaaacagcgtcgtcccgtcatagaaaatcctgagatcgtcattgaggtggaagggaacaccctgcagtacgttgccgatcgccacgccgaagataagcgaaggtacgaagccgccgatgaagagcgcccagtcccagccggtgcgccatgcg

SEQ ID NO: 115014 - DNA, 261 bp, Glycine max
  Peptide Sequence Number=SeqID_231792
atgaagaaaagaaaaactgtttggtggacttcagtaggtttcacacgactggattcgcagttggatttcatgtggggtttcatgatgaggtttgccaggagttggggctcattggattttgccgcgatggtggcagaggagatcacatttgttggattttatgacgaggttgcggttgaaatcacagttgggttctactaccaatatttctaccctatgaataaagataaagaaatttctacactgaatatttggaattaa

SEQ ID NO: 115015 - DNA, 264 bp, Glycine max
  misc_feature (244)..(244): n is a, c, g, or t
  Peptide Sequence Number=SeqID_231793
atggaagccaatgcggttgcagttgccgatatcagcgctgttgctaaggtgaacccgatgcccccatcttatctcaaccaaatgaatcatccaacctcagatatggtaggcaaagatttgggaagtacggacggccccatgatgtgcaaattcaaaatgagcatgcctttccgccatatggcttgcctcccaaccatacaccacccaatatggcgtacactcccgatgaggatgtcaataactnctgcttctcatactcattga

SEQ ID NO: 115016 - DNA, 438 bp, Glycine max
  Peptide Sequence Number=SeqID_231794
cgtgactcaaatatcagtatcagagatcttgtgagcacggaagatgacacagcaaaaaagaatgtttattcggataaccactcgggtatttccgcccgtcagcgtgactcaaatgtcagtatgacagatcttgtgagcgtgaaagatgacacagaaaaaaagaatgtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtcaatatgacagatcttgtgagcacggatgatgacacagcaaaaaagaatgtttatacggataaccactcgggtatttccgcccgtcagcgtgactcaaatatcagtatcagggatctt

SEQ ID NO: 115017 - DNA, 417 bp, Glycine max
  Peptide Sequence Number=SeqID_231795
atgtcaggatttacacgcaattctcctcaaatttcagccagcccgcatcaattagacattgcaccttacgcttcagagccctaccatgctcaatggaacgccctggggcttctccgtgacaagcacacgttgcgtttgagtcgtattctcggagaaatggaggttgatgaaccttggctagggttatggctaccattgaattatcaagcagatatgggagcaagtggtgttcgtcattggaagtgcggtagacagactttgtggaatggcagtcacagcatgggtttctccctcatcctcaccctctttatttgccccagttttctcagtcgtcctagtaggatgatcaaatttgcctcttttcggacccacattgatcctttcattggcgaagaccaaatctgcaaagctttgagg

SEQ ID NO: 115018 - DNA, 189 bp, Glycine max
  Peptide Sequence Number=SeqID_231796
atggaagttgcccctattgctaaggatgttcagcacgtggatgacgcaactgacgaggtccacacacagcctgaagaagtagttgttgatgatgaacgttttgagttgaagttatcctcccatggaagaaaggttcagaaattcggcagacctactatagagattgaaggcttaattgctgccacatga

SEQ ID NO: 115019 - DNA, 876 bp, Glycine max
  Peptide Sequence Number=SeqID_231797
atggaggtgccgagttcctgggatgcccttcgcaaacaggttcataggattggcaggctaggaatgcacccgatttgtttaggaatcaaggtgatcatagatggtgcagagatattgttttgtgcttttacaatactggagcccaatgatgcaagaaaacttgaagctcagttggatgagcagatgaattcttatcgtaaattggtttctaataatgtttctacaaaagctgacgctgcagagagtgatctagagtcttggattgagcgtttactaaaacaactccaacaagtaaacacacagatgcaagcttgggtatcatctggtggttcagaaatggtttctcatactttgactagacaccaagaaattcttcaagatctcacccaggttttgtatagaaagaatcctttcactgccaggagatttgacaaactgctggagttttatcgtcttcgctcaagtcttaaagctaagcaagaacatgcttcactgctagaagattttaaagaatttgatcgaacaagattagatttggaacaagtagactctgaacagcatgcactcctaaaagaacgcacatctatcagccgaaatacaggacatatggacaatgtaatttcacaagcacaagcaacactaggagcacttgtcttccaacgttcgacatttggtggtatcaattcaaagctcggcaatgtgagcagtcgcctcccaacggtaaatagcatactttcagcaataaagagaaaaaagtcaatggataccatcatactttcccttgttgcagccaaaaagccttgtcaatattgtcgtggcagaaccatagttgtagaattcagtcctgtcattgattcgttcgaggcaatgggttag

SEQ ID NO: 115020 - DNA, 318 bp, Glycine max
  Peptide Sequence Number=SeqID_231798
atggaagttgatgcaatacagtgttcgtgtgcttttcacgaaaaccatttggtaactttcagcattttcctaagtgaatatctcccaaaaaactttcctggaaaagctagtgttttctctctacctactaatcctgcaaaggcaccaaaaagccccatcaaaataccctcaccaccatatctcatgtctctgtcccttttctgttttatcatcgccgccgacactttcatcgtcctcctcaacacctccactgccactgataatccttattcaccaccacatcatcgtcctttcatcgtaaatcgcaaattgccatga

SEQ ID NO: 115021 - DNA, 798 bp, Glycine max
  Peptide Sequence Number=SeqID_231799
atggatcttcaaaggcaagagccatgcccttctgaaaatttgaacatcatcacattttcagataccgtaccatgccaaaatccttccatcaacactcaaacaaagacgaatcagacacaaatggaagatcaaaaacaccagcatgattccgttcctcgtgttttactagatctaagtctctcctccaacaaggattcaggtgatgataactcaaagcttaagccagaactcaacctcctcaattgtttccatacaaatttctctgaaaactcatcagaatctagtcagggaaatgaactggatcctcgtgttttctcatgcaactactgccaaagaaagttttatagttcccaggcactaggtggacaccagaatgcgcacaaacgtgagagaactttggcaagaagaggatacaaagctggtgctgccgattttggacacacatactccaacattcattttctgccttcacatggcttatacaacaaagcacttggaattcaggttcattctatgatcaacaaaccttcttatcaaacaccctttttcgggttgtgccgttccaataatgggtggcagaggcaacctttggattcacaaccagcaattgggaactttcgtgtgggggcagaaactgagtcatcatccttggctgatagtgttccaaagttaggcaagttttccacaaggttggtggcagaagggtttggaggttactgctttggtagcattactactcatttgaagtctaaacaacaagaggagttgcagaagcttgacttgtcccttaagctctaa

SEQ ID NO: 115022 - DNA, 183 bp, Glycine max
  Peptide Sequence Number=SeqID_231800
atgaaggccctcatcatttcacaacatcttaagcttcagtgccaggattccgataatggtcgtggtggatatcacgaagatcataggattcaagattcattacacattttacgaataacgagagcttttgagaagagaactccaccgaaaacaattgggatccaaatctgtaagggtttttga

SEQ ID NO: 115023 - DNA, 114 bp, Glycine max
  Peptide Sequence Number=SeqID_231801
atgaactgcacgccattcacatccttagttagaaacatcaatgtagggcctactacatcgacattggaaagtggtgacaacaatgtccagagggttcatctgaaaaagtggtga

SEQ ID NO: 115024 - DNA, 720 bp, Glycine max
  Peptide Sequence Number=SeqID_231802
atggctgtcattgcttgccatttttttttctatacagtattacagtttgaaaattttgtagcttccttggttgctcatgcaagtcacatacaggagcaatttgtaactgaggttaccgagaattatgagacaacatgctggggttgtggactgcgtgttttgcttccatcatgtgcgtccgctttcaaatgtggatggtgtggggccattacagaccagaacaaaaagaaacctaacctgaagtgcatcaggtggagagtggtgcgtgatcgatgctttgtttctgttgtcctcgtatttatgttttttgtaatatttggtggggtgtgggcagtttatcctgttgtcttttctgtcagtattctttgtggagtttttcactcaatcattacagcaatcttgtccgtagccaccatttcctttttcagctttgcagcatttaggtgtgctggcacaccaccaaatatattatggggaagctaccccactgtagggaaaagtgaccttgaaaattatacttactgtcactactgctcaaagccaaagtcacctagagctcatcattgtcgttcttgtagaaaatgcgtcctggacatggatcatcactgcccattttcccccgtatcccgccttagttgcagcttctttgggggttgccttaattgcagcctcaaggttggtgatttagtcccacatctggtagtgataagaccaaagtag

SEQ ID NO: 115025 - DNA, 421 bp, Glycine max
  Peptide Sequence Number=SeqID_231803
atgggatctagagacaaagatggtgaggagtcacttggtataggccttcagccacgcaactctggctttgacccttcgatcatagcctctttgcctaaactcttgtacaagcaaacggaccaattcaagcaaggtgaagttgtagagtgctcggtttgcttaggcactattgtggaagatgcaatcactagggttctaccaaattgtaagcacatttttcatgctgattgtgttgataaatggtttaattctaacaccacatgcccaatttgccgcaccgtggttgacccaaatgtgcaaccagaacatggtcatgtaggtgccacacgggttcacaaccaagtccaacccacagcaccaccggctgagggtggtgttgagctacaagatgatagtgaattggagagggtggggtgttcag

SEQ ID NO: 115026 - DNA, 192 bp, Glycine max
  Peptide Sequence Number=SeqID_231804
atggcacctgtcaagttgcaaaacgccgtcgtaggaggtgaagcaaatattgccaagatggacgatcgcatgcgacacgcagcgagaacactagtagttggtgaggttgtcatcacaccggaagaggttgtagatagcgtcgaaagagacaagaacaatgaagttgttgtagttggcgagggcgacagttga

SEQ ID NO: 115027 - DNA, 1269 bp, Glycine max
  Peptide Sequence Number=SeqID_231805
atgatttgcccttacataataaatgcatctttgcttcttggagctatattttcatggggtattctatggccattgattgagctcaagaaaggaatctggtatagcacagatctaccttctggcagtctaagtggcatccaaggatatagggtcttcactgcaattgccatgattcttggtgacggtctttaccattgcatcatcatgctaataagagttgcctatagtctcatcacccaatacctaaagaaaagagtgtcatcagcggtagaccctgaagatgttgatcaaaactcaagtgaagattttgattctcaacgtcgcactgagtatttcttgaaagacgagattccctcttgggttgctatcattggctacagtgttcttgcagttatttccatcataacggtttcactcatctttcctcaactgaaatggtatcatgtactaatcacttacctcattgctcctattctggccttttgcaatgcatatggatgtggcctcactgattggtctttggcagcaaactatggaaaacttgcaatcattatattcagttcatgggttggccttgagcatggaggcctcattgctggccttgcatcttgtggtgtaatgatgagcattgtatccacggcttctgatttgatgcaagacttcaaaaccggatatctcactcttgcatctcctcggtccatgtttgtgagccaagttttaggcacagccactggttgtcttgtttcacctttgatgttttggttcttccacaaggcttacacacttggtgaccctcaaggctcttaccctgcaccctatggcgaagtgtaccgtgggatggcccttcttggagcaaagggtttctcttctcttcccaaaaattgtcttgaactggctatcattttctttttattggctgtgtttattaacatagtgcgcgatttgttggagcgttatgagaccaagtataggttacataggtttgttccaaaccccatggccttggccatcccattctatcttggtgggtactttgctattgacatgtgcattgggagcttgattctgtttctgtgggagaaaaagaacaaacagaaagcaaaagattatggtcctgctttggcatctggactcatctgtggtgattctttgtggagtgttcctgctgctatactgtctcttgctggagccaatccaccaatttgtatgaagttcttgtctagagctatgaataacaaggttgacaccttcttgagtggtggtcattga

SEQ ID NO: 115028 - DNA, 372 bp, Glycine max
  Peptide Sequence Number=SeqID_231806
atggattttctaggtttgagaagtgaaattgaggatgagcacagcccaagctttctcataagtcctaaaagacattttgagctaggattaactcactctaacctccaaataccacagaatccagatttaaccttccaaccctcaaggtctcactctttttccactcacaacaccatactctcaccttctaaccctagaaacctagcaagactacccatcatatctcccaaaaccccatacccacgaaaatcaaaggagaaagaagtccacccaaacctgaaatttcgaagtcccacacgtagagacgagcttcacgactccgaaaatgccctcctttcgcgatttggagcagaaatgggcaccaaaggttga

SEQ ID NO: 115029 - DNA, 267 bp, Glycine max
  Peptide Sequence Number=SeqID_231807
atggcaatgctcttcacaatgccttgggatcccaaagaactggattttagtgaaaataataagacacctgaacctcccaaggagcagcctgtttttaattgcccaatatgtatgtctgctttggaagaagaaacatcaacaaggtgtgctcatattttttgcaagaattgcatcagggctgctctatctgcacaggctaaatgccctacctgtagaaaggttacaaggaactcactaataagggtgtttctacctgcaactagttaa

SEQ ID NO: 115030 - DNA, 330 bp, Glycine max
  Peptide Sequence Number=SeqID_231808
atggattcttcaaacagcaatggaggatcacagaggctcctggacttggcgcaacggctccgccttgacaagcccccaccattccctgaagacattttggatcagatcatggaagagaagggagataaggttgtctcagaagtgagttacacagaatcagccaccccaattgctcaaaacacagaaaaaattagatacaagagagctgcagttttgatctgcatatttgaaggagatgctggggatctgagagtgatactcactaaacgctcttccaagctttccacttactctggtcagtccagtttcatacattttttgtttgcttaa

SEQ ID NO: 115031 - DNA, 237 bp, Glycine max
  Peptide Sequence Number=SeqID_231809
atgggttcagtaagttgtcacgtgctctttgctgaggattgtgattataagtttcttcattacaaagatcatgttctcaacgatgttatgaaaggaccacaagtgataggtccatttctgtcagaaaaaggtattttgggaatattgaaaattgttaagcacgtgggggtgagaatagtgcaaagcgagaagagaatagtaattcccagatggaacatagttgcagagaggttgtga

SEQ ID NO: 115032 - DNA, 867 bp, Glycine max
  Peptide Sequence Number=SeqID_231810
atgtttctatctctatctggccacattttgcaacagggtatcttaactcaagagaaactaaatgcatcaaagtcaaacaattatccaggaaaagaatccagtggtttaacaaatggtattaaaagtgaaaaccttgtgtcagctggggtgtcagttgaaactattgctgcaacaaggatccagactgcatttcgagcttataaggctagaaaagctttacgtcgcatgaaaggatttacaaaactgaagatcctaacagaaggcttttctgttaaaaagcaagctagtacagctgtaacataccttcattcatggagcaagatacaagctgagattagagctcgtcgaatctgtatggtaacagaagacaggatcaggaggaagaaactagagtctcaactaaaactggaggcaaagcttcatgatctggaggttgaatggtgtggtggttctgaaaccatggaggaaatccttggaaggatacatcacagggaagaagcagcagttaagcgcgaaagagccatggcatatgctttttcccatcagaaccaactgcttggtaattatgaacttagcaaagctaattggggttggagctggaaggaatgctggattgctgctcgtccatgggaaagccgtatccctagcttatccgtcaccccggagaaagctcaacataagcagccaagcccaagcaaagttcagaaggataagaacacatcaacaccaaaaactcccgtctcatttaaacctccttcagccaatgcaaaagggactcctccctcggccaacgcaaaaggcacttcaaaagctaggagattgtcttatccaacaactgagaaaactctggtccaaagagtgcaatga

SEQ ID NO: 115033 - DNA, 708 bp, Glycine max
  Peptide Sequence Number=SeqID_231811
atgggttcgaacagggcggaggtacgaggttcacagagattacaggctctgattcaccatctccactcttctattccctctgactctaacgaacccaattcaaaattcaccgtttggaagaagagagcagcagttctgatctgcgtcttcgaaggcgccgatgggaatcttcgagtatttctcacccagcgggcttcctctctctcaacccactccggtggcaagagggaagaaggtgatgctgacgatgtacaaacagcgctgagagaggctaaggaggaaattggcttggacccttctcttgtttctgttatcactcttctccctccctttcatactaagaaattggatgaggtagcttctgaaaaggttgagtatggtgttacaataatacctgtggttggagtactgttcgacaaggatgcattttcacctgttttaaattcagctgaagttgaagcaatatttgatgttccattggagatgttcctcaagaacgataacagaagagccgaggaaagagagtggatgggggagaagcatcttgtacattattttgattatgaagatgggaataagaagtatgtgatatgggctataactgctgcaatcttaattcggtcggctactcttttacttcagcggccacctgcatttctagagcagaggcccaaaatatggggaggaatgactgaaaatgacatatga

SEQ ID NO: 115034 - DNA, 597 bp, Glycine max
  Peptide Sequence Number=SeqID_231812
atgtttatgagtgtttgcaagtctggcagtggtcttggcagagggagagacttagagtcatgtggtgactgcccagaaggaattgaaacactttgtgctgatatggaggtggaccatacagatgtgagggttttgatgcttgcgtggaaaatgaaagctgaggagcaaggatattttaccttggatgagtggaggagaggcttaaaagcattaagggccgatactgtaagtaaattgaagaaggcactcccagacctagaaaaagaggtcaggaggccatcaaactttgcagatttctattcttatgctttccaatattgtttaacagaggagaaacagaaaagcattgatatagagagcatttgtgagttacttactcttgttttgggttcaacatttccagcccaagtcaacttgtttgtggaatatttgaagactcaaaatgattacaaggtcataaacatggatcaatggatgggatttttccgcttttgcaatgagataagttttccaacccttaatgactatgattctgaacttgcctggcccttgatcttggataacttcgttgaatggctgcgagaaaaacaaaaataa

SEQ ID NO: 115035 - DNA, 432 bp, Glycine max
  Peptide Sequence Number=SeqID_231813
atgtcattgccaaggcatgggagaagtaaccagagcaccaccattgcttggagcttctggcttccactgccacacttacatcacaagctagtccatgccaccactgttaagggattagaggcatctaggaagaaagtgaagagaataaattgctggactggaagtgagggggtaaaattggtgattaccggagcggaagagatcggcggcgatgggggtggaattggattgacccgtctttttggatgcagaagagcgtcgcatcttcaacaagaaatccagactctctctgattcggaagaagaagaatcgaaacgcgccaaattcaggaaagataaagagaaggagaaaggggttgaggttgagggtgatgacgtggatgcgctgaagttgtggtgtggggtggtgccttacacagtctcatttaagtag

SEQ ID NO: 115036 - DNA, 543 bp, Glycine max
  Peptide Sequence Number=SeqID_231814
atggtggaaagggagaaatttgatcatatagaggaaaggctgagggtcattgaaggaggcagaaattatgcctttgctgacatggaagagttatgcctagtggccgacgtggtcattcctccaaagttcaaggtgtcggatttcgttaagtataagggaactacttgccctaagaatcacctgaagatatactataggaaaatgggggcatacgcaaaagatgaaaaattgttgatgcatttcttccaggaaagtcttactggggaagccgtcacatggtatactaatctggaaccgtcccagtatcagtacaattctgatatggctccggatagaatgcaactacagaacatgtgtaagagggagcatgaatcttttaaagaatacgcccaaaggtggagggatttggcagctcaagtagcacctccaatgatggaaagggaaatgataacaatgatggtagactcattacctgtgtttgcaggtgagaggatcgaggtaggcctaagaaaaggcaaatttgattacggctttgatgaatag

SEQ ID NO: 115037 - DNA, 284 bp, Glycine max
  Peptide Sequence Number=SeqID_231815
atggagctacatcaagatgtagctagtcataaggatggtattgaggctgatgcaaacgttgatggacaagatgatgaagctaaggaggaggatggaggtagcaacaatgatggttcaaaggagccacttgtccaacaagtgaaacttggaccattgaggaagaccataggcacgtatgttgagggtgcttggtggatcctcaacctagtgctagaggtttttgtggtggctaacgctgaatggaatgatagaatagatgcatgggtggttgaatccctagagag

SEQ ID NO: 115038 - DNA, 276 bp, Glycine max
  Peptide Sequence Number=SeqID_231816
atggaaacatgccgtggcagtgccttcgcggtgtcgagcccatctccattttcagctacaaagaaatggaacaagaaattagggtatggtagggaagggaatggacgagtgctcctttgggttggtaaatgtggctttaatttgttagttagcgcgaatggtgcaacaaggacatataaggggatgtcggagaatggagggaggggggaggcagtagttgctgtctacagtggaggaatattcatagagaatagagaggagctgcgaggggtctga

SEQ ID NO: 115039 - DNA, 375 bp, Glycine max
  Peptide Sequence Number=SeqID_231817
atggttcctcctctagctgaattcacactactagttctcctccaaaatcagcgggtcacccaagaactggttgagggcatctgcatcgaaggggatccagtgatccctcacccacgagcgcatggctcgaaccccctcctcagtgggccaggcattggcatagaattctatgactatctccagggtactcatcctcctgagctggacacgcctctccctgtggaacgaccatcccttgatggcctcaaagtgctgctggtgctcggcacttcggaaccagtgactatcaaactccaaggcggcactggagtcttctccagtggcgtcctttctagacctcttcgtggagagcttcttcggagctatctcctatga

SEQ ID NO: 115040 - DNA, 417 bp, Glycine max
  Peptide Sequence Number=SeqID_231818
atggcattagggtttgagggttatagttatacaacaacacttggaaggaaaagggttgtgttattacacaatgaagcttctaatctcaactacaatacattggtgaatccattgaagagaagaatgagtagtgagaaattcacttttgactctaaaaggtctcgccttgaggcttttcctgttgatgttctgtgttggggtttgctattgctggctgaggtcgctaggaggatgcattttgagtatagcactccaaagaacataaccttagctattcctaaatcgtttgatatagagggtgctactaggcttgaggaaattaacactccaaaagccccatttaggaaacctaagttaaagccgattggtaaaaatttggcaagcatcccagtggcattgtttgcttccactaattaa

SEQ ID NO: 115041 - DNA, 2619 bp, Glycine max
  Peptide Sequence Number=SeqID_231819
atgctggggaagacgaggaaggtttcggcgcgtggcgaagccgtggcggcgaactacgccttcggtccctccgaagatgacgtaatcatcaaacacaggcttctcacgcgcaccaccaccaccaggggtgaccctcccttgaagaagcttcagaagaagttcaccacgttcgtctccgaagtcgacaaagacgaagacatcaactacaacgactgcgagaagctggctagagcgtttctgcaggagctgacgacattcgaaattccgcttctgaagagcaaggcgattgtggaggcgaacgttagggagaaggagaacttcaacgagttgaaggaggaaatgaatcgccagatcctgctggcgcagtccgacattgaggatctcaagaagcagcttgaggagagcaaggttgagaggaggcacaaggaggagtgcgaggctattaggaagttgattgccatgcagcccccgagatccgagacaatgaaggttatttcggagttggagaaggaaattgccgcgttggatgccgagaacacggctggttcgaggttgttggagctcaggaagaagcaatttgcgctgttgttacatgtgggtgggcctggcactaattttgggtcagtagtgactggattaggaatggatggtttggggaagacaaatgagttacttgtgcaaatggacagctggcaacatggagtggatgagttgcagaacacaatagaggaagagcaaaagagccttgtcgaggagatgagaatggcaacggaggagcttaagaatgggatggtgtttgatgatttgagggatataactttatctgcttataactatatgattaatggctatcacaaacaaggccaagttgaagagtctcttggtttagtgcataggcttttagtgtctggtgagaatcctgatggctttactttttcaatgattttaaaggcgtctacttctgggtgtaatgctgcgttgcttggtgatctgggtagaatgttgcatacccagatcctcaaatctgatgttgagagagatgaagttctttatactgcactgattgactcttatgttaagaatgggagggttgtttacgcaaggactgtgtttgatgtgatgttggagaagaatgtggtatgttcaacatccctcatctctggttacatgaatcaagggtcttttgaagatgctgaatgtatatttctgaaaacgttggacaaggatgtcgtggcatttaatgcaatgattgaaggctacagcaagacgtctgaatatgccacgagatctcttgacctttacattgacatgcaaaggttgaacttttggccaaatgtttctacgcaattggtgcttgttccatgcttgcagcatttgaaattgggcaacagagttgtggatactcgaagagtttttgaccacatgcttgtgaagaatgttttttcatggacatctatgattgatggatatgggaagaatgggtttcctgatgaagcactcgagctatttgtaaagatgcaaacagagtatggcattgtacccaattatgtgacactccttagtgctctctcagcttgtgcgcatgctggacttgtagataagggttgggagatcattcagagcatggagaatgaatacttggtaaagccaggcatggagcattatgcatgcatggttgatctgttaggtcgagcagggatgctgaatcaggcttgggagtttatcatgaggattcctgagaaaccgatttcggatgtgtgggctgctttacttagttcttgcagactccatggtaatatagagttggcaaaattagctgcaaatgagctttttaagctgaatgctactggaagaccgggggcatatgttgcactatctaatactttggtagctgctgggaaatgggaaagtgtaaccgagcttagagaaataatgaaggagagaggaatatccaaggacactggccgaagttgggttggagctgatgatggtaagcaatcaacaaggattagaagcagcagtggaagcaacggctacttttctgagcaacgctgtgaagccagtcattgtgggagggccaaaactaagggtagcaaaggcacaaaaggcctttctggagtttgcagaagcttgtggatatccaatagcagttttgttggccccatcttcaatggctatagctccgttggatactcattgttgataaagaaggagaaagccataaaagtgcagcctaatcgggcgaccattggcaatggtccttcctttggctgggttttcatggctgatttcttaacagcattggctaaaaaagtgaagaccaacactgcaactgtggagaattaccgatgtatctatgtcccaccaggcattcctctgaggcgagagaaggatgaaccacttagagttaatgttatattcaagcaagttctatttataagctccttcaagattttagatcaagaagttcttggcagggattcgaattggaattctctacctgttgccagtaatcgtgttgaacaggaactgctgagcggagatactgctgtaatagctgaaactggagactcatggctcaactgtcagaatctccgtctgcctgagaattgcggctga

SEQ ID NO: 115042 - DNA, 576 bp, Glycine max
  Peptide Sequence Number=SeqID_231820
atgacaagggcaaagttttatctcttcggtgattccatcactgaagaatctttctcagttggtggatggggtgcttctctcgcccaccatttctctcgcacggctgatgtggtgctaagaggttacagcgggtacaacacacggtgggcgttgaaggtgttggagagggttttccctgggtcacatggcgttgacggtggaaccggaacagcaccaattgctttgactgttttctttggggccaacgacgcttgtgttccagatagatgttctgcttttcaacatgtacctcttcatgaatacaagcagaatcttcactccattgtttccttcttcaagcgtgctttggttgcgtatattgcatgtcacgaaagggttaattatttgtcatttggtggggtcgagtgttatgatgattttctggtcaaatatggttgtggggtttcacgaattgaatggggagaattgagaattgagatttcagaggtggtttcagctaacacacgtgcgtggccgtgggcatgggaagtgtggttgttgtgtttgccacttgaccattatgatacgctgtcataa

SEQ ID NO: 115043 - DNA, 390 bp, Glycine max
  Peptide Sequence Number=SeqID_231821
atggtgattgctcctttagttgttgttcgaaacaacaatgaagaagagcaacacaataatgagcctatgatacacaataaacctattgtcaaagaacaacaagaagacctcttagaattgcctaagggttgtaagagagttggttgcaagtgggtcttcaagactaagcatgactctcatggaaaccttgaacattacaaggctagacttgttgctaggtgtcacaacctgccctccggcgggggcacgccacgagactcaaaggtgcatcttccatttgaggaaaacgcgcggagttgccatcaatgtttattcgagggaaacattgaaaaaaccaaaatggaaaggttgagggtctacgtatttttgaaaatgagggttcgagagtaa

SEQ ID NO: 115044 - DNA, 168 bp, Glycine max
  Peptide Sequence Number=SeqID_231822
atgatgaggactgcagttctgatgaaaactcaaagaagggtcctccagcgaaggtgttgtggtatcttcccatcattccaaggaattaatgaagcattgggcttgaatctagaattgggcttgggcttgaatccagcattgggcttggacttgaagagggcgaactaa

SEQ ID NO: 115045 - DNA, 309 bp, Glycine max
  Peptide Sequence Number=SeqID_231823
atggggattcaaatctttgaggtagagctttcagtgctagagcttgtctccaaggaaggaggtcctgaaacattttgtggattttttattcgtgcccctacaattctagaagcatggccagaagttcaagtgctagctgattatcctgtaccttctagcagactgttgagttttgattcctctattgaagaccaaatggaagtagctgtagaggtggttcaaaagttgcaaccacgtgaagcatcagctgtgtttattgaggtgaaatctgaaaaaccattttatcgcattttgttttggattgtttag

SEQ ID NO: 115046 - DNA, 285 bp, Glycine max
  Peptide Sequence Number=SeqID_231824
atgcattttctcattcagacagatgctagagatatccctgttgcacctgaaaagtctgttgttgcatttaaaaatgagaatccaacagtttcagtgctagagaagaaagaaatatatcttcttcctattgtacggatgagcaatttgctgcattcccagatagatgccattctaagtgaaacagttgtagtgggggtgggaaagtctatgaaggttgttaacatcaacaaagatgctgatcaaatgcctctacaagtagaagaagaagatctgaaatggtcttag

SEQ ID NO: 115047 - DNA, 228 bp, Glycine max
  Peptide Sequence Number=SeqID_231825
atggaggtagaaatgtgcaccttagaagtcacagacaatcaaaggtactggaatgtgtgtgcggtacattacaacatgggaactgcttcaagagtagaaggaagtaaaagaacaccctatgacacccctgctatgcggaagttattgttagatgattcccaacttcagcagagaaaaagaatggcacataaaaagcaggcaatagatcgtggcaggccaaaaagatag

SEQ ID NO: 115048 - DNA, 1584 bp, Glycine max
  Peptide Sequence Number=SeqID_231826
atggagcaggctgaaactaggtcaccgagaatggtgcagcaagatgcaagtggttgcagtgagagtgctcgagataatagtaataataacttggtgaatgtccctcgtaggaggagtatttcaggtagttcttctgcaagtccttcaatgagtcctcagaaaacaaggaatggtgattttgtgccatattattacacgtattccaaaggaaatcagttctggtccgcaccagaaatgccttcttgtgaagcagggttgctacctcctgccttctttgatttatccgcgttaagcacagaagcttccctttctcccaactcccatcaaagtctacagatgaaaagttcccagaaacacaccagaacttttagtggacctccatcccccatacattccatgttaccacttgagatctcaacagcacgccatgaaagtaatgctcctcctgtcggtgttcacccattgcccctgcctcctggagctgccttgacctcaccgcctgctgctgctaccttttcccatgccgtggctaagtcagaatcgttcccaatgaaaagccaatggaagaaagggaaacttattgggcgtgggacgtttggaagcgtttatgtcgcaaccaataggtatgctctgaaacagatgctgcttcttgacagggaaaccggagcattatgtgcaatgaaggaagtagagttatttcctgatgatccaaaatctgcagagtgtataaagcagttagagcaggaaattaaagttcttagcaatctaaaacattcaaacatcgtacagtattatggcagtgaaatagttgaggaccggttttatatttatctggaatatgttcatcctggttcaattaataaatatgtccgtgaacattgtggtgccataacagaatctgttattcggaatttcactcggcatattctctcagggttggcttatttacatagcaaaaaaaccattcatagggacatcaaaggggctaacttgcttgttgactctgctggagttgttaagctagctgattttgggatggctaagcatcttactgggtttgaagctaatctttctttgaggggaagtccatactggatggctccagaggctgtgatacaaaaggataacagccctgatcttgcttttgctattgatatttggagtttgggttgtaccatcattgaaatgttcactgggaagcctccttggagtgaatatgaaggagctgcagctctgtttaaggttatgaaggagacccctcctatacctgaaacactgtcatctgagggtaaagattttttgaggtgctgctttaagagaaatccagcagagcggccaacagctgcggttttactagaacatcgatttttgaaaaactcgcaactgctggatgttttatcttccacccagctgtataatgaaacaagcttcatggacaaaccacatactccaagtaggcaatctgaaaatagttatgatcagttgtcaaccccctgtgcaaagattgcaaagggtaaagctgctgagaggcgaggatttctcatttcttcgtttgatattctccctgcatacttggaccaataa

SEQ ID NO: 115049 - DNA, 399 bp, Glycine max
  Peptide Sequence Number=SeqID_231827
atgtctttatttgctagaagtgtttccacactacgggtgcttatattgttattatcaacgttgaacaatactatggcagtgaaagcacttattagggttacaaatgatctgggagttctagacataactgtttcctgcaaggttgatgataatcatccacacgttctcagccccggtacttactatgagtggaacttttctcctgataacgaatttggaacggaaccattattcagtaattgttcctttcaatgggaacgtggccattatcacacatttgatctgtacgtagaagttcgtgatggtgattgcagcaagtgcttatggcttattaaaccagattctccatgtaggtatacgggtaattcaaggtttgcttgctatcaatggaaaacttaa

SEQ ID NO: 115050 - DNA, 348 bp, Glycine max
  Peptide Sequence Number=SeqID_231828
atggctgtggtggcaaaagccatgaggtggttgcccacgctttcgttctccccttcgaattcttcttcatcttcttcgtcgtcttcttctgcctccgctgcttccgccgtggatcaccgccggaaggcgtggctcttcggaaattcgtcgaagaagcgcgcctgccacgtcggcgaccacgacgaagatgcactagtttcttcccccggcacgcctcagcagttgcctctgccggagctctccgccgccgccgtgctccgtcaacaagacggtgagtgccgccttccctcgcccaaggacgctgcacccaccaccaccggctttcggatgaggagggaagctgcgtag

SEQ ID NO: 115051 - DNA, 216 bp, Glycine max
  Peptide Sequence Number=SeqID_231829
atggagttcaaggtattggtgaaggtggttttgttgctttctctgataggattcactgcaactactgtggatgctactctcttcgacccaagttccttcatcactcggctactccccaacggtgaaatgttgggccaagctgccactcagcttgtagaacttgttgctgtctatggggcaaccctcccaagtgtcactgccttgaccataccctaa

SEQ ID NO: 115052 - DNA, 156 bp, Glycine max
  Peptide Sequence Number=SeqID_231830
atgacgtgcatgatatatattaatagcaaagacataatagtcctgtcgcgtatggcgttgtgttgcggcaaaatgcatgatttcaagtcaccttgtggatttgagggagtattcgttgaggagcacctcggtgatcatgaggcaagaacttgctag

SEQ ID NO: 115053 - DNA, 1203 bp, Glycine max
  Peptide Sequence Number=SeqID_231831
atgaagatctatattttgctagtcattacttccttcacatttggtttccttgagaaagttgtttcaaatccaagtcctcgtccatataaggcaattttcaacttgggtgactctctaagcgacactggcaatttccttgcatctggtgccattttattcccagttatcggaaagcctccctatggtcaaaccttctttaagcgtgcaaccggccgttgctcagatggacgactaatgattgattttatagctgaggcatacgaattgccttatttaccaccctatctggcacttaccaaagacaaagacattcaacgtggagtaaattttgccgttgctggagccacagcacttgatgcaaaattcttcatcgaagcaggacttgcaaaatatctatggacaaataattcattgagcattcaacttggctggtttaagaaactgaaaccctccctttgcaccactaaacaagattgtgatagctacttcaaacgctctctctttctggtgggggagataggcggtaatgactataactatgctgccattgctggaaatattactcaacttcaagctaccgttcctccagtcgttgaagcaataacagcggccattaatgaattgattgctgaaggagcaagggagctgttggtgccggggaattttccaattggatgctctgcgctatacctaactttatttagaagcgagaacaaggaggactatgatgacagtggatgcttgaaaactttcaatggctttgcagagtaccataacaaggagctcaagctagccttggaaacactaaggaaaaagaatcctcatgcaaggatactgtatgctgactattatggtgctgccaaacgtttcttccatgctccaggacaccatgcttgtaaaacagtgtgtggattaactaggcatgggtgtttctggtttaaccagagtatcaagttcaagattgcctacgggtttactaatggggcgttgagagcatgctgtggtggaggtggaccctacaatttcaacatttccgcaaggtgtggtcacacaggttcaaaagcatgtgcagatccatccacatatgcaaactgggatggaattcatttgacagaagcagcttataggtacatcgccaaaggcctaatttacggtccattctcatatcctcccctcaagatctctcccaacaagatagcctag

SEQ ID NO: 115054 - DNA, 1011 bp, Glycine max
  Peptide Sequence Number=SeqID_231832
atggcgagtcttgcatctccaaaggctcatcaaacccaaggtctatccttggtgagtctcacagctccaaaggcttgtcaaacccaaggtccaccattggttagtctcgctcctctaaaggctcgtcaaatccaaggtctgcccttggtgagtctcgcatcctcaaaagctcgtcaaacccaaggtttttccttggttagtcttgcttctctagaggcttgtcaaattgaaggcttgtccttggtgaatctcgcttcgccaaaggcttgtcaaactcgtggtccgaccatggcgagtcttgcatctccaaaggctcgtcaaacccaaggtctttccttggtgagtctcacagctccaaaggcttgtcaaacccaaggtccaccattggttagtctcgctcctccaacggctcgtcaaatccaaggtccgcccttggtgagtctcgcatcctcaaaagctcgtttaacccaaggtctttccatggtacgtctcgctcctccaaaggctcgtcaaacccaaggtccatcccttatgagtcttgcttcttcaaaggctggtcaaacccaaggtccctcgtgggtgaatttcgcttcaccaaaggcttgtcaaacccaaggttcgtccttggtatgcctttttgagtctcgctcctccaaaggctcgtcaaatccaagcttgaaaggctggtcaaacccaaggtccgtccttggtgagccccgctcttccaaaggctcgtcaaacccaaggtccacccttggtgagtcttggatctcgaaaggctcgtcaaactcgaggtttgtccttggtgagtctcgcttctccaaaggctctttaaacctaaggtgtatccttggtgagtctggcttctccaaaggctcgtcaaaccctaggcctattgttggtgagtctcacttcgccaaaggctcgtcaaatccaagatccacccttggtacatactcctacaaaaacctaagacatgcttttggtaagctcactcctttggaactatga

SEQ ID NO: 115055 - DNA, 1278 bp, Glycine max
  Peptide Sequence Number=SeqID_231833
atgaagatgaagttgtctctggttccatatataaaacacgcggtagcagctttgatcaaaaggtgggttggtatggaaaagaagatcatgaatagcagcatagcgaaaaaatggcgacaactcagtgggcaagatcattggaagggtctgatagaccctctggacattgatcttcgccgctacatcattcactacggcgaaatggctcaagcggcatacgatgctttcaacacggagaaagcatcaaagtacgctggaagcagcagatacgccaaaaagagtttcttctccaaagttggtttggtgaatggcaaccccttcacgtattccgtgacaaagtttctgtatgcaacttcggaaattgacgtccctgatgcgttcatcataaagtcgttttctagggaggcttggagcagggaatcgaattggatagggtatgttgcggtggccacagatgaagggaaagctgcgttgggtagaagggacattgtgattgcgtggagaggcacggtgcagacattggagtgggttaatgatcttcagtttctgttggttcctgctcctaaagtgtttggtaagaacacagatcctaaagtgcaccagggctggtactccatttacacctctgaggaccctcgttctccctttaataaaaccagtgctagaacccaggtcctaagtgaggtgagaagactggtggagctatataagaatgaagaaataagcataacaataaccggtcacagtttaggtgctgcaattgcaacccttaatgcagtggacattgttacaaatgggtacaacaagccaagtgatccatctctcaaggcttctccagttactgccattgtgtttgccagcccaagagttggtgacataaactttcagaaggttttttctggctacaaagatttgacaaccatacgcatccgaaacgagttagatattgttccaaactaccctcttgttgggtattcggatgtgggtgaggagttgaagatcgatacccgaaaatcgatgtacttgaagagtcctgggaatccatctagttggcataatttggaggcttatttgcatggagtggcaggaacacaaaggagcaaaggagggttcaaattagaggttcatcgcgatattgcacttgtgaataagaccttggatgctctaaaagatgaattccttgtgccagtgtcatggaggactgaaaagaataagggtatggttcaacaaaatgatggttcgtggaagctgatggatcatgaagatgatgacttttga

SEQ ID NO: 115056 - DNA, 901 bp, Glycine max
  Peptide Sequence Number=SeqID_231834
gttcaagtctttcgatgaggatctgttaacccttttggagagggtcgacagggctatcttggagcagttgtcggcctcgctggatgcgtgggccattttgtcttttccatcggcaggcgatcccctcgttgccttggacgaagggagtcaacccattgttgggattgaccctactaataaagttgttgaggtctcccccaacatgctttcctctgttttggctaagagaaagcatgatgatggtgttggggtctatgagggaagctgccaggttgatgctcagttcgggttgcccctccaatttgtagggtcccccttggctctgtcggccgttcaggctattgctcttattgttgccgctcatgctcctcctcctcctgctacgtctacccaggagatttctgcttctcctgctactgaagttagtgctctggtcgcttcggacgatcctgttaaggctccttcatccaccactgccacacccttgctaagtgctggtgtagcaaccacaagcgctctcgcgatgccgcctccttcttcttcagctccaccaattctcccctcagttgtcttagcgtcagtgtcaccttccacctcttctcaccctaattctgccaaggtcttccctcagcaaagtttggtgatcctggaagagattgggcaaaagcaccaagaggtgttaagtaaggtggcgtccgaggctaaggttgccaaatggagggccacagctcgtatagtttggagagtggagccccctaaggtggccaatgccatcatcgccttcgttaaggccgtgaagttgaaacatcagctatcatccaaagttggtagtgttcttgccaagttgttgtgcactagattagatggtgacaagctgttcgagtgctacaaaggcttgtag

SEQ ID NO: 115057 - DNA, 2325 bp, Glycine max
  Peptide Sequence Number=SeqID_231835
atgatgatttcctttatatggttagttccaagtgacgtgctggaccttgtcgtttcagtcatggaagcctcgaaagcacatacaaatcacttattggcatctcacgatctacttctgcaaagtagtttagagaatggaagctacaataaactccacagttacaaacacattatcaatggcttttctgtccacacaaccccttcccaggctgcaagactaagaaggagcccaggagttaagttggtagagaaagacagaggagcgaagatgaggacaacatacacacctgagtttctaagtttacgaaaagggatatgggcgcaagaaggaggagaaagaaacgcaggtgaaggagttgtcattggttttgtggacagtggcatcaacgcacttcatcccagctttgcttacgatcccatgcaccctttctcatcaaatctctctcgttttgagggtgcctgtgagacgggtcctctcttcccacctagttcttgcaatggaaagatagtagcagccaggttcttctctgctggggctgaagctactgttacgcttaatgcttccatggattttctttcaccctttgatgcagatggacatggcagtcatgtggcatctgttgctgctggcaatgctggtgtttctgttgtggtgaacggttttttctatggaaaagctagcggaatggcaccacgtgcaaggattgctgtttataaggctatctttccctccgtgggaactctggcagatgttattgcagctatcgatcaagctgttctggatggggtggatatcttatcactctctgttggaccaaatgaaccaccagaaagcaccgtgaccttcttgagcatgtttgatatttcgttgctatttgcacgaaaagcgggagttttcgtggtgcaagccgcagggaacaagggtccagcatcttcaagtgtagtgtcattcagtccctggagtgttggtgttgccgcttgcaccacagacagaaggtaccctgcttcacttcttcttggaaatggttcagtacttaatggcgcaggactatcaggaccaacttttggaaatggatcagttttgcataagcttgttttagctaaggatgcagtaaaaataaatggaacaactcaggagtacatagaggagtgccaacatccagaagttttggaccctaatatagtgttgggaagtatcattatctgcaccttctcaacgggcttcaataatggaacctcaactcttaatgctattattggcacctcgaaggctctagggttggagggctttatcttagttgcaaacccaaactatggtgattatattgcagagccaatcccttttgctgtttctggtattatgatccctcgtgtagatgatgccaagtattatgaagaacaaataaagagggataggaaaggaactgccacagaatttggtgctatggctgctgtgggagaaggaagagttgcctctttcacagggagatcacctatagttagtagattttcttcaaggggtccagatatcattgacatgcacaataatcttgcagatgtacttaaacctgatattcttgctccagggcaccaaatatgggcagcctggacccccatcagtgccttagaacctatgctaaaagggcacgattttgcgttattatctggtaccagtatgtccacacctcatgtggctggaatagcagcacttataaagcaatacaatccattatggactccagcaatgatagcatctgcaatctccacaacaagctcaaagtatgataatcttggagagcatatgatggctgaaggctttgaggccagcagcttgcttccctccactccttttgaatatggggcaggctttgtgagccccaattgtgccattgatccaggtttggtactatcatcagaacatcaagacttcatcagcttcttgtgctctttgccaaacatggacacggatgcaataattgcagctactggagagcaatgcaatcacccctttgcctatccattcagtctaaacattccttcagtaacaatatctgcactaagaggatcagtttccgtgtggagaactttcatgagtgtggggaacaacacagaaacatacttggcctctgttcaacctccaaatggaacaaaagtctacctgtatccaacttggtttaccataagtccacaaggaacacaagatctggaaatacaactcagtgtcatccaaccaatgtcgaattttacctttggtgaaattgttttaacaggaaatttgaaccacatcgtacgaataacgttgtcagttttagcaatttcggtgtaa

SEQ ID NO: 115058 - DNA, 213 bp, Glycine max
  Peptide Sequence Number=SeqID_231836
atgccgcaagcagagagttataaagatgctggcaagttgaagaaggcagggccaaatcaattttcggaagactttatgctgaaagacaacgatagcgaagtggttctggtagaaggggtggtgggtgatggtgaaaagaatcgtggggttttgggtcttgatggatcagaagatgaggctaactatgatatctgtatgggattattgccataa

SEQ ID NO: 115059 - DNA, 2109 bp, Glycine max
  Peptide Sequence Number=SeqID_231837
atggtagctggcaaggtcaagctctcaatgggcttccccaagtccctggcgccccctactcctccgcattccacccccggcaactcctccttcacgcgctctttcggcgcatacttctcacgctcctccgctcaggttcagccccgcccctccgacatcctcgacctcctccgcctcgtggaggaccttcgcgacagagagtctcgcctcaaaacagagcttcttgaacacaagctcctcaaggaaaccgtgaccatcgtcccccttctcgagaaccagatttccgcaagtgacgcgcagcttgaaatcaatgccaagaaaatggaacaagtggaggcagagaatgagaaactgaggaacgagctcgaagaactaaagctccgaatggaagaagagaaaacagagaacatgagaaaaactaaggcgttggaggatgagatagcggagctcaataaaacggcgtcggatcccgtttgcaaggcgttggtaaacgacgaggattcttcgcttgaatgcaagtcgtttgaaaacgacgagcatttgcaaacgcctttggaggtgccagcgaggccaaattttatcaagagtttgaaaaaaacggcgttggatcatacaagtgtgaaccacaagcagcttgttgttgttgttgcggattttaaaccagaggtggcggaaagtgaaagaccgcgtcgtgactcggaggaactcgctgattctgccgagtcgagtttaaccaggtcacgtgcgcctcgtgttcccaaaccgccgccgagacggtcgttgtcttcttcgactctgctttcttctaagaatggcaatttcaaaatggagcaagtgatttcgcaacctccgagggtggcgccgcccccgcctcctcctcctccccgggctgcgtctaagtctgctccgcctcctccgccaccgccgcttaaggggagtaggcaggttacggcgaaggtgaggaagataccggaagtggtggagttctaccactcgttaatgaggagggaatcgcagtcccggcgggaatcagtctccggcgatgtggaagtgccgcctacgacggcgaatccacgtgacatgatcggcgagattgagaaccgttcatctcacctgctcgcaataaaaacagatgttgaaacacaaggagactttatccgatgcttaatcaaagaagtggagggtgctgcatttacagacattgaagacgttgttctctttgttaaatggcttgatgacgagctttcttatttggtggatgaacgagcagtgttgaaacacttcgattggccagagcagaaggccgatgccctgcgtgaggctgcattcgggtattgtgatctgaagaagctagaatctgaggcttcttcgtttcgtgatgatcctcggcagccatgtggtccagcccttaagaagatgcaggttctctttgaaaaattagagcatggggttttcaacatctctagaatgagagaatcagcaacaaatagatacaaagtcttccacatacctgtccattggatgcttgataatggttttgtgagccagatgaagctggcatctgtgaaattagccatgaagtacatgcggagagtctctgctgagcttgagacaggtggtggtggtggtcctgaagaagaggagatcgttgtccaaggagttagatttgcatttcgagcacatcagtttgctggggggtttgatgtggagacaatgagagcattccaagaattgagaggtaaagcgatgtcatgcaatcttcaatgtcatagccagcaacagaaattcttttgcagtggggaactccaaactcagtttggaaagaaaaatgagtttgacatgtttgattttttcccaaaagtatattggaatactttttcaaactcagtttacaaatttaagtttgatccaaacttaagtttacaaactaaaattcaaacatgcactcgaatgaccctcatcttaccgggtgcaatcataattcatccattcattaaattattaatgaacgactgggaaagggaaacgagacatgcactcaaccagaaacaccaattgtttcctctcgttcacgttggtgttgctattccaccaaaaccacttccttaa

SEQ ID NO: 115060 - DNA, 249 bp, Glycine max
  Peptide Sequence Number=SeqID_231838
atggaaatcagatttgagccaaatatctgtcatcaaatagggaatgaaacccggacgactaaagctactgcgaagacttgcagtttgctgaggtcagaggttgcgttggttggccatggtggcgaggaggaagaattagggttcgagaaggagaaggggaaattgaaagtggaaagcagtcgtgggaaagactacttcgtccaatggtccaggaaagtttcacactgtgaagggcaattcacgtgctag

SEQ ID NO: 115061 - DNA, 1781 bp, Glycine max
  Peptide Sequence Number=SeqID_231839
atgatgatctcaaaggttgattcactcagacgcaaaatgagagtggaaggagtagtagtacagtggtcagatctacctcatgacctgctttcaagaattactaatggtctagggcctattgactttctcagcttctgtggtgtttgcaaagattggcgcgttgcttcttcaaaatcttctcctcaagccccaaggataaacgctacaccatcaacatcccagaggccagaactagatggagcaacatgccttgcatcatataaaggattaactactgagcatgttgcagcactttcatctccccccacttctcaagattgcattgttgctgtgcttaaccgcatcagtgattctgaattagaactcttcatgcttcgtcgtggggagaaccaatgggtgcaggctaagcactcccttttgcgcattaggtttaatacagtaagagcagctttgttccatgaaggggaggaacttcactttttggacggggatgataacttggttacctttaatgcttctaaaaccaagcaatgggaagaatttcgtttatcatacgcaaaaaccattttcaattggaggataattaagaagaaattaaaagtgggattattagaggcaaatgtttcaatttctacatgcgggactgtaattccacacgctggtggtgaacttgacatgctaattcagagtgaaagcattgagccagcaactcatcaatctgaaagccgtcatcatcgtaaaggggtatggatccaaccaagatatttttatgttcctccgggtcaaaaatgggtgacctcaaaggttgattcagccacatacaacaagatgacaggggagtggtcaaatctgcctcatgaccttctttcacgaatttcgagtggtctagggcttattgactttctcagtttccgtggtgtttgcaaagattggcgagttgtttcttcaaaagtttcctctgaagttaaacaatctcttgggtgtgatccttggtttctcgtgtatgaagaaggggaagattctcactctcagtgttcccttctaagccaccaggatcaactctacaccatcaacatcccagaacttgatggagcaacgtgccttgcatcgtacgaaggatggttacttctctttcgccacggttcattgttcttctttagtcccttttctagggcaacaatagagcttccaaattgtcctttcgctgaagcaactgatgagcatgttgcagcattttcatctcccccaacttctcaaaattgcattgttgctgtggttaaccgcatcagtgattctgaattagaacttttcatgcttcgcagaggggagagtgtgtgggctacgcgctgctgtcatggctataagtttaaaacaatgataacaggtttgttttgtgaagggaaggagtttcactttctggacctgaagaatggcttggctatctttgattctgaaaccaaagaatggaacaagaacaactatcgtatacgttgtcaaagatcatcaagggatatatctgcatcatcgctccgagcattgcgctatgtggtacgtaaaaacgtttttcaggataagagtataagaacagtgggattattattagacgacgaaaatgtttcgatttctacatgcgggactgcaattccacatgctagtgttgaatttgatcagatcgtaattaagagtgaaagcattgaggcagcaaagcaacctgaaagccgtcatcttaaaggggtatggatccaacccatatatctttgtgttcctcctggccaaacatg

SEQ ID NO: 115062 - DNA, 861 bp, Glycine max
  Peptide Sequence Number=SeqID_231840
atgaattcaacaaggaacaaggctttgatagttgaggcaggaatattgtccaagctgcctaagacaattgaccttgtagatgaatcaacaacaagtaaattggcagagatacttttgtcattgtcatctcttgcaaacactcaattccctcttgcttcattagactttataccgttacttagaaacattcttgagacaggcccaagttttgacaccaaaagttcgtgtttatgtgccttacataacctatcaactgtgttagagaatgcatgccctttggtttcaagtggggtggtccctatcctcttggatgtgtcctcaataaaagaaatttcagagaaagcacttgccactctagggaacttgtcagtgactttgatgggaaagaaagcaatagagaacaattcaatggtgccagaaacctttattgagatcttgtcatgggaagacaaacccaaatgccaagagttgtcagtgtatattttgatgattctagcacatcaaagctcactgcaaagaaagaaaatggcacaggcagggattgttcctgtgcttcttgaagtggttttgttggggagccctttggctcagaagagagcaatgaaactattgcaatggttcaaggatgagaggcaaaccaaggtggggccacattctggtccacaaacaccaagatttgcaatggggtcaccagtgaatcaaagagaagcaaaagaagggaagagattgatgaagagtttggtgaaacaaagtttgcataggaatatggaaataatagcgcagagggcaaatgcagcaggggagtcttctagattgaagtctttgattattagcacaagttccaagagtttgccttactaa

SEQ ID NO: 115063 - DNA, 816 bp, Glycine max
  Peptide Sequence Number=SeqID_231841
atgtgtagatcgtggtgggcgaggacgagcccgaggacagaatcatcaacccctttaagaaggaggtcctcaaagccgaagccacaatcaagagcttggggacagaataaacacgattctgaaaagaagaaaaaggatgttgctgatgatgatattgatgattgggaacttccacatggtattgctgatacaatgggatgtttgcaaagggagggtcgtttgcttcagggagagcataatcttttaggcgaagcatttcttgttatgtcttcttctgctgggatccaacaacaacaagatgttttaaggtggttactagaacctttaagcgttcagtggacacaattggagtggcaggataagtatttgtcaggtccacacggtttggttcagttgtgctcagatgtgcctgttatgtggtcaatttttcatacagtgacattctttgagagggcacttaagaggagtggattgaagaaagccaattggaattcagaaaacagctcaacaccaaattcaatccctttaaatccaatggcctctcgcatatcatggatggtgactcctctcttgaaactacttcgctgtatacattccctttggtctccatctgtaagtcaagctttacctggtgaggtcagagctgcaatggtcatgggtgatgttgagaggttcagtcttcttggagaagggaactctaaattaccaaaaggtgtcacagatggatctaagattgacatgaataaagaaggatacactgaacccaatgaatcagatattcgaaattggtttaaaggcatcagagacagtgggtaa

SEQ ID NO: 115064 - DNA, 464 bp, Glycine max
  Peptide Sequence Number=SeqID_231842
atgtcaaccccttcatcatcatcatcatcatcttcttctatttgggtgttgtctaacataaagcttcagttctttgcccgcatcagaaggtttctccaatccaaagcaaccagaaagcgttgtgacccctctgatcggtttgacacagctaagagcagagttgaacacaacaacaaggttgaaaatcttgaaacagttcacgttatggagaagcataaggaggaggaagagtctgtgatcatgttgcagagaactgtgaagatgcttcactttggaagctgggaagagaagatagtggcagcaaaggagattgaaaagttagccaaggaagatgttaaggttagtaagttgataacagaacttggcgtggtgccggtgttggtatctatggtggcgtcgccggtggctagccgccggcgagtagggttgacggcgttgatccacctagctgatggaacctacac

SEQ ID NO: 115065 - DNA, 186 bp, Glycine max
  Peptide Sequence Number=SeqID_231843
atgaggcggaacatatttactggttatatcatcggcaatcgcctgaatttcaagacgttcttcgaaccaatcatagactttattgagataggaccctatgaatcaacaacaaaaacatcgacttcctgcgatatccacgatgattcaaaaaaaccatatatggaagtccaaaaattccccgattaa

SEQ ID NO: 115066 - DNA, 231 bp, Glycine max
  Peptide Sequence Number=SeqID_231844
atgatggcacatcaaaaccccccatacttagccttttgcactcctgggcaaaatgaaacaatgaacaaaatccaaggatatcaaagagagacaaacgaaaacattcacatatttctcaatgaacatcaaggaatgaaaggaatggcctttgagaaacaacatcatattcagcatgtccaacatttaaccaatatgcaatttacatcaagtatggctcaaaatatatcatga

SEQ ID NO: 115067 - DNA, 435 bp, Glycine max
  Peptide Sequence Number=SeqID_231845
atgacgccctttacatgtgtatgcagcaaatacaataaggaagctgtgcttaggtataggcttgaggtgatgatcaaccagggaaatgaaagcacaaaattcttgctttgggaccgtgaatgcagtgaattaattgggcaatcagctgatgcagttagtaagcttaaaattgaagatggtgatgttgatttgaatgcttcaccccaagcacttgataagttgctgggtcatgaacttgctttcaagataaaggtgcaacccaagttcaggaattctgttgttttgaagtgttcagctgactcgagctttataaatgttgtgatggatacgctagctgatgctgagacatcttcaaaaatggatatcccggtttctgattcgaatcattctgctcaacatgaatctgtgagttttgataactgctctcatttttaa

SEQ ID NO: 115068 - DNA, 1215 bp, Glycine max
  Peptide Sequence Number=SeqID_231846
atggtatccgcttccgaaccagatcgatgctcgccaacttcgaggactccgaggcgcctctcaagctcccgtagatcccaatcccaatcttcttcgtcatggtatccaaggaaacgaaccaaactgcttctcgcgcttattgcgtttctcgctttcgttttcttcctcaattggtttatgcttctccgcttacagcatcagcacgatgcacccgatcctattcccaaacctacactccgttcctcctccgtttcactttcccttcaggggaaatggaacaagcctgcaaataagaaaaaatcacaaaaggggaattatgcaaggatgctggcattggctgcacatgccttggcagagaataaacgcgaaccgaaagatttgtggcaagaacccttcgttcctgcttcttcttggagaccttgtgctgatcagcggaattgggaacccaatgaggggggaaatggatacattttggttactgcaaatggtgggatcaatcaacaacgagtagctgtttgtaatgctgtcgttgtggcccgtttactcaattcaactttagttatccccaaatttatgtacagtagtgtatggagagatgtgagtcaattcagcgatatctatcaggaggagcattttattaactacttgactcctgatattcggatagtgaggcagcttcctaaggagctacaatctttggacttggaggccattggtagtgttgtgacagatgttgacatggagaaggaggccaagccaagtttttacttgaaacacatcttacctattatacttaaaaatcaagttgttcactttgttggatttggtaatcgcctggcttttgatccaatagcatttgagctgcagagatttcgttgcagatgtaattttcatgccctgcaatttgttcccagaatacaagaaaccggtgctctgcttctaaaaagattgcgtgaacattcaggtcttattggaccgttggatcgttatcttgttggtccatttgcagaatcaatgaaggagaaaagtgaaagtaatgccaagaaagcatccaagtacctagctttgcatctcagatttgaaattgacatggtagctcattctttatgtgaatttgggggaggtgaagaagagaggaaagaattggaagcatatcgtgaaatccattttcctgcactgtcactgctgaagaggactacaaagtatgcatcatga

SEQ ID NO: 115069 - DNA, 2142 bp, Glycine max
  Peptide Sequence Number=SeqID_231847
atggacccaggaccatcgcggttgccttccccattaccggaatcagtttcggtgcaaattagcctacatgctttgtccggtcatggtgcacttgagacattacgcctcacgggattcatttgtgagcatcgcgtccagattctaatcgatgggggcaacacccataatttcctacaacaggaattggtcgcattgctgcagctgcaaccacaagagacctccaccttgcgggtcactgtgggtaatggtgaggaattgcagtgcactcaggtatgccctaatctcgccgtgaaaatacaaaaacatgaatttccggttgacttgcatgtattgcccatacggggagctgacgttgtgctgggagttcagtggctcaaagctttaggcccagtccttactgattacacagcacttacgatgaaattcatctacaatggccagttgattgagttagtgggagatcgcgacttgtcttttcagatgatatcaccttcccagttacgtaggttggtggacacaggtaacaccagtaccttcttccacattaaaatggaaccttccttggagacgccaatgactataactcacccaataccgacagtccagaaactcttttccaaacacgctttcctcttccaacctctatcaactctacccccatctcgagccacagaccacagcattaccctccttcctaactcagccccagtcaatgtaaaaccttaccgttaccctcacttccaaaaacaagagatagaaacccaagtcgccgcaatgctccgacaaggccatatccagcacagctcaagtccgttctcatctccggttttattagttaagaagcgcgatggatcgtggcgcttttgtgtggactatagggccctcaatgcaatcacagtgagggatcgtttccctattccgacggtggatgagcttctcgacgagctcggaggcgcggtttggttctcgaaactcgacttgatgcaaggctaccatcagattctgatgagagaatccgatatcggcaaaacaacatttcgcacccatcatgggcattacgaatttcgcgtaatgccctttggtcttttgcaatgctccatcaacgtttcaagcgatgatgaacagattgtttcagccccacttacgaaggtattacactatggccagtttactcttaagctcaccaagtgttcatttgcgcagaagaaaatagaatacttaggccatatcgtcaccggtaatggggtccaacctgtacctgagaaggaagggcatcctatctccttcttcagcaagcaattttgcccccgattactacaagcttccacctatgtcaaggagctcgcagctatcaccgccgcggttaagaaatggcggcagtacttgttaggccgctctttcatcatattgacggatcacaagagtttgaaggagctaatgaatcaggctgttcaaactccagaacagcataaatatctcgcacgattactgggttttgattatgtaatccagtatcgagcagggaagagaaatatcattgcagacgcattgtcccggtcaacacctgcttcattattcatcatctcagtccctcacttcgtcttcctcgacgagctgcgaagagagttgcaggcaaatccagcgttcatggaattaaggaggaaagtgactacggagcctcacgcatatcctgatcactcactagctcaggacctcatcctttatcggggtcgtatatggttaccccaggactgctctttcatcaaaatcctcctctcagagttccatcaatctccctcaggaggacatatgggattccgaaagaccctaaatcacacactggagaacttcacatggagtacgagtactcgagacacgcgtgactttgtctccaattgtttagactgccaactagtgaagtacaaaacagcaaaacctcgtggccttctatgtcctcttccggtgccgtcgcagccatgggatgacctttcgatggatttcattgtaggacttccggcgtatcgagggagtgcacctctgaatgcttccctcccatcacacatcacagatggtggctcagtcattcatggaaatggtggggaaattacatgggatgcctcgcagtatcacctcggatcgtga

SEQ ID NO: 115070 - DNA, 246 bp, Glycine max
  Peptide Sequence Number=SeqID_231848
atggatggaaaaacttgtcttctcgagggatatcgtgccacatttattccttttctcatttctgaacgccacacagacaccgttgataaagctatctatgagttttccggcttgaacagctttcctgatcagtgtggctttgtatctttggttctcagtttcctttgctgtgcttatgaatgtggtagtaaacttgttctggctctatggataggtttaggaattgatgttctataccggctatag

SEQ ID NO: 115071 - DNA, 1106 bp, Glycine max
  Peptide Sequence Number=SeqID_231849
gaaaatcttcttttgagattgagataccccaaagtctttgtggtgatgttgaacgtgtctattgtgaccattgtgctacttcaattattgactttcatagaagctgcccctattgttcctatgaactctgccttagttgttgccaagaaatacgtgatggaagcattacaccccgggctgagctgaagttcccatatgtaaataggggctatgattatatgcatggtggggaccctctacctgtgccttgtgatttagagacattagaaggtcatattgagccgtctactgtgtggaatgctaagagtgatggaagcattagttgtgcgccaaaggagttggggggttgcggtagtgctgtattggagctgagacgcatcctcccagatgggtggatatctgacttggaagccaaagctcgcaatatgctgaaaatttgggaaattgagcacacaactcttcagcaaaaagaagcagtatcaagcttcacctttttgagaaaggaagctattagagaaggcataaatgacaataacatatactatccagagtcaagtaacactcaaaaagaagggctgctgcttttccaaaagcattgggctaatggtgaaccaattatagtccgtgatgtccttaaacagggaacaggtctgagctgggagccaatggtaatgtggcgagcattatgtgaaaatatggtttcagaaatcagttcaaaaatgtcagaagtgaaagccatcgattgcctagctaattgtgaggtagaaattgatactcacacgttctttaaaggttatatagagggaagaacatacagagatctctggccagagatgctcaagctaaaagactggcccccctccgataagtttgaagatcttttgccccgccattgtgatgagtttattcgctccttgccatttcaagagtacagcgatcctcgggctggaattctcaatcttgctgtgaagttgccagcgcatgtcctaaaacctgacatgggtccaaaaacatatattgcgtatgggattaaagaagagcttggtagaggtgactctgtaacaaagcttcactgtgatatgtcagatgcgaagatggcgccttaa

SEQ ID NO: 115072 - DNA, 639 bp, Glycine max
  Peptide Sequence Number=SeqID_231850
ttgaaagaagcacacaaggcacaagatgagagagaacagtgtgccgaagagagggttgctgacagcctggatgatcaaccttgcaaagacaacaaagaacatatagaaaataaggaagtttttgaagccaaaagcatgaagaaacaacctattgaaatcaatgaaaatatctttccaaataatgttcttgaggggttcacttctcctgctatagagaatgaatcaatggaaactggtagtgccctctgggatatctttcggagagaggattctgaaaagttagaaacatatcttagaaaacactccaaagaatttaggcatacttactgttctccagttgaacaggtcgtacatccaattcatgaccaatgtttttatttgacattggagcataagaagaagctgaaggaggagtttggtgtagaaccatggacttttgaacagaaacttggggaggcagtatttattcctgctggatgcccgcatcaagtcaggaatctcaagtcatgcataaaagttgctgtagactttgtgtccccagaaaatatccgtgagtgtctacgtttaactaatgagttccgccagcttcccaagaaccacaaggctagagaagataagcttgaggtgatttgcttctaa

SEQ ID NO: 115073 - DNA, 567 bp, Glycine max
  Peptide Sequence Number=SeqID_231851
atgaagaggtttatcccaaatgcatccttcattttattagccactctcatcttgacaagttgtttttactctgaagctcaaaagtgccgcccaagtggaagaattagaggaaagaaggcccctccaggacaatgcaaccaagagaatgattctgactgttgcaaagaaggcaaaatgtacacaacatatgaatgttcaccaccaatgtcaagcaacaccaaggcctatctcactctcaacagttttcagaagggtggagatggtggtggcccttcagaatgtgataaccagtaccattctgacgacacaccggttgtggcactgtccacgggatggttcaaccacaagagcaggtgcctccacaacatcaccattagcggcaatggtagaagtgtggtggccatggtggttgatcagtgtgactctagaaagggatgtgatgcagagcatgactatcaacctccatgtcccaacaacattgttgatgcatcaaaggctgtttggaaagccttaggagtgcccctaaatgaatggggtgggttggatattacctggtctgatgcttga

SEQ ID NO: 115074 - DNA, 981 bp, Glycine max
  Peptide Sequence Number=SeqID_231852
atgtatattcaaacaaacagcatgaaagcagtacctttgttgctgaagcacgtgaggagcattttcctgcaaaggggaagagatgaattgtttgatgccaagttggaaaagttgacgttggcactgaacaagataaaggacgtgtttatgggagtgaggcagaacgaagatgaactgcttgacgtgttggtggagttggatggccatcttcgcaagttagacaagaagaagttggatgaagaggtggatgacatttgcaaaagaataagtgattctgctctcaagttgctcccagtagagaatgaaaataaggatgaaaagagtgaaaaagtgccctcagatgatgatgatccttcttcaagccaacaacacaagaaagagttggaggctcaagacttgaatttgaatctgctgtgggaaagttatcgcaagctaggatcgaaagcgaaagattgcttgctgtctctctcagttttccctgaagatgctgttgtaaagaaaagacaagcaatctattggtggattggagagggtcttgttagagaaacatcacagaaaacagcagaggaagaaggtgaggatgtgattaatcaacttttgaaatttaatgtgattgtaccacatggtaatgtacttgagcgacgaaaaattgtactaggtgatgaggatggtttgaaacctgaacgtttgatacatactgtgtttaatgttggtgcgagttatctggattttcgatctgattggtcggataaactggagaatgatctagtggtgcttcaacttggttgttggcaagatttacctttacatcacattgaggtggggagtgaagaatttctaaatgagttgaggaatttaatgcagttgaagtatcttggtcttcgtgggatatcaagaatatccaagcttccaccctccattttttcaagctaccactcttgcaaaagtgatgttcaaatttttagacgatccaattattaa

SEQ ID NO: 115075 - DNA, 412 bp, Glycine max
  Peptide Sequence Number=SeqID_231853
atgcttgacacattagaagaggtggatggccattttcgcaagttggataagaagaggttggaccaagagatggatggcatttgcaagagaataggggaatgtgctcacaagttgctcccaatggatgattatgatgaggaggatcacaagagtagtgaaatactacactcatcttcaacccaacacaacaatcacttgttgctggaaaggtattgcatgctaagacagcaaagaagtgtttgcttgttgtctctcttagttttccctgaacatgctattataaagaatttaagtacaatttattggtggattggagagagttatgttgaaaatacagaagataaaacagcagaggaagtgggtgaggatgtgattgatgagcttttgaaattaaatttgattgtaccctatg

SEQ ID NO: 115076 - DNA, 228 bp, Glycine max
  Peptide Sequence Number=SeqID_231854
atggggagtttgaaagcttgggagagttgtcggcacttaaacatctcaaaatatcatggggagtgtctgaaacaaggctttcctggacagaaagttccagaattcctgaagcctagcaagcttcccagtggattcaaacagctaaaaataatcggaggaaaactccaaagtatgaatgatgatgatgatgtgaacaagtggggcatggagatcgtgcatctcaagtag

SEQ ID NO: 115077 - DNA, 471 bp, Glycine max
  Peptide Sequence Number=SeqID_231855
atggagggttgctatgatttgcagatgatgggacactcatggatattttctggggatgcaaattctagagcaacttctgtgtactggggatggcaatggagcaggttccacagctatggccgcagaatccgaaactcggcggcgaaaggcggcgtgagcgaaacggagcataataagcaaccggtcactagggcgtacccttttcacgagatcgagctcaagtggcagcgtttttgggatcacaatcgcactttccaaacccccgatgacgatatcgacacgtcgaaacctaaatactacgttctcgacatgttcccttaccctagtggagccgggcttcacgttggtcatccactgggatacactgccacagacattcttgctagatacaaacgaatgcagggatataatgtgttgcatccgatggggtgggatgcttttggattgccagcagaacaatatgctattgag

SEQ ID NO: 115078 - DNA, 507 bp, Glycine max
  Peptide Sequence Number=SeqID_231856
atgggcgaggaatctcaagggattaagctgtttggtgcgctgattacattgaagggtggggaagtaaagaaaggagaaaaaggaagcgaatatgagagggtggagaagagagcagagaagataataccctgcccgagatgcaagagcatggaaactaaattctgttacttcaacaactacaacgttaatcagccgaggcatttttgcaagagctgccagaggtactggacggctggtggggccctccgaaacgtcgcggtcggcgccgggcgccggaaggctaagtcaccgtgccatggagccggtgacttcatggatgggcgtgcctatgaaacttctgaagatgaaaacagatttttcaggccaagcgccagagaatcacctcaggagctcagcatcaaggtcaatgaaatcatgtacgaaaacacaacttggaattattatgaacaagaaattaaggacttcagcagcgagggaccaaagcgtgtcttgagaattaagatgtga

SEQ ID NO: 115079 - DNA, 1110 bp, Glycine max
  Peptide Sequence Number=SeqID_231857
atgatgattccccacacctcaaacttgtttctccttttcttcttcatgacctgcaccaccctcatatgtctgtcttcatcaagttgtggtatcccagaccagtacaactcaatattgggcccaaacctagacaagcttccatcacaggaagaggccatgcaactcttccaactatggaagaaagagcatggaagggtctatagagacctggaagagatggcaaagaaatttgagatatttgtgtccaatgtgaagaatatcatagagtcaaatgcaaagaggtcatcaccttctagctaccttctgggtctcaaccagtttgctgattggagcccctatgagctccaagaaacctatttacacaacattccaatgcctgaaaacatcagcgctatggatctgaatgactcgccctgcagtgcgccaccatccgtagattggaggccaatagctgtgactgcagttaagaatcaaaaggattgtggaagttgctgggcattctctgccaccggagctattgaaggagcaagtgcattagccacgggaaaactgataagtgtctccgagcaagaactcctggattgtgcttatagctttggttgtggaggaggatggattgataaagccttagattgggttataggaaaccgtggcattgcttccgagatagattatccttatactgcaaggaagggtacctgcagggcctcaacgattcgaaacagtgtaagcattgatggatattgtcccatagcacaatcagacaacgcatttatgtgtgcaactgctaagtaccctattggtttttatttcaacgtggtcaacgactttttccaatataaatccggaatctatgatggtcccaattgtccagtgagttctacatttataaatcacgccatgttaatagtgggatacggttcaatagatggtgtaggtttttggatcgtgaagaattcttgggacacaacatggggaatgtgtggttatgcgttgatcaaacgggacacaagtaaaccatatggggtttgtggaatccatgcctggccggcttatgccgcaaccaaatgtattggatcagtgaacccaagtataattagttccatttga

SEQ ID NO: 115080 - DNA, 3054 bp, Glycine max
  Peptide Sequence Number=SeqID_231858
atgaacaacctcaagctaggagtagaagttgcgagtgctcatgaccttgttcccaaagatgggcaaggctcatctagtacttatgtggaactccactttgatggccagagatttcggacaactactaaaaacaaagatttgagtcctttttggaatgagagcttttacttcactattacagatccaagcaagttaccaagtctcactcttgaagcctgtatctaccactacaacaaagacaatggctccaatgtactccttgggaaggtccggctcaccggaacctcatttgtttcatattctgatgctgttcttttgcactaccctctggaaaagaaaaacattttttcgcgttccaaaggagagattggtttgaaggtttttgttacagatgacccttctgtaagagcctcaaaccttcttcctgctgtggaatcctttttcaatacagaccaaaatgaaaatctaacagaataccaatcaccgccaccagtatcatttacaaactcaatccaaaacaacatgtctagaaagaaaactgagccaaggcacacgtttcataacattgcaaaatctagtaatgaacaaaaacagcagtctaagcctgcagcagatgccaagccaagtgtaacctttgggattcatgagatgaaatcatcacaggctcctccaaaagttgttcaagcatttgcaggtccacaagagttttcagtgaaagaaacaagccctactcttggagggggaaaagttgttggtggaagggttattcgcgggagcttgccagcaacatccagcagctatgaccttgttgaaccaatgcagtacatttttgtaagagttgtaaaagcccgagaccttccttcaatggatatgacaggtagccttgacccctatgtggaggtaaaggttggaaacttcaaaggaattaccaatcactttgagaaaaaccaaaatcctgaatggaacaaggtgtttgcctttgccaaggacaatcagcaatcatttattcttgatgttacggtcaaagacaaggatcggatatcagatgatgttgttggaactgtgaggttttatgatctgcatgatattcctaaacgtattccacctgatagtccattggctcctcagtggtattggattgaaaacaagaatggagaaaagagaggggagttgatgcttgctgtttggagaggcacacaagctgatgaggcttttcaagatgcttggcattctgatgcagtagtgtcccctgatggaagcactatatctaactatgctcagattcgatcgaaagtttacatgtctccaagattatggtatgtacgcgtcaaagtgttggaggcacaggacttagtttcatctgacaagtctaaagttccagatgtctatgttaaggtacacattggcaaccagattacaaagacgaagccactaagagccatgaacccgcagtggaatcatgaagcgttgtttgttgctgctgaaccttttgaagagcctttggtcttcacagttgaggaacgcgttggtggcaacaaggatgagactattggcaatgttgttattcctttaagcagaattgaaaagcgtgctgatgataggcctatccgtgataactggtatcttcttgaaaagtacatgtcatctgctatggaggagcaagcaaaaaagcaagagaaagagaaggagaaggacaagttcttcagcagaatccgtgtcattgcctttcttgatggtggataccatgtgctagatgagtcaacttattacagtagtgatcttaggccaacctcaaggcagctatggaagaagccaattggtgtcttagaacttggcattttgaatgctgatgtattgccagttccaaccaaaaatagggatggaaggggaacagcagatacatactgtgtggcaaagtatggccacaaatgggtgcgcactagaaccattgctaacaatctaaacccaatgttccatgagcaatacacttgggaagtttatgacatagctacagttctcaccctgggagtatttgataatgcacagattaccaattcttcaaatggtaacaaagattccaagattggaaaggttcggataaggatatcaaccctagaagctggccgcgtttacactcactcttatccattgttatcagtgcaaaactctggtctcaagaagaatggtgatgtgcacttggccatacgcttctcatacacctcgatgtttgacacgatggctttgtatttcaaaccccatttgccaaagatgcactacacaaagccccttaacatcatggaccaggaaaggctgagactccaggctgtgctcattgttgcatctagactaggcagggcagaaccccctcttagaaaggaagtggttgagtacatgtctgactcagaatctcatttgtggagcatgcggcgcagcaaggccaacttcaaccgtctgaaggaggtgttttctggcctatttgcatttggaatttggtttggacaaatcgccaaatggaagaacacttttgtgacagtgctgctgcacattctctacttaatgtttatgtgtttcccagaacttattctaccaaccgtgttcctatacgtgtttgtaatagggatgtggaaatggaggttccgcccaagataccctcctcacatggatgctagtctctcttgtgcacatgtaacaagccctgaggattttgatgaggaaatggacacttttccaaccacaaagagcatggatatcgttcgttggaggtatgataggttgagaagtttggcagggaaggttcagagtgttgttggacagatagcaactcagggagaaagattacatgctcttataaattggagggatccgagagccacttcgatattcatggtgttttgccttgtgactgctatagttttgtatgttacaccaccaaagatgttgtttattctatctggattttacctaatgaggcaccctaagtttcggggcaagacaccaggagcaccagtcaatttcttccgtaggttgccttctctcacagatagcatgctgtaa

SEQ ID NO: 115081 - DNA, 648 bp, Glycine max
  Peptide Sequence Number=SeqID_231859
atgacttatacctgcccaaaggattattaccctacaaagttggagcaagaccaagattcatcaacagcatcaacatgtccagagtacttcaaatggatccatgaagatctaaaaccatggaagagaacaggaatcactagggaaatgatggagaggggaagaaatgtttcatactttaggcttgtgattaaacaaggaaaagcttatgcagaaatgtatgcggattcatatgagacaagggatgtgttcacaatatggggaattctacaacttctaaggttgtaccctggaaatgtacctgatttggagctattatttgagactggggataagcctgtggtgggtaaagaacacttccaaggaacaccaccacctattttccattattgcgggcataaaaatgcatatgacattgtctttcctgattggagcttctggggttgggctgagcttgcaataaagccatgggaggcattactacaaaacatagatgaaggcaacaagaagatcaaatggaaggatagattaccctatgctttttggaagggcaacacatgggtgtcccacaaaaggaatgatctcaccaagtgcaacgcttcagaccaacatgattcatacgctcaaatacatcctctgctaaatgtgtaa

SEQ ID NO: 115082 - DNA, 255 bp, Glycine max
  Peptide Sequence Number=SeqID_231860
atgagatacttggcaccttcatacgactacataaagaagcgggctattgcaagtgctggaacatatgtcaccatcttcttggggttccacgctgaaacgttgaaacgggtttatgtggctatacttggagttttggctgtcgtagttgtcccgcttgaaatttacagatgcaagtctcagataatgcatcatgctgtgattattcaccgtgaactgtggaacagatcgagaaggaagttgatgaaactatgctag

SEQ ID NO: 115083 - DNA, 2388 bp, Glycine max
  Peptide Sequence Number=SeqID_231861
ttaaaatcattaggattttcatatgactgggatcgtgaagtctctaccatagaacctgactattacaaatggactcaatggatctttctacaacttttaaaaagaggattggcatatcaggctgaagttccagttaattggtgccctgcacttggcactgtgttggccaatgaggaggtgattgatggtgtcagtgaacggggaggtcatcctgtaataagaaagccaatgaggcaatggatgctcaagattactgcatatgctgaccgtcttctcgaggatttagatgaccttgactggcccgaaagtgtaaaagaaatgcagagaaattggatagggaggtcagaaggggctgagatggaattttgcattcttgatagtgatggaaaggagagagatataacaattattgtgtatactacaaggcctgatacaatctttggtgcaacttacctagtcgtggccccagagcatcccttgttgtcatcattggtttccattgcccagagcaaacatgtagaggattatgtagaccttgcctcaaggaagagtgaccttgagaggactgaacttcagaaggaaaagactggggtctttactggctgttatgcaaaaaatccagcaaacggggaagccattccaatatgggtggcagattatgttttggggagttatggaacaggagctatcatggctgtgcctgcacatgattcacgtgattatgaatttgctttgaagtatgatgttccaatttgctgggttgtaatgccagatgataaaagtatcgagtctggaaaggctttttcaggtgaaggcactattgtaaattcatcaaatacactggtggggcttgacattaatggcttgtctagcaatgaagctgctctgaaagtcattgagtgggcagagaaaagtgggaatggaaagagaaaggtgaattacaagttaagggactggctttttgctcggcaacgttactggggtgaacctatccctgtcatcttcttggatgatagtgatgagactgtcccactgtgtgagactgaactgccccttattctacctgaattggatgatttttctcccactggaacaggggagcctcctctgtctaaggcagtgtcttgggtgaagaccacggatagcttatctggaagaccagctacccgtgaaactaataccatgccacagtgggctggttcatgctggtactatttgagatttatggacccacataattccaaggaattggttgataagacaaaagaaaggtattggggccctgttgatgtgtatgttgggggtgctgagcatgcagttctccatttactgtatgctaggttctggcacaaggttctttttgacattggtgttgtatccaccaaggagcccttccaatgtgtcataaaccaggggattattcttggagaggttcaatatatgacttgtagagatcaagttggcaatctgatatctgctgattcaaccgacatgttgaatgaacataaactagaaataattcctgcagaaaaggtcatgaaatctggggattcttttgtcctgaaagaacatcctgatatacgtttatttgcccgcgcccacaaaatgagtaaaagtaggggaaatgttgttaatccagatgatgttgtctctgagtatggtgcagattctcttcgattatacgaaatgttcatgggaccattgagagactcaaaaacatggagtactagtggcattgaaggtgtacaccggtttttaggaagaacttggaggctcattgttggttcacctttgtctgatggcacatttaaggatagaactgtatcagttgatgaggagcctactatagaacaacttcgttgtcttcataaatgcattgctaaggtaacagaggaaattgagggcacacggttcaacactggaatttctgcaatgatggagttcctcaatgcggcatataagccctgtggcagtgaacctatggttccaggaaaggccagaaaaattgaaatgtgggataaacatccaagatcggttattgaggcatttgttttgctgctttcaccatatgcaccacacatggctgaggagctatggtctcggctagggcacacaaaatcattagcatacgagcctttccctaaggcaaatcctgcttacctgaaggattccacggtagtacttccagttcagattaatggcaaaacaagaggtaccatccaggttgaagaaacatgtacagaagaggatgcttttgtactagcatctagggatgaaaaactatccaagtatttggatggtcaatctgtcaaaaaaagaatttacgttcctggcaagattttgaacgttgttttggaccgtaaaaacattaaggttggtgtacagtag

SEQ ID NO: 115084 - DNA, 489 bp, Glycine max
  Peptide Sequence Number=SeqID_231862
atggtgtcaaatcaagccaaacatacctcaacgacacatctttctccaacgccgaggacctatatatacgtggacgaagcagataaagcttgggcaagccacattgaaaatttcgactacgtgattttctcaggaggacaatggttcttccgaccattgacattctacgaaaacggccaagttgtcgggtgtcagaagtgccacaacctgatggaagatcctcaaaacttgtacggatacagacacgcattccgaacggcttttagaaccgttataaacctaaaagggttcaaggggatggtgtttatggtgagtcattcgccgaaccattttgagaatggggagtggaataaaggtgggggttgtaatagaacactggtctggaggagttttaccagacacaagtggaggaattcacagctgcagagagaaaggtttgcgtttagggttgaccaatataactgccgttatgcttatgagatctcataa

SEQ ID NO: 115085 - DNA, 252 bp, Glycine max
  Peptide Sequence Number=SeqID_231863
atggccttagttcatgacccaaatacaaaacaggttaccaagaaggaagggaaggaaaagtggaagagttggaaatggaggtcttccaaggatttattcctaaatggtgctcatttggtaccatctgggtttggaacctgtgccccaaattattcacctactcaatctttcactgctgctccagcgtacatggtgcctgcaatgactctcaatgctggtcccacaatttgtgttgttgggagagcatgttga

SEQ ID NO: 115086 - DNA, 345 bp, Glycine max
  Peptide Sequence Number=SeqID_231864
atggctttggctgtttttgtgtcagcaatatctcccggaagtgaaaaaccaaaagggaaaattaatcgatttctttctgacagggtggtgctgacatgtgaaaaataccctgaggtatgcctcattaaaggaagcgcaggatctgattgctgcaagaacaaatgtgtcaacctttccacagatgtctccaattgtgggaaatgtggaaagaaatgtagctatggtaagatatgttgcgaaggtaagtgcgtgaatcctcggactaacgagaagcattgtgggaaatgtgacaacaagtgcaactctgagagttcatgtatctatggaatgtgtagctacgcgtag

SEQ ID NO: 115087 - DNA, 876 bp, Glycine max
  Peptide Sequence Number=SeqID_231865
atgttattactaattctcattcactcattgttgttgagtctcacaacaagagctcaatccacgccatgcagaacttcttgtggtgacattcccatcgaatacccttttggcattgacgatgggtgtggaagcccatactaccgttacatcctggtttgttctgactcaggaaaactccaagtcagaaccccttctgggagataccacgttcacaacgttagctatgctgatccacacattctggtcactgatccattcatgtggaactgtgacgatggtgagaattaccgtcccacaaggcctttcagtttggacaccagcacacgcttcaagctttcccctcagaatgagtacctcttcttcaattgcagtgaggatcatgtgatcgttaagccaaagcctattttctgtgagcgcttccccgagcgttgcgattcttcgtgtgacagtggtagctatctctgcaggcacatgccagggtgctcctttgctatgactggtagctcttgctgctcttactctccaagatccattgaatcgttgaggttgatgctcaagtattgtactagttatactagtgtttattggagaaacgttggtgctcctcagcctcacgatcaagttcctgaatacgggatcagaattgattttgatatccccgtcactacgcgctgccttcagtgccaggatccttccaaaggagattatgatgctgcacggcacaacagaaaggtccatgtgattgcagggacagtgagcggtgtttcagctgcaggggcatttggaattggagctggtatttggtacttgaagaaagtgagagctaaagcgccagtaacatgtggagttcaaagcaacgagaatagacttttctga

SEQ ID NO: 115088 - DNA, 2081 bp, Glycine max
  Peptide Sequence Number=SeqID_231866
aggtatttgcccagttctgaagtttgaggcgacgaagatgtcaggaagcattcccaaaggtgcgttcttattacccctcactctgtttctcatcgtgctactccttcctctgttcagaaacttcattcaatcatctccaaagacatatgccagcaacttggaaaccaaagaaacaaggagatgcaacatattttcaggaaactgggttccttaccccaaagaaccttactacaacaatgaaacctgccctttcatattagaccagattaattgcatcaagaatggtagacccgacagagatttcctcaaattaaggtggaaacctcatcattgtgagcttcctctgtttgatgcgactcagttcctggagctagtacgaggaaagtcaatggcctttgttggagactcaatggggagaaatcaactagagtccttactgtgcctcataaatactgttgcacatcccgaggacattacagagaaatatacatcaaacgataacatatttttcagatggtggttcgtgcctgattacaattttacagttacaacaatgtggtcaccatttttagtgaagttcaacgactcagatcccactggtcgtggtttctacagcgccacgaagctttatctagaagaggcagatgaagcatggagaagcaaaattaaagattttgactttgtggtgttctcaacgggacagtggttcttccgaccattaacgttctatgagaaggggcaagttgtcgggtgtcaaaaatgcgagaacagtacagagcttaactactatgggtacaagaaggcgtttcaaacagcttttaggactatcagaaagcttgaagggttcaaggggttggcttttttggtgactcactctccggagcactttgagaacggggcgtggaatgaaggtgggacttgtaacagaacaaagccatttgaagaaaagggggtttatgaaaatggggatattgtggaagcgttgcatcagatacaagtggaggagtttaatgcagcgagagaaaagggtttgcggtttggtttgatagatataactgatgcaatggggatgagggctgatgcacaccccggtaggtttaggcttggggggaataataataacaatttgaatgtgaatgactgtgttcactggtgctccccaggtgctgttgacacttggaatgagtttttgctgtatttgatgaaattggaagctgaaatacagcataaacataaagtcaaatccgttgatgctgatcccaatgctagttctttctacagagccacgaagctttatctagatgaggcagatagagcatgggccattgttgggtgtcaaagatgcgagaagaacatgacagagcttaacttctacggatacaacagggcattccgaactgccttcagaactgtcatagattttaacgggttcaaggggttgacttttttggtgcctcactctccggaacactttgagaatgggttgtggaatgagggtgggatgtgtaacagaacaaagccctttaccatggaagaaagaggggtgtataaaaatggggatattctggagacattgcatcagatacaaacggaggagtttgaggaagcggaaaaggaaacaaggaaaaagggcctgatggggcatcctagtagatatgggaaagtggttgataagaatgtgacggttagtgactgtgttcactggtgcatgcctggtccaattgatacgtggaatgagtttttgatctatgtaatgaaattggaaggggaaaatgacaccatgcaccatgaagccgtgaaggtgctattatttttgctttttcatgtaactcaggtgaaggatcgagttggatgtgggtcattcacattagaggaaggtgatggtggttgcaatgaccacggaaaaatggaaggggaaaggggaggagatgaaaaaagggggaagcctgacgaatgtgagcttccactgtttgatgccaaacagtttctgaaggttgttcgggtaaagtacatggctttcgttggagactcaattgggagaaaccagatggagtcattgttgtgtctcctaaatagtgcaa

SEQ ID NO: 115089 - DNA, 1310 bp, Glycine max
  Peptide Sequence Number=SeqID_231867
tgcttgatttggataatacaaatcaaggtgccaaacttccatcatggatatatacccaaaaatcacttgagtatctggatatatcaagctcgggaattacatttgtggatgaagataggtttaagagacttatagctggaaattattttatgctcgatatgtccaacaattcaatcaatgaagacatatcgaacgtgatgctgaattctagctttataaagttacgccataataacttctcaggaaggctcccacaattatcaaatgtccaatatgtggatttatctcataactctttcacaggatcaattcctcctgggtggcagaacttgaattatttgttttatattaacttgtggagtaataagttatttggtgaagttcctgtggaactctcaaacttgacgcgattagaagtcatgaacctgggaaaaaatgaattttatggaactattccgatcaacatgccacaaaatttacaagtggtgatattgagatataatcactttgagggtagtattccaccacaactgttcaatctctcttttctagctcacttggatcttgcccacaataagctttcaggatcaatacctcaggttacgtataacattacccaaatggttaggagtgaattttcacacagctttgttgatgatgacttaatcaatttgtttacaaaaggtcaagattatgaatataatcttaagtggcctagggcaactgttgacctttcagctaacaacctgactggagaaattcctttggaattatttgggctgattcaagttcaaacgttgaatttatcttacaatcatttgattggaacaataccaaagaccattggaggcatgaaaaatctcgaatctcttgatctctctaataataagctttttggagaaattccacaaaccatgactacactgtcttttctgagttatttgaacatgtcatgcaacaattttactggacaaatcccaataggtactcaacttcagagttttgatgcatcaagctatattgggaatccagaactttgtggagctcctcttcctaaatgtaacacagaagacaacaatcatggtaatgcaacagaaaatacagatggtgactctgaaaaggaatcactctatcttgggatgggagttggatttgcagttggattttggggattttgtggttctttgctccttcttaggaaatggagacataaatactatcggttctttgatcgactggccgaccaactgtatgttacttatatggggaaattcaacatatttgtaaacagagaagcacctgttagttga

SEQ ID NO: 115090 - DNA, 255 bp, Glycine max
  Peptide Sequence Number=SeqID_231868
atggcggattctcttccagaaaagtcagtgcaggattcaaaaccaacagagacagttaaagggaaggacttggacattaatggaggaacatttgctactgttgactcggcaagtgaatggcagaaaggtggatggaacatggaaggagggaattcaacgaatggtcaaataaaaccacagacagcaacagtgtcaatccaatgcaatcatctactagtaataaatgcagtcaaacatttcaagctcacgttatag

SEQ ID NO: 115091 - DNA, 321 bp, Glycine max
  Peptide Sequence Number=SeqID_231869
atgatgatgacagtcatagtggttgtggtagttgaggtgacaatagcattaatggtgacggttgtgacgatgacaataacaatgatgataatgataatgattacggtaagtgatagtagctatgatgcttgtgattacaatggtgacagtggtgtgatggtggttttgacgacgataatgctaaccagtgataacaacgacagtggtcctaggtgttatggaggggacggtggtggcgagtatgatggagatggtggtggagacaatggtggaagtgggggcaatgacggtaggggtgatgacagtggagtagtgaagtga

SEQ ID NO: 115092 - DNA, 636 bp, Glycine max
  Peptide Sequence Number=SeqID_231870
atggcagagctgcaatcgaagtctgaaactgcccctgctccggctccggttgtggctgaggtgccatcgaacgacgccgttgcaaagaaagcttctgaaacaggggaatccaaagctattgtttctgtatccgagaagacaccagttcctgcaaacaagcaaagctcaagaggatccattgatagagatatcgctctggctgaagtagagaaagagaaaaagttgtcctatgtgaaggcatgggaagaaagtgagaaggccaaagcagagaacaggcaagactttatgtactttaacagccatgatgatgatgatatgccatttcatagattatttgatccttcttgcaaatttccaatagctcaaaaacatctctcagctatcgctgcttgggaaaacagcaaaaaggcagctcttgaagctgagcttaaaaaattggaggaacaactggagaaaaagaaagcagaatatggtgaaaaaatgaagaacaaggtggccttagttcacaaggaagcagaggagaagagggcaatgattgaagccaagcgtggtgaagagattctgcagacagaggaaatggctgcaaaataccgagcaacaggaaccactccaaagaagactataggatgcttttga

SEQ ID NO: 115093 - DNA, 159 bp, Glycine max
  Peptide Sequence Number=SeqID_231871
atgagtagaggcgatggagtgattgaagacaacaatagtagtatatatagtaatagcaatgaagttgctaatgttggtagtggtaatgggggattaggagtgacagttctctccatattatctagagatctcggtgacttctactccattgacatttga

SEQ ID NO: 115094 - DNA, 724 bp, Glycine max
  Peptide Sequence Number=SeqID_231872
atggtgtcctctatttctcaaacttcaatccttttgctcctacttttttatgcatccacattccaaaaaggtatgtctaataatcttagggaggttcgttgcaatgagaaggatcgacagacattgctaatcttcaaacaaggcattgttcgtgatccatataacaagctcgtgacgtggtcaagtgaaaaagactgttgtgcatggaagggtgttcagtgtgacaacaccacaagcagagttacaaaacttgatctatctacacaatctctggaaggtgaaatgaacttagctttgctggaacttgaatttctaaatcacttggatttgagtatgaacaactttaatgctattagcattccatctattcccaatgatgtcatatctgactctaacctccagtaccttgacttatctttgagtggttataatctttccatggataatcttaattggctttctcaactttcttccttgaaacaacttgacctcagagggactgatctccacaaagaaaccaactggcttttggctatgcctccttcattatcaaacttatacttgagagattgtcaactaaccagcataagtccttctgcgaatcttacctcactcgtaactgttgatctttcttataacaatttcaactctgaattaccatgttggctgtttaatctcagtaatgacatctctcatctcgatctttcatggagtagtttacatg

SEQ ID NO: 115095 - DNA, 297 bp, Glycine max
  Peptide Sequence Number=SeqID_231873
atgattgatgacttgctaacccataaattagacttggtgcacgagagaggaagggatgcgaaagtgaagtgcaagagtcacggatttagggttcagcgcgcaagaatgaaggaccaaggtgttatgcgcgagtgttgggtcacggattcagggtgcgacgagaacggaactgcgctgcaatgcgaagctgcgacacgagtgagcttgtgtgtagtgtcgttggaactttggaggaagatacagagaaagggctctcaagagagagaagtgcgagagtggaaaagattgagggcgtga

SEQ ID NO: 115096 - DNA, 2355 bp, Glycine max
  Peptide Sequence Number=SeqID_231874
atgcttgcaataagaaagctcaaaacaggacctgatatcccttttgttttatatgtcatggttgctaattgcaattatggcacagcccgagtttctagtaacaaaagtgtccagtctattgttaagtctgttggctcttatttagccaactcaagttctcaagcatttccacttggatcagagaataaatttactcttcaaggactatatttctctagtgtggctgaaagaatcctggtccaggctcaagacccagccaaagttagtttggagatacaaaatgctattgatgataatcaattagattattcatggaaattatttgagcagcatatgcacatggagggatttccccgaaaatttgtcatcagcaagcttgtaacaagttatgtggacagccttgatgttcaatatctagaaaaagcttatgaattggttgaacgtgccattgaggaaggtaaacaagacttgttagaaaaggaggtgcttatctaccttagctttggccttgcaaaagccaggctaccagttctgtcatcaactgttttaagaaagatgatagctatggagcatttccccccagtcactgcttggtctgcagttttggcacacatgtcacaaacagcagagggaagttaccttgctgctgagttgattcttgaaataggatatttgttccagaataatagagtagatccgcgtaagaagagcaatgcacctttgatagccatgaagccaaacgctgctgcttttagcattgctttggcagggtgtctcttatttgagacatctaggaaggcagaggagcttcttgatatgatgcctcgaattggcatcaaagctgatgcaaatttactgataataatggcacgtgtatatgagagaaatggtcgaagagaagagctcaagaagctgcaaaggcacatggaggaagctccaaacctaaatgatttacagttccgacagttctataattgtttgctgacatgccatttgaaatttagggatctagactctgcatcaaacatgattttggaaatgcttagcaaagcaaaggaagcaagaaattctcttgcagctgccaaatttatgacaaatgctgctgacattgatcgtagccactctcctggactggcttctgtgcatagtttgaacaacagtgaagatttggatagtttacagaataacaggtcaattacaaatgctgtattatcttatgaggagttttctatagatagaaacttcttaaggcttgaattagagtcaaaagctatacttggttctttattagctaagttgcagatgcaggtggacttgattacaaccaaacatggtatactgcagccaactgaaacaatttatgtgaaattagttaaagcttttctagaagctggcaagaccaaggatttagcagtgtttcttctcaaggcagaaagagaagattctcccttttccaatgacaactcagccttggttcatgttattaatgcatgcatttcacttggatggctggatcaagcacacgatcttctcgatgagatgcgtctagccggagttagaaccggttcatctgtatactcttctcttttgaaagcatattgccgggcaaatagggctgcagatgtcacatcacttctgagagatgctaagatagctggtatccagcttgactcaagctcttatgaggcaatgatccaatccagggtgctccaacaagacacacagggagcactccaactatttaaagagaggaaagaggctagaattccaaaagtcactcaacaaaactctggcatgatggctaaaagtggtgcagagactgatgaagctgggctggtgaccaagttgttgcaggaaatcaaggaagggcagagtgtggattgtggagttcatgactggaataatgtaatccactttttttgcaagaagagactgatgcaagatgcagaaaaagctctaaagaagatgagaagcttaggaaactcgccaaatgcgcaaactttccactctatggtcactgggtatgctgccgttggagggaattatcaagaggtgacagaactgtggggtgagatgaaagctcttgcttcttctatctccatgaagtttgatcaggaacttcttgattccgtgctgtacacgtttgtgaggggcggattctttgttcgggccaatgaagttgtggcaatgatggaaaaaggaaaaatgtttgttgacaagtacaagtaccgaatgctattcttgaaataccataaatcactttacaaagggaaggctccgaaatttcagacagaatcccaactaaacaaaagggaagcagccctggcttttaaaaggtggataggcttgaattga

SEQ ID NO: 115097 - DNA, 861 bp, Glycine max
  Peptide Sequence Number=SeqID_231875
atgacacaggcaaaactaaggtatgctgttgttactggggcaaacaaagggataggattggagactgttaaccaattggcctcaaatggagtcaaggtggtgctcacagcaagagatgaggacagaggccatgaagccattgagagattgaaagagtgtggtctctctgactttgtgatttttcaccaacttgatgtgactgactctgctagtattgtttcactagtagagtttgtgaagacacagtttgggagacttgatatcttggtgaacaacgcaggaatcagtggtgtcaatccatatgaaacggaaggatcaacaattaactggaaggaactggctcaaacttgtgagatggcagaaaagtgcctaacaacaaactactatggtgcaaaggaaacaactgaggcatttcttccccttcttcaattatccaactcacctaggattgttaatgtttcctcccaagcaggattgttaaagggtatagcaaatgaattggccaaaggggtgtttgatgatgctgaaaatcttacagaagatagaatagatgaggtactcaaagaattcatcaaagacttcaaagaaggttcactcaaaaagaaaggttggccaaccttcttgtctgcctatatggtctcaaaagcagccatgaattcatacacaaggattctagccaagaagcaccaaaacttttgcattaattgtgtgtgtcctggttttgtcaaaacagacataaacagaaacactggcttcttatccgttgaccaaggtgctgctagtgttgtgaggttagcactgttgcctaatgcttccccttctggcctattctatagtaggcaagaactgtcaaacttttga

SEQ ID NO: 115098 - DNA, 543 bp, Glycine max
  Peptide Sequence Number=SeqID_231876
atgaggatgttgcggtggatgtgtggtaagactcgacaggataaaattagaaacgaagctattagagagagggtgggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataaaagaggttatcaaaaaggatctcaaaatcaatggtttggatagaagttctcttcttcaattctcaagcccagtggcgatgcaaaccagcacccctgagcttcttgacaggttaccaacgagtggagaacagtttcctcttccaaaccacataatgggcacaatcaagatgaagattcagtgggataaaacttcaatttcaccacatgatagccagaatttacggtgtatatactgttgttggtatgcccctagctcagccaggcatcagaagaaacatgtctcacagagatacctttcatacaccttgatgtag

SEQ ID NO: 115099 - DNA, 1557 bp, Glycine max
  Peptide Sequence Number=SeqID_231877
atggcggccccgggcaccgaggaagctgttagttgtgttagcaatagcacacacacagcgatggaaaacgacgacgaacacaagctccacaatcacagagaacaagtacaagaacaagaacaagaaaatgaagaagaagaacaagaagatgaggtttggagttcttcggattctgaaatcggtgaagcgttggactggttggattcaagggaggaagatgaaggctcctccttctccctcacttcgtggcgccccaacgctcatggcggccaccaccaccattcctccactctgcaacctctcgccaatcgcaaccagaagttctcccatcacattcgtgcttcacccttggaggagtgggaagggagaatgaatgttggcatgtctaattctgtgacgacagcaattcgcagcagtgttcgagacttggccattgggaagactaaaactactgagaaagcagaccgggctactgttgagcaggcaaatgtttatcatgcaactaaatctgatggtcaagaacttgcaattaaagtatacaaaacatctgttttggtattcaaggatagagatagatatgtgcaaggagacttccgatttcgaaatggatactgcaagcataatcccaggaaaatggtaaaaacatgggcagagaaagaaatgagaaatcttatgaggcttaaggcagcaggaattaggtgtcctacgccatatcttctgaggctacatgttctggttatggaatttataggaaaatctggttgggctgcccctcgtcttaaagatgcagctttatctttagacaagttgcgggaaggctatgttgagggtcacttgtacattattgatgtttctcaagctgttgatcctgaacatcctcatgcccttgattttctgcgtgaagattgcgttcatgtgtctgacttctttaaaaagcatggtgtagcagtcatgacaataagagaattgtttgaatttattgtcgatgcatccattactgatgatgccgtggatagttacttggaagagatgcaacaaaaaattttgacgaggggagatatatctgcagaggatgagattgcagactctgtatttgtgcagtcctatattccgaagacactagaggatgtgaagaatgctgaggaggatgtacaacggataacaagtgggaaggacaccaaagatttatactatcagaccattactggacttaaacatgctctgtcattaacacagccttcccagcaaaaaacccaacagaaatcaagtcccacaaaggattcaccggctgtttctgatgataaatctaaactcttagaggatgatgctgagggtcaatctgacgaggatgaagatgatgaaagcaattctgaagaggattcaccctcagaaagtgaagtagatgatcctgcagataaaaaagctgctagaaaagaggctaggaaagagaataagaagaaggtgaaggaggagaaaagagaagcacgtaaaactaaagtccctaaggctgttaagaagagaaagaaaaagttggctaaagcaaaaaagaccagatag

SEQ ID NO: 115100 - DNA, 442 bp, Glycine max
  Peptide Sequence Number=SeqID_231878
taacaacaagggtgacagtaatggtgtcagtaacagtggtgaaaatacaaatagtgattatgatgacaatgatgatagaagtgattggtggtggctagtagggatgccgatggtatttgtgataatattggtggtggtaatgacattaatggtaataaacaatggaggtaatgacaaaggcggtattggtgataatggtggtggtagcagtagtagtaatgttagtggtatcggtgacaatgataatgatagtggtagcaacgataacattggtggtgattatgacaacaacgttggtgatcgtggtgacgatgatagtggtggtgacaatggtggtggtggtattggtggtgacgatgatagtaacattggcgataacgagtgtgctgatagtgataatagtagtggtagtgacaacaaaaggtgtcatgatcaaatatga

SEQ ID NO: 115101 - DNA, 295 bp, Glycine max
  Peptide Sequence Number=SeqID_231879
ttcctgaatttgtagtagaagtggaagtcctcgccggatggaatgaacggcgaggaggcggaaagctccgtgaggtggtgatcgaagtccatggcgccgtggcttttgaagacagtggagaatttgctgaaaggggttttggggttagggtttcgcggtttttgccattgtcgttgggaaatgggaaatcattcactctcactttcgttcgctacttactcagagtactcagcgatttggtttcagaacattgtgtgagaggagagagtcgtcacggtctcgtggatacgggcac

SEQ ID NO: 115102 - DNA, 213 bp, Glycine max
  Peptide Sequence Number=SeqID_231880
atgtgtaacgcctttattggttgtcatttcagcaaagagtttagattctctgcagtggtgcagcaccggcagcaacatcaacatgagatcgaaaatgcaaactcgcaccaagcgtttggaaagaagcaatcgggtattgaaaagggacaagggagaacatttggcataagagtgttatacactggagcaaattctatatcgaagccgaattag

SEQ ID NO: 115103 - DNA, 543 bp, Glycine max
  Peptide Sequence Number=SeqID_231881
atggagtcaagcaatgtgaaacaaggagaaaatacgaggttggcaaatgcaaaaatgcaagagaagataaagagagggaatgttttagatgtgacaagaaaattcagtcaagatcatatatgcaaaatcaagcagcttagagtcatggagaaactctctgttttggattttgttgataaagaaaatctcgagaatcttgtgccagtagagcctccctcaatagaatgcacccctttcaagcttgtggaggatgtcaaaggattgaaggaggtggctgctatgctgtcttcagttaatgaatttgcggtccgcaatcatgttgggccatacctgagggaagtcttcaaggaccctaccaagaagaaggtcatgcatggagcagatcgagacattgtgtggctgcaacgggattttggcatttatgtttgcaatatgttcgatactggccagagtaataaggttgattgttttgctacagctttgaagaaaattgctggaaataagtgctgtaatgagatctgtgccagctttgcttttgtttga

SEQ ID NO: 115104 - DNA, 642 bp, Glycine max
  Peptide Sequence Number=SeqID_231882
atggtggggcatgcaagtaaaaaccgcatatatgcattcggatcagaaataaatcaaaatgagaatcagaacacgagcttcgctcaaggctcaatgatctgccgtccagccaatccaccaaatgctctccaagtgaggcctccagacggcgacacgtcctcgtcttctgtctctctgcgtagaaactttctcggagagtatttcagtcaagtagcgctcattagagacgagcaagttggcgaccgaaatggcgttgttattgttgatgtttctgttgtcgctgtggtgttccttccttttcttcttccccgaggaggaggacctctggaggtggttgttcttttccgacggaggcgaggggagaggcatgaggaagtaaatcttgccgcgttggagctctgcgtcgggagggacgacgacgatcttgggaacgacgccgtcttgggtggagggggaggaaggcttcttgaggacgtgcttggggtgtgccttcatgacgtcgctggccttgatggtgccgctgatttcctcgacgcggccgttggagtgcactatgcggattacgtccagggccccgcatgggagaatgcaggagatgcaacaccggatgctgtttctcatgccttctctcaattctcatag

SEQ ID NO: 115105 - DNA, 561 bp, Glycine max
  Peptide Sequence Number=SeqID_231883
atggcgactccaacctcggagaaaacaagggagtggctgtgcgagagtgaagcatgggtcgcggagacgcagctagacaccatcgacccgcgccgggctcctccacccacggcgaaggaaccgatggtcatggctcgcctttacccagggaccgacgagactcacgatccagcgggtaaaggagacttcccgcggttacagcaggagagccagaaaggagccgcagtggagtcaaagggaggcaatgtggcagaacgtgcagtgggaattttgaagggggaagatgatctcgtgccatacgaggtggcagtgggttgcagaggaggtcacgggaggacaaggagtagggtcagcaatgaggggtttacgcacaaccaagacttgaatggctttagtggaaattcaaagcaccaggatgcaggggagaagacatgttcaggagaaaacagtaaagcaagaagcatcaatcatttgggaattagcaaaccagttgggggtaaccgctgcggaagaccaggggaggatggtggacagatttatggaaatggaggagagagatag

SEQ ID NO: 115106 - DNA, 465 bp, Glycine max
  Peptide Sequence Number=SeqID_231884
atggacaggaaactacaattcaaaacactggctgcttcagacttccatctctccggcataccaatggtaccaaaacaactctttgcaaaattaatcttgaggctagatacaagttcaaaagacctcaagattgctttaatggccctcacattctccattgatgcctctccaaagaatattgtgtcatcggcatattgcaggatgcttatatcaacactgtttgctcccactgagaaaccccggaataaatttctcttaaccgcctctcttactagaccattcaatgcctccgccacaatattgaaaagaaaaggtgctaatggatccccttgcctaaggcctctctgtggtgagaactcaaccgaggggctgccattgactagaaccgaaatagatgcggattttagacatcccacgatccactggatccatttggcacagaagtccaatcttcttagcatataa

SEQ ID NO: 115107 - DNA, 120 bp, Glycine max
  Peptide Sequence Number=SeqID_231885
atgggatgtgggaactgggaaatgtgtattaggaaatgcttgaaattgggattattaggatgccaagttggctatttcttggtgccagagtctgaaggttctgataatcctctactggag

SEQ ID NO: 115108 - DNA, 2136 bp, Glycine max
  Peptide Sequence Number=SeqID_231886
atggaggcagaggaggcgccatggttaggaaggaaattcacgtggttccggcctaatggaattgctaagagcaagttggacagattccttgtgtctccagaccggctcacaaaatggcctggaagcacacaacaaccactagacaggaatttctcttatcactgcccagttttgcttaggtccaagttcgtagacaggggtccaaagccattccggatacttgattgctggttgtcggacaaatccttcaattcaattgtgcaggagtgttggacgacccaccagctaagggatttgtgggcaactgcacagtatcacgaatccttactacgccataaggcgagggctagatgggtaaaagaaggggattccaattcccgatacttccatttattggtgaatgcaagccgcaaaggtaactctttgcatggtgtgcggattgatggagaatggactgaagaaccggcgagagtaaaagaagcagccagactatttttcctacatagattcaaagaagaggatcacaatagacccctcctagatggtattcactttcagactattgggcatcagcacaatgacatgctaacagggagattcatgaaggaggagatcaaggatgcagtgtggggatgtgggagtgagaagagtccagacccagatggaataaatttcaaattcatcaagagattctggcacatagtaaaacctgatgttctacagtttttggatgaattctatgttaatggaatttttccaaggggatgtaatgcatctttcattgttttaatccctaaggtgcccaatctgcaaactctggatgagtacagaccggtatcactcattggatgcatgtacaagatagtagccaagctgttggccaatagattgaagaagattatgcccctcataatagatgaaagacaatccacatttatagagagtaggcatctactacaaagtgcattgatagcaaacgaggtggtagaaaatgccaaaagaagtcagaaatcgtgtctagttttcaaagtggattatgagaaggcatatgacttggtctcatggaatttcctggtttatatgctaagaagattggacttctgtgccaaatggatccagtggatcgtgggatgtctaaaatccgcatctatttcggttctagtcaatggcagcccctcggttgagttctcaccacagagaggccttaggcaaggggatccattagcaccttttcttttcaatattgtggcggaggcattgaatggtctagtaagagaggcggttaagagaaatttattccggggtttctcagtgggagcaaacagtgttgatataagcatcctgcaatatgccgatgacacaatattctttggagaggcatcaatggagaatgtgagggccattaaagcaatcttgaggtcttttgaacttgtatctagcctcaagattaattttgcaaagagttgttttggtaccattggtatgccggagagatggaagtctgaagcagccagtgttttgaattgtagtttcctgtccattccttttgtctatctaggaatacctattggggcaaacccgaggcggggacagatgtgggatcctattataaaaaagtgtgagagagcattgtctaagtggaagcagagacacttgtcttttgaggggagagtgacccttatccagattcctaagaaggtggccaacaagttacttagcttacaacgaagatttcaatggggaggagggccaaataaaaataagattatgtggaatctatttcagcaggaaggacagttgtgggcaagggtctttcaaacctcacaacagggcgaggagctcaaaaaagggattcagtggagggtggggagtggagataggattaaattctgggaggacgagtggatagatggagaggtctcattggtaacaaagtatcctagattgacgctgtttgataatgagataccaatggctactaacttcctaacagatatggagaggaagactatacagaggaacagaagggacgagtgggtggggaaggcagacccaagtggacaatatacagcgaagactgcttacaatctaatgaggggggcagaaattgaagggatacaggatagggctttttga

SEQ ID NO: 115109 - DNA, 1164 bp, Glycine max
  Peptide Sequence Number=SeqID_231887
atggcacaagttgggaatgttcttaatgacatcattgtccccgggagagaatcagtaccacagaaggaaggtgacgacggattaggggatattagcataaaagagttcaatgattggatagacgatttggaggctgttgaggtaccatggttggaaagaaaattcacttggttcagacccaatggtgcttttaggagtaacctggacaaattcttggtatctcctgaatggcttggtaaatggcctggaagtactcaacttacattggagagaaacttctcagatcattgtccaatcttgctacggtctaagtttgtagattgggatcctaaaccttttaggattctatattgttggctattagacaactctttcaaggcaactgttcaccaatgctggatctccaatcagcaatcgaggtggggaggttacttgctcaaagaaaaaatgaagagactcaaagaaaggctgaagatttggaataaggaacaatttggagatactttcaagaaggaagcactatgggtagctgctcaagctcatgaatctctattgagacagaaggcgaggtcaagatggatcaaggaaggtgactgcaactcactttactttcatttgctgatgaatgctaaccgtgggaataactccttaaaaggagtcatgattgatggaacatggactgatgaaccacatagagtgaaggaggaagttagatcatttttctcacaaagatttcaagaaccagactatcacagaccccggcttgcagtgggagaacatcagattgaggaagaattgccaaaggaactacaagctgaagaacaagggatacaaccggaacaagtattggtaacaagaatgtttggttcagcaggagcaaaaattccacaagtattcatcaagtggaaaggacagcatgctgaaggagcaaccttgcaggacagatcaaatatgatgcaacaattccctgctttcaaccttgaggacaaggttctggcagggaagagagctcttccttgtgtaaagagagaaagaactatcaataacagtgaatcttttatctctgcgtgtactgtcttgtgttggttcttgtgtgcgtctgtcctacctctagttgcagttagtaaagtagagaagattcctaacgggaggctcatgcactag

SEQ ID NO: 115110 - DNA, 770 bp, Glycine max
  Peptide Sequence Number=SeqID_231888
aagggatttgggaatggcgtgacggtcttgctcgtgcagacgatgaaggtcctggctatgtattgccaaatagaattattcttgaaatcgctaaccagatgcctgtcattataagcaatctacggcgaatagtaggaaggacaaaacacccatatgttgagcgcagccttgatgtcattgtcaacattgtcagacattctatgcaaaatgctgctgcctttgaagaggctgcactacgtttgaaagaagaacatgctgcaagtttgtcaaatgtgatacccgttaaggatggaactgaagtacctcatacactacaaaaggatggatgtgcagcaagaggaagcatgggaattgaaaatggctcctgtgttgatatcacacaaaactgtatgctttcttatgaccaagaggagaaaagttttcagcatcaagttgaagatggactatccgattgtctcaattcagatctactaagggtcagtcccactattccatataagaatcgggataatgcaaatgttattgtactctctacagcaaaggtcaagaaggagatcaagccggaacagagtagatcgtcgttaaatattccatctcccttattgttgggcaacaatgagaagtcaagactagttgcagaaactccaagtgtaacatatgaaacatcatactcacgggagaaacttgtttcaggttcaccttctacctccaaccctattgggatggtaatggtagattcagccaaggaaaagaagatgaacgatgagtaa

SEQ ID NO: 115111 - DNA, 516 bp, Glycine max
  Peptide Sequence Number=SeqID_231889
atgcttaacacctaccatgcctccaaactaccatcaaaccagtgtggttctagccttgtgcaaacaatagatgcacctttacctcttgtatggtcccttataaggcgctttgagtatccacaagggtacaagctctttgtgaagaagtgcacccttcttgatgggaatggtggcattggaagcgtgcgtgaggtcatggtcacatctgggttaccagctggtgttagtgtggagaggttggacaagctcgatgatgataagcatgtcttcaagtttagcatcattggtggtgatcacaggcttgtcaattatagttccaccattactttgcatcaagaggaagaggagtacgggggaaagacggtggcgatagagtcgtacgcggtggacgttccggcggggagtaccgtcgacgatacatgctcttttgctaatactatcatagcttgcaatcttaggtcgttggctaagatcacagaagaaatggtttgtaaggctaatcaaattaaggtttaa

SEQ ID NO: 115112 - DNA, 228 bp, Glycine max
  Peptide Sequence Number=SeqID_231890
atgcctacattgagtacacagaaattgaattctggagaaagaatgttaataaacgttctggtcaatattaggcataatactgaatgcacacttgacagacatttcaagtttgaacttcataaaaagatgaagcatagattacagtcattggaaggcatctctattgtatccatgccattgagttgttcatgttgccctgaagggaacaactgtcttgaagggctataa

SEQ ID NO: 115113 - DNA, 810 bp, Glycine max
  Peptide Sequence Number=SeqID_231891
atgacgatgaggaagtttaactataacgaaatagtaatcctcaacccattgcagactaggtaccaaatgatgtcttctagggtattcatctctctccatgctgcagcaaacgacggaatttacagaatgaatagaagaaagtttgtgacaaagtacggtccaaagactataggaatatatatgctaggagctttcggcgctctcattttacttataggtataggtatggcagcttatccgttcactcagactactgggatgactagtgctgatggtctaattgctatagtcataggagggcttatgttatattttgctataaagaatgcaaagaaaacggttcagaaaataaatgaagagaaagggattgaaggggaacttgtagtcccatggaatcaagttaagactataactgtcatgaatgtgaggcaagaaaacgtagctaataggcctagcttagttctcaatactatagctcctacttacaaggaaataggtggtggttctgaggacgtagatccgccactattattttctactactacggtatttccggatcctcctccgtttttctttctgaatgctcccatcatatgttctcctggtcttagtccgaagacaaagaaagctagagtgaacaaaaattccccatccatagctatagggtcgatagcaaacattaacgctcccaatggcagtgttgccaatatagcgaatgttactgcagctatcagcccagcaaccataagtcctatcaataagtctatgaccaccatagcaatttttcttgtccattcgaatatccataga

SEQ ID NO: 115114 - DNA, 780 bp, Glycine max
  Peptide Sequence Number=SeqID_231892
atgctggggctgcggcacgatcattcccgcaccagtgtcgacaatgatccgaaaggcggcgcggacgacagcgcgctgaccaggcgtttcggcttgatgtaccgttccgtcgctggcttgaacccttacatcagctatgccgagtcattcgaggggcagacggggctgaacaaggccaatgaaccgttcaagccgctgcgtggcaagcaatgggaggcgggggccaaataccagcctgccggccgtaacctcacgctaaccgccgccatcttcgcgatgatcgagaacaaccgcaaagtgccgggcgtggtcaatgggcgcgcggatacggtgcaggtgggccaggcgcgcacccgaggccttgaactggaggcgctggcctcgcagggcaatctcgacctggtggccagctacacctacctggatgcccgcgtcgccaggggcaagcctgccgaagagggcaggcaactgtccggcatcgcccggcacatggcatcgttctgggccaactaccgcttccgcgcattcggcgtgtcaggcctggtcgcgggggccggcgcgcgctacaacggcacccacgatgacggcaccggccacaatggcatggccgccgtgaccctgtacgatgccgtgctggcctacgatgcgggaccgatgcggatggcgctcaatgtcaccaatctgttcgacaagcgctacgtcgacgtttgcctggcgcgcggcgattgcttcttcggcacccggcgcagcgtggttggcagcgtgacgtaccgcttctga

SEQ ID NO: 115115 - DNA, 1827 bp, Glycine max
  Peptide Sequence Number=SeqID_231893
gaaggtgtaggtggccaccagatcgacattgcccagcgacgccagggcttccagttcggcgcccttggtgcgggcctcgcccacttgcacggtgtcggcaatgccgttgaccacgccggcgaccttgcggtttttctcggtcatgtcgaacacgctggcggtgaccgtcaggttctcgcccggcggctggtacttcaggcccgcctcccattgcttgccgcgcagcggcttgaacgcctggttggcacggttgaagccggccaggccctggaacgattccgagtagctcagatagggattgaggcccgcctcggagcggtacatcaggccaaagcgcttgctcatttcgctgtcatcgcgcgacccggacggcgtatcgtccaccgacgcgcgcgagcgatcgtggcgcagccccagcatcagcagccaacgctcccattcgagctggtcctgcatgtagaggcccaactggttgccgcgcgaggtcggcgcgctgaccgtcgaggtgggcggcgtgaagttgccgtacacggggttgtgcacgtcgatgggcgcgaccgtgccgcccaccccctggcgcgcatccagcacggaacgctggtagtcgatgccggtcagcagggtgtggcggatcgggccggtctggaacttgaactggccctgggtgtcgaccacgaactgcttgagggtcggctggttctggtagatcacgcggcgcagcagcgtgtcgctgcccggcacccatccatgcccggcgccgttgaagccggcggtgtagatgctgcgatagtcgacctcgctgtgcgtgtagcgcaggttctgccgcaccgtgacgttgtcgttgaaggcgtgctcgaactggtagcccaccgcgctctgcctggcggtgtacttgtcgaagtcgggttcgctgacgaagaagtcctgcgggatgcggccggccggcgtgctggtgagcgtgccgcgccacgggaagaaaccgaccatcgacccgctattgtctttctggaaattggccagcagcgtcaacgaggtcgcggcgctgggccgccaggtcaacgacggcgcgatgaaatagcggtcgtcgtcgacgtatttgaccgaactgtcgctatcgcgccccaacgcgaccacgcgatacagccacttgccgtcttcgtcgatcgggccggtgaggtcggcctggatctgcttgcggttgtggttgccgtagctgacgccgatctcgcgcatcgcctcgggctgcggccgcttgctgatctggttgacgatgccgccgatggcgccctgcccgtacagcatgccggacggcccgcgcaggatctcgatgcgctccagcgcgtaggggtcgggccgggtgttgttgtaggaccccacggcgttgagcaggccgtccaggtattgggtggaatcggtgccgcggatcttgatggagtcgccgcgattgtccggcccgaacgcgccggccgtgacgccagcggtatagcccgccgcctgctgcaccgactgggcgccctgcagcgtcatgcgatcctgggtgatgacgctgatcgactgcggcgtttccatcaccggggtgtcggtcttggtggcggtggcggcacgcttggcgacaaagccctgcacggggccgaccgcggtctgttcgacgtcgctgcccgtgacggtgacggcgggcaagtggacctcggcaggggcggactgcgccagggcggcgcccggcaggcccaggccgaatacgatcaaaggcaattgccgggcccggaaatgcaccgggcgccggcgggacgaaaggcttacagccatggaaactccgctcgcatgtga

SEQ ID NO: 115116 - DNA, 1020 bp, Glycine max
  Peptide Sequence Number=SeqID_231894
aggcaactgagtaaagctcaagccctagcgttaatagagaaagcagtagaagagaagactaagatattaaaaaagaaccaaaatagtgaaaataatcctaaagagacgaaagttgaacgggtacccgttcaacttagtgaaagtcaaaataaaaaaattcaaagcctcactgatttaaggaatgcagtaaaagaagagctaaagaagtataatgtaaaggttgatgatagagcactagactactatattaggattaaggaaaatgcaccatggctaaccgattatatactaaaaggaaaactgggaatctatcctgcctacagtatctatactaaactacaagaaatgggcttactagaagctgtagctaagttacctccttacgaaagaaatacattacttaccgatggaagaaagataattttggatgagaggaaggatctacttgaggagatagtaaaccataggatggcagtttctcaagcaattaataagctgaagaccgaagagaaactgcaaaggtctaagaagaaatccaaggtaaaagaagagaaagaagacgaaggagaggaagtcgaaactgatgagggagaggaggctgaaagtgatgagtattctttcgtagaggaatgggctcagaaggaggaagaggctaaacaacagttaactccccagtttaatactgaagttcactcgcctgcagaagagataaccagaataaaccatgaaaaatggttacagactgtagccaaactaaaggaggagatgttatccaattgcccagaaattaaacaactctatgaagagaagaaactggatgaagaggccattcttaccatggtagaagtttggaggaacttccagatagccttcaaaaacctatcaataaactggcataatgtagcagaacccctactatcttctcatttaaacagacaacagctggaggaactcttctacaagttcgttaaaggaaacatgaggctttacccaaaggaggaattcggggtggtgaaatga

SEQ ID NO: 115117 - DNA, 116 bp, Glycine max
  Peptide Sequence Number=SeqID_231895
tgttcattggcacctcactgttgtgtatgggagtccatcaagagcaaggatggacagtttgtgggatgatctctttagcttgtatgaagacattgaggggccatgggcccttacag

SEQ ID NO: 115118 - DNA, 867 bp, Glycine max
  Peptide Sequence Number=SeqID_231896
atgctattagagataaacaatctttatttttcacatcgtaaagaccagcctctttttcaaaacctcaatatacgatttgaggaagggaaaatcattgccctggccggtgaaagcggctgtggaaaatctacattattaaatttaatttatggacttttagactgggaaggcggtgaaattatttttgacggcactccacttatgggcccgaaaggcaatcttgttcccggagaacctcaaatgaaatttgttgcacagaattttgacctgatgccttattccaccgttgcagacaatgtgggcctgcaggaatatgctgatgttttcccaaaaaatttaagtggcggacagcagcaaagagttgctattgcgcgtgctttgtctatattgcctaagctcctgatcctggacgaaccttttagtaatattgattttccaagaaaaatagaacttcgggaaaggcttttcaggtatgtaaagcaacataacatttccttaatcatctcaactcatgaacttcaggatattataccttgggtagaccagatcgttgttcttcaaagtggaagactgatccaaaacacccatccggaagaaacttacaaagaaccttacaatccttatgttgctaaactttttggggaagtaaatattttcaccgatcatgaaatgaagaattttgggatctccaaattttcctattacccgcatgaaattaaagtttcggaaaacggtatggatgcagaagttctggaaagcaggtttgccggtaaccattattggaataaagtaagagcaaaggaaaaggatctcgttttatataccaacagcaaaattgaaggccccgtaaaaattgtctttgcataa

SEQ ID NO: 115119 - DNA, 201 bp, Glycine max
  Peptide Sequence Number=SeqID_231897
atgctccatggggagatgattgttgtcattttcaacagcaaagtgaaacacaactgcccatcttccccaaatttattttgcagggaactctttcggaataatgcaatggttgcagcacaacaccgatacacacaatccctggccaaacaaggcctcattcgactccagtttttcaagctacactatttggaattgatttaa

SEQ ID NO: 115120 - DNA, 123 bp, Glycine max
  Peptide Sequence Number=SeqID_231898
atggcagctagcaatgttgatgcttcgacttctgctatgagagctgtgcctataagaactgaagatgtagcagttaggaattcaccttctgagtttctaaggactgcactcataccatatagg

SEQ ID NO: 115121 - DNA, 435 bp, Glycine max
  Peptide Sequence Number=SeqID_231899
atggacgtggatgataaattaagttcaaaaaaaccacatggtttggctgatgaagcaactgcagcaacagaaactgtttctgaaaaagaagaacgaccattacgtttgtatttcggtaatggtccaagaatccacaagcagttgtgcattaagtatggtgttgttgataaacgctgtgaaaaatgtggtaaagttggacagttaacatgcttttcaccggctttccgaaaatgggctttagggagagttaccgaagaagaactcaaccaaacttgcaaaatatgcaatgaacgtggacacatctatctagactgtgatcttcctaacgaattggctgaagttcctcctcctaaacaaaagagaacagtgcgttgcggattatgtggtgaagctggacataataaacggacatgtccgaaagctaggcataactga

SEQ ID NO: 115122 - DNA, 3051 bp, Glycine max
  Peptide Sequence Number=SeqID_231900
atggcattggacgaaaggctagtcgccaaagacaaagaggatgtcagctcttctcagaagaatcgggcaatacaagggcgtcacgatggcaatggggcctcaggtgaccgatttacacattatgctggctatactaggttatcaagaattgagtttcctagatttaatggggataatgtgaaagaatggctataccaatgcgaaacttacttcttgatggatgaaacccctccagaagttaaaaccaattgggaagaatatgttcaaatcttgactgaaagatttggggatgcttgtgatgatcctatggctgagctaatgaatttgagacagaagggtgcaaatgatggttcgtatgtttcaacccagccaatgatgaaagcatataacctagccaaattgtatgaatctgcggctctgcaaggtactgcagccacactgcctagcaagaataaacctgcagtcccaatcaaatccttgttggaacctaaaccaccgacaataactgaaccaaagtccatgaaaaccaaaccaagattcaccaagaatttgacaccagcattcatgagtgaaagaagggccaaagggttgtattatttctatgatgagccattttctatggagcatagcttgacacacaagaaactacaaattcacctcatggaggttgatgacatagaggaggacactgttgagatagaaaaccatataggggggctgcaacacaggagatacaacaaaaagcctttacacatacttattgatagtggcagcacccattacttcttggatgtccatgtagttgcaagaattgggtgcaagattgaagatcttaaacctctagtagtcacagtggcagatggcaaaaaagtgctaatatcttcagttggccaaaattttacttgggtaattcagcataccactttcacttcagatgtcatgctgattcccctaggatgttgtgatatagtgctgggtattgaatggctgatcacattaggagatatcacttggaatttcaccaagctgagtatggaatttatggttcaggacagaagacatgtattaagaggttctaatccaagcagttgtaaatcagtcaagagcccaactcttgataaaatagtgaacaatagtgtgcacttgtctatgatccaagtagggatggaagatgtgtttgtgacacctacacaactaccactaagtagaggagagcatgatcatagaatccctctcttgcaatctgctgaaccaatcaacaaaagatcttataggtatgccaagcaacaaaaggatatcattgataagataatccatgagatgttggactcaataatcattcaaattagcaacagcccttatgctagtccagtagtgttggttgggaaaaaagatggcactgggaggttgtgtgttgactacagggacttgaacaagaatatcatcaaggatcggtttccaattcctttggtagaagatctcatggatgagttgcacggctttactatcttttacaagattgatcttagggcagggtaccatcaagttaaaatgcatattgctgatatttacaagacaacattcagaactcacaatggtcattttgaatacttggtcatgccatttggcctcaccaatgcccctgctacatttcaaaacctgatgaacactgttttccaagaattcatgaggaagtttttgctagtggagtacttagggcatgttatatctattgaaggggtttcaacagaccctgccaaaatagtggcagtccaaaattggcctatgtctgctactcttaagcaacttatagggtttttgggcttggcagttaatgcttctggtcaaggcataggtgttgtgttaatgcaacaacatcatcctattgcctttaagtggcaacactatctcttaagtaggccatttgttattagaactgaccacaagatcctcaaatgtatgctagaacacatattgactactgcatttcagcagaaatggtttgtcaaactcatggagtttgaattctccattgagtataagcaaggcaaggagaatattgcagttgattccttgtcaaggttgaaggatattgaatgcaaagcactaagggtccaaacaattcaaacagatgtgttggacaagattcaaagcacttggacttctgatgcttcattggcaactattattgcaacattgaaagaaaatagcagctctcataagcattacacttggcttaatgatcagttgaggaggaagggtaaattggtgggtttgacctcggatgtcaaacaatttgtgcagcagtgtgtaagtaagatcatgttgcttatccagggttcctgcaacaattgcctgtgccgaatcattaaagttgcacattatatacctttatcacatccatatactgccaacacagtagctcaagcttttatggatcatgttttcaagctacatggttttccatcttctataacaagtgacagggattcaatcttcctcagcaaattctggcaggaattaatggcattccagggtgtatgtgtgttgattctcctcaacaatgacctaagtggttacctttggcagagtggtggtacaattggtggatcgaagtttggcaaaaagaaaggagatgttgaagacttggtttatgtcaaattgcatgcctgtaggcaagtttccattgttgcgagagctaatgagaagctagctcctaaatactttgggtcatatccagtgattagtagaattggagttgttgcctatgaattgaagctgccttatcatgcaaaaattcacaatgtctttcatgtttcacaacttaagaagcatattagtcaattcattcattctccaacactgcctgattttattcctgaagctgtagggcctaaagaaccagcagcaatactggatcgaatgacattcaaaagaaggggacaagctgtcacaaaagtcttggttcaatggaaacatcaacttaaagaggatgcaacttgggagttctattatgacttgaagaggaggtttccacaattcgattcttga

SEQ ID NO: 115123 - DNA, 243 bp, Glycine max
  Peptide Sequence Number=SeqID_231901
atgacagattggggattttctggtggcgtggatgcaataaggaaagaattgatgtgtgtcatgactatggtaagcagaatccatgcttttaaaaaatggtccacgaccgcaatattggccagatcgaacgtcaaggtttcttgcctcgccacaaccacaattgcggctgcatcgtccacatttgcttgcaatatccgcaatgtcaaggatcataacaaaaccgcaactgcggccgtaatttaa

SEQ ID NO: 115124 - DNA, 105 bp, Glycine max
  Peptide Sequence Number=SeqID_231902
gtgtacctctcgaatctccccaacaattggtatcagagccaatggttcaagttggtgaccggctcagacgagtatgcaagtaccgctggtgaccagaatggctag

SEQ ID NO: 115125 - DNA, 213 bp, Glycine max
  Peptide Sequence Number=SeqID_231903
atgaggagagtgaaagtcagaagggacatacatggctgtaatatcttcttgtgtgttctagtttcgtcagcagcaacaacaatatacataaacaattcagaaactcaagttcccatgacaaagacaagccaagaaaatgtggttaaatgtacgagaaaaggggcacgtgacaattcaaggattgacgttaaccatcctgatgagcaggagtag

SEQ ID NO: 115126 - DNA, 471 bp, Glycine max
  Peptide Sequence Number=SeqID_231904
atggtgagggatcctctggatctgaggcggtatgcgaaaactgaggacggtgatgacctaactcaagcattggtggaggaaatcatagagaaatgtcttggtttcgaagttgagcagaggagtttggtgctcattttcaagccacctgcatttttttttggcatactggcacacccatgttactctaatacatttcactatgaacttgagaaaaattggggacaaaatcttactttgatgtatgaccgagtcctaagataccctgatcatgtcagaaatttgtatttcacttttctctttgttctgcgagcagtaaccaaactactttacaaccccaagcttcaagctgcatgtccaattccatttgatgaagccaatttgtggaaaggccaaagtggacctgagctaaaacagaaaattcaacaacaatttagaaacatcagggctttgttgtggcttagtctcttgtaa

SEQ ID NO: 115127 - DNA, 286 bp, Glycine max
  Peptide Sequence Number=SeqID_231905
ggtgtaatcttgataacaaggcccgggaagacatcatcagggtcatggatgtgagggttcttttccacaataaaggggtcaccgcacttgtcactgattgtgtgaaggcagaactgtctctgaatatgcatagcaatagaagagacacaagaagacatgcacagcaccatgaagctgcatcagctagggcttttgaacttgatattggtgcccttttggaattgaaagccatcactttgagagagtacgtgtgggagaggaagatttggatatggagtgagggaga

SEQ ID NO: 115128 - DNA, 342 bp, Glycine max
  Peptide Sequence Number=SeqID_231906
atgacattactactgcggaagaaaaaaacttcatccgtggagtctcgcgaaagacattttccgcgagattccacagaagaagtattcttccgcagttgtaatgtcaactgcgaaagacagcttcttccgtggaatctctcggaaaatgtcttccgtgagactccatggatgaaggtttcttccgctgttgatattacaactgtggaagaatacttcttccgtgagtgctcacggatgatgtcttccgcaagactccacggaagaaggtttcttccactgttgacattacaactgcggaatactgcttcttccgtggagtcttgcggaagacattttccgtga

SEQ ID NO: 115129 - DNA, 318 bp, Glycine max
  Peptide Sequence Number=SeqID_231907
atggagcatgcggtggaaggtggaaacggcgtcgtcgaaggtgggggttttggggagggttttgcgcggggagtgagagtagaagcgggtgaagaggaggagaaaaagaagggaggggaaaagggtggtgggattcagcatcatggtggagaaggagacacgagactcatggaaatgggagtgtgtgttgtaaggaaaagtccgaaacagaacaaaacagaacagagcagggtctgtattatatcagttagagtctataaattgctagtaaaagatcttcccgataaatgggatagttacgagttttttattctttaa

SEQ ID NO: 115130 - DNA, 1203 bp, Glycine max
  Peptide Sequence Number=SeqID_231908
atggatgcaaatttgcgagatctgtttttatacgaggtgtttttgtattacaaccctctccttcttgtgactatgatggtttggctttggggagcaaatttgtgggtatttctacaatcaactgtaagctatgccaaggtttttgatcttgatcaaaaccaccttagtcacaaagagacatggaagtgtagcacttggatgacaatcattgtccctactagcatgactgcttacctctatctctattctcatggggaagtgcttctctacattcttgttgcagtaattttgatctttccctttgatattttctatttgtcctctcggtacttctttttgaggacattatttcggatagctttcccttttcagccaattacatttcccgactttttcttggctgatattttaacctccatggcaaaggtgttttcagatttggaacgttcagtttgcagaatggtaaacagacaggtcgcgacaattgcttggcttgaagctgattcagtttgtggtagccactcagttgcaataccaatagcccttgttcttccttatgtatggcgtttattccaatgtcttcgccagtacagagataccaaagaaaaaaattgtctcttcaatgctttaaaatattcaacggcagtcccagtaatttttctttctgccctcaagtaccatgtcctccacgagaaatggacaactctttatcggccactgtggcttctctcaagtgtcattaattccctctattcgttttactgggatataaccagagattgggatttaagtggtttttcccgcatattcaagttcaacaaaccaaatctaatctccaaccttttatatggtcgacaatgggtatacttttgggtgattggaagcaactttgttctgcgctgctcttggacatacaaattatctgcccatctccgccataactacctgacagtgtttactatcactcttttggagatgtttcgacgcttccagtgggtattttttagagttgaaaatgagtggaataagatcacgcggtctggtgttcaactcacagaaattccaagagaagaggagaaattgctaggttccaacattcatgatgagaggttctgtcaatctcagcagttcaatgaaaatgaggaagcaagcctacaattgcacgcaaatgttcacttatacatgaagagctgcaagaagtag

SEQ ID NO: 115131 - DNA, 919 bp, Glycine max
  Peptide Sequence Number=SeqID_231909
atgaaagcctctttgaagttccgagaagaacacaagaaacccctcttccgtgcaaaagtcccactgagcatcctcggcaagcccttccaatccggcatagtcgctggcgaatccaaagaactcacactcaacctttgcaccttcttcgaatcgggtccttctctcaaagtcgcctccatgctcatgagctgtgagttcagtgttcccggtagaaccggttccccgttgttcatgcttcatttcaaaccccgcttcggcgacttcactttcaagaagacgcagtcttcgatttttgatgggaaagggtttgggtctctgaacacacaaaacgacgccgttgaacttgagaacggaaccgttgaaacgccgttgatggaatcggcgaaggtttcgattctcggcgacggtgcctccggcgccgtcgctgggatgttctccggcgtggaggtggcggctcggacgacgctgccggtgcggggacgcgccgccgtaaagttccggtggggagttagggttccgtcggagttcaaggggaacaacgcgtttcagaaaattccgtttctcgtgatggataagatcggcgtggaacacatgatggagtgcggcgtttcgaaggagaaggttagcgccggagagaagtctagggttccggcgagcgctgacgtggcggaggcgtgttttgcggtgaagcggcagatggaggttctgcaggcggagaacgggttgctgaggaacgccgtggaggatctccggcgagaaatcgtcggcgttcgaacctcaagttcggttatgggcaaaagccctaatttgagaaagaatgagaagaaaacgacgtcggattatggtaattttcccgggaaatcgacggaggctgaagcgagcgagaagttgaagaaagcgttgatgggagcggctgctg

SEQ ID NO: 115132 - DNA, 297 bp, Glycine max
  Peptide Sequence Number=SeqID_231910
gcccatggttttgatgtggagcattctaacttcaattttggttctctcatgggatatgagcattgggtgttggttccacattgtcttttttctgttggtaaaggaatgcttcttatgctagctgtcttagatttcttgtctgcaacgagcatttcgtcaaacagaagagggacactctttgcggcaaatgttggagattcttgtgttgtattgggcaagaaagttggcaacactcgaggtatagctgcaattcatctgtttgcagaacataatgcaaattttgaggctgttagatag

SEQ ID NO: 115133 - DNA, 102 bp, Glycine max
  Peptide Sequence Number=SeqID_231911
atggaggtcactaatgcaaggtggaatgaacatagctttctctacaaaggaaaatgcgcaatcctattttacatcatgatgagcacgttgcctttaatggag

SEQ ID NO: 115134 - DNA, 1476 bp, Glycine max
  Peptide Sequence Number=SeqID_231912
atgggaattttcacatgtggctggaataccatattggggactgctacctgcaggtgctgtaagcggactccgcttgagacaccacaatggggactgtcacctgcagggggtggaacaccaaaatggagattgtcgcatgtaggtggaacaccacattggggactacaacctgcagggagtagggcaccaaaatggggattatcgcatataggtggaacatcacattggggactgccacctgcaggtggtataggtgggactcctcttgagacaccacaatggggactgccgcctgtagggggtggaacatcagaatggggattgtcgcatgtaggtggaacaccacattggggactacaacctgtaaggagtggggcaccagaatggggattaccgcatataggtggaacatcacattggggactgccacctgctgggggtgggacacaaaaatgggaattatcacatgtaggtggaacacaacattggggactgttacatgcaagtggtgtaggcgggacaccacctgcaggtggggcaccagaatggggattgtcacatataagtggaacaccacattggggactgtcacctacaagtggtgtaggcgggacaccgcttgcgggtggggcaccaaattggggacaagctggagtttcaatgatgacagtttacaatccatatcattcaaattttgttggaccttcatatcatcatccaggatctgaatctattaatcagatgtggtcgacgaatgcttataatttgcaggcattccctaattataattattattatccatatgattataattatacagctccctttgctcatcattttcatgtccctcctgggccattgattcataactcttgggtttataattctgtgggagatggaaataatgaggcaactgccaataataccgttgctacaatatctgatgaagctagaggggaaattctgaggaaatttcaaagctttaaacaatttgacgttattgaagacgtttcagaccatcactttgttcatgccaactcttccatggaacagcattcaaagcattgggctaaaagaatccagggagagtggaagtcattggagaaggatttaccagattcaatatttgtcagagtttatgaatcgagaatagatcttctaagggccgtgattattggagcaaagggaacaccttatcatgatggccttttcttttttgatgttttcttctcgagtggctatccgcatgtacctccagttctggtctctatacagggtctaatcttggttgcgaagcctttctttaatgagcctgaatatgcacatttaagcaattcgcaatatggtgaaattagttctttgaagtacaatgaggacacattcatcctatcattgaggacaatgatatacataatgagaaggcctccaaagaatttcaaggactttgttgctgggaatttgcagccgagctcatga

SEQ ID NO: 115135 - DNA, 1079 bp, Glycine max
  Peptide Sequence Number=SeqID_231913
gggcaaatcaaacctctcggcgagctgatccggttcgtccggaaggatttgtgatggtgcaggcggaccataaaagctttcacagtgacgggctgccgtggtggctgtttgacatgcgaccgcagggctatctcggcagagcgtatgcctcgacttatgccagcgggctcggtctgccgacgaatcccgaacaatgggcggacgcagatgtggtcagagcgctgctggcgcaaggtcatgatgcgatcggcaacctgctgatcggcgaacaggcgcgcagccgttttctggaaatgcccgaaccgacacccatggaatgcgcgacggcgtatcccaggctggcgcgggccgcgggtgctggtgaggtgccgggctcatcagcggggggtgagcagcccaaattctgcacctataccgaacgcggtcatgtgctggtgaaattcacggcggcagatgacaacccagtcagcgaacactggcgcgatctgctgatggctgaacatctggccctgaaagtgctgggtgttaagaccgacgtgtttgatattgcagggcagcgcttcctcgaaatcccccgctttgatcgggtgggcaaaatgggccgtatcggcgtgttttcgctgcgcgcgcttgatgcggagtttgtcggcaatgccagcgcaagctggccggtcctcgtcaaccagcttgtggcggaaaagtgtgtccattctgaggccgctaatagcacggcccggctttgggcattcggcatgctgatcggcaataccgacatgcacgccggtaacctgtcattcatcagtcgccatggccgtccttatcacctcgcgccagcttatgacattctgccgatgggctttgcgcccagagcgggcggcgccatcgtgaatacgctgcggcctgcgtcactgccggaagtggtcaccagcgatatatggagagaagcactggctttggcggaggaatttctgtcgctgacgaacagttgcgatggcttctcagatcgctttgcgccctgcctcgccgcgttacaacaccatctggatgaggcccgagcgcgcatcgcccgactcggctaa

SEQ ID NO: 115136 - DNA, 293 bp, Glycine max
  Peptide Sequence Number=SeqID_231914
gtggggcacaagatgttgatcaaggtgacagtagcagctcagtccagtttaggacatctttagctgcatttgtgaatatgcttgttaatgagtttacacaagttggagctaaggattgtgacaaagtctttccattaactgctgtgggaaattcgtccagtgaaatgctaacaacagtgggaaatccatctggtgtaaagctgacagcagtgggaaatatgtccggtgaaatggtggcagcagtgggaaatgcgtctggtgaaatgcttgttgctgctgcatcaattccttga

SEQ ID NO: 115137 - DNA, 144 bp, Glycine max
  Peptide Sequence Number=SeqID_231915
atgaaggaaaagcctcgtggcttagcgcgcaaaaggactgctgagcgagatctgcagaccaaaaatctacaactctcgctaagccaggctcttgccagcttagctaaaatgatgcatcttaagtacaaaggagcatgcgcttag

SEQ ID NO: 115138 - DNA, 252 bp, Glycine max
  Peptide Sequence Number=SeqID_231916
atgaggctaataaatggaacagaacaatccctatctaaggaaaatgattcaatcaaaaagtcacttatgggtttcgccaatcctgttctctttctgagcctacgacaacgagtggttcacgacgcagaggctctgatcggagcaagcagcaaggaacatgctctggccgtcgaagaagctgatcttctcgatggaggtcatgcaacactcctgccagctaagctcgccaagatcagcaaccacatcctctag

SEQ ID NO: 115139 - DNA, 453 bp, Glycine max
  Peptide Sequence Number=SeqID_231917
aaagtgctggtgcaagcggtggagtcgctagatctagtggatctgccacagtcaatggtgagcgagagcgtgtcgacatttgtggtggtggcactagaggatgtggttgctgatcttggcgagcttagctggcaggagtgttgcatgacctccatcgagaagatcagcttcttcgacggccagagcatgttccttgctgcttgctccgatcagagcctctgcgtcgtgaaccactcgttgtcggaatgcctattgattgatcctaaagagcatcctatgcttcttgcagagccttcttctaactctcaacaacagagagaaaggacagtagagcttatgtttgagaagtacaaagcacctgcattgtttttggtgaagaatgttgttagtccttcactgacctacaccttcaaaaataatttatgtcatggagtgaggatgaaaaactactga

SEQ ID NO: 115140 - DNA, 1083 bp, Glycine max
  Peptide Sequence Number=SeqID_231918
atgcctcattcttatgtatttccagaaatgcaagatgctcaagacatttgcgatccagaagctgatgaaaaaaggaagtttattgcaggaagccagattgagcaatctgacaatctgaccaaagaagggacatgtaacccaatgacaggagacactgtttgggttgaaggtcttgtccctggcattgacttttgtaaccatgtgataagggtatcatatatagttatatacaatctgaagccaatagcaacatgggaagttgatggaactggtttagcatcaggagttcctttctccatgtatcttatctctgctgctcaaagtcccttgcagattgatcaagaaatctacattagttatggaaacaagggaaatgagcatcaatcttttaagctgcaagcagagaggcctgcaagggggagatttttcatgtggccaacactggaacttctgtatctgtatggttttgttattgatgataacactgatgactatctcatggtccactatccagcagaagcaattaatacaatttccttctctgagtccaaaaaccagcttcttgaagtgcagaaggctgaattgagatgtcttttacccaaaacttcactggataatggattttttccgttaaacacccaaaacggtgaagaaaataacaagtccaaagctgaccaagtttgcaactatagttggagtggtcagcgcaagatgccatcttatgtaaacaagctggtgtttcctgagaaatttatgactactttgagaaccatagccatgcaagaagatgagcttttcaaggtttcctcaatgctggaagaggttcaccagaagtttagaatcctgaagcttgctggacctgaaagggagagacaactatcagatacagatgtccaatcagcagtgtgggaggtctgtggtgattctggagctttacaattgcttgtcgatcttcttcgtgtgaagatgatggatcttgaagagagttctggaacagaggaaaatgaccttgatttgctcaagaaagcccttattattgatagccatgaagatagcaaacaatgcctgagcaatttaaggtag

SEQ ID NO: 115141 - DNA, 222 bp, Glycine max
  Peptide Sequence Number=SeqID_231919
atgtcgatacaaagtagtagcaattcctatttggtgtcacacacttcctctactcactctaaagctgcttatgagagtattagcatgcaaaacccaaagagagtatcatctcggacagctcaaggcaaaaatagcaaaactgaggacacaattattggagcctccaaaagaaggtggattagatatatgtgcaagcattccccttttgacatcttaatctga

SEQ ID NO: 115142 - DNA, 105 bp, Glycine max
  Peptide Sequence Number=SeqID_231920
atgttttcagcctcttctttccacatgaagaattggagctatacaacacgtccaataattatgcacttagcttatgcaagaactgctcaaaatgaagacgagtga

SEQ ID NO: 115143 - DNA, 801 bp, Glycine max
  Peptide Sequence Number=SeqID_231921
atgggtgagagaggtggcagcagtggtggcaccaccacaaggctcctccagacagctgcggaggacggtggagagaggaagagtgagagaccaaaggagccttggaaaggagagtatgtgaagagcatggtttttgcagggcttgatgccattatcacttgcttttctctcatttcctccatctctgctagcactagttcctctgtgcatgtgctggttcttggggtctcaaacctagtggcagatgcaatatcaatggggtttggggactttgtgtctgctagctctgagcaggatgtgatcattgaggaaaggagagtgacagaatgggatgtcattaaccaaagggacaaagagcaaacagagttggtcaaacactatcaaaatctagggatggactacaatgatgcaaccatggttgtgaacatattcacaaagtacaatgacattctagtggatcaaagaatggtagcagacaagggaatgctgccagcagaccaagaagtgaagccctggaggaatggccttgtgacctttgcatccttcatgctctttggctcaactcctttgctctctttcatcatcctcataccattcactgacaatgactctgtcaagtttctcagtgcttgcattgtttctgcacttgcccttgctcttcttggggtggcaaaggcaaggattgctggccaaaacatcatgctctctgcggctgtcacacttctctgtggtgccatagctgcagcttcggcttatttagtgggatggttgcttaagcttatggcaggactagagagttga

SEQ ID NO: 115144 - DNA, 444 bp, Glycine max
  Peptide Sequence Number=SeqID_231922
atggtagcagacaagggaatgctgccagcagaccaagaacagacctttgaatccttcatgttctttggctcaactactttgctctctttcatcatcttcataccattcactgacaatgactctgtcaagtttctcagtgcttgccttctttctgcaccttaccttgctcttcttgggctgccaaaggcaagaattgatggccaaagcatcatcttctctgtggcttcaacaacgggaaaaaaggtagtggcattgctattgtcatacgtgatatttacaaaattaacagaagttgcagaacagcatgtgataagtggagcactactcatagctatcgggaatacattgaagatgttgcttgataacatattcactagcaccaagaccaagagggtcttagcctcttctaccaccaggggcaatggtgcaaaatctactgtgtga

SEQ ID NO: 115145 - DNA, 1821 bp, Glycine max
  Peptide Sequence Number=SeqID_231923
atgggggttggtggtaatttctgggacctgctaaagccctatgcgcgcaaagagggttttgatttcttgaggaacaagcgagttgcagtggacctttcgttctggattgttcagcacgagaatgccatcaaggccacgcatgtcagaaacccccatctaaggcttaccttcttccgcaccatcaatcttttctccaagtttggagcacttccggtgttcattgttgatgggactccatcaccgttaaaatcacgggccaggattgtgagatatttccggtcttctggcattgaattggctagcttgccggtgcctgaagaaggtgtttcagctgagaggaaccacatgttttcaagtcatgttcaaaaatgtgtggaactggttgaactacttggaatgcctgtgctaaaggctaaaggagaggctgaatcactctgtgctcaattaaatagtgaaggtcatgtagatgcttgcatcacagccgacagtgatgcattcctctttggggccaactgcattataaaatgtttctgtcccaacttcaaagaaccatttgaatgctacaatatgtctgatattgaagctggacttggattgaagaggaaacacttaatagctatctctcttttggttggaaatgatcatgatataaagggtgttcgagggattgggcttgatactgcacttcgttttgttaaggcttttagtgaagaagatatattgaatagattacatgagataggcaaagggaatacttcacaaattcccatcttcattaaatttgaggatgatatggatatggatgggaactccctaaatagaaaacaatctcactgttcactctgtgggcatccaggcagcaaaaaagatcatatgaaatttccctgtgaattttgtgtcacaaaggctgatgaaggttgccagagaaaaccagaggattttaaatgtgattgcttctcctgtgatatgaataggaaacataaggagaaaaaaagactgaaaaattggcacacaaaaatttgtcacaagattgcagaggagccaaactttcccaagaatgaaatcattgatatgtatttgtgcaatgacaatgcaagtgatggcccacacattgtatggggaaaaccgaatattgagatgctgattgattttttaaacttccatcagcattgggaaccagcttacgttcgacggatgatgtttcctatgatgtcaaccatctttttgagagatatgacaacaactacagaagagactatgttatttgggcaatatcagtttgattccatagaacgtgtcaagatgagatatggataccaattttttgtggtcaagtggaaacatgcaggggttaacatttcctgtaaagttccattgaaggaatcaagtgtgcaacaggatgctataatagagcttgatgaaacggtggatctactggatgactgtgatgttccagagattcatgaagacagtgggtgtcgttttctgcttacagatgaaaatatggaccttgtaggtgctgcttttccagcagaagtcaaaaggttttggcaagaccaggaactgaaaagaagaaagaactcaacatcaagatctcaagaaaatgaaaaatcaccatcaccaaactcaagaagtattcagctaaacattacagagttctacccatcaaccaaagttaaacatcgtcaatcaaaacaaggaggaggagagtcatccaagattgctgatagtcaaggcaatgagggctcaaaaatgaaaaggaaaatgtcaagtcctgataagattccaaaatctgtgaggcgtcgccttttgtttgattag

SEQ ID NO: 115146 - DNA, 414 bp, Glycine max
  Peptide Sequence Number=SeqID_231924
atgttgttagggaagagacctcgtcctccaattatgaagagaacaacaagcatgtccgaaataaccttcgatctgaacacgaccttggacgatgatccgaacaatcccgtgaagggaccaggaggaaatcagaacagggtttgggccatggtttcacccagaaaccattccgaggatactacccctgacttcttgcgcgtttgctttctctgcaaacgccgtttagtacccgcccgagacatcttcatgtacaaaggtgatagtgctttctgtagttcagaatgccgtgaacagctgatgaagcaggatgagagaaaagataagtatcgtgtgggatcaaagaaacaagttgcggaaaagcctaattctgggtctcaagttaacaaggcgaaaccgtggttgccttgtaactaa

SEQ ID NO: 115147 - DNA, 347 bp, Glycine max
  Peptide Sequence Number=SeqID_231925
atggaagaggcacccccatcaatacaagacctcattttctctcttcaacaagccactttcatggcaaaacagttgttaccttcatccactaataaccccacccatctccaccaaatccactcctccctccaccacgcccaccgccacctctccgtcttcctcgccgccctcccctcgcctcctcccgccgccgagtcctccgccacggacgccgagccgatgcaggtcgaggacggtggcgatggtgatgatgaagagaccacttcaaagtgcattattgacaaggttgaggagaaaatgaggcactgcttcatcaagaacaagcgccccaaacggccactttcgcc

SEQ ID NO: 115148 - DNA, 345 bp, Glycine max
  Peptide Sequence Number=SeqID_231926
atgactaaatcaaacagaacacacactctgagggagttctcggagagatttgcaaaagataggataagtaccctcacctccagaggactacatgtcctcgccatcagaggactgcatgtcctcaccttcgtagggctacacgccctcacctttagaggactacacgtcctcgccaacagagggctgcacgcccgcaccttgagaggactacacgtcctcgccaaggtagggctacacgccctcacctttagaggactacacgtcctcgccaacagagggttgcacgccctcacctttaaagggctacatgtcctcggctccgagggctacacgccctcaccttga

SEQ ID NO: 115149 - DNA, 123 bp, Glycine max
  Peptide Sequence Number=SeqID_231927
atgtctagcatgaggctctcaacaatgttcgaaggagtatcctttcgagatgttaggggacagaaagttgaaccgcaagatcaagaagaggactttgttactatctctgaaacatggcaatag

SEQ ID NO: 115150 - DNA, 297 bp, Glycine max
  Peptide Sequence Number=SeqID_231928
atggaacagggggaaaattgggcgtgctcgggttcgcggaggaggaagacaatggtgaagatggaaaacgtagcaagagggcgtcaaacttctgagccatgctttgaacggtctcacccagagaagcatggagactttatggaagctgtagaggcaaaatcttcatctgggtatggaaagccgtcatgggtatttagaggcaggcaagtcgcctggtatcaactccatcttgtgaaggctgagaaagctcgagcttacattccagaagaattcaaattggttgaagcttttgggtag

SEQ ID NO: 115151 - DNA, 288 bp, Glycine max
  Peptide Sequence Number=SeqID_231929
atgaaggggcaacagatccttgaaactgcatgcctggctatggcaacagatccttcacttgctgagagagcattagaagtgtcgttcgtggttcttcttctctttaaggcaattcaggtggtaatatataaattacatggggaaagggaatattctagagaatctcttgaaaatggaaacacgttccagcaggtgataaaagaccatgacaatggggagaaatttatggaaaatgtacaacagaatcaagctagtattgatggagagggagaaggacatcataagtag

SEQ ID NO: 115152 - DNA, 3684 bp, Glycine max
  Peptide Sequence Number=SeqID_231930
atggctcagaagtttgacgccctcttgctacgttttccatcttcaccattgtcttcctcctccgcgaacccgagcacgcccaattttccccctgttcctgcatcacaacacaaaatgaaactcaacattcccaagtttgatggcactgaccttttcggtggatggctaacaatgggcagttcacgtcgtggcccgccttcatccaagcccttcaaacccgcttttctccctcgcactacgacgatcccacgggctcccttttcaaattacaacagaccggcaccatggtttaggttgtcgcccaacgttcgccgtgaggtgcaagcgctgcaacccttgacattggtgcaagccgctggcctcgctcgactccaggaagagaagcttctaaacacgcggccttcacttcgcaactgtgccccctctgttgtgcccattccatcgcggcctgccccctcccctgcgttgcttcctcttccagttccgcattcaccgccaccccggttaccccccaccttgaagcgactctcaccgaaggaaattagctctcgccaggaacgaggtctctgcttcaattgcgacgagaagtatcatagaggccaccgttgtgcctctagggttttcttcttggtcgcggaggaagatgaagctgttgatcctcatatagagggaattgacccaagccccgactcgcctgatatccacgacccgggcccgacccaaattagttttaattcactagcgagccagctagccccgaaaacgctgcgtttgataggcacggttgccggcaccaccgtagtgatcctggtggacggtgggagcacccacaatttcattcaagaatccctcgtgacccaacttggcctacagactcaacagaaaactcctcttcgtgtgatgattggaaacggccaacatttggcttgcaatcgtctctgccctaacctttccctcaccatgcaacaatttcattgtgtggtggacctgtatgtgctaccaattgcaggagcgaacatagttctgggtgtgcaatggatgaagatgctcgggccagtactcacagattataatactatgagcatgaagttcttcttggagggccaactcattgaacttcagggtgatcaggagtccaccttgacgatgttgaccccacatcaatttcgccgtttatcccataactccgacactagctccttctatcatattgcagtgctagcagaggtgccgataccagattccaactcacctctgcacccgtctattcaaaccttggtggatcactttgttgtcctgtttcaacccccaacttcgctctcgccggagaggatcaccgacgaccacatccatttaattccgcaagctgccccagtgaacgtgcgtccctataggtatcctcactttcagaagcacgaaattgagcttcaggatagttcatggcatttttgcatggattatcaggctctgaacgcgatgaatgtccgtgatcggtttcccattcccaccatcgatgagctcatgggtgaattaggtaaggcttgttggttttcgaaattagatttgttgcagggctatcatcaaatcaggatgcattcctccgatattgccaagacagcatttcgcacccaccatgggcattacgaattcaaggtaatgccttttggtttatgcaatgctccctcatcgtttcaggcaaccatgaacatgatcttcagaccgttccttcgtcgtttcctgatcgtcttcttcaacgatatactgatctacagcgcaacaattgaggagcatgtagcacatgtggaacaagcttttcaggtccttttggataatcattttgttctcaaattatccaaatgttctttcgcacaacaacaagtggagtacctcgggcacatggtttccaagaaaggagttgaaccagtggcggccaaagtggaggcagtacgacagtggccggttccacactccattaaagcttttcaaagcttttttggcctcacgggcttttataggagatttatcaaggggtatgcttcgatagctgccccattggtggcagcaaccacggtggatcctttccaatggaccgcggtggctcagctagcatttgaccatctgaagcaagccctgtccgaagctccgatactcgccctgccagatttccagctaccatttacggttgagaccgatgcttctggggtaggcatgggtgcaattctctcccagcagggccaccccattgcatattttagcaagccatttccgcctaagctccaaaggtcctccacgtatgtcctggaattgtttgttatgacggcggcggtcaaaaagtggcggcaatacctcctcagtaactgcttcatcatccttacagatcatcacagtttgaaggagctacttacgcaagttattcaagccctagagcaaaatatgtaccttgctcgactgatggggccgcatttggttaccaccacaattgcccttgatcatgactcttcttcgagagtaccatgccactctgacagttgcgtggactgccaatatgctaagtacaagacaaagagggtggcggggctactttgtcctctcccggtgccacatcggccatgggaggacctctcattgaacttcattatggggttaccttcttttcaagggaacactgttatcctcatagtggtggatcattttctgaaaggtattcacctggccatgctgccagcctctcacacggcacacgcggtggcctgtttgttcatgaacattgtcgaaaagatccatgggttgccacgcagcatggtctccgaccgggaccctctcttcatcagcaggttttggcaagaattattccatctgagtggaacacagcttcgtctcagttctgtgtatcacccacagagtgatggacaaactaaagttcttaatcgagtgattgagcaatatcttcgatcctttgtgcatcgccggccgggatcatggggcaagcttttactgtgggtggaatggtcccacaatacagcgaggaacgcgacaacggggtctacaccctatgaaatcacctttgggaggaaacctttcaattttccggagtacctcacgggcacttccaaggtggatgtggttgatgaaatgctgactaatcaagaagaaaccttcttgctcattcgcaagaaattgcttaaagctcaagagctcatgaagaagtatgctgatcgcaagcgcagggaggtggtctaccagctaggggagtgggttgtggatcgtgtgggacctgtagcttatcgtttgaaacttcccgagggcgccaacatccatccggtgttccattgttcccttttgaagccatttaaaggttccccagagatgactaactcagtcccattgcttgatcaagttgttcataaccaacctctgatagcccctttagcaatcctggattatcgccaagcttcagctggagaagactctcactgggaagttctcgtgcagtggtcaggactaccaccagaagaaacctcatgggaacgctggactcaattatgtaaagaatatcaccttgaggacaaggtgcatttgcatgggctgtggaatgatagacaagcaggggtacaacaagcaataggaaaggaaccaagcaaacacactaacagcaaggatcatctgaagggttgttgtctatga

SEQ ID NO: 115153 - DNA, 369 bp, Glycine max
  Peptide Sequence Number=SeqID_231931
atggtagaacttgtgtggcattcccttgtggacgacattgttaaccttgatggcgacataatcgccggcgtggtaggttctgaggtatgtggtggaggaggccggaggggtggtggaggaagaggagggaggcggtggtgccggcaccaaagccgaggagggcaagggggccggggggggaccatgggagggaacgctctagggtttgcggggaagaaaaagacctacagttttctcaatctgcctctgcctctacctactctccttactaaggcttctagatgtcatctccacacatgcccataccacctaagagcatctttactggattatcacatgatgattaaccctcacaatatcacatcataa

SEQ ID NO: 115154 - DNA, 399 bp, Glycine max
  Peptide Sequence Number=SeqID_231932
atggaggccatgaaagagaaaatggccacaatgatggaggccatgaaagagaaaatgaccacaatgatggaggccatgatgagcatgaagaagataatggaagccaatgcggttacaattgccgctaccagcattgttgctaaggtgaacccgatgcccccatctggcctcaaccaaatgaatcatccaaccttagacatggtaggcaaagatttgggaagtagggacgacccccatgatgtgcaaaatcaaaacaagcacgccttcccgccatatggcctgcctcccaactatacaccatccaatgtggcatacactcccaatgaggatgtcaataactccactcctatacccattgagagccaacaaccccaaactgatcatgcacatgtctcttaa

SEQ ID NO: 115155 - DNA, 543 bp, Glycine max
  Peptide Sequence Number=SeqID_231933
atgttgggttcaggtaccaatttggtgaccacggtcattgggtttgggatgagtgccactttcattgtgtttgtgtgcaccagaatcatttgtgggaggctaagagggggtgttgaatctcggatgatgtacgagattgaatcaagaattgatatggaacagccagaacatcatgttaatgaccctgaatccgatcctgttcttcttgatgcaatccgtactttgaagttcaaccaagaggctttcagttcccttgaacacacacagttaagttttagtctctcaattgtagagctcatgatatacaagcagcactttgatagatatataactgaggttgcttctacagtatgccgtctgccgttgaaaaactcttccgaaacgaaacatgtgagacctgtgacatttaccatgagccaatcccttgacgagtctcacacatcagacagaaacgatgatattgagagatatgttgaacctacacctactgcagccagtaactctttacaaccaacttcaggagaacaagaagcaaggcaatga

SEQ ID NO: 115156 - DNA, 114 bp, Glycine max
  Peptide Sequence Number=SeqID_231934
atggcacatctaagctccactaggaaggtcgttttcatacacaaacaagacaagaccctgcaggggacctccagcagttttgaagatatatttggtataaccaattgcaaatga

SEQ ID NO: 115157 - DNA, 426 bp, Glycine max
  Peptide Sequence Number=SeqID_231935
atgtatttaattgttggaatgctcttccaggtgacagatgttgacatggagaaggagaccaagccaagtttttacttaaaacacatcttacctattatacttaaaaatcaagttattcactttgttggatttggtaatcgtctggcatttgatccaatagcatttgagctgcagaatacaagcagcttgtgctttgttggaccattggatccttaccttgttggtccatttgcaaaatcgatgaagggagtttgctcacgattggttgctttgaccaacttgtaccctaaattggtcagcaaagagaacttgctttcttcagctgaacttcaatcttttgctaattattcctctcagttagcagcactggacttcataggctgcactgcttcagatgcattcgccatgactgattcaagaagttag

SEQ ID NO: 115158 - DNA, 1007 bp, Glycine max
  Peptide Sequence Number=SeqID_231936
atgcgtcgccgccaccccccccccatgtggagacatccaccggtcatgactcgtggatggagcgagacgccgacccgccccgtccacccacgagggtcccacgacgagagggacggcgacgactcggtcgacgacgacgcatcgcgacgcgcgtcgacgaccgcgggtgagcgacgagagaacgaggaggcgaggcgagacgcaggcgagaccgttcgtctcgacgcatcgaattcgatgacgacgccgttgaacggggacacgatcaacggcgccgtcgtcgcgacggagtacgcggtgcgagggccgatcgtgattcaggcgcaacagttggagagggcgctcgaagagggggcggatttgccgttcgagaaggtggtgtactgtaatatcgggaatccgcaccagttggggcagagaccggtgacgtattatcgtcaggtgttggcggcgatcgagtgcgagggcgtggacggggcgttgccggcggacgtcgtcgcgcgcgcgaatgagtataaaagctcgatcaaggggggtacgggggcgtattcggagagtaaaggtgtgcaggttttacgccagcgcgtcgcggcgggaatcaccaagagagatgggcacgcggcgaatccggatgacatctatctcacggatggggcctccgccgggtgccactacctcatgaacattctcattcgggggtccgaggatgccgtcatgtgtccgattccgcagtatccgctgtattctgcggcgctgacgttgtacggtggtactttggtgccgtattacctggatgaagatcgctcgtggtcgatggatgtcgaacacgtgaagaaacagttgaacgaggcgagagcgaacgggaaaaacgtgcgcgccatcgtcgtcattaacccgggtaacccgactgggaacttgctttccgatgaaaacttgttagacattgccaagttttgcgccgatgagaagttgcttctgatttccgacgaagtgtaccaagagaatgt

SEQ ID NO: 115159 - DNA, 318 bp, Glycine max
  Peptide Sequence Number=SeqID_231937
atgtcttgggtctcggctcagattattaccctccgacttgggaaagtcatggctgcaaccctttccactataccagtccgagtgtctctattcagggaatatcaaggaaaaggaaaaaggcataaaggaggaaacactaggctgcaattatttttcctagtctttgtagtgacctttgcctattacactattccaggggttatgactgtggaagcacaaaaggcttataagtgtggtgtagattgtacaatgactatgcactataccaattaccaaaggcaagacattgatgttgaggagcagacattgaagacatag

SEQ ID NO: 115160 - DNA, 486 bp, Glycine max
  Peptide Sequence Number=SeqID_231938
atggcagggggatgttggttacaacaaaaattgtcccatgcaactgaccagaataggaaggagctagaggaaaagtttaacaatgtcgagaaggatgctgaagaaacgatacaatctgctaggcgcgaagccgaagagtattcttttgatcttacgaagcataaaactgctttcattgatcttgtgtcaaaccaaaggcagctcgaggcggaagtcggtcgagtggttaagcaactgcaacctactagacaacaccttgcttctgtggacgagaagaaagaggagttggatttgatggcgcggaaattggctttggagatcaaaaaatttcacaaggatttcgaacataagaataaaattttgtcaccaatgttgagtaagtgtaagctggacactgcagacaaccaaatgttgttgaaggaggttaagttatcaaacaataggaggaagcaagctgagcaggagacacaaaggtggttcaactga

SEQ ID NO: 115161 - DNA, 219 bp, Glycine max
  Peptide Sequence Number=SeqID_231939
atgaatgacgtcgttagggtgctagagttttttttgcagcttcaggatagtgttgttagcggagtggttgcggagagtggcgggaataattatgaagatatattggatatattgagcatgacaagcgatggagatcgtagctttgtgggtaaggaatctgacaagttggttcctgtagagcttgttttctctgagattaacgatccaaaggggagatga

SEQ ID NO: 115162 - DNA, 390 bp, Glycine max
  Peptide Sequence Number=SeqID_231940
atgtcttatgtacttcgccgcctctcgccgccgcccagcggctcacgcgcacccttcgagcggcgtcttcgagtcgtcggcgcacccgagaatgtgaacgtcgtcgtgcccgctgttgacgatttgcgtcgaggcggagtatgccccccattcgggagccacctcgcccgagccgtcggcgtggtagtacgcgcagctgaaacgatgcttcggggacgggtgcttttcgttgatgaagataaagctcgggtagccgtgttgcttggcgtattgcttgcagtcacccggacccttggcctggccgaaaccttgttcgtaggtgtgagtggcgtgcgcccatccttcgatttcgtttcgcgcgtgtcgcgcgtggtgcgactagcacgttga

SEQ ID NO: 115163 - DNA, 468 bp, Glycine max
  Peptide Sequence Number=SeqID_231941
atggcgcgtccacctcctcgtctcgacctcgtcgtcgtcgcgcgtcgtctcgtcgccgcgacggtgcgcgcaccgaacgctcgcgtcgcgcacgcgcgcatgccaatctcgcgcgtcgggttctcggcgtcgcgggcgagacggacgatggacgcgcgcgtcgcggtgtcggagacgagtcggtcgtcatcgtcgtcgtcatcggcatcggcgtcatcggcatcggcatcggacgcgatgccgacgatgggcggcagagaggggcgcgtcgagggcgatgcttcgatcgatgcgtggattcgacgcgtacacgagcgcggcgccgcatctgacgagaaagacgcgcacgggcgcgtacatctccatcgtcggcgtcgtcttggcgctgagcctgggatgcgtcgagttggtggattttctcacgccgatgcgcacgaagacgatggcggtggacgatgcgcgaggtga

SEQ ID NO: 115164 - DNA, 1323 bp, Glycine max
  Peptide Sequence Number=SeqID_231942
atggatgaacgagcgtcgctgttggcgcgagaggagcgcgtgttgcgcatggtggacgtcgccgacggaacctatcgcgcggagaagcgcgcgttcgagacgcagacgcgagagttgcgggaggaattggcgagcgtgcgagcgacgttggtgcgagagcgagaggcgagagcgagcggggagagtgggtcgagggagcgggagagcgcggacgcgcgcgccatcggtgcgttgcgacgccgcggcgaggagttggaacgcgaggtggagacgctgacgacgaaaaatcgcgagcttcacaaggaggcgttgttggccaaggcgaacgggaacaaggtggattggctcgagggtgaggcgacgcagacgcgcgagcgactcgaggcgagcgaggcgacgatgaagcgtttaaaggcggatttagaatttgaaaaatcgagcgtcacaaagtacgagagcaaagccatcgcgctggaaaaggaaaagagcgggttggagaaggcgctcgccgcgcgcgatgggaagattgagcgtttggaggatcagttgcaggcgaaggaggagaaattggcgacgatggcgagcgaattgagagcgagcggcgcgttggcgcctcgcgaggcggcgctcgcgaagagcgaggcgagcgtcgaggcgagagaagcacgcgcgcgcgcgagagagacagagatcaaggaggcgctcgccaagttgaaatctcgtgaatccgcgtgcgacgctcgagagaagggcttgggaaaacgcgaggcggcgttggatgcgcgcgaggtcgcgctcaccaagcgcgaagccgcgtcgacggtgcgcgcggggagatccgcgcgcgcgccgactccttcgtcggggaaagagctcgcggtggcgcccacgccgaaacgcctagcgtccagatttccggacattgtgcgtcggtacgtcttcacacccggtttggcgcctcgtcgagcggatgattcgccgacgccggcgtcgccgccggcgccggcgtcgacgcccgtgagcgaacgatcgaaacatctcttcgccgccgtcgtcgagaaggcgcaatccgcggccaaagcgtcggcgtccaagttggaggcatcggcgtccaaggcatccgcgtcggcgtccgcggcaaagacggcggcgggcgtgggcatgttcaacgcgttgcaatccgtcgtcggatacaaggaatcgccgcgagcggcgatcgcgtcggctgaaaaatcgccaaagacgcccaagtcttccaagggcaaggagaaggtggagaagaaagtggcggagaaggcggaggagaaatgtgggatcctctag

SEQ ID NO: 115165 - DNA, 1417 bp, Glycine max
  Peptide Sequence Number=SeqID_231943
ggctctacgagcgaactttgacaagtacgcgaaccaactgtgcgatacgatatatcgcgataacggtccaaccatcgagctcacaaaggctgagcgcaagctcgcaaagttgaccaaggatccggagagcgcgttttacgcgctcgaacagaaacctctcgaagatttttcctcggcgtctttcgaagagttgtgcgtggagtttgattactccatgaaacgaaccgtgttcgacattccggcgtacgtctggatgcgcgacatggagctgatggatctgaagcaagaagccatagacgagtgcgagaagaagcgcgaaaccgcgctcagacgcatcatcgacatcgcacagacgacaaaggattcctttgaaaagtgtcagaagaagacgcaagaaatgtatgaaaaaatacacaatctgatcggacgtctcgcgggtgccactggtgcgcgtcgcaaaatgcagggatccagaatcgaaacggctcgaatggcggcggaagtcgtcatgctgagacacgatttgcgcaaattagccttgaacgatggatctttgaagattcccgagcacgaagtcggcgtgaccgcgtcttacgacggcgcgattctcttgggcaactatcgcggagatttcgcgggcatcgtggcgtcgagattgcccgaagatgaaaacgacgtcgcgacatccttcggacaagttgatttaccaatctttgagtgcgcgctcggtttgggtggtttcgacgaggagttcgaaaagcaagccagaaagtgcgggattttgttcggtctcttggacatagacgcgagcctgaacgaggtgagcaaaaacgtcggcccttcgcttctgcgccgaccgccgagggcgccattcgacaaaaataaagacgtgaatgagtacgacatggaagcctacgctcggatgcctgctgattcatcctttgtaaacatcgcggagacttcgtttgatcaagtcgaatacttagacacagactatctacacgaaggtttatctttagctgggaaggatgacgacgaaaacagcggacccggaaaagtgaagatgtattttagcgtgatgcgcgtcgcgagggcgtacatcaagctcctcaacgccaacgggaaacggaaacgttcttcagcggtcgcgcgatacatgtcagccgctcctgcgcccgaggttctcctgatgcacgtcccggattcgtgcggcgtcgataataccgactctcgcggcatgtccgtcgagctcgccgtcgccagcgtcaaggcgctgcaaaccatcgtgaatgagtggaacgagatgcgcacgctgttcaaatcggcggctcaaagtgagggtgggttcgtcatcgatatcaatcgtagtatcggcgatatggcggccgaagattttgaaaaatgtgggatcctctag

SEQ ID NO: 115166 - DNA, 249 bp, Glycine max
  Peptide Sequence Number=SeqID_231944
atgagaagcctagactctcaaggaaatccaaaggctcactttccgaatagccttgttaacaaggttcctgccttagatagccgagaaggccaaaccaatcatgaacttgttgaagaagaccaaaaagttcaaatgggtccaagaatgtgtaaaagctttccaaaacttaaaactgacactagccatgccacttttgttagccaagctagacacataaaagaagttagtcatatatctgtcaatctctag

SEQ ID NO: 115167 - DNA, 489 bp, Glycine max
  Peptide Sequence Number=SeqID_231945
atgactaaagcacgtcaaaagggggtatggaaagaaaataggggaggagcttgccacccagctcgcccaggcaagctaggttgcttcctcccgaagcaaccgccttttggaggaacatcctggaaggcccaagtgggcctgaatttcacggattgtgtaacaatgcttccttttgatttctggcatgtctcgaaacttcacgaattgcctaacgatgggtgccaattgattatgtttccaagtgggttgaagataaggccaccaaaactaatgaattctaaatttgttgtggattttgtgagatctaacattttttgcaggtttggtgtgcctagatccatcattagtgaccaggggaggcacttctataatagatcattagcatccttactccagaagtatggggttgtgcatagagttgctatagcttatcatccccaatctagtgggcaagtgaaggtttttaatagaaagatcaagcaagtgtag

SEQ ID NO: 115168 - DNA, 1392 bp, Glycine max
  Peptide Sequence Number=SeqID_231946
atggcgaaggaagatgtgtttgagttcctcgggaacgttcctctgctacagaggcttcctggctcgtctgtgcggaagatatctgagcttgtgattctcaaacactatgagccaggagagtatgttgttcgtgagggagaacgtggggacggtctttacttcatctgggagggagagttttctgacttgcaggctgaggttgttggctctgtcaatgcggatgatgataatcatccagagtttcaattgaaaagatatgactattttggttttggtttgtcaaatgaagttcaccatgctgatgtcatagctttgacaaagctatcatgcttggtgctgccccatgagcactcagcattgctgcagccaaagtctatctggagtgcagaaaaatctcatgatacatgctcacttgtggagcatatattgcatttggaacctatagaggtagacatcttccgaggaatcactcctacaaatgctccaacatttgggaaggtatttggtggacaaatagttggacaggcactggctgcggcatcaaaatctgttgattgtcttaaagttgttcatagcttgcatgtctattttcttcttgtgggggattttaacatacccattatatatcaagttaagcgtctccgtgatgggaagagttttgctactaggaaagtggatgcaattcaaaagggaaatgtcatattcactttgctggcttcatttcaccttttatcgttggaagagcttcgggaacaacgtcttactgaccctcgtctcccaagtttgagatattggtttagagcaaggggaaaactttcagatgatgaagccttgcataggtgtgtggtagcatatacttcagatctaatctttcttcaagtgagtttaaaccccaaccgtaggaagggcaggaaggcacgtgctgtgagtctggaccactccatgtggtttcacagacctttacgagctgatgactggatactatttgtgatctttagtcctactgccaataatgcacgtggctatgtcactggccaaatgttcaatcagaagggagagctacttgtatcagtggttcaagaaggtgtaatgagggaagttatttctgcaaattttaaaatttgcaaaattggtccttttgttgtctgcattcttcccatcccctaccaagattcacacctctccgactcttccatcaccccgagcttcgttcctcccatccctaccaagattcatgcctctatcgactcttccatcaccatgaaaaatcatagcttcacttcatcaatcaccatacatccaaaattgcaaaattcaaatattcacactaaacgtgctctaacatgtaacgcaaatacaaatatacccacagtcatggaaatattatactag

SEQ ID NO: 115169 - DNA, 3866 bp, Glycine max
  Peptide Sequence Number=SeqID_231947
aactcaacctcgtgagacgcatctcgcatgcttcactcgctcgcacgctcgcacgccggacactttccggtgccgcagttccgtttcctgatctcgatcttgccggattcctccccatcgcggccgatctcgccggacctccgcgccggtcgccggtaattgcggtgcctgacggagctctgaagattccggtgaggagaagacggatctgccggagaattcgtcatttgcaacgtcatttcgatctggatgcttgtggagttcctgaggacatggtttttttggttagagatggaggctggttcagacttgggattatggcaactgatatgcagaggcttgttggaacgagtgaggatgatgaagaaatgggaatggatgtgaaagatgaggatgatgacgatgatgattatgaggaaaatggaggtgagcagggaaatgcttcagtatcagggatggtagagattgatggtgggaatgggataggaactgccactgatgacaacaggtttcagcagcaccagcagtttcaagagcaagtaggcaccccaggtggaggtactcgaagatctaggccgctagaagagaaagagagaacaaagctaagagagaggcgccggagggccatcactgcaaggatcttggcggggcttcgcaggcatggcaactacaatctaagagttagggctgacataaatgatgtcattgctgctctagcaagggaagctggatgggtggttcttccagatggtactacttttccctcaagatctcaggttcaaaagcctgctggtggtaattctacaattgtcacttcatcatcttcccatgcggcttcacaacagactccatctgcttctctcaggggagttgcttctggctataggagccctttagagtataatgcatgtcaaacaaaaagtgtttttatgccaactccgtctccttatggtctatcctcaagttcccggtctcaaacatctatggtgggggatggagaagcacaaagagacaatcgtcctctgattggtggttcaatggataatgctgatgataagcagattgctgacttaccccccagattaccagagcgtgatttggctggtaccccatatgttccagtttatgtgatgctaccgttaggggtgatcaatattaaatgtgagctagttgatccggatggtctactaaagcagctgaaggtgttgaaatcagtacatgttgatggtgttatggtagactgttggtggggaatagtggaggcacatgctccacaagagtataattggaatggttacaagagactctttcaaatggtgcgagagcttaagcttaagctgcaggttgtgatgtcatttcatgaatgtggaggcaattttggtgatgatgtttgtattccattaccccattgggttgctgagattggtaggagcaatcctgacatttttttcactgatagagagggaaggcacaaccctgaatgtctttcttggggaatagataaggaacgggttttaagaggccgtactgctttggaggtttactttgatttcatgagaagtttccgggtagagtttgatgaatattttgaggatgggttaatctctatgattgaagttggactgggtccatgtggagagctaagatacccatcttgtcctgtaaagcatggttggagatatcctggtattggtgaattccaggataagggtcttcatttaacctctattgatataaaactcaaacttcgtaccccattgcccagaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcgccctcttaacctctattgatatatgttgctatgatcagtatatgttgaaaagtcttaggaaagcagcagaagtaaggggtcacgctatttgggctagagggccagataatgctggtacctataattctcagccacatgaaacaggtttcttttgtgatgggggtgattatgatggcttctatggcaggttttttcttagctggtactctcaggttttgattgatcatggaaaccgggtactttctctggcaaaattagcttttgagggatcttgcattgctgcaaagttatcgggtatttactggtggtacaagactgcaagtcatgctgccgaattaaccgctgggtattataacccatgcaatcgtgatggttatgctgcaattatgacaatgttaaagacaaatggaatcaacttaaacattccttgtgttgacttgcacacattgaaccaacatgagggctttccagagacctttgcagatcccgagggactagtctggcaagtgttgaatgccgggtgggaagttgacctaccagttaccagtcagaatggatttccttgcctaaacagagttggctataacaaggttttggataatgccaagcccatgaatgatccagatggaaggcacttttcatcttttacttacctgaggcttagttcacttctcatggaacgacaaaacttcatagagtttgaaagatttgtcaagagaatgcatgtgtttgagttccttgggaacgttcctctacttcagaggcttcctggctcgtctgtgcagaagatatccgaacttgtgattctcaaacactatggagagtatgttgttcgtgagggagaacgtggggatggtctttacttcatctgggggggagaggctgaggttgttggctctgttagtgccgatgaagataatcatccagagtttcacttgaaaagatatgactattttggttttggtttaccaaatgatgttcaccatgctgatgttgtagctttgacaaagctatcatgcatggtgttgccccatgagcactcaacattgctgcagccaaagtctatatggagtgcagaaatatctcctgatacatgctcacctgtggagcatatattgcatttggaacctatagaggtagatatcttccgaggaatcactcctccagatgctccaaaatttgggaaggtatttggtggacaaatagttggacaggcactggctgcagcatcaaaatctgttgattgtcttaaagttgttcatagcttgcatgcctattttcttcttgtgggagattttaacatacccattatatatcaagtttatcgtctccgtgatgggaagagttttgctactaggaaagtggatgcgattcaaaagggacatatcatattcactttgctggcttcatttcaggaagaagtagggtttcaccaccaggcagtgtccatcccattggtccctgcaccagatgaggcaacttttatcgctggaagaactacgggagcaacgtctaacggaccctcgtcttccaagattgatgtgggtaaaaaagctagctcagaagtgcttgatcaggttcttggagtatttgatagaaacgacactggctcatttgacctctcggtcatagtggctttaataccatttgcatatgcttcagatctaatctttcttcaagtgagtttgaaccccaaccgtaagaagggcatgaaggcacgtggtgtgagtctggaccactccatgtggtttcataggcatttaagagctgatgactgggtgctatttgtgatctttagtcctacttcttctaatgcccggggctatgtcactggccaaatgctcaatcagaagggagaggtttttccatttgacaacttgcagcttcttgtgtcagtggttcaagaaggtctaatgagggaagttatttctgcaaattcagccatcaaatctaatctttga

SEQ ID NO: 115170 - DNA, 720 bp, Glycine max
  Peptide Sequence Number=SeqID_231948
atggaagcacggaatcacatgtcaagtggccaagtcacttcacctgtactagtgtacagtagtagtcaactaatggaaggcatagcaaatgtgggaatatcaagttctgctcagttgctggcaaattcatcagaggaaacacctgttttgtcacctttagccccagtttcattattgagtagttcaaaaggtgaagaccagaagcagaaagttgttactaagccagaaaaagttcaagcgatattaaaggcaataaaacagagtccaaagaaggtcaacttggttgctgctctggttcgtggtatgcttgttaaagatgcattgatgcagttggaattgacaataaaacgagcagcaaaaactgtatatcaggttattcattcagcccgagcaaatgcctctcacaatcatgggttagatccagaacgtctcattgttgcggaagcatttgtaggaaaggggttttataaaaagagactttggccccatgccaaaggaaaatcatcgcttagagtaagaccagaatgcaggctaacagttgtagtaagagagataactgctgaagaagaggcagagattgctaggctgagggtccacaacttcaagagactcaccaagcgtcagaaacgacttgtgcctcatcagctcattgagtccaatcctatttggggccgcaaaaacaaatctagtggtcaaaacttgagtgctacacctgcatga

SEQ ID NO: 115171 - DNA, 111 bp, Glycine max
  Peptide Sequence Number=SeqID_231949
atgtggtttgaagacctgggaaatgtgaatctcaagcacgaactaagatggggtgcagcgaccttgttggatatccctggtgcgggaaaaagagtggttaaagagttttaa

SEQ ID NO: 115172 - DNA, 1275 bp, Glycine max
  Peptide Sequence Number=SeqID_231950
atgaatgagaacaggattgattcatgtgtaggacggattcaacaaagctatggtctaaatggtgattggaactctgagtttggaaattgttctagtcaatattttgatatgagacaggcttcaaatatgggaactagcaatcagccacttgccatggcaagtggtggaggagtggaacaagaaccaaacataggccaaaccaaatcatctagcagcattataagccgttttgagtcaccagcttcagccttttatgcaacagaaatgtgcatgggtggtttcccacaatatgatagccaaattggtaataatctctctttgatgtctcagtcctctaagtttagtaatatggaattccctttgtatcaatctcccaggcaaagccttttcatggcttcattagcaaaccaacctccccccaactttgacttgtcaaatcccttgcaagaaattctcaaatctcatttgaatagtgatcaatgtgttagatctcctgaagactctaataaaatcccatatggggattttcctggcagcaattttcttccaattgaacaacataagtttttcattgatgatgctatctcaactggtataagcccttcaattccttctaaaggaaatcaggatcaatcagtttcttgtggcccattcaatttaccttctgcacagcttagcttctcttctcagcaagagatgctttctccaacaggtagcatgtcaactacttctggaaattctaattcaaatggaccagtagtttcaagtaaaacaagaataagatggactcaggaacttcatgagaagtttgttgagtgtgtgaatcgccttggaggtgccgagaaagcaacaccaaaagctatattaaggctgatggattcagatggattgaccatcttccatgttaaaagtcatttgcagaaatatagaattgccaaattcatgccacagccaactcaagggaaatctgacaaaagaaccaatgtagagaatgtgcatcttgatgtcaaaactggattgcaaattaaagaggcacttcagttgcagttagatgttcagcggcgtcttcatgaacagctagagattcagagaaaattacagttgaggattgaggagcaaggtaagcagctgaagatgatgtttgatcaacagcagaagacaagtaatggccacttgattactgagaataatgatagaccaattagttctaaagatgttctggtttccacttctgacgggtctgaaaattccttattctctaccaatataagctag

SEQ ID NO: 115173 - DNA, 783 bp, Glycine max
  Peptide Sequence Number=SeqID_231951
atggcaaccggattgagaggttgctcctacgaggctagatctccagcgacgacggttctagttatggcggcggaggaagtaccggttgtaaaaggagccctccccttcggtgtaagcttcagacccattgtcttcatcgcgaaagtgacctccggcgccaccttgaacacctccggccaacacgagaatctcatgaccatgtataacaaagttctcagagttgagtttgagtttccaccgtggtttttgcctgagtcaaagaagctaatctccaagattgtagtggcggatcccgccaagagaaccacgatttcggccataactcgcatgccgtggttctggaagggcttttcttcattttttgctccaaacttgtgtcagttggagaaacaagaggcccttacgattacggaggaagaaaacaatttcaagatgcctaagttcttcaacgcgtttgagtttatttcgtccatgtcttctaggttcaacctctcgaggatgttcgagagcaagaggaagacaacgacgatgttcacgctgaagtgctccacggcggtgattgtggcgaagattgcggtggcgacatggtggctgaggttccgcgtggcgaaggtcaaggacttcaagatccggctgaagggtgtggcgaaggggaggaagaagaggcaagcggtcacggtagaggtattcgaggtggcgccggaggtcactttcgcgacgaagacaatggaaggggagggctcctattacaaccggtaccccaaacagatctccatcatttga

SEQ ID NO: 115174 - DNA, 664 bp, Glycine max
  Peptide Sequence Number=SeqID_231952
atggaagaagcgaaaccagcgatgggtcctcctcctcctcctgctcctcccactacgaagaagaggccactggaagactccaatgcccactccaattacttcaagattcgcgctgttattcgagaccttcgtcctcactttctcgagaatggctcttttccacttgaaatactgtttgaagtgcctgaccattgctgtttgatcttgaaggttctccgaactccagactacaaaaattgcaaggcatcccatgaaattcaagaacatggatgtgttaatgattggcatataagtagaaccttggttcctgatgatgccaccgtgtctatgatttctgagctgaagattgtggtcaagttatacgagaatatgaaagcagatgcggcttcactagcaaagtctaagaatgtgcaagatggccagatgaaggctggccagaacatggatcagaaaacactgaaagagcagcaacctcaacatggcaagcagagtcaagtagagaaatcatttgcacggccatctgaaattaagctcactccaccagctcctggcttccagaagcagctggttgaagaaactcagacacaagggacatatgtagttggaggatctgcttttggctggaatttcatcactttttcaggcaaggagcctgtgtattatg

SEQ ID NO: 115175 - DNA, 513 bp, Glycine max
  Peptide Sequence Number=SeqID_231953
atggttaaggcggctaccaatagtcggcagctacagttagagccacaactagcttatctaaataataaaaaaaacacgtggaatgttctgctacaaatagaactactaagtgcttggttcttcacattactcactgaaagagaaagtgagagagagagagagatgatggagttgaagaaggtggcattggtgaaggtagctttgttgcttttcctgttagggttcagtgcaaccactgcagatgctactcgcttcgacccacgttccttcattactcaggtgctccccaacaattactatgtaaaaatcaaatccacagccactgcatgttgtgatctttgtctttgcacaaaatcataccctccccagtgcaattgtgtagatgagagcgagacaggctgccactcatgttgcaaaaattgcatttgcaataagaaatttcctcggacgtgttattgttcagatataaccaacttctgctatgacaaatgtaactcaactgaagccaattaa

SEQ ID NO: 115176 - DNA, 231 bp, Glycine max
  Peptide Sequence Number=SeqID_231954
atggagttgagcatgaaagtgttggtgaaagttgcttcgttgcttttcctattgggattcactgcaacagttgttgatgctcgcttcgatccaagttcattcatcactcagtttctccccaatgctgaagccaacaattactatatattggagaaacatgtcacccttcatgcaaaagttgtttttgtgatattcccacgtttcctggactgtgtcaatgcattgacgtaa

SEQ ID NO: 115177 - DNA, 1236 bp, Glycine max
  Peptide Sequence Number=SeqID_231955
atggcctccatgaagtgtaagagcattggggcaaggccaactgctcaatatgatattagacagttccactcgcttgatgctttgaaccgttatacagataacgttttgggaaggagcattttgctagagagaaaggttgagatataccacacagagtttgatgacttcaagacagagttggagaggcataatcttcacaaacacctcaccaacctggctgatgggactattgatgttgctttggttaaagaattttatgctaatctctacagctctgaggatcctttaccaaagcaagccagagctagaggccacttggtggcctgcaggttacccatagaccatagagagattgaggctgctctttgcagaccatggagggggttcattttgaatgctgagggccatccggggaggattctcaggaaggatctgactaccttggcccaggtgtggagtgttctctcttactccaacctggcccctacatctcatacatcagatcttactgtggatagagccaatctaactcttgcaaacttgggttcccctactttgattaccgccttatgtcgagcccgagggattgtctctgacaacctcacatttgagcgcctgagctcggccattaacttggcctacatcaagaagaattgttggaacactaatgatccaacaattgctttccggggggctaggagggcgagggcgaggcccgctgatattccatctacttctgcagccctagcacctactccaacatctacttctgcagctccttcaattccagctcatgttgactcgcaacgctttgaagccatgcttcaaagtattcatcagggatccatcctatcagtggagcagttcttagagatggtagcctggcctggggcccaaccttctcttgatagggaaggtgaaggtcccacagcctgggtaccccaacatgtacgggatgcttcctccaagaccaccattccagagccattcactcttcatcctgaggcaggggaagaacaggtgagaccagagactgctgttactcctgagagatcccttgagggcacatcagagcctcgtactccagtggcagacctctcctcaccgcagcctatagctgacccttccactcatttacttgacataccagaggaccagaccacaccagtcctggcactgaacacctctcctccagctactccagtacttcatctaatagatgaggaggatgcttag

SEQ ID NO: 115178 - DNA, 423 bp, Glycine max
  Peptide Sequence Number=SeqID_231956
atgtttgatttgatcctcgcgcgggtgagcaattcactcactcctccacgcgtcgcgacgatgaacgcgtacgactccatcgaacgcggtgtcgtcgatgagggcgaacgacgacgaccacggacgtttactctcacgcaactgctcgtcgcatgcgtcgccgtgtcctgctgcacgctcgcggcgacgacggtcgtgaacacccaccgaggcctcgcgaacttcggtgatcctggtactgaggccataaaacagcaatatgaggatgtcatgaagaagcaggctgaggccgtgaaggcggctgcttccagatatgaggccatgatcaagcaggctgagcatatagatgccatggagacgcaggccgaggccataagggaggccaaggaggctgaggccatggagaagcagctgaggccataa

SEQ ID NO: 115179 - DNA, 1677 bp, Glycine max
  Peptide Sequence Number=SeqID_231957
atggttttgaatttgttacaaggtcggtctctcgagcaggtaaaaggcattgtcgagagaagtttcggcaactatctcggggggaaggctcgctcggttcgcgaacgcgaactccaacgcgcaaacgaccagatcaaaactctgacggctcagatcgaagaaacgaacagcaatgaagaagcaggtgaatggagacgtttcgtgaaattggatgagcgattgaaggaggaaaaaagattactcaaaattttagtgcgacaagctgccgaatcgcaagcggacgagatacgcgagacccttcgatgcgagctcgagacgagaccgggtcccgttctagttgcgatcgatatcggggataacgccgttcgacgtcgaaaagagcgtaaatcggccactatcgcgttatttgaagatgactccatgagggttgagggagaggatttcgccggcgagtggagattgcaagatatcggcaacgacgcttcggtcgattttgaccgcctcacgagcgatttcgacgatggatcctctgaagacgattttttgcagtcttttgatgagaacgttgggttacctcgaggcgtcatcgccgcggctgtcgtcgaagcggttccggcggctaaaatcgcgccaacggcaagcgcggtcggcaaaccgtatcccatgggtgaattcacggctcttgggagtgatgggtattggtaccttttttattcggatagagtcaagtacatttgcgacgatgcgttgcatttggccgactttgagctcgtcggatcgccgcccgcgtcgagcagcctgcgatggatacgagccagcggcggcggtgtgtggaaggcagacacatcgaagaagacgaagcccgtcgcggagcgcattccgactgatccgaacaactttactatgcttgatcaggcggttgaatcggcagaatttatcgatgcgcaaaagttgcagatccaacaaactcgggaggagattagtcagctttcgcatatcgctgagttgcgcaaaactgcgaaacagcaaaagaagcgtgaaaccaagctgaaaaaactcaaagagagacgagataacatagagcagaggattaaagagtattccgccgccggttgggacgagtttctgagagtggttgatattctcgtcgagtgcggggcgctcgaacgggagtccctcgatttactcgagtttggtgaagtttgcgcaaacttgagaggcgaaaacgagctttggctcggcatgacgatgtcttcagaagcccttgcggatcttgacgcgcctactttggccggcttcgcgggcgctctatgcatggataaccgtccagcgacgtgcttctacggtgcctcgcaagagctcgttcaagttcttgaggatctcgaaccaaccatgggtgacctcttgtatcttcagtcgtcttcgagaatcgatatgcccgtcagtttaagttatgagattgcggcgttggccgagtcttgggcgtctggtacgtcgtgggatcaaattcgccgagacacgactttggacgagggagacatcgcgcgcttattccgtcgcactgccgaacttctcgcacaaattccacgcattcctcaccttcccgagagcctcaaggtgaccgcgaaaaaagcgaacgatgtcgtcaacaggcctccgattagtgatttatcgtag

SEQ ID NO: 115180 - DNA, 294 bp, Glycine max
  Peptide Sequence Number=SeqID_231958
atgaagggctgtcacttcgatgagcacgatcaacaatgcttcagcgccgttggacaggaagagtgcgatcacgccgatcagcctgaggagcctgagaagcctgaggagcctgaggagcctgagcctgaggagcctgagcctgaggagcctgaggagcctgagcctgaggggcctgagcctgaggagcctgaggagcctgaggagcctgagcctgaggggcctgagcctgaggagcctgaggagcctgagcctgaggagcctgagcctgaggagcctgaggagcctgagccatga

SEQ ID NO: 115181 - DNA, 127 bp, Glycine max
  Peptide Sequence Number=SeqID_231959
atgggtgaagatatcgttaagcgcatggaaggggacggcgtcagaggcgctaaagctcttcgacctacgttcactgttccttccaacgactttagcgtcggcaacgaagagtccatcagactcacgg

SEQ ID NO: 115182 - DNA, 390 bp, Glycine max
  Peptide Sequence Number=SeqID_231960
atgccatgggagactcttaacccgacgctggcgcatcatcgcgacgtctttgaagcgcgagcgctgggaacacgtccacccgaaccgaaagagatacgactcgcgcgcactcgcggtgaaacatccgcgcgcgcgttcgccgagcgttttcagctcgacgtcgatgaggcgtctacggataggcgcgtgcgcgcgcgcttggacgcgggtgacgccggtgtcgacgagcgtgccgcgccgtcgcccgtcgcgtcaccggaagaaggcacgaacgaccgtctcgccacggttgacgtgtggcgcgacgtcaaagaagaaccaccgacggacgacgcggagaacacggcgcgttcgcccgccaacctggaactcttcgacgacatggagtag

SEQ ID NO: 115183 - DNA, 246 bp, Glycine max
  Peptide Sequence Number=SeqID_231961
atgcggccatggtggtggttgcgctgcaatcgatgtcaccgttgcgtcagggaatacacgtcgaggcctattgcgcccggctcgttgttgaaggctgcgacgtgcctatgcagaatcacagtggcggtcaacaatcgaatcgggtgctacacgaagaagacggacgatcgttcccgactcaactcacacgcgaccttgtcgagcgtcgtgaggtgccgcgggcaccgatgcttatcttgttattga

SEQ ID NO: 115184 - DNA, 207 bp, Glycine max
  Peptide Sequence Number=SeqID_231962
atgtcgctaagaagtgtgagttcggatatttcaaaatcatgtacactccccagcaggcgtaggcgcgtcgttactttataccatatcgatggcgaagagaacgaggcgggtattaccgaaacaacgcaaatacagtgcgttagtgacggaccgcgagctgcctcagctacgagcgctggtcaccacgggcttgagccactcgagtaa

SEQ ID NO: 115185 - DNA, 372 bp, Glycine max
  Peptide Sequence Number=SeqID_231963
atgttgtacggcgcgaagggtgaagagattaacgccatgttggaagagtacacgaagacgttcatcgtcgaagaggcggctcggcgcggtttgtcgacggctgatttggactgcgaggtgatcggcgaaatcgccaaacgcgtcgtcgacgagcttccggaacacgtgcacgtcttgcacgagtacacagacgcgacgctcggtttgcaggaactcatgcgagagcgtatgaagatgatgacgccgcaagagtttgagcgcgtgttacatccaatctttgaacaggacgaactcacgctcatcatctcgggagccgtgctcggcgccatcgccggttatttgcaacaaataggcacggtgaaaaagacataa

SEQ ID NO: 115186 - DNA, 531 bp, Glycine max
  Peptide Sequence Number=SeqID_231964
atgaatacagatgaacaaaaaacaatttacaatagaattatccaagctgtcaacaacaatgaaggtgggatgtttttcctatatggatttggaggcacaagaaaaacattcatatggagaacattagcaagttcattgagagcagacaatcaaattgttattatcgttgcttctagcggcatagcttctctattattaccaggaggcaaaactgcacattccagatttaaaattcctgtatcaatttttgaagactcaacatgcaatatccatcaagggacccaattagcagaattgttgaaccagacaagtctaataatttgggatgaagcaccaatggcccacaaattttgttttgaagcacttgatcaaagtttaagagacattatcacaaataaatcaaactcaaatcaaatatttggaggcaaagctatagtattcgatggagattttcgccaaatactaccagtcatcccaagaggaagccgctcagacattataaatgcaacaataaattcaacctatctatga

SEQ ID NO: 115187 - DNA, 966 bp, Glycine max
  Peptide Sequence Number=SeqID_231965
atggatgaagttgtcgccatcggctatggtaccacaaaacggaaagatctgacagggtcagttgcctccataaatgccgaacaattgaaagatctccccacggtatctgtccttcaagccatatccggtcgtttaccgggagtcaatgtcaccataacggaaggttcgcctgatgctcagataaaagtccgcgtgcgtggaggaagttccatcacccaggataattcgcccctatatatcgtggatggatttcgtgtcgccaatatcaatgatattccgatggcagatattgaaaatatagatgtactgaaggacgctgcctccactgcaatatacggctctgaaggagccaatggagttatcttgatcacaacaaagtctgggaaaggaggaagtccaaaaattacattcaactcctatctggcagcaagtaacgtgtacaaccttactgaggtgctttcaccttatgagtatgtatattggcagcgtgagctcgatccttctgtggctgcgaataacagtttcaattccatgtatggactatgggaagatgtggatatctataagtccaaggggggacttaattggcaggataaattatatggtaatacagggctgcaacaaaactatagcttgggaatgaccggaggtgataaggacggaagtctgacctataatttaaactatacacgcgatgatgaggactatattatgctaaactcggcttatcagcgggattatgtgagcgcaaagctcaataaaaagatcagtcctaagctttcctttgagtttaactcgcggatgtcaaatacaaaaatcactggccccagtatttctgatggacgcaaactacgggaagctgtaaaatatgcgcccgttcgtagtcttgcatctctgaccgaaggtgctcttggtggagcagaagatattacctcagctgaagcacttagctcactcaacgacccc

SEQ ID NO: 115188 - DNA, 654 bp, Glycine max
  Peptide Sequence Number=SeqID_231966
atgacgtcagaggcaccaaaggaaattactgagaagattgatttgttggaggagcaggcatcacaacgttcctttgtctcctatggacgtcaggatgtccttattgttgccattgggcgaccagaacaccctggtcgtgtgcgtgctgttagagccggtgtgaccatcaagcaatactttgaatcgaatccacaaacctcccacacttcttcctctatggctcctgaagaactagagcagctgactcaacaaatcagggaccagttggaggagtcgatcaaagaaaaaggacttgcactgcctctggagcctaaggttggcccctcaactgctcatgttagcataaaggagagttgtgttaatccctcagggaatgatccagacacgagtgattcagacaaatgcgggttgtacatcgaagaaaatattccccacctggttgccctaggaagagtttatgagggatccataaccattcacaacatccctttgttacatgatcaagtgaaggtcagtgttgaggaggttaaagatgcagatgctcccgttcctgtacctactgacgagggagttgtgggaccagcaaaacctatagataggctgcatcatgaggtcgatgatcccctgtatctgatgacattgatcattccatag

SEQ ID NO: 115189 - DNA, 2046 bp, Glycine max
  Peptide Sequence Number=SeqID_231967
atgacaaagagagagacttcggagaatgatgaggaggaaagtttattgaagaatgagaatagcggaacagataatgaatctaagattaactacagagggtggaaggtcatgcccttcattataggaaatgagatttttgagaagctaggagccattggcactttatccaatctcttggtctatctcactactgtattcaacttggaaaacatcacggctacaaatattatcaacatctttaatggcagcaccaactttgctacattgctaggcgcttttctctctgatgcctttttcggtcgctacaagatactggcattctgcacagtggcttcctttgtgaatcgtacgattccacaaagcctcaacgagttaaaacgggagcagaatcgaaatcggagtggactcggccgagtcagtgcagactcgggcgagttaagggttcatgcttcgtgctgcctgcagttgcttaatcgtgtttcttcctcctcgcgtcgcattcgttgtcagagtgcgacggtaaagtccgatggtgaagggatcctccgcgagaccacgacggtgaagttcgagtgccactgtgccgtctgtgcgagttcaagactagcggcaattgagaagctgcatccacctcactgtgaagagtctgccatatgccagggaccaacagaggggcagatgacatttctaaagaccggtttaggtttattgatggtaggagctgcagggatccgcccatgtaacttagcatttggtgctgatcagtttaatcctaacacagattctggaaaaaaggggatcactagcttcttcaattggtactttttcactttcactgttgctcagatgatatccttaacaattattgtctatatacagtcaaatgtaagttgggcagtgggtctgggaattccttctgctttgatgtttgtatcttctataatcttcttcatgggctccaaactgtatgtgaaagttaaaccaagtggtagccctataactagtatagtgcaagttatagtggttgcaacaaagaaaaggaggctgaagcttcctgaatatcaatatccttccctcttcaactatgtagctcccaatgttcaccagatggtttatcttaacaggttccttgacaaagcagcaatcgtgactccccaagatcaaataaatcccaatggatctgttactgatccctggaatctttgcagtatgcagcaagtggaagaggttaaatgcttgttgagagtgttacccatatgggtttcaggcattttgtactttgttgttatcgtccaacaacacaccattttagtgttccaagcccttctatctgacaggcgtattgggcaaagcgagttcttgatcccaggagcatcctactacgtctttctcatgattagtgtggcaatttggttacccatgtacgaccgaaaagtcatgcctttactccaaaggctcaccggaaaagagggtggcatcacactccttcagaggatgggtattggcatatttttctctatactcagcatgctagtctctgctaaggttgaaaaacaccgtagaactctggctctgattaatcctctaggagtggaaaccagaaaaggtgcaatctcatcaatgtcaggcctgtggctgattcctcagctgtcattagctggacttgccgaagcattcatgtctgttgcccaagttgagttttactacaaacaatttcctgagaacatgagaagcattgcaggttctctttactactgtggccatgcagggtcaagttatttgagtagtgtgcttatttcagttatccaccaaatcactgccaaatctgaaactggaaattggttaccggaggatctgaacaaggggagattggataacttctattccctcattgctgctctagaaattattaatttaggctactttgtgttatgtgcaaggtggtttaggtacaaaggcacgggcagcagttccattgaactcgaaaaagctacaaaacaatcggaaagaagtgctactaattgtgttaatgattcaaatctatag

SEQ ID NO: 115190 - DNA, 195 bp, Glycine max
  Peptide Sequence Number=SeqID_231968
atgggtcgtaagcaacgctctaacctttttgtggatgagctgagggggagattggcattgtggtcgctgggcagaatgttgctaaatagcaacgtcatccacgtaagaatggtcatgttggtgcctagatccgcacttgtctttttgcagcggcacgggggaaatcttgccccggtttgcatagtagatgcgtga

SEQ ID NO: 115191 - DNA, 630 bp, Glycine max
  Peptide Sequence Number=SeqID_231969
atgaagtgtggtaagtctgtcttcatgaagtttttacttgctaacctttttcatctccatgtgtattccatcatgctttcatcacaagatcaagacaaatgcaaactcaggaagttaaaagaagaagatttcaagtgctttggaggaaaattgatgcaaaaattggaagaaaaaaccttgaagaaaaataggaagaattggaaagcacgattagcgcgaaaaaggcccatgaagaagcccaaaggcgcacttagcgcgaaagcccgctctaagcccgaagtcaaccctaggctaaacccctattgttgggtacgtggaggccaaagcgcgtgtgacgtaatcctttgtctattatgtggaagcaatgtcttccaagattattttgatgatgccaaagaatcaagagttaagcaagttccaaagaatcaggcttcaagaatcaagtctcaaagaatcaagattcaagaacaattaagtttcacgattcaagattcaagaacaatcaagatcaagattcaagactcaagattcaagattcaagagaagttgatttcaagattcaagagaagaaatcgagaagcaacagtcaagacttcacaagggaagtatttttcaaaaatccaaacatag

SEQ ID NO: 115192 - DNA, 546 bp, Glycine max
  Peptide Sequence Number=SeqID_231970
atgggggacaagtcccaagttttggaggctgttttgaaggaaactgttgatttggagaacatacccattgaggaggttcttgagaatctgagatgtggcagagaagggctcagcagtgaagctgctgaggagaggctcaccatttttggtcacaacaagctagaagagaagaaagagagcaaatttttgaagttcttgggatttatgtggaatcctctgtcatgggttatggaggctgctgctataatggctattgctcttgcaaatggaggggggaaggctcctgattggcaagactttgtgggtatcattaccttgcttctcatcaattcaactatcagtttcattgaggagaacaatgctggtaatgctgcagcagctctcatggctcggctcgctccgaaagcaaaggttcttcgagatggtaggtggaatgagcaagatgctgcggtcctggttcccggtgacataatcagcatcaaacttggagatattattcctgcagatgcccggcttcttgaaggggatcctttgaaaattgatcaa

SEQ ID NO: 115193 - DNA, 158 bp, Glycine max
  Peptide Sequence Number=SeqID_231971
tgaccttgttggatatccctggtgggagaaatatagtggttaaagagtatctctggaagggggatgacttagaatctttaattatccacggtcagtgcattgatggtgcccatgtttcatacgttgtgtgttgtgtacgtacatgggcggtgcagtga

SEQ ID NO: 115194 - DNA, 240 bp, Glycine max
  Peptide Sequence Number=SeqID_231972
atgtcgggctatggagatgcaaacttcgaatgtaatcaaagatatttagaagctaaatggaagattggcaacattaacatggttcatgggaatcttgttagagtccctgtcgtaacctacccttcggcaggagggcgacgtgaggctcatgggtgcatcttccaaggaaggaaaacatgcagagtcaccaccaatgtttatttgaggaaaacattagaaaaaccaaatgcgggtctatga

SEQ ID NO: 115195 - DNA, 441 bp, Glycine max
  Peptide Sequence Number=SeqID_231973
atgccaacgacgtcttccagcgaatccaaagaccggaacgccgatccgtcccggtcaccgctcatttcggcggcagagaagcccaccggagagtcgtcgaagtcggagaagctatgcatcgatgagatgctgcagaggtactgcggcgaattcgggcgctggcagctgaagcacttcatcttaacgagcctggcgtgggcgctggaggcgttccacacgatggtgatcatattcgcggaccgcgagccggagtggcggtgcctcgacggcccggccgggttacggtgcgacccggccgcgaagagcgtgtgccggctcgaaccgggctcttggaagtgggtcggggactccacggtggcggagtgggacttgttttgcggtgacaagtttaaggttgggctggttcaggccgtcttcttcggcggctgcatgatcggttag

SEQ ID NO: 115196 - DNA, 387 bp, Glycine max
  Peptide Sequence Number=SeqID_231974
atgttccatttggctatgaaattcctcagtgacgagatacaggtcataacttcgaaaggagatcataaaaaggcttgtaggtgttataaggaatctctgaagcaaaataatttagacaaatcgaacaaaatggactatgagccgaggactaaaacacagtctgaggtgatgcttatagagttagattgtagagaagatattaaaaaaggggtgtgggaacctagactggagcttgaagctagttgccaagatctccatatagagagtatgaaagagcaagtgacatctattggagccgacctaggtgaaggaaccagagaaatcttatcttccttcatggaagccaacaaacatgctcgatatagtcccaaactttttctgtcataa

SEQ ID NO: 115197 - DNA, 275 bp, Glycine max
  Peptide Sequence Number=SeqID_231975
ataaaggggaggacgaagacgaggaagaggagggaggggatggaggaggcaatgtagagattgccccatgcggggaagatgtaggcaaggacggagaggagggcgatgccggaggagaagaagtagaaggtggacatgccaactgcaccccgcattttggggcccaccggctcggtggcgaggacgaaggcgcagaggccgacgccaccggtgctgcagccggtgaggaggcggaagaggacgtagaaggagtagttgggggagaaggctgttaa

SEQ ID NO: 115198 - DNA, 354 bp, Glycine max
  Peptide Sequence Number=SeqID_231976
atggctaagtacgatcccgagatagtcatggagttctatgccaacgcctggcccacggaggagggtgtcagagacaagcgctcctgggcaagcgctgagagtttaactagagtaggagtcaagcctcgggctatgatgaggaggccatcagctagttgctatgcgttccggggcaggatttcgcccggagcatggcggggagacggacctccccctaccgaagtgtcagctggtctacaccatcctgactcatggatcacacctcctagacacccagtggacctggagaagtccaacagggcactgggatttcctgctttgatcacgggcctgtgccaattctatggagtgacg

SEQ ID NO: 115199 - DNA, 135 bp, Glycine max
  Peptide Sequence Number=SeqID_231977
atggctctaaagaagcttttggccaagagttccaagaaagatgccgctagagagggttctagagtcaggaacaccagcgacgatttaaggccattaaaggttggtcgttcctcatggagaggtgagtctagttga

SEQ ID NO: 115200 - DNA, 414 bp, Glycine max
  Peptide Sequence Number=SeqID_231978
atgtctgctaattcaagcacaagggggaatgccacgtcaaaccgtctttgctattgtcgtagaagagctaccattcaaacagcaaggacggcaagaaataaagggagactgttttatgcttgtccattaccacaacaagatacagatcgatgtaatttctttttgtgggttgatgaagacattgatgttggtgctactgaaataggtagaatagaatcaataccagactttggtctaaggttgagaccggagattctgcaaagagaagttaggtctccaattgcactattgtcatcaccagcccactcaggtctccaattgttactcaatttttttccctatctaatctggattgctgcatcgggcacaatggtccacttcttacagctaacttcaatttatggtcactcatag

SEQ ID NO: 115201 - DNA, 207 bp, Glycine max
  Peptide Sequence Number=SeqID_231979
atggctcacaaattttgttttgaagcacttgatcaaagtttgagagatattattaaaggcaaatccagttccaataaaatctttggaggtaaagtcatggtgttcggtggagatttccgacaaatcctaccagtcattcccagaggcaatcgttcagacattgtaaatgcaacaataaattcctcttatctatgggattattgtcag

SEQ ID NO: 115202 - DNA, 399 bp, Glycine max
  Peptide Sequence Number=SeqID_231980
atgtatttctttcaaaggctgaggcaaagagcctttcagaaattaacaacatttcggaggtatagacttgaggtgatggtcaaccacaaggacaaaagcacaaaatttctactttgggaccatgaatgtactgagttgattgggcaatcaactgatgaagttaataggctaaaaatagcacaatccctatctgtaacagtagatcatgatccacttctcggactctgtcgcaatgtgcccttttgcgggcgagcgaaggcgaggctcacgggtgcgctttccaaaggaggaaagatgcgcggagtcgccaccaacgtttatttgtggaaaatgtcggaaaaaccgaaggaaaccggtcaaaatgaaaattctaagttcgggagttgtatttacgcttga

SEQ ID NO: 115203 - DNA, 171 bp, Glycine max
  Peptide Sequence Number=SeqID_231981
atggtgcatttggtaatccatttggcatatgaggcaaaagtgactggtccaattcattacagacgaatgtatcccattgaaagattgcatgcatacaataacaagatagtgctaaagttgcagatgataaagtggctagcacgtggtctactagaaactgtgagaagatag

SEQ ID NO: 115204 - DNA, 315 bp, Glycine max
  Peptide Sequence Number=SeqID_231982
atgggctcagaaatctaccctgaggttcatgagaaccttggggccttctttagcagctctagtccaatcctcttggagtcttctatccaatacccttggggggttggacttgttggtgggactatgccatcgtttgctgccattcctcttactggagaaaggggtcaacctgctattcaagttggccccattattgttgtagctgaggtctccctcgatgtttgttcctctcttttggctaataggaagcgagataatggcattggggtgttaggccgcaagaagtccagtgcccctttagcctttgtgcattga

SEQ ID NO: 115205 - DNA, 450 bp, Glycine max
  Peptide Sequence Number=SeqID_231983
atgttttccttcatttctgactctgccataggcatgggtggtaatgactccaggggtttgattcagcaacccctggtggaccaagaggtcatctccatcagcgattactccttggaggagactcaccatgcaacttcaaatcttcttccttggaaaggtcgagggaaacctattcccgtcacgataattctccccccttctatttctgggggagccagaagaagtggtggtggggacgttagggcatcccctcgtgtgaggggtgatgttttgaagtatcggtcctccattacgtctgcagtgagtgtcgctgctctaccacgccaagtgaaattggtgagtcttgatgacttcccttttctgagggcagtgttgggcaatctgcccttcttttcgtgtataggtgctcttcgagatcttgcgtctagttctccccttgactatatttga

SEQ ID NO: 115206 - DNA, 720 bp, Glycine max
  Peptide Sequence Number=SeqID_231984
atggtagcgttattccacaacatgatgcacaaagagattgagttctacgtggatgacatgatcgctaagtcaaaaactgaagaggaacaccttgtcaatttacgaaagttgttcaagaggctgcgtaaataccgattaaggttgaatcccgcaaagtgcactttcgaggtcaaatatggaaagttgctcagttttatcatgagccagaaaaggatagaggtacacccagacaaagtgaaggccatcctcgaaatgcccgagccacacactaagaagcaggttcgaggtttcctaggacgtttgaactacataacgaggttcatatcacagctgactgccacttggaagaagaagacaaacacacaagagttttatactggttcggcaataacccatgcctacatccagtccccaagcgacctgcggtccttgagatttcttttcaaccttgtaaattcctttacaagcaaagatccacaagggatgtaccctcccttgttctctttgaacaacctagtggatgtaccctccactagaactgattcacaagaaatgtaccctctcttgttctcagtcacaacaacccaagtagatgtaccctctacttgtaccacaaaggatataccctccaatgtgttaagacaaagttctcaggcagttagtccttcgaaactttgtgaagggggaaacaaaagaattctcaggcggttagtcttttga

SEQ ID NO: 115207 - DNA, 2505 bp, Glycine max
  Peptide Sequence Number=SeqID_231985
atgtctcagggagatgcttacaagcgcaagatgcagaattcagtatatagtttcagagagcaaggcactgttgggaataaaaaggtgaaacttgatgacattgatgcttcttatgttcatgaaaagaaattgggtttaaagacactatcagaagaaaataaggaagaagtgaaaaactgggactcagttggaaagcaacaaaaggcagcgtctcccattcgcggcattcttaagaatcacaaacacatttctgaaagtacttcaagtggtagtaatattcaagatggtaacgaggaaagccattgtgatgttcaagtgttattatcagacaatcatgtgagattttctgctgaggattccgtacttggtccagaaaagagaaactcatttgatgaaactgggttcagtttgtcttcagattcgctggcttcttcatttggagagaagcagttcactggaaatgaggaaggaactgtgaatttggaggaaaacagaaatgacaacactgccattaacacagataagacaaaggaggtttgtcctatggttgaaaataaacagttttctaatactctaggacatgttgcggtacaaaaattgttaaagccatgttccagtgaagagaaatcaaagcacttagaagagaagtctgaatcattatccaatgtgacgatttgtgataataatttagaccggttcgatagaggcaacacaactacagtgcttgtttctccatatggtgacttttctagatctctttcagaatttcaaggggggcagacttctggtataaatacacaagcgtgtgaatctgaagcttttagttgcactggaaagttcattgatcatttgggaggtccaacttttcagtctacaaatgcaaacacaaggacatatttggagccttcgccctcttattctgcttcgtgtaacgaagtaaatgagagacctgaatttccattgcacacgtataaaaacaatgataacaatggccaagctttgggtggcagatcattgtcaggcacgttttctgcagataggattggtaattcgtttctcttgcctggctgggggaaaggaagtataaggaataactgcatggggctgaacttttatggtttgccactcaattctcatggtgagctaatcaacttcagttcaagtggaaaagttgagatgaacaagattgagacatcatgtacattaagaggttctttaaccgacttagctgtgaataatgttttccatcaaaatagccaggaatatttaagcatcggtaagaggcatgttgttcagaagacatttcaagatcgggtaaatctatttcctcactattcaggcagtttaggtgttagagagttacatggaagggagagagcagatatctatcagcataattctggttggtgttccaatcaccatgtcgagccatttgattcagagttgaacctcatgagaaaccctttcattgaacagaatcagcttgaaaagatgccaaatcacaaggaatatggaatggtttcaccaagaggaagctcgggtcttctttcaccaagttccagccaaccaacaatgaggttgatgggtaaagatgttccgattggtagaagcagcaaagaaaagcaaaaaattgttggaggagttccttgggctgaagagaaatccagaaggcattattctgtagattctgctcgggacaattctttgttaggaagatgctacatgccagattcagcatctggttcgcaatcacagagacaaactgagaatgtgtttcaatcagtgaaaattcaaagcaatcaggcattacaaagtaccttgttgatgaaaggtccaaactctgaatttcttaatctgcgaagtaatcatcatatatctcaaaatggaagccttggattcagcagaaatgctagtactaatttgcatactatttcccaagcacctacttcctgtgcaatatataataggccacatgaagacttgcctgagcagtttatatctggagcgaaacctcaaggattctgctttcattctcaggtaccatctagtccttgcaatttcaatctgtctactttaagcagtggtgagctgaatgaccggaagaggcaccattgtgtcacgaattcgtcctttggattccccttcttgcacccgattgttgaagaacaggccaaatcatcctggagcaagagttcctatagaagtttgccaccatggtccttaggctcaacacatgaaaggccacttggaagctcttcaagtacaagttttcctcataatacatggagaaatgattctactatcccatttgtgaatcattcggcagatgttttgtatcctcctaattctgtgacttctcactttcccaggaagaccattctttgcccaacatcaattgctcgtcctcattctccacatgcttctgttccccccattatagaaccaccctctgccatagatagtggttgtagaaacatatttaaggtcacggacagtgaaatttga

SEQ ID NO: 115208 - DNA, 348 bp, Glycine max
  Peptide Sequence Number=SeqID_231986
atggaagggtgtcatcctgttgatactcctcttgacaaagggagttatcaaaggctcgtagggagactgatgtacttgaatcacaccagaccagatctgactaatgcattaagtgctgttagctacaataaacctgaggacccaaaaattaggctttattgtgacaataaagctgcctgtgatattgcctataattcaatacaacatgatcacacaaagcatattgaagaggacagatttttcattaaggagaagttagacagaaagattgtagagttgcctaagattagaccagaagaccagcaggctgatattctcaccaaagcagtctcaaaagcagtgttttaa

SEQ ID NO: 115209 - DNA, 1443 bp, Glycine max
  Peptide Sequence Number=SeqID_231987
atgaatttaattggggactatacttccaagatgaggtccgtggatgttttcaaatgctggccattcgccgcctccggactcagccgcgacgaggctgagtcctggcttcctccaatgagtattccagagtcacggcagtggtccgataaccttgccggacagagatccaacctcgcctgtgccggcagagggggagaaaggttgaatcaaccgaatgggatgatttcgtacgagagtgaatcggagaaagaggataagttagttagcggtggatgtgccaaggataagttagttacgggtggatgtgccaaggatttggtgttggaggaagaggagaaggtggagctggtttgtcccgtgtgccgagatttcaaggctgcaacactgacgacggtgaatgcgcacattgatgattgcctctcgcggacggtgagggaggagcggcggtggatgcggcagtcgaaaccgaaggcgcccaaaaggcgctccatctcagagattttcgagatgaaagaggatgttgaaaaggagaagccaccagagattgagtcagtgttgaaacgttttgtagccgatgaggtttcgattacagtcacgaagtttcggtggctctcggagcggctcgcggccttgagatccaacggaatttccttcgatttcgtgggaggaaactcgaattccactgatgaggagaaggaatcggagatgctttgtcctgtttgtagggttttcaacactgcaacggtgaccacggcgaacgcgcacatcgacgattgtctgtcaatggcgatgaagaagaatgagttgtggctggaaccaagtttgaataatccgaagctgaaagtatcaaagaagcgctctctcgccgaaattctcaccgtcacgcctcaaatcaacgccgttggagaccgcaaactcactgcggaggctgggaaagaagatgaaaacgaagagaatggagaagagtttgcgaatttcaaaaggagtacgaacaacaacgtgacgaagaagaaaaagttgaagaaggttatcacgaggaagaaaaacaaggtggaaaggcgtggctttgtgattctaaacgatgaaagtaagaagataaacaaaaggagaaagaagctaaacaaggagttcactgcgaagaagagggtgccatgcgataataggtttgcgactctacgcgtggcttttactgcatataaaattgatgctgaaaaaaggggtgggttgagagatagcgtcacgtttgtgattagaggaacggagttggatacacagcttacagctggatatatgatgaagtttcggtttgtgcatgggatctgtgtgaggcaattaggttcagaatttgaaggatcgttgattattgggtctataatctatagggatgttttgttaagccataaaatttatactggtttggttatagccatgactcgtgagtaa

SEQ ID NO: 115210 - DNA, 255 bp, Glycine max
  Peptide Sequence Number=SeqID_231988
atggcttcaatcaagatagcttttgcagtggtctttcttgctttaatagcatgcaatgggcatggtttcaagaacatacgaagaatgaaagctcttggtgaaaatcatgaaactgatgaatgctggaagactggttgttatcataaaggaaagccacaatgtaatgtaaatcgtgattgctggtttgcttgtactgattattttgatatcgcgtactgtgatatgagtactcgcaaatgtgtgtgcccttgttag

SEQ ID NO: 115211 - DNA, 282 bp, Glycine max
  Peptide Sequence Number=SeqID_231989
atggcggtgcttgcgttcagcaatgccaatgcgttcaggagtgtatggtggactgacatagtgagatatgccattagagttgaatgcgagagaggccacaattggccaacatttgagcaagaactcttgatgaaggatgaccaaagcgagaatgccaaagagaggaggaagtgcatgtggttgacaaggcagtgggagatggtggggaggctagacgataagtgtagagatcaccactacttggactgcgcatcaatgtcacccccgttgcttggtccttga

SEQ ID NO: 115212 - DNA, 312 bp, Glycine max
  Peptide Sequence Number=SeqID_231990
atggccaccactaaccctacctcttccaaatcatccctcctccttaatgtttccatcactttcaaattgtctcgtgctaattaccgggcttggaaacgtcaagtcaccgccctcctctctggtatccaagtcatgggccacattgatggaactatatcgtctcaatcacccactattgtccaagatggatcttctactcccaatcctcaatacaccaattggttcactattgatcaattgatcattaatctccttctctcagccatgacagaggcaaacagtctctcttttgcctcgtatgatacggcttga

SEQ ID NO: 115213 - DNA, 360 bp, Glycine max
  Peptide Sequence Number=SeqID_231991
atggcagctaaatttggttgttatgtacatattgatgaggtctttcaacagacctataccagaaaggatattggtgaatttgtcaatgaaagaactaaaagaacagaatttcaaagaatatattctcaagctaggtttgaggctacatcatttgttagtgaattagagactagccctcttgaaccctctttggagaagagtattaggcctaggtgttgggccgaagttgttggtggaaaaaccaagggacgactctacggggttggagaccttactcatgattatgaaggtggagattgtagtctcacgcaaaaaaggaaagcaccaaatatttcatctaattcagaagagattatctag

SEQ ID NO: 115214 - DNA, 2748 bp, Glycine max
  Peptide Sequence Number=SeqID_231992
atggcggaaatggcagtgtccttcgcacgagacaaattgctttcactgctaagcaatgaagcaaacctgctttccggcatccccaaagaatttgcagacataagaaaagatgcagatagcagggctgcaaatgaaggagacaacacaaatgaggggatcagaacattggtgaaagagttgagggaagcatcttttcgcatagaagatgtcattgatgaatacttgatctatgtggaacaacagcctgatgctcttggatgtgcagctttgctctgtcagattattcacttcattgaaactttgatgcctcgtcaccgaattgcatcagagattcagcagattaagacagttgttgatggaatcatgcaaagagttcaaaattataactccctaaatcaacttttttctaaacaaggacaaagcagtcatggaggtgtccaacgtcatcagcctcgatcaaatccacgtttccttgaagatgctgaagttgttggctttgaagacaccaaagatgaattgattgggtggttagtagagggaccagcagagcgcattgtcatctctgtggtcggaatgggagggttaggaaaaacaactcttgttggcagagttttcaacaaccagaaggtgactgcacactttgattctcatgcatggatcactgtgtctcaatcctacaccttggaaaagttgatgagagacttgttgaagaatttatgcaaagaagaaaagaaggagcctcctcgagatgtttctgaaatggatcaagattcattcattgatgaagtgagaaaccatttgcagcaaaagaggtacattgttatttttgatgatgtgtggagtgtagaactttggggtcagattaaaaatgccatgcttgataataacaatggaagtagaatagtgataacaacaaggagcatggatgttgtaaactcttgtatgaattctccttcagataaggtgcatgagctgaaacctttaacttttgaaaaatctatggacctgttttgcaagaaggcattccaacgtcacaacaatggaggttgtccagaagatctagaggatatatcttctgactttgttgaaaaatgtaagggtttgccattagcaattgtagctattggtagtcttttaaaagacaaagaaaagactccatttgaatgggaaaaagttaggctaagtctgagttcagagatgaagaaaaatccccatttaattggtatacaaaagattttaggtttcagttatgatgatttgccatactatcttaaatcatgcttgttgtattttggaatatatcctgaagactatagagttaaatcgaaaagactaactcgccagtggattgctgaaggatttgtaaaagtggaagaaggaaaaactgtggaagacgttgcacaacaatatctaacagagttgattggcagaagtttagtgcaagtatcttcatttaccatagatggcaaagctaagagttgtcatgttcatgatctattacgggatatgatccttagaaaatgcaaggatttaagcttctgccagcatattagtaaagaagatgagtccatgtcaaatgggatgattcgacgcttatcagtagcaacctattccaaagatttaaggaggactactgaaagctcacacatccggtcactacttgttttcacaggtaaagttacctacaaatatgtggaaagaatccctataaaatacaggctattgaagatacttgattttgaagattgtccaatggattttgttcctaaaacatggggaaatctagcacacttgaagtacttaagcttaaggcgttgcattggagctgaagttcttgtgaaattcattagtaagttgcagaacctcgagaccttggacataaggaacgcaaagcttggggaaatgtcaaaggagatttgcaagctcacaaagctacgacatcttttggttaagaatgtgaagttgtttgaattgaagaatggtcttggaggcatgacatccctacaaacattgtgtcaattaagtgtaggttataatgaagatgatgatgtagtagagttgttgaaagaactaggaaagttgaagcagttaaggagcttaggcttaattgaccttaaggaaggattaggaactgctctatgttcaacaataaatgagttgccaaacttggagaaactacatattcagtcagattgggattttgatttcaatgttattgatttgcctcttatttcatctcttgctatgttgaggaagcttaaactaagtgggaggttaaataagtttccagagtgggtcccacaactccaaaatcttgtaaaattgtctttgttacgctcccggttaactgatgatccattgaaatcactacaaaatatgcctcatttgttgtttctatactttggctactgtgcttatgaaggtggaagtttgtattttcaaaatggagggtttcaacaactaaaggaactatatctctatgaattacggtacttgggttccatcattatcgataaaggagcactatgttctctagaaacactcgaattgtatagaatacacctcgagacagtacctcatggtatccaacacttggaaaaacttcaagttctcaacgcttatgttttgccagataaattcatggaatgcgttgctcccgatggaggaccagagcacccaagcatccaacatgtgccccttgttagaattacttcctatggaaaaacaacacgcattattcatcactga

SEQ ID NO: 115215 - DNA, 189 bp, Glycine max
  Peptide Sequence Number=SeqID_231993
atgatcgattataaggaccaaagagtcaattccaaaaaaagatacaataccattgttgaagcccaacacggagaatctaattttgaaagcactggaagaagcccaattcctatgccaattcaaggagcaatgttagtagagaacattacattggctagacttttgatagtgcaaaatatttgctactaa

SEQ ID NO: 115216 - DNA, 1053 bp, Glycine max
  Peptide Sequence Number=SeqID_231994
atgtgggtgtccttggctcgagacaaattgctttcattgttaagcaataaagcaaaactcctttggaacatcccaaaaaaatttgtagacataaaaactgaattagatttcattcaagccttcctcaaggatgcagatagtagggttgtagatgaaggagacaacaccaatgaggggatcagaatattggtgaaagagtttagggaagcatcttttcgcatagaagatgtcattgatgaatacttgatctatgtggaacaacaacctgatgctcttggatgtgcaactttgttctttgagtatgatattgcacacttcaatgaatatttgaagcatcgtcaccaaatagcatcagagattcagcagattaaggaccagcagggcgcattgtcatttgtggtcggaataggagggttaggaaaaactactcttgtcggcagagtttttaacaatgagatggtgatggcacactttgattctcatgcatggatcactgtgtctcaatcctacaccgtgggaaagttgatgagagacttgttgaagaagttatgcaaagaagaaaagaaagaacctcctcgagatgtttttgaaatggatcaagattcattgattgaagaaatgagaaactatttgcaacaaaagaggtacattattgtttttgatgatgtgtggagtatagaactttggggtcaaattgaaatttccatgcttgaaaataacaatggatgtagaatactaatcacaacgaggagcatggatgttgtaaaatcttgtaagaactcttcttttaacaagatgcatgagctgaaacctttaacttttgaaaaatctatggaacttttcaacagaaaggccactccgatgtcacaaattaatgaacgttgtccagaagacctcgtgaatacatcttctggctttgttaaaaaatgtaagggtttgcctctagcaattgtggctattggtagtcttttagatgacaaagaaaagacgccatttgaatggaaaaaaataagccaaagtctaagttcaaagatggagaaaattcccatttaa

SEQ ID NO: 115217 - DNA, 294 bp, Glycine max
  Peptide Sequence Number=SeqID_231995
atggataattacttgaaaaattggagttgggtatgggatgaggatatactcacaactttacgtgatataggtgcaggttggatcatctatctctgcggctccttcatcacccagagttcagacaaaattctcatatcaaaagagtactttttcacctcgagagtaaaaatcaagcgaaagacgtggtttcaaattggggaaaaggaagaaagggcaagagagtcgagaaacggcgcactccgtctgttcctcaccgtcaccggcgcgcgcaccctctgttccagcgactcctaa

SEQ ID NO: 115218 - DNA, 1335 bp, Glycine max
  Peptide Sequence Number=SeqID_231996
atggaagagtttcatgccactccccaaggaggacactccgggttttaccgtacttataggcgtcttgcttcgaatctgttttggaaaggaatgaagggagacattatgaggtttgtgcaggactgtgatgtttgtcaacgccagaaatacctaacaacagcccctggaggtttattgcaacctttaccaataccggatcaagtatgggaagatatatctttagattttatcacggggctcccgagatccaaagggtttgaggccattctagtcgtggtagacaggctgtctaaatatagtcatttcattccattaagacacccttacacagcacgagccatagctgaaatatttgtgaaagaggtgattaggcttcatggggtacccaattctgttgtgagtgatcgtgatccattgtttatgagtctgttctggaaagaattcttcaaactacaagtcactaatcgatgcttggaaacatacttgaggtgctttatcacggatcagccaaagggatgggtcatttggcttccgtgggctgaatattggttcaataccacctatcaagattcaataggcactacgccatttgaggtagtttatggaagaaagcctccaatgatagtaaagagtatacaaggagaagtgaaggtggaagtagttcaaagggaattgcaagatagggatgaagctttgagacaattgaagaatcacttggcaagagcacaagagaggatgaagaaacaggcggataagcatagaaaggagaggaattttgagataggtgacttggtgttcctcaaattgaagcaacataggcagcattctgtggctgcaagaatcagtccgaaattaagcgctagatactatgggcctttcgaggtgattgagaggattggggaagtagcttataggttgaaattgcctataagttccaagatacacctggttttccatgtgtcctcgctcaaaaaagcacatggagattacaaagttgaaagcacactacctagtggattggaggatgaccgtgaaggagaaattgaactagaactggtgttggcaactcgtagtataatgaagagaggcgaaagagtcaaccagtggctagtccaatggaaggggaaaagcgtagatgaagcaacttgggaagacaaattgacattgaagagccagtttccagaattgagtcttgaggacaagactttacttcaaggagagggtgttgataggaaccaaatttgcaatgggcctttagttcatgagatgcagaaaggccaaagggaatggttagtgtattcccgtagaaagaaaagaggggtagaagaggaataa

SEQ ID NO: 115219 - DNA, 456 bp, Glycine max
  Peptide Sequence Number=SeqID_231997
atgccgcgaccaccatccaaccctgcaccaccaccgccatccaaccctcacgccaagtggatgtgcatgtcgacccaacccaaccacaataggttcgggttcatgcacttcttgttgttcatcgtgaacaccatcaccttctcctcactgcaacacacgctaaagatcctgtccatgaagctctggattctcgatgtagtaatcaccttcgctatccccaattccagttccacaaaccagtcgagatcctccactaggattactgacgtcgttgttttcgtcaacaaaaacttcaaatccaaaggggaagaaggagaaggggaggcaaaggtcgaggtcagcatcgagggcagagtcaacgacacagtgggcagtggtgacactgggttggatgaagatggtggcgtgaggttgtgttctgttggagaaggggaagaagaaggattgaatttttaa

SEQ ID NO: 115220 - DNA, 264 bp, Glycine max
  Peptide Sequence Number=SeqID_231998
atgactctcgagaggcaaacgacacatctgatcaaaaatggtcccaatcaaatggttcatagaaacatcaatgagcctaagcgaagtaaggttagacattcccttagaaacaacacaaatagagatgcaactcattttgggcagagggcaccaaaaaggaacgtttccaaacatgttcaaaaaccaaatggatcaacaaaaaagcaacggagaccaatccaaaaacaaattgtcacaagttcgcaggaggaatggaagggttga

SEQ ID NO: 115221 - DNA, 1045 bp, Glycine max
  Peptide Sequence Number=SeqID_231999
atgaaggtttttgaaaatcattgctgctataaaggagatagaattagcgatgaggaagatgcttgcagtcaagatagtgaaatgggtatgcgtttgggatcttcaggctcagagttctcttttgacacctggcatgcgacggagcatgatgtcgttcagagacaggattccacagaggacaatttggagacaaacaaaagcgttgacctagatcagggtaaaggggtcattgggcctctggcccattgtgctgcttctattagccaacccctaggctttgaattaaaaaagattactattggcccttctgattccaaaccaacaaaggcacttctcacttcaaacaaattttttgatcctcctaagtcacatgcaagcagcaactacaaaggtgaggcagagaacatgctggaccaaggtgtaaacattggtttcttagactatggcagccaaaaggtatttattgacaacctcactctcttagtggaaagagatgaaagcaaggtcaagactgctagaggactcataagaaaatatgatacccaatttgtcacactacaagagacaaaaaaggacttcatagacttagagttctataagcgattatggggtgactatgttgtgtcttgggaagctatatttgaaaataatacatctggaggaaattggagggacaacaatgaggtgatcacattggtaaacgtctactcaccttgggacttggaagccttagatgttcctatgatcgactgcaaattcacttggtaccaaataagggaactaaaagccaaattgatagattcatttgcactagggggtggtcaaagagatatgccaaaactttcaagtggagggacaaagtgcatatgtcttgaaggaaatcttaaaatcactaaacaagctttgaagagatggaatttagaggagtttggaaatttaaagaagaaaaaaaaggatgctcaattggagatgaatagtcttgatttgtcagaggaagagagaagtttgggtgaggaagaaaagacaagaaaaatacatattcaag

SEQ ID NO: 115222 - DNA, 513 bp, Glycine max
  Peptide Sequence Number=SeqID_232000
atgtacattgctgatgatgtgaatagggtcaagattgaagatggtgatgtttatttgaatgcttcccctcaagcacttgacagactgttgggtcatgtgcttgcttttaaggtcaggattcaatcaaaattcaagaatgccgttgttgttagatactcaaatgaactagatttgatcaatgctgctctcgagatgctggctgatagtgaggcatgttctaaaatagatccttcgaacgttgactgcaataatgctacccatgctgaatgtcaatctctgtctgtgacaaccgaccatgatccagttgcaggattccctttaacccccaaaaagcggatgccatctgatgaacttgatgatgagttaggaagctcgcaaatttccccagcccaactatcatctaacaaattaacaagacattctgataaaaacaattatgtagttttcgttattggtacatctgacaattcccctggtgtttctttctaccatgctgatgctttggccatttga

SEQ ID NO: 115223 - DNA, 363 bp, Glycine max
  Peptide Sequence Number=SeqID_232001
atgcgccgttcactccatggtgacctccgaagtctgccgcaagctccgtcgtgcctttactctcgtcccaccatgatagctagcgcattccatctattgcttccagctgcctctgtcgtgcaaaatccctttttcaaatatattcttggctgcttgaatggccccgaaggtctattacatttttatattaaggaattgaaatcgagcaaaccaatttgtgatactatttggtcacaacaaatgcataccacacgacaacctgtttggtcaccacctgcaggcagagcaagcgtggccgaactggccacaccagcaccagccaccaacttgggttgtgcatttgttgcctcctgctatagctga

SEQ ID NO: 115224 - DNA, 1220 bp, Glycine max
  Peptide Sequence Number=SeqID_232002
atgaaaaccattgtggcttcttacaacatcactccaaatcaaccaactccaaaggaccctttatggctatccgatagtgaccaaatcggggtcctaggtcatgtatccattctctacatttacagatcagcaaaagaacacaacaacaacaccgttgagaggatgaagaactctcttagcaagcttctatcgtactactatccagtagctggcaggttaaggttgtcaaaaagtggtcgaatggaattggattgcaacgcaaagggagtgacattgcttgaagccgaaaccacaaacacatttgttgattatggagacgacttttcaccgtccgagttcaccgatgaactcattccaaaacttgatgatactcaacaacctatagaggagattcccctactgctggtgcaattaacaaggttccatagtggtggtgattgtgaaggccttgccattggagttcttctatctcatcctttgaccgatgccaccggcatcattgacttcatgaacagatgggcaaagctgtctcggggagaagaactagaccctaatgaaatcccgtttcttgatcgaacactactcaaattcccagacattttgttggagaaaccgagggaagtaaatactagagagattagtaaacttgacaccagtacacttcaacatattccaacatcaaaactgttagatcagtggaagaagcctgtggtgccacaaacaccagaagatgatgggatagataagccaaagaagagaagtggtgcaatgctaaaactcacatcaagccaggtggagaggctaaagaataaggctatggctaataaccatcaatcttcaaaacaagggtcaagacctaattatagcagatttgaagttgttgctgctcatatatggaggtgtgcatctaaggctcttggtgatgacctaactcaagttcggttcagtgttaattttcgcaatagaatgaacccacctctccctcataactattttggcaatgctgtggcaaacgtagccacacctgagggagatatcatatcaaacccattaggttttgctgctcataagataagggaagcatctcatgcagtcacggacgagtttgtaaagtcacaattaaacgttagtcgtttaggccaagtgcaattggataacataagggctttcttcatgcgacaaggacaccgtgtgaatatcccttatgctttgatcataat

SEQ ID NO: 115225 - DNA, 282 bp, Glycine max
  Peptide Sequence Number=SeqID_232003
atgtatcaaaaagcatttgacaggcttgaaatggaagacaaaaagaagtatttgcaattataccaaggtgttgaggagggctctcaaatcaaccaaaaagtagtaaagttggatgaagaagatgatgatgatatccatgattgtgagcctttcattaagtcaattaattttgatattttgaactggtggaaggactttaaagagcttgagaaattcgagcaagatatggtgtctccacatgaaggggcttcatcgaccgtcgttattaatcttgatgattga

SEQ ID NO: 115226 - DNA, 357 bp, Glycine max
  Peptide Sequence Number=SeqID_232004
atggatgaggaatacaatgctaatggaatggaaatgattagggtagaggcagaaatgcacaattatagtgatgaaacaaaacgcgtagttgtgcgcttaacgagtcttgcagctttgattggtctacaacttctgctaagcgggatatgccgcgcttggcagattaagcttagcgagagtgtctcgcttagcctaattgacattaaagctcacatagagaaggttggcgcgattagtgagagtgtctcgcttagcccaatttcattaaatgcacaacccgagaaggttttgggcttagaagatgggcttactcagcgaggaaccctctgccactggatgagggattggtgcgcttag

SEQ ID NO: 115227 - DNA, 1284 bp, Glycine max
  Peptide Sequence Number=SeqID_232005
atgccaaaaggtcgcgactctagaaactcaacccccgtccccttcatcttcatcgctaatccttctactatcccttcatcggtcacttcccatcgcttgaagctcgagataacccaatttttcgagtatcatgagacgccagagccagatcgcctcaccattgcttcgttttacatggaagggctgacattagccttcttccaatggatgtctaggaatggccaattgtcgtcatggcccagtttcttgcgtgcgcttgaagctcgctttgctccatcccagtacgacgacccaaccggagctctatttaaactcaatcaacataggtccgttaatacttacttatcagagtttgagtccctcgccaacaaaattgttggtctcccaacaccttttttgctcagctgtttaatcttaggattaactcccgagattcaccctgaagtgcaggagaaactagcagattcctgtctattttttcaacgtcgttcggtggcatcaacgttatcagtccctcctccttcacaaccgttaccgccagttccaacatcggcgctgctacctactccacaaccgtctccttctatccctttcaagaaattatcgccggaggaacttgcattacaccgtgagaagggtttgtgtttcaattgcgatgaaaagttcagtaggggtcattgttgttcctccaagatgtttttgtccatcacggatgaagacggcaatcctgcattaatccctcctgatgaacttggcgatactggggaacaagttgggccattgtcgggccaaatcagtctacacactattgcaagccacatagctccaaagacactatgtttggtgggttggttagcgggacacatggtgtggatattaattgatgggggtagtacccacaattttatccagaagcgcttgattacaaatttgggcttaaccactcaagccactcaacccttatgggtaatggtgggtagtggccacgagttggagtgccacttgcggtgccctgacactcttcttcggatccaagggcatgattttcgggttcaattccatgttcttcccctatgcagagcagatttggtcctggttgttgaatggttgaaatcattaggcccggtcttgacaaattacagtgagttaactatgaagtttactcacgatggcagaattgtggaattaaagggtgatcacaacaatggtgttgggtccatctctgtacatcagctgcgttgtctagtgcaaaccaataaagtgagtgaattttttcatctttga

SEQ ID NO: 115228 - DNA, 2544 bp, Glycine max
  Peptide Sequence Number=SeqID_232006
atggccagttgtcgtcatggcccagtttcttgcgtgagcttgaagctcgctttgctccatcctagtacgacgacccaaccagagctctatttaaactcaatcaacataggattaactcccgagattcaccgcgaagtgcaggtagcacagcccctcatgctggtccaagctacaacactggctcgccttcatgaggagaaactagcaaattcctatctattttttcaatgtcattcggtcacatcagcgttatcagtccctcctccttcactattgttaccgccaattccaacatcagcactgctacctactccacaaccgtctccttctatcccttttaagaaattatcgccagaggaacttgcattacgccgtgagaaggacgacaatcctacatatgaattaatccctcctgatgaacttggcgataccggggaaccagtggggccattgtcaggccaaatcagtctacacactattgcgggccacatagctccagagacactacgtttggtgggctggttagcgggacacagggtgtggatattaattgatggggtggccacgagttggagtgccacttgcggtgacctgacactcttcttcggattcaagggcatgatattcgggttcaattccatgttcttcacctatgcgaagcagatttggtcctggggtgatcgcaatagtggtgctgggtccatctctgtacatcagttgcattgtctagtgcaaaccaatacagatgaagatgttagcaagacaatgttctgcacccatcacgaccattatgagtttcgcgtaatgccttttgggttgtgcaatgcacctttgtccttccaggccacgataaatgagactttccgaccttatctttgcaaattcataatcgtattctttgacgacatcctcgtctatagcaaaaccttccaagatcacttggttaatctagtaaagacatttcgtgcgttggagacgggtcagttcttcttgaaaaagtccaagagatatgcttcaattgcgaatcccttaactcaacctcaccttgtttggtcttcggttgcccaaacctttttccaacaactgaaggacgccatcagctctgctccgtccgaacaccccatcggttttttcaacaaacaattctgcctgaaactcagacatgcatccacctatgtccgggagttggccaccctcacgaccacaccagaacaacaattttatcactctaggcttatgggttacaatttcaggatcaagtatcgcacagaacaactcaagacggacttgaccactcaccctgatttcgtggccctccgtccgctcaatacagacttgaccactcaccctgagttcgtggcccttcgtcaggagattttggcaaatccgacaaagagacctgagtatacgattgccaatgatttgattctgctgaacaaccgcatatggttacctaagggaatcgctttcattcaaacattacttcaggaattccacacttgcttggattgtcaagctactaagtatgaagccaagaaaccagctgggctcctctattcgttacctgctccttcacgaccatcgaaagacctttccatggatttcatagtgggtcttcctttgtatcatgacaataccactattttggttgttgttgacagattctctaaaggaattcatttgggcatgttagtgacaaattacacagcttcctctgttgctttattattcatggagatcatgggtaaaaaccatggaatgcctaagagtattgtctctgatagggaccctctatttgttagtagattttggcaggagttgtttcgcttgagtgaaacaaagctgcggatgagttcctcttatcatccacaaatggatggtcaaacagaggtgttaaacagagttatggaacagtacttaagagccttcatgcataacaagccgaaatcttgggggaagttgttgttgtgggcaacatggtgttacaacacctccatccattcggctacgggcgtctcaccatttgaagaaacttttgggcgcaaacctccaagcattccccagtatctgacgagtgattctcaagtgattgcagtagacaacatcttgaatgaaagggaagtagtattcacaacgttgagtaagaaactttccaaagcgcaacaaagaatgaaacttacagtggacgtgcatcgatgggacgtcatgtttgaacctggagaatgggtcatgttgcaactccctgaagaatcacgaatccatccagtgtttcattgttccaaccttaaactttttcaaaactccactacagcaactcctctagctctaccttcacaggacattgacaacaaccccgttattatacctctggctattctgggaacgcattgggatttagttttaaagaaagctcaccaccttaaggacaaggtgttgcccaatggggtggaaaatgataagcccaagattggtaatgcaaaaatcactcaaggcaagcccaagagaagaatcattgtgcccaatcacttgaaggattatgcctga

SEQ ID NO: 115229 - DNA, 201 bp, Glycine max
  Peptide Sequence Number=SeqID_232007
ttgcaaaccaaatttcgagaagatccaacggttaacgaaggctgggcagcgtttctaccgaggcagcttcatactaaatttcgagaagatccaacggttaatgaaggctggacagcgtttttaccgaggcagcttcatgtagctttctctagaagcttcattaagaggcttcctctagaagcttcctcgtggcttctttga

SEQ ID NO: 115230 - DNA, 655 bp, Glycine max
  Peptide Sequence Number=SeqID_232008
tgacgttgttggtggtggtgacagaggtggtattagtggtggtggtgacggtggtgacaaatgtggtattaatggtagcaatgtcaatggtggttgtggcaatgatggtgatgacaaatgtggtattgttagtagtggtgatgacacaatgacggtggtagtaacattgatggtagtgagggtggtagtaatgctggttgtgatggtgatgttagtggcgatgatagtagcagtaatagtagtgttagttggggtaccaagtggtgatgatgatgatggttgtgacaacaatggtggtgatagtgacactaatgatgatggtggtcatggagatgacgatgatggtggtattggtggtgatggtggtggtgatgacaacaaaaagtgtcattgtcaaatggcgagccttggtgcagcggtaaagttgtgccttggtgacttgttggtcatgggttcgaattcggaaacagctaaagagtgtgtacacgacacttgtgctgagtgcgcttttacagttgaatcaagtggtcgcgcgctaagtgcaggatgtgggcttgctcgtgatagttgtcttccaatgtggcttcttgcgctaagcgacttgcttgggttgaatggttttgacttgctaagcgagaaggtcgttctgcattga

SEQ ID NO: 115231 - DNA, 297 bp, Glycine max
  Peptide Sequence Number=SeqID_232009
atggaggatccaaatcaagctcaagaagggtcttctcagaagaaaatgggaagagggaagattgaaatcaaacggatcgagaacaccaccaataggcaagtcaccttctgcaagcgccgcaacggtttgctgaagaaagcttatgaattatcagttctgtgtgatgcggaagttgcccttgttgtcttctcaacccgtggccgtttgtatgagtatgccaacaacaggttttaccaacacacaaacccttctttaaatttttctaacccccaaatcttgaaggttcttgataaatag

SEQ ID NO: 115232 - DNA, 321 bp, Glycine max
  Peptide Sequence Number=SeqID_232010
atggatcccactaatcccacactagcttttaaacagtttcctgaattgtttgtactttgcagtgttagggccaccattgaaaggtacaagaaggcaaatgctgctgcttcaaacgcagaatccgtatctgaagctaacacacagttttaccagcaagagtcatccaaattgagaagacaaattcgagatattcagaatctaaacaggcacatccttggtgaagcacttggttctctgagtctcaaggaactaaagaacctcgagggtagattggagaaaggattaagcagagcatcaatcaattggtatctgacaggctag

SEQ ID NO: 115233 - DNA, 201 bp, Glycine max
  Peptide Sequence Number=SeqID_232011
atggtacagatagctgaacatgagagagctcaacaacagcaatcaaatatgatgtcaggaacactgtgcgagtcccttccttcacaatcatacgacaggaattttttccctgtaaatctcatagcttctgatgatcaacaacaatattctagtcaagaccacactgctctccaacttgtacaaaaacaagaggctcaatga

SEQ ID NO: 115234 - DNA, 582 bp, Glycine max
  Peptide Sequence Number=SeqID_232012
atggcttcctcttcaaactcagttctcttccagtcttcgcacagcaaaagctctcaaaactctctagaatcgtattcatcgactaaaaatggatcattagccttggggatcccttgtatcaaaagtcttcctggcggtgagtctaggcagcgtgtcccgcaggagaaggctacaatgtggaagagactcacacatgaggggggagattgttggagtacaagtgtgagtgtggtgtcaagttcccttatatggtggctcatggtccaaaggtgtaaatctcccaggcatttacccccctcgaatgtccccaacataacggacattaaccatcctgtgttgggttacaagtgtgagtgtggtgtcaagttcccttatgtggtggctcgtagtccaccgctagagagcatgtggactctaatggctatactcgtggaagactttctctcgtggggaaggctaccatgtggaagagactcacacttgagggaaagattgttgggttacaagtgtgaggtgaagttccacattggaaaatttggtgtcaagttcccttatgtagtggctcgtggtccaccagtgtaa

SEQ ID NO: 115235 - DNA, 537 bp, Glycine max
  Peptide Sequence Number=SeqID_232013
atgcacaatcatcatgagaaaggaagagcttctgatctggaaagtgtattggcagacttcaagacatatcaagctagctctaaagattatcaatgggaatcagaatggcaaccttgttatcagaatgaagcagaaggattgtctaatctggatgacctgttaatgcaattcaagggtatagtagattcaatgcaacaagcgtttaaaagagctgagactcagattggtaagttggtggatgatatgactaaagttgtggtcagaagaaaagaagagtatgcagagattgaaacacatcaagaaagtattcttcaagttaacacaatccatcatcaattgatcaacaatgaagaaaaggatgaagtctccattattccagaatattcctgcatggtaaccactggctatgatgtaggcaaagataaaggtcgattggaactcagtgtagaggatcataacatctcctttgacctctttaaaggaatgaaacacccagatatgagtgatgcctgttttgaagaagaagaggtggagtag

SEQ ID NO: 115236 - DNA, 1059 bp, Glycine max
  Peptide Sequence Number=SeqID_232014
atgaaaattttagttgcctttcagggtagacatccatactcatttggtgataaatttgttctttcatcggtcttggacttctgtttgaataggataacagatcctgatccatatctgttgtcatttgagcaatttctcattcagtgtatggtgatgattaaaaatattctggaatgtaaggagtacaagccaagtcttactggtagggtgatggacgaaaatggagttacactggagctgatgaagaaaaacatttccagtgcggttggtggtgttttaacttcccttcttcccactgaacggatagtccacttgtgtaatgtgttgatatcgaggtattttgttctgacagcaagtgatttggaagagtggtatcgtaaccctgagtcttttcaccatgagcaggatatggttcagtggacagaaaaattgaggccatgtgctgaagctttgtacattgtattatttgaaactaatagccaattgctaggtcctgttgtggtctttcttcttcaagagtctatgaataattgtccaacttcagtggcggaaattactcctgcattgcttcttaaagatgctgcttatggtgctactgcttataaactgatcaaacaaattaggacacccaaatctcattctcaacaaaagtttaatggtgctttatcactcgaactctcaaatgaacatccaaatttgcgtatcattcatcgtaaagttgctataattttggggcagtgggtttctgagatcaaagatgatacaaaaaggcccgtatactgtgcattaatcagattgttacaggacaaagatttatctgtccggctggcagcatgtcgatccctatgcttgcatattgaagatgcaaacttttcagagagggagtatgttgatcttcttcctatttgttgggattcatgttttaagttgtttgaggatgttcgggaatttgattcaaaggttcagattttgaatttgatctctatccttattggacatgttagtgaagttattccatttgcaaacaagttggtgcagttttttcagaaggttcagtga

SEQ ID NO: 115237 - DNA, 450 bp, Glycine max
  Peptide Sequence Number=SeqID_232015
atgaatacaaattcacttgcccaattagcatcagatccatcaacttctcaactgcttcagacagcatccatcccagttcaagaaaatatacttctttgtctggttgacatttgggttgacaaggtagataacgtttcttccatccagaagaagacaattggcttagccctctcaataattctgacatcaagactgcctcaagtacttgacaaactggatcaaattttgagtgtttgcactagtgtaattctgggcagaaatgatgacttaaccgaggaagagtccagtggtgacatgagctccagcacgtctcctgatgagggcaccattcctagtaaagaattcagaaaaagacagatcaaattttcagaccgtatcaatcagctgtctcttgaggacagtgtgagaaaatctacaaaaatgtgcttctattcatggagaatcatttga

SEQ ID NO: 115238 - DNA, 381 bp, Glycine max
  Peptide Sequence Number=SeqID_232016
atggcgctatcggcttccgacgttgcagccatgtactcgctgctttcgaattccatgagtaccgatcaccgtctccgcggtccggcggaggacgcgctcgcccaatcggagtccaggcctggcttctgctcctgcctcctcgaagtgattaccgcgaaggatttggggtcgcagacggatgtgcgcatgatggccaccgtgtatttcaagaacagcgtcaaccgctactggcgccaccgccgcaattcctctggaattagcaatgaggagaaaatgcacctgaggcagaagttgttgatgtacttgagagaagagaatgatcagatagctctgatgctggcggtgctcatctccagaatcgcccgcagtgattatccctaa

SEQ ID NO: 115239 - DNA, 327 bp, Glycine max
  Peptide Sequence Number=SeqID_232017
atgagtaccacaaattcaatcaccgatttcattcactcaaagccttctcatcaacaagtttcgtataatctagccttcatgtacacttgtgataatttgagtgaaccagatcagacagagtttgtgggaacttttgttaatttgttccatggacaaggccataatatcaaagtaactagttttaaggtagggatatcgaaagtgctcgattgtttagaagctgaagaagacgatgttgtactagttactttggtgcctaaggttggaaaaggagatgtcatcataggaggcatcaaagttgagtttattccaaagtacaaggattag

SEQ ID NO: 115240 - DNA, 291 bp, Glycine max
  Peptide Sequence Number=SeqID_232018
atgtggtttcctggcagttttcccttcaccagttatcccaaattcgtgaatattaatccgtgcacgcttcgtgttcgattaattgcctctgagcctaacttgcgttcatgcttaatggacgaagggctaactgaagacaagagttgtcattcaaattcgatgaagaaggtaccaaatgcatttgtaatacatggcgtaagcggtagaggaatgtttcgaacggagtcaaagatggaagttggagaagtcattgttgtgcctggaagtagtggagacttggtggaagtatga

SEQ ID NO: 115241 - DNA, 165 bp, Glycine max
  Peptide Sequence Number=SeqID_232019
atgtgttgtgtgcttgaattgaaggttattcatttacgagtttttgtttgtacatggagtgttcttggggttgataaaaatgcaagtcagcgggaaattcagaaggcttttaacaagctctctcttcagtatcaccctgacaagaacaaatccaagggtgcataa

SEQ ID NO: 115242 - DNA, 267 bp, Glycine max
  Peptide Sequence Number=SeqID_232020
atggttttggcttgcaataattcgaagcttgcaaggaaacagagtgaggccacgaagatgacccgtgtggagggaaaacgggtcttcatattgggatccgaatgtgtcgccggaaggaatttgaaatcggaaataggaacagagtccagatgcttccaggttaaggacgtggcactatggtgtgtgaccacgcatgttggccaatcagatttcagaatttctgatttgggcattgctattgacactgcctatgtgggtggcttttga

SEQ ID NO: 115243 - DNA, 1380 bp, Glycine max
  Peptide Sequence Number=SeqID_232021
atgtcagccccttctccatcctcgtcaccggcgccaccaccagaactctcttcctctgcacctcccagttcaacttcaccattaccgttaccctcaccgtctccatccctatctccagccaatcctctgccggcaccaccaccacaatcgccggcatcaatttcttctcctccagcaaccctgccacctcctcatagttcctctccttctccaccatctactacaactataagtagtagtgcacctcctcctcctcctactactaggaaaaatccttttgattctcatcattctactccatcacacacttctggattggctccaccacctccatcagcacaaaattctggcccgggaagcagtagtggaactagtgcagtggctattgttggtgtactgacaggagttctgctgcttggcttcattggcattgctatctggtgtctgaggaggcaaaaggaaagggtttctaagagtggtgcttatgacttgccacctgaatcagatatgcctttacataagattcgttcttcagctcctctaatagaaagagcttccggcggtaatacaccaccaggactaggcaactctaggacattgtttgcatatgaagagctactgaaggccacaaacgatttttcaactaaaaatctcttgggagaaggaggatttggttgtgtgtataaaggatcacttccagatgggagagaagtagcagtcaaacagctgaaaattgaaggaagcaagggtgagagagaattcaaagctgaagtggaaatcattagccgcattcatcatcgccatttggtttccttagttggatactgcatttcggataacagaagactacttgtctatgattatgtccccaacgataccctttattttcatcttcatggggaaggtaggccagtgctggactggacaaaacgtgttaaaattgcggctggggcagccagaggaatagcttatctccatgaagactgcaatccacggattattcacagggatatcaagtcagcaaatattcttttacactacaactttgaagctcgaatctcggattttgggctagccaaattagcagttgatgctaatacacatgtaaccacacgtgtggtgggaactttcggattacggattcatgactcatttcttaataatgctcaaacagtaaaaatgattcgttttttccctcttaaaagatatgttgcgccggaatatgtatcaagtggtaaattcactgagaagtcagatgtgtactcttttggagtcatgcttttggagctcattacaggaaggaagccagtagatatatctcaaccagttggagaagagagtctagttgaatgggaaggtgctggtgtgtcaaactgttga

SEQ ID NO: 115244 - DNA, 201 bp, Glycine max
  Peptide Sequence Number=SeqID_232022
atgaggactttgagccctatgaaagataaagtgaggactttgagtcctatgaaggactttgcatcctatgaaggcgagaactttaagtcctctaatggcgaggactttgagccctctaaaggcaaggactttgagtcctctaaggcgaggactttgagtcctctacctatgaaggcaaggactttgagtcctctaagatga

SEQ ID NO: 115245 - DNA, 597 bp, Glycine max
  Peptide Sequence Number=SeqID_232023
atggcatgcggagacaaatcatggtcatctgcaacctttttgtcatccagagacaatcaagtccgatggcacgcagagacaaatatggtcatctaccctcttttgtcgaagactcaatgtcttttgatagagactattaaagtctcccctccgtcatccagagacaatcagaccattatggtcatccgttttcgttgttttcaagactattttagtctcctttaccgtccagagacaatcgattccgatggcatacgaagaccatatgtcctcatttacattttgaagatgacaatgtcttcagtcattgcatgccttcaaaaggcgacaatgtcatcatctacatttcgaagacgacaatgtcttcccaaggcgacaaaaccttcttttacatttcgaagacgagaatgtcttcaccagtcattgcatgccttcaaaaggtggcaatgtcctcatttgcattttgaagacgacaatgtcttcggtcattgcatgccttcaaaaggccaccatgtcttcatctacatttcgaagatggcaatgtcttcagtcattgcatgccttcaaaaggcgacaatgacttcatctacattttga

SEQ ID NO: 115246 - DNA, 525 bp, Glycine max
  Peptide Sequence Number=SeqID_232024
atgtcttcaacagcaattgttcttccggaacagagtcttgcggcagagaaggcaggtttggctgtaaacaagaaaggtttgactttaaaagaacttctccagcaaacatctcatcacaatccaaaagttcatagagatgcattgattggtattaaggatttattcaccagatatccagctgaacagaagttgcaaaaatatgctgctgtagaaaaacttcgtgagcgcattggtgatgatgataaagtggttcgaaaatcattatatgatctttttaaagtagtgattttaccttgctgtaaagagagcagcctagtacatactggaagtccagaactagaagaatctttaaaagtcttatcagcaaaagcccaaaatgcccaggaatggtggggtagaagaaatttatggttaaaggttatggaatcatgctcccaccaaattaacctcactccagctaaaaagtgcaatattttcatcctactccctaaaccactgatacacccaaatgttgagccattctaa

SEQ ID NO: 115247 - DNA, 1419 bp, Glycine max
  Peptide Sequence Number=SeqID_232025
atgtccaagtccaacgtatttgagtttttgcaccaatcccgtggaagtggcaatgtctcagccattaagaaactccatgctcagctactcagaacaggcatgctcttcctctcccataatctccacacccaactcattgccacatatgccgcatgcctccctaacaacaaccttcaatcccttaacaacttcttcaaatgcatgaactccaccaacccattacacttcaacgccataatatccgatttctgtcgcaaaggcttaccctttctcgctctcgcctccttctccttcgtgcacgccaacggtgtccccttggatacatacgctttgtgtagcacgttgaccgcctcctccaaagtcaaagatcttaatttagggaagcagatacacgcccacgtggcgaaatcaggttggtcttctagcgtgtttgtgggtagtgctctcattgatttttactccaaattgtcgaatgtaaaagatgcagcccatatgttcgatgaaattcctgagaagaacactgtgtgtgccaatgcacttttgtcgggttatgccgaggccggcctgtgggttcaggaacttcaactagttaggaagatgcccgtgttgaaattgaagcatgatcactttactttatcagcagctttgcgtgcttgcactggattatctgctgttgaaatgggtaggcaagtgcatggttacttgctccgtacgacacctgatatagagagtgatgtgtttcttcagagcgcgttggttgagatgtatggcaagtgtggattagtgaagaaggcttggcaagtgttcaagttggttgggatggagattagaaaagaagtaagaagcagggacgttgtgttatggacttcaatgcttggtgtgtatggtaggaatgggcattacaaggaagtgattgatttgtatgatgagatgttggtggaaggaatcagaccggatggaatagccttcttgacagtgatctcaacttgtggtcacactggccaagttcatgctggtgtcaagtattttgagtctatggctaatgatttcaagttagatcctggtccagaacattacagctgcctcgttgatttgctttgtagggctggtgaattgcagagggcgtgggaattgctgaatgagacactctataagggaatgggaaattgttctgtgtcaatgtggggagcactactcagtgcttgtgtggatcgtggggatttagacctgggaaaattggctgctcagagggcccttgagttagatcctcaaaatgttgggatatgcattatgctatcaaatctgtatgcccggtttggtatgtgggaggaaattggtcacttgagggtattgatcaaagcaagagggctaaaaaaagatgttggatgcagttgggttcaggtgggttcaggtgactga

SEQ ID NO: 115248 - DNA, 251 bp, Glycine max
  Peptide Sequence Number=SeqID_232026
tgaagatcaacaacaatgtgtatgccataagggtagtgttggaagttccatgccaagctaaaaaaaatgtggatgttggcgatcaatatagcaaggtcaatagggatggagtggtgggggacgaagctctagaagacaaaaatagagaggattatgaggttcacacattgacatttgtggaagataacgttggtcaacaagtctatcacacgaaacaagggacaaagagaagtgtggatgtcgacaacatg

SEQ ID NO: 115249 - DNA, 267 bp, Glycine max
  Peptide Sequence Number=SeqID_232027
atgtatttggatatagtatcaaccactctgttgtacgatggaaatctaattggctatagatccacatttccgcccaaaaccatctggttatctgccgtgcaacacatgcagaacacacttagcgccagcaaaatatggagaagcgccagcaaaatatggagaagtctgatacgcgaagatgcgctcaacacaagtcaagcgctaagcgcgagattatcatcttacttgctaagcgtgacaatcgcgcttagggcaaaaattgtgtga

SEQ ID NO: 115250 - DNA, 186 bp, Glycine max
  Peptide Sequence Number=SeqID_232028
atgaaaatttcagtgtcagtgggacaatatttgttaccgggggctaaaacctgcataaaaatttattgcccgtctttacctgagcaaattgaagtcaaaatgaagaaagggatatggcaacagaccaacagcaaccctagatttaaggtttctatcagccagctagcgttccctgaatcatcataa

SEQ ID NO: 115251 - DNA, 204 bp, Glycine max
  Peptide Sequence Number=SeqID_232029
atgaaacattatatgccattatcatcctcttgcaccagcatgcttgcaatagtcgaatctgatgctgaaatgtacaatctcaagtctttccctttcataggagacatagaattggtggattggcaatccgtgttccaccaattctctattgagtccgggcatagcttcatattcccatgtgaagcagtccttgaactcatgtaa

SEQ ID NO: 115252 - DNA, 238 bp, Glycine max
  Peptide Sequence Number=SeqID_232030
tttgcgtggtcttcaaaggcgtgtggatgtcccaaagggcagtgtagcagtgtatgtaggagaaagccaaaagaagcgctttgtggttcccatatcatacttgaaccaaccttcatttcttgagttgctgagtcaagctgagcaagaatttggatttgatcatccaatgggtggcctcacacttccttacacagaagaagtcttcctggatgtcacttctcgcttgcacaggcgataa

SEQ ID NO: 115253 - DNA, 309 bp, Glycine max
  Peptide Sequence Number=SeqID_232031
atggaaaatttgagatggtcaaagcggatcaatcatcgtatgggatttacgatgcctttgcgagagaagctactgcagccattgaaatcgaaaaagtggctattgtggccgtcaaaattgaaaaaatggctactgcggccattgaaattaaaaaaacggctgttacgaccatcgaaattgaaaatgatggatactaatggcatcgaagaagaaaaggaaatgatggatactaatgccatcaaagaagaaaagaaaatgatggatattgatgccattagagtaaaagagaaatcaaaagatgtttcttag

SEQ ID NO: 115254 - DNA, 462 bp, Glycine max
  Peptide Sequence Number=SeqID_232032
atggatttgactcttgaccattttttgaatcttgaaattgaacaacaccctccaaccgcgaaagaacaactcacactcaaagttcccgtggatatttctgttcttattctggttgtcgaaaccaatgagtcgatagttgaccagactattgtaaaaaacttgtccatgatggatgcagagaatcttcacagggagacagatccattgaatgtcgatccttttgctttcatcgatgtttggtcttctgattcggtgccttctaaagcttctgaatctagttacaataggtcattcacatattttgatgaagctgtggcaaagtttcaaagactggcttttgaccagccttttgaagactctctttctaatctagattataagtctcaacttcaaaagtcaataaatgaggtctttaaatttaatgacttggtggttaatgagattccaaaggtctttccttaa

SEQ ID NO: 115255 - DNA, 792 bp, Glycine max
  Peptide Sequence Number=SeqID_232033
atggaacgtgaagaaggcaaacaacctccccaaaaaaccccattacacaatcaacatgagcaagctaattctgacaacaattttgttcaagaaaataacttgcaagagcaaagtgggacattcacaacttttgcatcatttgaaagtgaaactgagggtgagtcctcttttgatgacaatgattatgatgctgattttttcctgagccaagagttcgaatcagaacttcaatttcttgagagtgaaggaagcaatgacaacggcgatgattatgataatgaagatgacgaagatatggaagaagatgagatcgatgtagatgaattgacttatgaggaattgattgagttgggagattttataggacaagagaagagagggttgtcagcacatgagatctgttcatgcttgcattctcacactttccattctgctgaaaacaaaagtggaattgatcgttgtgtgatttgtcaggtcgaatatgaagaaggtgaatctttggtggcaattcagtgtgagcacccttatcacacagattgcataagcaagtggctccaaattaagaaggtttgcccaatatgtaacatcgaaatttcagctcccaagatgaaatttgatgttccaagtaaaatgttggtggcacgtgaaggtgtcaaggtgagaagatttcttcataaaacagcagaaattaatgcaaagaaaggatacagtaaaaatgagaaattgagggtttccaaatttaaccctgttgatgtcgactatggaaacgagtctgtgtgcacccgaaagtaa

SEQ ID NO: 115256 - DNA, 234 bp, Glycine max
  Peptide Sequence Number=SeqID_232034
atggcggcctcctctcaatacaatacttccgcagatcaagtggcctctatgagtactgagggaagcataccactaccaacacctactgtatcaacgacgaccaccaacaaaggcattgagctaattctcattctaagacatgaagaagagtgcaagaaagtccttaccgtcctgaactggattatgaagccattagtagttggttccccacttatgaggatgaacatcttataa

SEQ ID NO: 115257 - DNA, 201 bp, Glycine max
  Peptide Sequence Number=SeqID_232035
atgggtgaccaagaggagatacaggaacacatgaaagtcgacatgtcggctttgaaagagaaaatggcttccatgatggatgtcatgctaggaatgagacaacttatgaagaataacgtggccaccgctgccgctgttagttcggctgccgaagcagacccaactctcctagctaccccgcaccatcctctcccaaacgtg

SEQ ID NO: 115258 - DNA, 807 bp, Glycine max
  Peptide Sequence Number=SeqID_232036
atggtagtaactagggcattgttaccccctcctcctcatcctcaccccctctgctcccttccaattcccaccaaaaccagagcctttgcctttcaccaagtagacccatttttgggattcaaattggagcgacaacacaaaagaaaatcaaagaaacatgtggctcatgtgtcactccatgatgaccctttggtttcatacaccatccaacaaaacccctatcacctggtcttgttggcagagagtgcgggttactctttggccagttattacacttctttgggtctctttgtcatctctgtgccaggactctggtctctcatcaaacgttctgtcaaatccaagattgtgcagaagacgtttataggtgaaggtgaaaagaaggcgccgaatcaagctgctggggagattctatcgttcttcactcgtaacaattttacagtgactgacagaggagagacaatcacgtttgaaggaatgatggttccaagcagaggtcaagcagcactattaactttttgcacttgcatcagcttggcaagtgtggcacttgtgcttaccataaccttcccagatgttggcaacaactggttttggatcaccatctcgagtccattggcaggcctttattattggactcgggcatcgagaaaggagcagattaaagtgaaaatgattgttggaaatgatggaaacttatcagagatcattgtccaaggtgatgatcaacaggtcgagcaaatgaggaaggaactcaagttaagtgaaaaaggcatggtgtatgttaaaggcgtctttgaaagatga

SEQ ID NO: 115259 - DNA, 351 bp, Glycine max
  Peptide Sequence Number=SeqID_232037
atggttccaagaggtcaagcggcactattaactttttgcacttgcatcagcttggcaagtgtggcacttgtgcttaccataaccttcccagatgttggcaactactggttttggatcaccatctcgagttcattggcagccctttattattggactcgggcatcgagaaaggagcagattaaagtgaaaatgattgttggaaatgatggaaacttatcagagatcattgtccaaggtgatgatcaacaggtcgagcaaatgaggaaggaactcaagttaagtgaaaaaggcatggtgtatgttaaggcgtctttgaaagatgatctattggctattttcttcaggaggtag

SEQ ID NO: 115260 - DNA, 501 bp, Glycine max
  Peptide Sequence Number=SeqID_232038
atgcctcatcaatttttcactctaatcgaaccaccaaacaaaaccccaacctccaagccattctcgagcctccaggccaagacctggacttcatcagaaagcatttgtgtattttcttccaaacaaagtgggttttcttggagaagattttggggtcgatggactttccaagttctaaatcttatgtggctaatatggtattccaggaatcagtgggtgtttcaaaataaggtaatcccattgtggcaagtgtttcaaagagctgcgataccccatatagagccagagaagaaacgaaatagaggcactggcttaggggtggtgtatcacgatagtgaagggatgttcttggcttgtgcagttgttctgatcacatattgctatgatctgaaaattgcggaggctatgactttcaaatggtcaatggagactgtatctcacctttccttttctcgggttaagtatgaaattgacagcctagaaaggaaattcctcgactaa

SEQ ID NO: 115261 - DNA, 1299 bp, Glycine max
  Peptide Sequence Number=SeqID_232039
atgacaggtcaagaaaacatgaaaggtcctttcaccaagtctggtgcattagcaagctttgattgttatgacccattggatcctaatgggaacatttccgtaacttttgacatcttccaacgtactccagataatggatatctggcaagggtgacccttcaaaactactatcaatatcggcatgtagacaaacctgggtggaaactaggatggacgtgggctaacaatgaagtgatatggtcaatgagtggtgccatagcaactgatagagggaattgttcatcttacagcggctctcagatgccacattcatgcaagaaagatcccaccatagttgatctctctctagatgcctcacaaaacaggtcagagcattgttgccgtggtggcctcctctctccctggtctattgatcctttctatgcattctcttcatttgaacttgaagtgcgcaacgtgggagataacccacttggacaagcacctattaatcttacattgatggccccaggtcctggttacacttgtagcccccttcttgacactgatctctcagtgtcctcagattttgggggactaagacaagttcctgttctcagaacttggaagtcaacatgtgcatactccagtttcttagcaaacacaataccggtatgctgtgtttccctctcatcattttacaaccccgccatcacatcttgccgtaattgcagttgtggatgcagagaagcagataaaagtacagcaacttgcataaggtctagttccttgtcacggtctaatgaggacaacacaattgatgaaatgattgaatgcaccgaccacatgtgcccagttcgagtccattggcatttcaagaacaattatatgaaccaatggagggtgaagcttacaatttctaactacaactacaacagaaactactcaaactggaacgtactcgttcaacatcctggtttcacccaaaaagcgagaacttacagcttcaacagcactaaacttcccacccttgggctccaagattattacaacaatgagctagtgcattctgataaggatggagtgggtcttgtgactacagaaatactattggataaagatccaaattctttcacagtaagtaatggatgggcatttccgagaagaatatatttcaacggggagaactgcgaaatgcctttacctgacacgtttcctatgttaccaaatggtggctccattttaagagctacttactgtggtttcagtcttttatatatccttttgtttcttgccctactactgatcctttggttttga

SEQ ID NO: 115262 - DNA, 1030 bp, Glycine max
  Peptide Sequence Number=SeqID_232040
atggctgctgatcagaggagaaaacgagtaaatggtgcaaacattgctggttatggttctagagagcaacacaggatcaaaagaaagaatttgggattagttcaaaatgatttgaacatgaggcctcacatctctgttgagtgggatggtaatcacaaaaaggttgttgctaagtgggaacagattggcatcagttggagacaaatgaaaccatttatcaatttggtttctaatgatcacaaaatcttggcagatgtgttcgcagtgcctcaagaaatttttgaattggataatttaagtgaagttctttcgtatgaggtttggaagacccatctttcagaaaatgagagaaaccttcttatgaattttctccctagtggctttgagtcacatcaagttgtggaagaactacttggtgggattaactttaactttggaaatcctttctcgaaatggggtgcttcgctatgtttaggcagtcttcatccagatatgattgttgaccaggaacagcatcttaagacagagaggagagaatactactcacacattcataattatcacaatgatatgataggatttctatcaaagttgaagaagagctggcaaagctgtaaagatccagaaaaggagattgtgcaaaagatatggaggacaaagcatgtagagaaaagaatgctctccaaagtgattgaatctagaggctatgatcataatgggaatgttacagggacatctgagtcatgctcctgggatgcagaggagaaagcatgtagtagcgacaaccaaatttcctcactgagaaaagacgataaacttcaaagaagggtgcttgaaaaatgcattgttaaaggtaaatccagaaatttgatggattctttggacaatatgcctaacgtgggagaaaagcccaagacaggagacaaactgcccaagcatagcattcattctagcgatagtgataaatacatgtcatgtatcaagattagcaagcagcagcatgaacttgttaagaatatgaagcaggctg

SEQ ID NO: 115263 - DNA, 1641 bp, Glycine max
  Peptide Sequence Number=SeqID_232041
atgaaggataaatcaaatccattcatggaggaagaggatggtgtggacacagggagtgaacttaaggatcaggatggtgtgaactcagggagtgaactacaggatcacgatgaggtgaactcagggagtgaacttcaggatcaggatgaggacaaccttggctcaggggacaagctaaaggataagaatgaggataacatgagttcagaatgtgagcctcaggagcagaatgaggataatgtgacctcagggagcgaacttcaggatcagggtgaggataatgtcaactcgggtgatgagcttcaggatcaggtgaatgatggaggtctgaatgatcagtctgacttgaaagaagatgaggattctttttctaggtcccccgagaaccagtcccagcacaattcttatgttagtggtgatgatgagttcaaccgaatgagtgtagattcagaaaggaatattcttttatcaaaatcaaataatacttcatcgattagtggtgatcatgagttcaaccgaatgaatgtggattcagaaaagaatcttcttttatcaaaatcaaataatacttcattgaataaagatgagtattcaaggaatatgaacactcgggatgtttctattgatgaagaagcacctttcacttccagtggtgatgtctggcaaggagttgaaatgccacattcatactatgattctgctgtgacccacgagtatgcagccagtgggttatcactggctaatcctcaagtcagtcaagagcagccaactcgtatgattgatcttgaagctgatttgcgtcgagaagagacaggcaaagagttgttaagtaggcaattagataatgggaccttcagttcataccaaagccaggatcgaagtgtcttacttgaatcactcttcaaaggagaggggttgttaccttatcatcatgatcagaaagtagctgagttagatttccaaacttcaaacaatgttatgatggggggtggccaattttccagtcatttaaaggagccattgcaaacttcgctgacactggatcaggggcgaaggagagctactgaggtttacatgccagaaaacatgtcagagaatatttattcggatggaggaaggtatttgatccccaggcaagatcctttgactgcggtaaatatgactgattgggctgctaataatgctcgcatagcagggccttcccaatctcacttgaacactggagattttattgatcatcattggttccctgctgatcatcaagttcgtggtggtggctggaatggatctgatggtggtggtctttcaagtcaaagtcttggcactggagcaagcgctgatcagagtttatttagtattctgtcagagtgtgaccaattgcattcaggtagcccttatgattcagttagaaatactaaccagtttcttgcaccgagaacttatggattagcagatgcaggtacaccaagggtaaacacggttgcaccaccggcttctcatccattagattacttcaccagacgtgaagcacctagtggcctggtgcctgatgatacggtatggatgagcttgccgccacatcagaattcttcattacatgatcaaatcagaaagccatacttaaggtcatggaaccggtaa

SEQ ID NO: 115264 - DNA, 576 bp, Glycine max
  Peptide Sequence Number=SeqID_232042
atgactctttcacagctgcttgataacttcctccacaaggcacatttcgcagcaacatcaagctgcctcaatgccgcaagttccttcttctcaaaggcacagaccgacacggcaccagcggcagcagctagagcggccacagcgtacacggtgaccacgacggtggctgccaccacggcaattacgacggcggagagagatatggtggagccgcggacgacgcgccgagagaggcagagtcacgacagcaatttcgcgatgcggcgatcgagctgcgttttgacgttggaggggttggagcaggtgacggagaaggtgtggagtcggggatgggggtttagggtttggaagaagtcgaggaggggagcgtggaggtcaagcgcgcggaggaggcagtggtggaagtggaggcagaggttggaggcggtttcggtgtggtcgaagaaagttgaaatgaggcgcatgaggcgcgtggggattggggttagggttagggctagggcttcttggacacggtcgcgggtggggttaagatggtggagttgggcttcgatgttggagcgaatgtcggtgtag

SEQ ID NO: 115265 - DNA, 501 bp, Glycine max
  Peptide Sequence Number=SeqID_232043
tcctggtccatttcctccaggggttgatagtataggcacgataccatctgctcttgcaacatatgctgctgttctagcattacaaccatacttgatcatcaatgcaggcaccgctggtggcttcaagatttttgatctgtatggaattggtttacgtaaagtctttgaaacacccaaccttgtaaaggagcttaatctaaaggagttcattgtctttgtgcaaaacttgaatgttaaacaatatttatgcatatttctggtggctaaattgtctactggtggctctttagatatgacagagcaggatgaatcatcaataattgcaaatgatgccacagttatagatatggagggagctgctattgcatatgttgccgacatactaaaagttcctgcaatttttataaaagctgtgaatagtatcgttgatggtgacaaagcaattgtagaagaattcctgcagaatttggaagctctaactgctgttcttgatctgaacaa

SEQ ID NO: 115266 - DNA, 1356 bp, Glycine max
  Peptide Sequence Number=SeqID_232044
atggggtcgaaccggaggaagagcgaggaccacccggcaacgacgctggatcacgcgctgctagcgtcgggagaaagcgcggaagagagggaaacgcggattcgcgctctcttcgccttcttcgacgcggagaattgcggattcttggactgctccgcgatcgagagcgggctctcggcgctgcgaatgccctcggactcggagtgctgcaactacgcgcaggacctgttcggcgcgtgcgatgcaaacaaagacgggcgcgtggactacgaggagttcaagaggtacatggatgataaggagctcgagctgtatcggatttttcaggcgattgatgttgagcacagtgggtgtatttcgcccgaggagctctcgcacgcgcttgttagagcagttattggacggccgaaaattcagcttgaggggatgttggaaatttcacattgcctagtgatggtcaactgttattccaccctcaatagatgtccagccttgcaaattccgcgcccgataattctcgggattcagattgatgatgaggaacttgcccgatttgttgagcgtgtagacaaggatcataatggggttataacatttggagaatggagggattttctgctgctgtatcctcatgaggcaaccattgaaaatatttaccattacttggagcgggtatgcttgattgatattggggaacaaactgttattcctgcaggcattagcaagcacatccatgcaagtagctatctgattgctggaggagtagcaggtgctgcatcacgtacaacaaccgcaccccttgatcgattaaaggttgtgttgcaagtccaaacaacacgagctcatgtaatgcctgcaataaaagatatatggaaagaaggtggttgcttaggtttttttcgaggcaatggcttaaatgttcttaaggtggccccagagagtgctattagattttacacctatgagatgctaaaggcattcatagggaatgctaaaggagaaggagcaaaggctgatgttggtactatggggcggcttctagcgggtggtatggctggtgctgtagctcagactgcaatatatcctctggatcttgttaaaactagaatacaaacttatgcttgtgaaggtggaagacttcccagtcttggaactctctcaaaagatatatgggttaaggaaggaccccgcgcattttataagggcttgattccttctattctggggattgtcccatatgctggcatagacctagctgcatatgaaacgttgaaagacatgtccaagaaatatattcttcttgatgaaggtaatggacttatttgtttgtcatgttctgtaccagatgtgctatag

SEQ ID NO: 115267 - DNA, 435 bp, Glycine max
  Peptide Sequence Number=SeqID_232045
atgcattggtgtgacgcaaaaaaaccacatcccaatgataaaaaaacgtggaagctacaaagcaaagcttcaggagagacatggctattcacgtcagagttgagtaaccaaacacaggataccaatcatataaactctcccccagtaaatgaatataaaagaaaaagtatatatcgtagcataagagaaataacagcacttgactttatatgggtaggggagatgcatggctcgataataggagtgcaggggacaatggcgcagggtttgagaaccaatgcttggatatttcataatagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 115268 - DNA, 822 bp, Glycine max
  Peptide Sequence Number=SeqID_232046
atggcaggcatagctatactgttagatctatggaggaaaaatcaaaacttgagctctggattgcactcttctcacgcctttcagtcttccagtgccttctgttctgcctctgctgccactgccgctgcagcgtctttagctgcgggaaccggttttgcctcaagggcattgtttggggcatttgcgttgacttccttaaggtcattcttgatgttctatttgccacttttggagccccgtgtggaaatggaagatgatgagaatttccaggaggaggatcaagagcaccatgttgatctggttgttccctttaaaaaatcagtcaagcaaatcatgcgtgagacaaccgttgtgaccactagaaggattttagaaagaattgttgtgcattatgtttcacaaagaatggcatggaagcttcttaaagatatccctagatcagcaactcgcaaggctggaaggagcatgcctactttggtttacgtctactgtgtgagcagaacaacattcagaggacatatgcttggagttgcagcatcatggcttgtccaagtaggcattgatttatatcgattcttttcctccacattccagggccagtacgaggataatgatgttgatcaaacaaatcaagttggagttcttggacagaaggttgtcattgctactgttagatgtacttcatctttaatctttgcctccataggagcaggaattggtgcaacctttattcgtcgtccatggctcggccagtgggttgggtgtgctattggtgatttgggcggtcccatcattgtagcattttgtgctgacagattttga

SEQ ID NO: 115269 - DNA, 819 bp, Glycine max
  Peptide Sequence Number=SeqID_232047
atggctgcgcttggggaccaatcagaggaacaagccatggctgcccaacctaaacctcagaaccgacccatttctaacatcgtcatcgtcgttgctatgcagacggaggcacttcccattgttaacagattccagctcactgaggaccctgacaccccgtttccgcaaggggttccttgggtccgttatcaggggacatacaaagatcttaatataagcttgatttggccgggaaaagatccaactttgggggttgatagtgtaggcacgatatcatctgctcttgtaacgtatgctgctattcaagcattacaaccagacttgatcatcaatgcaggcactgctggtggcttcaaggtaggcactgtcttcccccaagccatacagttagagttgctgttgttctactttccacccttggccaaaggagctagtattggtgatgttttcattgtatcagattgtgcttttcacgacagaagaatacccatacctgtttttgatctgtatggagttggtttacgtaaagcctttgtagcacccaaccttgtaaaggagcttaatctaaaggtgggtaaattgtctactggtgactctttagatatgacacagcaggatgaatcgtcaatcattgcaaatgatgccacagttaaagatatggagggagcagctattgcttatgtttctgaccttctgaaagttcctgcaatatttgtaaaagctgtgactgatatcattgatggtgacaaaccaactgcagaagaattcctgcaaaatttggcagctgtaactactgcacttgatctggcagttgaacaa

SEQ ID NO: 115270 - DNA, 210 bp, Glycine max
  Peptide Sequence Number=SeqID_232048
aaattagagagtgacatggttgttgattttagaatgcaggctcaacgtgcttatatggggatggctgatgtattcaggataacttttaaacatgaagggtttaggggattctacaaaggactatttcctaacctgctaaaagttgttccatctgctagtatcacttatttggtctatgagaatatgaagaagggcttggatttggattga

SEQ ID NO: 115271 - DNA, 1803 bp, Glycine max
  Peptide Sequence Number=SeqID_232049
atgtcttcgtttccgatagatagatcccataatgggagtcttaagtgtctagaggcactaagtagtgtatcagaaaaggaggaatttgatttctcaaaagcattagataggcctagggctctgaatatagagagacagagatcatttgatgaaagatcaatgaatgaactatccttaggcttttctccacgtcaattggccacaaaagttgatagttcatctcgcctgggagatcttcttgatcatgtacattctcctaggccaaagtcagatattaatactccgggatcagtgacattggatccacatccattaacatcagaagcttgggaagagctgaggcgttccttggtatatttccgtggtcagccagttggtacaattgctgctttggataattctgatgagaaacttaattatgatcagtggggggaggaattggcacaatttcatcacaatacttggattttggttacacttctagaccatgttaactattatggatctacactcatggtgtttataagagactttgtcccaagtgctttggcttttctgatgcatggggaaacggacattgttaaaaattttcttttaaagacccttcgccttcaatcatgggagaaaaagattgacaggttccaactagcagaaggggtgatgcctgctagttttaaagtattccatgacccagttagaaatcatgagaccctgatagcagattttggtgaaagtgcaataggcagggttgctcctgttgattctggattttggtggattatactgcttcgcgcatacacaaaggctacaggagactcttctttggctgaacggcctgaatgtcaaaagggtatgcgcttgatcttgagtttatgcctgtcagaggggtttgacacgtttccaactttactatgtgctgatggatgctgcatgattgatcgaagaatgggtgtttatgggtatccaattgagattcaagcattgttcttcatggctttaagatgtgccttgcaattgcttaagcaagacatggaagggaaagagtttgtggagcgaattgtgaaacggttgcatgccttaagctatcatatgaggagctacttttggttggatttgaagcagcttaatgatgtataccgcttcaaaacagaagagtactcgcatactgcagtgaacaagttcaatgttattcctgattcattaccagattggatatttgatttcatgcctcatcatggtggatactttgttgggaatgtgagcccggctaggatggatttcaggtggttttgcttgggcaattgcattgcaattttgtcgtgcatggcaactcctgagcagtcaattgcaatcatggatctcattgaatcacgctgggaggaattaattggagagatgcctgtcaaagtttgttatccagcaattgaaaaccatgaatggaggctcgtaacaggatgtgaccctaaaaatactagatggagttaccacaacgggggatcctggccagttcttttatggcttctggctgcggcatcgatcaagactgggaggccccaaattgcaaggcgtgcccttaacattgctgagagcaaattgctgaaggacaactggcccgaatactatgatggaacgacgggccgatatgttgggaagcaggcccgtaagttccagacctggtccattgctggttacttgtccgctaggatgatgctcgatgatccatcccatttaggtcttgttgctctcgaagaagacaaacacctcaagcctttgctcaagagatcaatttcgtggactttatga

SEQ ID NO: 115272 - DNA, 264 bp, Glycine max
  Peptide Sequence Number=SeqID_232050
atgaatcatatactggtgacactagatgagtattcagatagagctcacaacagttctatttggaaatgcattccctatagatggaaaaagggaaaagcagatcaaatgggagatacagaggagataatagaagtacttatgatttcttcaccaaaacgtgatgaccttttgtttccaaagggtggatgggaggatgatgagactgtcacagaagctgcttgccgtgaagctctagaggaagctggagtcaaagggattataagg

SEQ ID NO: 115273 - DNA, 351 bp, Glycine max
  Peptide Sequence Number=SeqID_232051
atggtggctttcatctctctctctctctctctctctctctctctctctctctctctctccctctctcttaattctcgtattagatctgaaattgttcttcagaatgatattgatttgctgaatcctccagctgagttggagaagagaaagcacaaactcaagcgtcttgttcagtcaccaaactctttcttcatggatgttaagtgccagggatgcttcaacataacaactgtgtttagccactctcaaactgttgtggtgtgcggaaactgccagactgttttgtgccaaccaacagggggacgggcgaggttaaccgaaggttgctcatttaggaagaagggagattga

SEQ ID NO: 115274 - DNA, 357 bp, Glycine max
  Peptide Sequence Number=SeqID_232052
atgcatgagaacgaatggcacggcgcgtgtttgctctttgcccctatttgggaacctataggacactatctaggggtctctaataactactccccaacaattcataactcacacggctgttttctagagttcaataaaagcacacccaaagttcaccattcgacaattcctaaaataggcctaactcacaaagaaaaatccccagcggagtcgccaactgtcgcaacgtgcccttcgcgggcgaccgagggcgaggctcacgggtgcgcttcccaaaggaggaaagatgcgcggagtcgccaccaacgtttatttgtggaaaacgtcggaaaaaccgaaggaaaccggtcaaaatga

SEQ ID NO: 115275 - DNA, 141 bp, Glycine max
  Peptide Sequence Number=SeqID_232053
atggttccttttcgtgtgaacataaaattaattgtggcattaggaatgcgaaaaccgtgtgacggaaaatgggctcttgcaagggaagaaaaagaagaacaggagaagaaaggaaaacagcatggtttcttcatgacttga

SEQ ID NO: 115276 - DNA, 357 bp, Glycine max
  Peptide Sequence Number=SeqID_232054
atggaagctggtaaagtcataaggtttgtgctttgtgagagaggagaaaatggagcggttctaccccaagagaaggggaagtggtcttgcagaatggaaacagggtgggagcatgggcaatgtttctgcacctccgggccatttgctcaccatattcggcattgtcattggcttgttgtccttctcccgttacaaagactacaaggctcagctccataccacagccttcagctttcagctattcctcttcttgttgcccgtcttcttcatcttcttcatcttttcatattctactacctcaaggctcaactttcacgcattcagaccatgactctaactgccactggagttgcttaa

SEQ ID NO: 115277 - DNA, 573 bp, Glycine max
  Peptide Sequence Number=SeqID_232055
atgaaggacgatgttgagttgggaaactctagctatcccatggttttggtccaagtcccaatgtacaacgaaagagaggtttatcagctatcaatcggtgctgcttgtggcctttcttggccttcagacagaatcatcatacaagttcttgatgattctactaacccaacaatcaaggagctggtgcaaatggaatgtagtagatgggcgagcaaaggggtgaacataaagtacgaggtgagggacaacagagacgggtacaaagcaggggctctgaaagaaggcatgaaacgcagctacgtgaagcaatgtgactatgttgccatctttgacgccgattttcaaccggagcctgatttcctctggcgaactgtcccattccttgtcaacaaccctgaacttggtctcgttcaggcacgctggaagtttgggctaaggtgggtcccactttgtgttgaaatggccctcaacatagggcacgtgtacaagcctcttccgtgttcaccaaggcccagtgttgtgtttgtgttcttactttgtttgtttgggttcagttgtcttcaatcttcatag

SEQ ID NO: 115278 - DNA, 1905 bp, Glycine max
  Peptide Sequence Number=SeqID_232056
atgtcgagcatcgtcaaggagatcctggcgagcccgatacaaatggcggaccaggtttcgaagctggctgaggaggcccagaatttccgacaggaatgtctggagctgaaatccaaatcggagaagctggcgggcctcctccgccaggccgccaggaacagcaacgatctctacgagcgtcccacgcgccgcatcatcgacgacaccgaacaagtcctcgacaaggccctggcgctcgttaccaaatgccgcgccaacagcctcatcaagaagctcttcaccatcatccccgccactgccttccgcaagacctccatgcagctcgagaattccgtcggcgacgtccagtggctcctccgggtctccgcctccgccgacgagcgcgacgacgagtacctcggcctccctcccatcgccgccaacgagcccatcctctgcctcatttgggagcaggtcgctattcttctctccggcgcttccttggacgaacgttccgacgctgccgcctcgctcgtctctctcgctcgcgacaacgaccgttacgggaagctcatcatcgaagaaggcggcgtcccccctctgcttaagctcctcaaggaaggaagaatggacggtcaggaaaacgccgccagagccatcggcttgctcgggaaagatcctgaaagcgtggagcacattgtcaactccggtgtctgttccgtgtttgccaaggtcctcaaagaaggccacatgaaggttcaaacggttgttgcctgggctatctctgaactcgccgcgaatcacccgaaatgccaggatcatttttcgcagaacaacgccatacgcttgctggttagccatctggcgtttgagacaattcaagagcatagcaagtacgccattgcgaacaaacacaaatccattcactcggttctaatggcgagtaatacaaccagcgcgcaggaagaggatgatgataagcaggtttctcaccccatgtcgggtcagtcatccactctaatgcacaacgtggtttccaacacaatggccataaagagcgccatggaggaggatgacaaagccaacaccaagaaacaacaacagcaacagagtgggaatggttcgcacttggcaattgctgggaagagtattaaggggagggaatatgaagacgcggggaccaaggcacagatgaaggccatggcagccagagccttatggcaactctcgaggggaaacttgaccgtgtgtcggagcataacagagtcaagggctctattgtgtttcgcggttcttttggaaaaaggaccagacgatgtgcaatcgtattcggcaatggcgttgatggaaatcactgcagtgtcggagcaacattcggagctgaggcgctctgctttcaaaccaacttcccctgctgccaaggctgtggtggagcagctccttaaagtaatcgaaaaagaacaagcggaacttctcatagcttgcgtcagatccgtgggaaatttggcgaggacgttcagagccaccgaaacaagactcatagggccgttggtgaggcttctggacgaaagagaggcgcaggttagcatggaagcggccattgcgctcaacaaatttgcttgtacggacaactaccttcatgagaatcactgcaacgccatcatagaggcagggggcgccaagcacttgattcaactcgtttactttggggagcaaatggttcagatttcttccgttactctgctttgttacatagcgctgcacgtccccaaaagcgagacactggcgcaagaagaggtgctcattgttctcgagtggtgcaccaagcagccacatctcatcgaccaaccctccatccaaccactcttaccagaagccaagagcaggctcgaactctatcaatccagaggaagaggattccgctga

SEQ ID NO: 115279 - DNA, 139 bp, Glycine max
  Peptide Sequence Number=SeqID_232057
acttccactagagggggaggctaccatgtggaatagactcacacttgagggggagatatgttgggttagaagtgtgagatctctttatgtggtggctcctgatccacaggtgtacccttcgaatctccctaacaattag

SEQ ID NO: 115280 - DNA, 1005 bp, Glycine max
  Peptide Sequence Number=SeqID_232058
atggggattgcagagaactcaaagggtttggttcttgctgtggcatcgggtgtgttcataggagcaagcttcgtcctcaaaaagaagggtcttaagcaggctgccacccacggcactcgcgcaggagttggcggctattcttatctactccagccactttggtgggctggcatgcttacaatgcttattggggaggttgcaaattttgtcgcttatatatatgctcctgcacttctcgttactccccttggtgcactaagtattattgtcagtgctgttttggctcacttcttgctcaaggaaaagcttcagaagatgggcattttgggatgtgtcttctgcattgtgggttcagttctcattgtcatccatgcacctcaagagcatgctttaaattctgtccaagaaatatgggatctcgccactcaaccgttatttctagtttatgtggcggcggcagtttcggtagttttagccttgattttgcattttgaacctcgctacggacagacaaatatgctggtttacttgggaatttgctcgttaattggctcacttttggttatgagcacaaaagccatagggatcgcaatcaagcttacattggagggaacaagtcaattaacatatcctcaaacttggttttttcttaccgtgactgtcatatgtatcattacacagttgaattacctgaacaaggcactggatacatttaacaccgcaattgtctctcccgtatattatgtcatgttcacaactctgaccattattgctagtgtgataatgtttaaggattggtctgagcagagtgcaggtagcatagcctctgagatatgtggatttgtcattgttctttcaggaacaatcttattgcatgcgacaagagaacaagaacaatccaacaaacaagggtccttaacatggtacattggtgaggacttggtaaagcgcattgaggatggacacctgaaccttttacatggttcagattatgttgaaaagtga

SEQ ID NO: 115281 - DNA, 411 bp, Glycine max
  Peptide Sequence Number=SeqID_232059
atggctactttccacctccccgccaacaacaagcccaacgcgtcttcctctgacctctacttctcccaccacctgggctctgacgacattagctccgtctacctcgccaaactcaacgatgactccctctcagtcatgtttgccaccaaggtagcagatgcaacaatgtgtaagcaccacacacccaacgacgaggactatcttgagtgctcgagcgtgcgtgacttcattacaaagccaaagttggtgttcttcttgatgtccacgatggcggtgaaagtgaagttaagacttgagaggtcagtttttgtgttttgtgactccatcgttacggtctccataagtgacggaaccaaaattgggggtgatttgggagaagatagagtaggtgtgagagcggataatcgataa

SEQ ID NO: 115282 - DNA, 1374 bp, Glycine max
  Peptide Sequence Number=SeqID_232060
atggcatcggagaaagaggttgaaactgtaatagttgggaactatgaggaaatggaaagtgaagggaagcctagggatgcaaaatccaggttattaagtttcttgtggcatgggggttctgtttatgatgcttggtttagctgtgcttccaaccaggtggctcaagttctgctaacgttgccatactctttttcccagctgggaatgctttctggcactctttttcaactcttctacggcttgctgggtggctggactgcttacctcattagcacactctacgttgaatacagaaccagaaaagagagagagaaatttaatttcaggaaccatgtcattcaggttcttgatgggctcctcgggaaacactggagaaacgtgggcttggccttcaactgcacatttcttctatttggatctgttatccaactcatagcttgcgcaagcaacatatattacataaatgataatttggataagaggacttggacttatatctttggagcatgttgtgccaccactgtatttatcccttccttccacaactacagaatctggtcctttcttggcctcctcatgaccacttacactgcttggtacctcacagttgcctctctccttcacggccaggtggaaggagttaagcattcgggcccgaccaaattggttctatattttacgggggccacaaacattctctacacatttgggggacatgccgttactgtggagataatgcacgcgatgtggaaacctcaaaaattcaaggccatatacttactggctaccctgtatgtgatgacattgactctcccatcggcagctgcagtatactgggcatttggagacatgcttctaaatcactccaatgctttttctctgcttccaaggtcacccttccgtgacatggctgtcattctaatgctcatccaccagaaagcaatagggatacacgagtgtaggagcctgtgcaagcgtgcattggcgagattgccagtggtgatcccaatatggtttttggccatagttttccccttctttggtcccatcaactccaccgttggatctcttcttgtcagcttcaccgtttacatcatccccgccctcgcccacatgttcaccttcaaatcacccgctgcccgacggaatgcggtggagcaacctccgaggtcggtgggaagatgggtgggtgcgtacaccatgaacgtatttgtggtggtgtgggttctagtggtaggctttggattcggaggatgggcgagtatggtcaacttcatacaccagattgacacattcggtttcttcaccaaatgttaccaatgccccacacccacttccatcaactcaaccgcgccttcccctcgtgctcactaa

SEQ ID NO: 115283 - DNA, 1923 bp, Glycine max
  Peptide Sequence Number=SeqID_232061
atggaccgtgacgacgacccttctgcacttgcatggctttgggtcattgaagccctgttaacttccaaagaaatcaccactcccactttgcagggtttcattgatgcggcacctgtgggacatcatagatttagtaaaaatacaaaggaattggtagccttgaggtgtttggagaaactgtccactcttgttgttgaccctgaagcttcttctaacttggattccagatttggattcaatgttttggggagttgtcaagatgtcctcaaagaaatattgggcaagatccctttatcaaatctgaaagtggctggagcagagctattgaaatgggatatttgcccatttattaagcacaaaagagctgtcacttttaaatgtcacttagagcagctgagagaatcgatcttcaaaaatactcatccagatactgattacttgaaagaaacaactagattatttcctcagaatagcagtagggtttgctctaagaggagtagggtttgctcggctgatgaaacagatttgccctctaagaggagttgggcttgctcagctgatgaaacagatcatgctaggaatggttatggggtagaaatatcaggtgatattgtgtcccaaggtgaaaagattaaccttgaaacgaaaaagcaggcagagcaaaatctttctttgaagtgtaatgaagaggatcgattactgatatgtgatgcaaatgttgtccaaccagtggttcctgaatatgttatgacaaccaccattataccccatcatacctctgtagctgagccttgcaataatacatctatggatgaaactgacaatactgcacatcatgccattccaacaaatgatgctaatgcagaaaataatcagcatattattaattttcaccaacccaaacagacagaaccagatattacatctttaaatctctctcagaagccagttgctagtgataaaactgtatttgatatggttaatggctgcagagctgagttgtctagtgatagtgatggatatcacaatggaaaaaatgatcttgaagcaaaaaaacatgaattcctgtgctccccctgcacggttgatcaagatttctcagcaatgactgaatcaattgaacaaaatcttcgcacggttgatcaagttttctcatcaatgactgaatcaattgaacaaaatctttgcatgaagtgtcatgaaggtggccaattattggcttgtaaaacaactacttgccctttgatggtgcataaaaactgtctaggtgcatctgctcaattggatgcaaagggcaactttttttgcccattttgtgcatattctcatgctatttcagaatatcttgaatctaaggaaaatgcttccttggcaaggaaagaattagctatctttatcagtaaaggaaaactgattcaagctgcagaatttgttcatgaatttcatagacaagaacattgtttttcaagaaagaacagtaagtgtgaacacattcatgttaaaaacaatgaagatgatcagttagcagggtgtgaagacaatagagaagatcatgttggtgagcatgcaaatgaagccaatgatcttcaatttgaaagaagtaagcaacaagcagaagttttaagagaagaggaaataggtaaaatgccaactgttggaagagttgaagaaagcgaagtgccaactgaccatgtagatggacatgttggtgataaatttgctagtgaaaaaacaaatattgctcctgaaagcaatgctgaagaagttccacaagaaatgacaaaacagcacaatattgatggaacaatagagccagtttgtgcacaagatactgggaaagagaaaatttctgaagatgaaagtgaaaagcatagtaatcctctatactcattgagattccgtaaacatgaaacacaatggtaa

SEQ ID NO: 115284 - DNA, 273 bp, Glycine max
  Peptide Sequence Number=SeqID_232062
atggaagaccaacactctctggacaactccaaaggaatgggacatctgattccaatggttgagttggccaagaaggagaatttccggtcaccacaaccctctaaggccgaaaccgctgtgcgatgcctacaaatggattggacatgtcttcaacagttctactcttcacgtttaaactgcatcgtcatagttgtctgttttggtagcggcggtaccttgtccagtgctcagattaacgaactcgctttgggtggggttggagatgatgagtga

SEQ ID NO: 115285 - DNA, 1605 bp, Glycine max
  Peptide Sequence Number=SeqID_232063
atgactgacggccccctatatgactccactgcttacgccgagtgcaaagagaagccagaggagccactttatggaggaggacttttcaacactcgtcgtggtgttgaaggcaccattgattcatcaatatcaaacgttgccaacaacagctatgtgccttcactcgttctgtataatctcactcagggcaccatttactctttttccgcatgggtgagagtaaaaggttcaagttcagctatggtaaggaccaccctggaaacggagaaagagacgcatgactgcattgggacagtttcggccaagcatgaatgctggtcattcctgaagggtggatttgttctgaattggtcttcaaatttatccatgatcttcttccagaacgctgatggtaaagatatcaatatagatgttgctagcccatcactccagccatttactaagcaacaatggagaatcaatcaacagtataaaatcaatactcaaagaaagcgtgccgtcactattcatgtgtcagatagtaacgggaggagattccaaggagcttccatctgtatagagcaaatctcaaaagacttcccttttggatctgcaatagcaaagaccattcttggcaacttaccctatcagaattggtttgtgaagcggttcaatgcggcagtgtttgaaaatgagctcaaatggtacgccacagaacctgatgaaggcaaggtcaattacaccatttcagaccagatgctgcaatttgttagaacaaacaatattatagcaagagggcacaacatattctgggaaaaccctaaatacactcctccatgggttcttaaccttacaggcaccaagttacaatctgctgtgaattctcgaatacacagtctcatgagccaatacaaagatgagttcatacactgggacgtcagcaatgaaatgcttcattttaatttctacgaggaaaggcttggacctgatgccacattgcatttctttgagacagcacatgaatcagatccattggcaacgctttttatgaatgacttcaatgttgtggaaacatgcagtgatgtaaaatccactgttgacgcctatatctcgcgggtaagagaactgcaacgaaatggcatcttcatggatggaattggcttggagggtcacttcacaatacccaatcctccccttatcagagccatccttgacaagttggcaacacttggccttcccatttggcttactgaggttgatataagcaagacacttgatagagatgcacaggcaaattacttggaggaagtgttgagggaaggcttctcacatccttctgtgaatgggataatgctttggaccgcatttcatccaaatgggtgctaccaaatgtgcctgacagacaataatttcaagaacctcccagcaggtgatgtggtggacaaacttgttgaagagtggcaaatcagtcgtgtagagggagtcacagatgtgcacggttcctatagcttttatgggttcttaggagaatatagaattagtgtcaagtatggcaataagactacaaagtcaacattctccctctctcgaggtgatgaaactagacattttactattacaatatga

SEQ ID NO: 115286 - DNA, 318 bp, Glycine max
  Peptide Sequence Number=SeqID_232064
atgcgggagaaggaagcagatgaagtggagccaaagggctatttgctgccatctctgcttggagttgaacgagtcccaggggacaagagccagccaatgccaatgacaagcagcttaactggactaactccattggacactccaccattcagcataccatctagcaaaaatggagttgaagcattggaagggtttgagattgcagaacaaaatgaaggtgagatttttcatttcttcttttcttatcagctatgtttggcaaagttaaattctggtattggaagattcaagaggccactagcactggcatggaagtga

SEQ ID NO: 115287 - DNA, 645 bp, Glycine max
  Peptide Sequence Number=SeqID_232065
atgaagacacctgaacctgatgctgccaaccaacccaactatggagctgcagctggcaataataatatcccggtgaaggtgataaaccaagtttttgatccaaattactcttacgggaaagtcctgatcaaagatttcattaagcccctccttcctaaggccactggtggaaacccaaacaccctcgctatagtcatagcctccaagggcgtgacagtgcaagatatgtgtgccggatcatgcgcccaacacggtcttattgaaaaccaagtttatgttgctgtgggggacccagaggaggagtgtcctgaatgcgcatggccattcctggcgaccaagggcaagacaggtgcaacgatgaaaccaccaaatgggaatgttggagcagatgtcatggtgaagttgttggcaggtggcttggccggtgcagtcacaaacccattctgggacgggttctacgcaaatgcacacggagaccatgtcttggaagccactagcaagtgccctgatatttttgcaacaaccaagctacccgtggaccctcgaaatggaggagcctttaatgctgttggcgacaagggtaccaagttcttgctccctgctatttggaaccctaaaacttcttcctgctggactcccctctaa

SEQ ID NO: 115288 - DNA, 243 bp, Glycine max
  Peptide Sequence Number=SeqID_232066
atggcaaacttcactaaaaatttcgtaccccattgcccggaggctcttcgctatgcgaagaagactcaatttgccaatgtatccctaccctccatcatcagtcaaagccatcagaaagcatgcaaaagatcatcaccattccccaaggtagctaaacaatttgccacaaagaaaggggtggattacaatgcaaaggctggcaacaacacaatctgcagtatcaaggctcaagccatatcataa

SEQ ID NO: 115289 - DNA, 474 bp, Glycine max
  Peptide Sequence Number=SeqID_232067
atgactaacgtggtggccagaaaagaggaagagcgtgcagagattgaaatgcatcaagaaagcattcttcaagttacctcaatccatcatcaattgaccaatgaagaagaaaagcatgaattctccagcaccctggaatatccctgcttggccactatcggctatgttggagggaaagataaaggtagattggaactcagtgtggaggataaaaaaatctcttttgacctctttgaagccatgaaacacttagatataggtgatgcctattttgaggaagaagaggtggagcaggaaatagcattatcagcttcaaccatggtactacagtcccctttggaaagagaacctagttatgggatagattgcttagtttgtgatgaagagcttgatgatccaaaagacaattgtgttgatcatgtggtttttgaagaattggaaaaaatgagaccaacagaaaagcccaaagcataa

SEQ ID NO: 115290 - DNA, 330 bp, Glycine max
  Peptide Sequence Number=SeqID_232068
atggatcaagctggcgaggaaaggaagttgcaactgagtgagttagatgaaatccgcctagaagcctacgagaatgccaagttctacaaagaaaaaaccaagaagttccatgatagcatgatagttaagaaggatttcatggtggggcaaaaagtgttattgtatatttttaagctgggactcatgagtgttgagatcaaaagcaactccacaaacaagagcttcaaggtcaatggaccccgacttaagtctttcctcccaaacccttctttagggaacgtagtgggggaagagacttccttactcccccctacacttcctttcccatga

SEQ ID NO: 115291 - DNA, 1674 bp, Glycine max
  Peptide Sequence Number=SeqID_232069
atggctaacattatgcggaatgctgatcctcccgcgctcctttcctgcaacttgttgttgttgtttttcattattctctttagttttctcccacaaaccatagcgctgcagtatcaagtttcgaaaacattcatcttcagaatcgattcagaatcgaagccgtcagttttccccacacactaccactggtacacctccgagttcgcagacccaacccgcatcctccatctctacgacaccgttttccacggcttctccgcagttctcacccaccaacaagtcgcttctctcggccagcacccctccgtcctcgccgtcttcgaggaccgccgccgccaccttcacaccactcgctcccctcagtttgttggcctcagaaaccagcgtggcctgtggtccgaaactgactacggatccgacgttatcatcggagtgttcgacactggaatctggccggagcgccgcagcttcagcgactccaacttaggccccattcctaaacgctggaaaggggtttgcgaaagcggcgtgagattctctcccagtaactgtaacaggaaattgatcggtgccagattcttctctaaaggccacgaggcaagcggcacttcctttaacgacaccgtcgaattccgttcgcctcgagacgcggatggccacggaacccacacggcgtcaaccgcggcgggccgttacgttttcgaagccagcatggccggctatgcttttggagtcgcaaagggcgtggctcccaaagcaagactagccatgtacaagttgtgttggaagaattccggttgctttgactctgacattctcgcggcctttgacgccgccgtggccgacggcgtcgacgtcatttctatgtccatcggcggtggcgacggcatttcctccccttactatcttgaccccattgccatcgggtcttacggtgcagtttcaagaggtgtgtttgtgtcttcttcgggtggaaacgacgggcccagtggcatgtcggtgacaaacctcgctccgtggttgacaaccgtcggagcaggcaccattgatcgtgattttccggcggaggttatattgggaaacggacgaagactctccggggtatctctgtactccggagagccgttgaaggggaaaatgtatcccttaatataccccggaaaatcaggggttctgacggattctctgtgcatggaaaactcattagaccccgaactggtaaaagggaagatagtggtttgcgacagaggaagtagtgcgagggttgcgaaggggttggtggtgaagaaagccggtggagtgggaatgattctggctaacggaatatccaacggagaaggtcttgttggggacgctcatcttcttcccgcgtgtgcgcttggtgctaactttggagacgaaatcaaagaatacattaatttctccgcgaaccccacggctacaattgatttcaaaggcaccgtggtgggaatcagaccggcacccgttgtggcgtcgttttcggcgagggggcccaacgggttgagtttggaaatacttaaaccggatttgacggcaccgggggtcaacattctggcggcctggaccggtggggttgggccttctgggttggactccgacaccagaagaaccgaattcaacatattgtcgggcacctcaatggcgtgtcctcac

SEQ ID NO: 115292 - DNA, 591 bp, Glycine max
  Peptide Sequence Number=SeqID_232070
atgatgacaaccgccacggtttttgacaacaccaacgctctgatgattgatcaagccaccgggaatgcttccacgccctatgattttggcgctggccatctcaacctcgctctcgcaatggaccctggcttggtttacaacattaccccccatgattatgtcaccttcctctgtgctattggttacgggcccaggttgattcaggtcattaccggatcgccgcccaattgtcctcggaggaggcccttgccggagaatctcaattacccgtcgtttgtggcggtcttaccggtgtcgtcgtcgttgttgagcaagacgttcttcaggacggtgacgaatgtgggcccgccgagtgcggtgtatcgggtgagggtggagacgcaggcggagggggtggcggtgacggtgaggccgtcgcagcttgtattttcggaagcagttaagaagcggagttttgtggtgactgtgacggcggatggacggaatctggagctgggtcaggctggggcagtgttcgggtccctttcgtggacggatgggaagcacgtggttcggagccccatggtggttactcaagctcaaccgctttaa

SEQ ID NO: 115293 - DNA, 1182 bp, Glycine max
  Peptide Sequence Number=SeqID_232071
atgacaagccacgaagaggatctggatctcctcctttcccttgacgagagagttgctgaaacccctccatcttctcccacaatctcagacgatgatgatgatgaacttgaacttcccaaccaaagggaaagggataaacccgacatgtccgttttcaaaagcgcccttcaggattgccttccttacgatccccccaaaccaactaacaaacccgttattaatgttgattcccaccttgaaaagttttcgggccttcgaataaggaaccaattgttaactcctgccgagcttaaggaacatttttcagacattcgttttgttcggctgtcggttatcaagaattccttagttggggatactgtttctggaagttgggccactgttggagtattgaccgagaaggggactcagaagacaagttcaacagggaagagctattgtatatggaaaattggctgtttagatgaaactactgtttctcttttcttgtttggagatgcttatcagatgaacatgcaagagcaggctggaaccgtctttgcactctttaattctaccgtccgcaaggataatgcgggtaatggtttttctttgagtatatactccaccagacaaattatgaagatgggcacctctgttgattatggagtttgcaaagggaaacgaacagatgggatggcttgtaccctaaaagcatcagagaagtattcctcaatgcgaactgaactcaagggaggaaacttaagaacagcgtttaggcctatgggttacctcaaatcagaaggaatttacttagttgaccctcttgctgacaaaacaaacttgaagaagtctcagcctgtgaaattattgtccgtggatggtatcagaaaggcattgagcaatgcaggaaaagtaacaacagcttctcattcgcaagggattaggtttctttctgaggttgcagccaagtcggatccaaaaatgaagaataaaggatcaaaatttccaaatgttcaaaacaaatggacagagaagaggaaatcatcttttccgaatgtgggatcctctccagtcataggaaaccgacagtcgggtgaaaagagaataaaaccagacgggcaggttttggctgataaaaccctaaagagaatagaaaagatgattgaaattgatcttgttagttcggatgaagacttctga

SEQ ID NO: 115294 - DNA, 5583 bp, Glycine max
  Peptide Sequence Number=SeqID_232072
atggaaactcggagtcggaagcgggcggaggcttcctcagctgccccttcatcctcgtccaccaccccttctcgttcagccaagcgctctcgtctttcttcttcttcttcttccatcctacctgttaatacacgttctcgttccgccaggaataacaacaacaacaacaactccggttccatttctttcatggaccccaccaatgaatcctccgggtcccgacgtgatcgccgtggcaagaatttcgatagggaaaattcggacaaagggaaggagaaggaacaggatgttaggattagggatgcggagcgggagcgagagcgagccttggcgttaaacatggagagtgaagatgttggggatgacgatgataatgatagtgacggcggtgtgggaattctgcaccagaatttgacgtctgccagtagtgcccttcaagggcttcttcggaaacttggtgctggtttggatgatttgcttcctgctactgctatgggcggttctgcgtcatctcctcatcagagtggcagactcaagaagattttgtctggcttgcgtgccgatggggaagaaggtcgtcaggttgaggcattgacgcagctttgtgacatgctctccattggcactgaagatccctcagcacattttcgggcgctaacccatttatgtgatgtgcttccttcatcctgtgctgctgttgtgcattatggtgctgtctctatcttctgtgcgaggctgctcaccatagagtatatggacttggctgagcagtctcttcaagcactaaagaagatttctcaggagcacccaactgcctgtcttagagctggagctctgatggctgttctttcttacttggacttcttctcaacaggagttcagcgggtggcattgtctactgctgcaaatatgtgcaagaagcttcctcctgatgcagctgactttgtgatggaagctgttccacttttgacaaacctccttcagtaccacgactccaaggtcctggaacatgcctctgtttgtttgacacgaatagctgaagcatttgcatcatctccagacaaattagatgaattgtgcaatcatggactggtaacacaagctgcctctctcatttctaccagcagttctggaggtgggcaggcttctctcagcactccaacatatactggtttgatccgccttctttccacatgtgcaagtgggtctcctcttggagctaaaacgttgcttctccttggaactagtggcattcttaaagatatactatccggttccggtgtttcttctaacacctctgtttcgcctgcattgagtaggccagcggatcagatatttgagattgtgaacctggcaaatgaacttctgcctccattgcctcaaggaaccatttcccttcctgtcagctccaacttgtttgtgaaagggtctgttgtgaaaaaatcctcttctggcaattctgggatacaagaagacacaaatggaaatgttcatgagatattggctcgtgagaaattattaaatgatcagcctgagttacttcagcaatttgggatggatctcctcccagttttaatgcagatatatggtgctagcgtcaatggtccagttcggcacaaatgtctttctgtcattggaaaattgatgtatttcagcacagctgagatgatccagtctttactgagtgtaacaaatatatcaagtttcttagctggtgtgttagcatggaaagatccacatgttttggttcctgccttgcaaatttcggaaattcttatggaaaagcttcctggaaccttctctaagatgtttgtcagagaaggtgtggttcatgcagttgaccaacttattttggctggaaattcaaccaatatatccacacaaacatcatctgctgagaaggataatgattctgtatctggaacttcatctcgctctagacgctatcgcctgcgcagtggtaattcaaatcccgatgcgaacccttcagatgatttaaagagtccagttccagtaaatgttggtttgccaccaagttctgtagaaactccaacaactaattctagtatccgtgcatctgttagctcagttgctagagcttttaaagacaagtactttccttctgatcctgggtctgttgaagtgggtgttagtgatgatcttttgcatctgaaaaatctatgcacgaagttgatcactggtgttgatgaccaaagaagcaaggcaaagggaaaagttaaagcttctggatttggtctggatgataattctagtaacacagaagagtatttgattggggtgatatctgacatgctaaaggaacttggcaaaggagatagtgtatctacttttgaatttatcggtagtggtgttgttgaagccttgctaaattatttttcttgtgggtatttctctaaagatcgaatatcagaaaccaatctccccaagcttcgccaacaggcactttcaaggttcaagtcatttgtagctgttgcactacctttgagcattgacaatggggctgttgctcctatgactgtcttagttcagaagcttcaaaatgcgttggcctccttggagcgtttccctgttatgctgagtaattcatctcggtcatctagtggaagtgcacgtctctcctctgggctaagtgcattatctcagcccataaaattacgtctctgccgagcccagggtgaaaagtcacttagggattattcatccaatgtggtactgattgatccattagcaagtctagcagccatcgaggaatttctatgggctcgtgtccagcgtggtgaatctggtcagaagtctactgtaggcactgaaaattctgaatctggaacaactcctgctggggcaggtgtttcatctccttcctcttatactccctccactgcccatcgtcattctactagaaccagatcatctgttaatataggagatacacctagaaaagaaacatctcaagacaaaggaacgagctcatcaaagagcaagggtaaagctgtattaaaacctgcgcaggaggaagcgcaaggaccccaaacaaggaatacagtgcgcagaagagcagctcttgataaagtcgctcaaatgaaacctgcaaatggcgactcaacttctgaggatgaagaattggatatatctcctgttgaaattgctgaggctttggtgattgaagatgatgatatttctgatgatgaggatgaagaccatgaagatgtgctgagggatgattctcttcctgtctgcttgcctgacaaagtgcatgatgtgaaattgggtgactcagctgaggagagtactgttgctccagcaacaagtgatagccagactaatgcagcctcaggttcaagcagcaaagctggtacagccaggggttctgactccgctgattttaggagtgggttttcatctagctcaaggggtgcaatgtcatttgctgctgctgctatggctggacttggatatgctaatagcagaggtttcaggggcggcagagataggcatgggtgcctgttgtttggtagttctaatgatcctccgaagttgatttttactactggtgggaagcagcttaataggaatctgagtatatatcaggcaattcaaagacagcttgtgctagatgaagatgatgatgagagatttgctggcagtgactatgtatctggtgatggaagcagtctgtggggtgatatttacaccatcacttatcaaagggcagaaaaccagccagataaggcgtctactggaggatcaagttcaaatacttcaaaatctgccaaatctgggtctgccttaaattcaagctcagaagctaaattgcatcagacatctgttctagacagtatattgcagggagaattgccatgtgatctagagaaatctaatcccacctacaatattttggcactcctgcgtgtgctggagggtttcaaccaacttgcgcctcgtttgagggtcctaatggtttctgatagctttgccaagggaaaaatcttggatttagatgagctatgtgttacaactggtgctagggtgcttctagaggaatttgtaagtggtaagcttactccaaaattggctaggcaaatacaagatgcccttgcactatgcagtggtaatcttcccttatggtgttaccagttgactaaagcgtgccctttcttgtttccttttgagacccgacgacagtacttttattctaccgcatttgggttatctcgtgcactgtatcgacttcaacagcagcaaggtgctgatggccatggttcaacaactgagagggaggtgagagttgggagattgcagcgccaaaaggttcgtgtctctcgaaatcgtgtcctggattctgctgcaaaagttatggagatgtattctagccaaaaagctgtacttgaagtagaatattttggtgaagttggcactggtctgggtcccacccttgagttttatacaattctaagtcatgatttgcaaaaagttggactgcaaatgtggagatcttattcttcagacaaacatcaaatggaaatagatggagatgaaaagaaaaagaaaagtgaaggctctgggcctaatttggctggagatggagaacttgttcaagctcctctggggttgtttcctcggccatggcctacaaattctgatgcttcagagagtagccagttttcaaaagtcattgagtatttccggctactaggtcgtgttatggctaaagctcttcaagacggacgactactggacctgccattgtcagtggcattttataagcttgttctctgccaagatcttgatttgcatgacattctgttcattgatgctgagcttgggaagactttacaagagttcaatgcccttgtttgtcggaaacattatatagaatctattggtggtagctatacagatacaattgttaacttgtattttcatggtgcaccaatcgaagatctttgcttagattttactctccctggttatcctgaatacaccttgaagccaggagatgaaattgttgatatcaacaatttggaggagtatatatccttggtgatcgatgcaactgtcaagactggaatcatgcggcaaatagaagcatttagagcagggtttaaccaggtttttgatatctcatctttacaaatttttactcctcaagaactagataatttgctttgcggccgcagggagttgtgggaggctgagacacttgctgatcatataaaattcgaccatgggtacaatgcaaagagccctgccattgttaatttacttgaaattatgggagagttcacaccagagcagcaacgtgccttctgtcaatttgttactggtgcacctaggctgccacctggagggctggcagttctaaatccaaaactaacgattgtgaggaagctttcgtcaactgcagttaataattcatctaatgggaatggaccttcagaatcagcagatgatgacttgcctagtgtgatgacatgtgctaattacctgaaacttcctccttactctaccaagaagggaaaatggtgcaatgaaaatggtctccaaataactgtggcatcataa

SEQ ID NO: 115295 - DNA, 410 bp, Glycine max
  Peptide Sequence Number=SeqID_232073
tgagggtttcagaaatccagaaagtgttggacataagtggagtgcagacatatgtaatcaacagtgctcgagttttgttcctgaatgtgaggcctcagccaaaatctggaaaaggagtagctcacatttgtgagatttgcggaaggagcctcttggacccatttcggttttgttctttgggatgtaagcttgaaggaataaggaaaaatggggatgcaagctttgctttggatggtaggaatgaagaattaacaatggatacttcaagaggatcagtctcatcaagacagcaagaagaagaattgcgtgaaggttcaacacaagacatgtatccagccacgccttctccatctgcttcaaattcaaggagaagaaaaggcatacctcatagggcaccttttggctcctaa

SEQ ID NO: 115296 - DNA, 1080 bp, Glycine max
  Peptide Sequence Number=SeqID_232074
atgaaactcttggaaaaggatttcgcggtgaaccaaaccggaactgcgaagctcgtggccgaagaacccgacgacgtgtggctcctctacaacctcatcctccccggcgacatcgtttcgaccgacaccacccgcaaggtccacctcgattcctccgccaagaagaacaccgcctcacgtgtgaaactcaccctcgacatcaaagtcacgtgccgtgacttccacaaagactcctccactctccgactccacggccgcaacctccaacccaaccagcacgtcgccgccggctccttccacaccctcaccctcgaaccccacaaacccttccacctccgcaagaagctttggcaaaacgacgccgtcgaaaccctaaacgaatccaccgagaattccaatcccaataccaattcccccgacctcgccgtcgttctcttccacccgcaccatgcggagattcaccttatcgcacagggagtcgccacgcgctgcaccaagatcgaaccctcttcaaactccagaaactccgtgtatttccgacaggtgttcgcggcgttcgtgaagcgcgtggattttaaggttgtgaagcgcgtggtgatcacgagcgaggagtttcgtaggtttgtgatgtcggaagcgaggaagtcgaggatgcggtcgatcgaggagaaccagtcgcgaataatggtcgttgcgggcggtgatagtttggagaaagtgatgggtgaccgggcggtgatggagttggtgaaggacaagaaggtggcggcgtttagagagttgtgggagatggtgtgcgacgattcggaccgcgcgtgttatggacctgcggaggtggagcgtgcgcgtgagatgagggccattgagacacttctgataaccgatgatctttataggaacgaagatgttgagacgagaaaaaagtacgcgagtttggtgaagtcggtgaaagagggtggaggaaaggctttggtgtattcgtcgatgcatgtttctgcaccgcaactcgctcaactcacgggtgttgcggcaattctcaggtttcccttgcctgaactcgaagatgtaaatgggtgctga

SEQ ID NO: 115297 - DNA, 867 bp, Glycine max
  Peptide Sequence Number=SeqID_232075
atggatgagattgaaggcagtgagcgtgggaagacgacaaccgttggatgtaatttggagatgttgtttggagcttacgcaactttggagcttgaatcttctttgcgtctctacgttgccacaatacaactctccaagcaacaatcacaggatggttcttcgcagtcacagtcgtggtatccgccgtcggtggtgagttcaccaacttcgtcgaggcctgttacaccgactgcatcttcttcttcattatcacagaggccttcgtctcatgttccaccttctgaagctgctgcagttattgccgttttgaaggacaagagtgttgatgagttgcggaagcttttatctgacaaagatgcgtatcaacagtttttgcattcacttgatcagctgaaagatgaactttgcaaggagaatttacagcttgcagaggaaaatcttcaaaaggaacctcgtatcatggaacttaggaatcaatgtagaataattcggacaaccgagttagctgctgctaaggagaaactaaatgagcttgagaagcagaaagaagacatgttgaaattgaattccgcagcatcccttctccaaaggattcaagagtctgtgaataagaccgacgaggaatctgaaaacttgcaccacaatctccttgacagagagattgaccttggtgcttttttgcaaaagtacaagaagctacgtaccacttaccacaggaagactctcgtacatcttgctgccaaaacatcaacacctgagattgttcattgtggtgacattgtcgagtggtttcatgccacttggaatgagtgtgctgtagcttatgagatcatcatcgccgatataggatttactgttgtgttgtaa

SEQ ID NO: 115298 - DNA, 204 bp, Glycine max
  Peptide Sequence Number=SeqID_232076
atgggatttaagctgcaggaggacacagctgttctggtacctccttggcttgaacaacttcttcacacacctttcttcaacgtgtgtcggattcacgcagaggccgctagaagcgagtgtaatatgttttgcctacattgcaatggcgaagccttttgcttttattgcagttcttcaagacacaaagatcatcaagtcattcag

SEQ ID NO: 115299 - DNA, 1158 bp, Glycine max
  Peptide Sequence Number=SeqID_232077
atgcggggtggtgtttccctgttgttggcgttagcctccgtggcggcggcggcgacggtgtcgtgcggtggtttggcggggacttttcttcctctggaacgggccattcctctgaaccagcaagtggagctggaggcgctgagagctcgcgacagagcacgccacggtcgaatcttgcaaggtgtcgtcggtggcgtcgtagacttctccgtccaaggaacctccgatccttacttcgttgggtacgggttgtattttacgaaagtgaagttgggatcccctgcgaaagagttttacgttcagattgatactggaagtgacatcttgtggataaattgcataacttgcagtaattgccctcattctagtggattggggattgagcttgatttctttgacacggccggctcgtccactgctgcgcttgtttcctgtggggacccgatatgttcgtatgcggttcaaactgcgacaagtgaatgctcttctcaggctaatcagtgcagctacacttttcagtatggggatggaagtgggactactggttattatgtttctgatacaatgtattttgacacggtcctcctcggacagtctgtggttgctaactcttcatccaccatcatttttgggtgtagcacctaccagtctggggatttgaccaagacagataaagcagttgatggaatttttgggtttggccctggtgctctatctgttatatcacaattgtcatcacggggtgtaacacccaaagtgttctctcattgcttaaaaggaggagagaacggaggaggcgtgctagttcttggtgaaattttggaaccaagtattgtttatagtccacttgtcccatcacaggtaatgacttctatttcattgcatttagccaagtatgttgattttggccgtattcttgttataaaagcaatggctttggaaggcacagttacatgccatatccttggtaaatggcatgaatcaaccaggaagtggcctcattacaacttaaatcttcagagcattgctgtcaatggacaacttctcccaattgattcaaatgtatttgcaacaactaacaatcaaggaacaatagttgactctggcacaacattggcataccttgttcaagaagcttacaatccttttgtcaaagct

SEQ ID NO: 115300 - DNA, 2976 bp, Glycine max
  Peptide Sequence Number=SeqID_232078
atggaggcgcttcaaggtcacaaagatgatttccctgcagcttcagcaggagtgggagatagcggtgaatcattatgctggtgtgatgacagcaaattggatttcaaacaatttgttgagaccatttctgttctttatcacccgtatctcaactcagcatcagaaggtccacagcaagagaatagattctatgaagctgtgctttacaatcctactggaaagcctgaaatcttctgggctcaagatattactattgtcacatctctagctatgcgtgttcttgtaatgttaactgatctgaaaggatggaaaggcattacagatgacaaccacttagatgcagatttagcagtgaaagatttaattcagttcctgggggagaaagttttgatggagatgttggagttcgtcaaatcagaaatacttgtctctttcaaggctattccaccagttggttgggccctcactaacagtatatgcctagcaacagggaatgagaatgaatccttcaatcaaggtttagagtatgcattgtatgtccgtgttgttattactctagcagaggccctactggcttgtcttgataatattggatgggtcaaaaagaaaaagaaagcccttcaaattgatgttgaaagttcaacacagccagttgatacagttcggcatgagggtgaagcaaccgatgaatccataataatgtcatacatggatcaatttaggcctgtttgtcagcagtggcatctcaaaaatcttttggcatcaatagatagagatgccaataacaaggctgcgactgtgatctcaaatgacctggcatgtctggggaagctagaattgtgtgatgttgcacttttttattctaacttacttagaatattttcagttttgagtccaattcgtggcccattatcagttctcaacatgctagcattcactcctggatttcttgtgagattatggggtgtactggaggattcctttttttctgaagacaaaaataattctgataatcacacaagtgaaagcagcaaacacaaagcctttgagaagatgcaaaaacatgtcagtaaagatggggctaataagtgggtcaacgtacttcataaatttacaggtaggtcacaagcagcgaccgattgcatagattccattggcagtcactctgagcctagcagagtgaatgacgattcatcagatgtatgggacacagaacctatgaggcatggcccacaaggcgttccaaaggatatgtttgccatgcttcatcttttctgtgcaacctattctcacctgcttttagttcttgatgacatagagttctatgagaaacagagcagcaaagaagaattgcgtcaatgctcaataccttggtttataatggcttgtcccatacacccattttgccctcctgctttgtggctttctcctgctagaaaaagccggccaccaattgcagttgctgccagaactcatgaagttttagcaaccaacctgagatctgatgattcatcagcttcactgagtgtaggttctgttgtcaccattgttcctcatgttttcccttttgaggaaagggcgagccctggtgcagcggtaaagttgtgccttggtgacctgttggtcgtgggttcgaatccggaaacagcctctttgcatatgcaaggagttgagatgtttcgtgaatttatcaagatggacaaagcatcccgaaaaatggctggtgaaatttctgaacctggttcacgggccattgagatagtaatacgtcggggccatattgttgaagatggatttcggcaattaaattcccttgggtcaaggttgaagtcatccatccatgtatcatttgtcagtgaatgtggtcttcttgaggctggcctggactatggtggattgtctaaagagtttctgactgacatatcaaaagcagcattttctcccgaatatggactcttttcccaaaactcgacttcagacagacttctaattccaactgcatctgccagatatttggagaatggtcttcagatgattgaattccttggaagagtagtgggtaaagctctatatgaaggaatattacttgattactctttctcccatgtctttgtacaaaagctattgggacgatatagctttcttgatgaattatcaacacttgatccagagctatacaggaaccttatgtatgtcaaggggagaggcttagactttggatttttgcactggagagctctgagactcggtgtgtcttttccttctgccttctactccttttataggcctaagccctgggcttttccttgtggaccttctcgtgctaagcctgaccttcgcgctgagcgagacttggcgttgagcttggcttcgcccgttgagcgagagttgcgcgctgagcctgatttgtgcactgagcgaaattatgacggtgatgtcaaggagctctctcttgatttcacagttactgaagaatcattgggcaaaaggtatgtggtggaacttaaatctggtggcaaagatatttctgtgacaaatgagaacaagatgcagtacatacatgcaatggcagactacaaactcaaccaacagatattgcccttttcaaatgcattttatagagggttaactgatcttatatctccagcctggttgaagttattcaatgctagtgaatttaatcaggtaattaaaggctttgaacctaaagagcgctgtatgcttcttaaatttgtcaccagttgttctcgtgccccattacttgggttcaaatacttgcagccaccttttaccatccacaaggttgcatgtgatgttcctctttgggcaacaattggaggacaagatgtagatcggcttccatcagcttcaacctgctacaatacccttaagcttccaacatacaaacgtccaggcactttgagagcaaagcttctatatgccatcagttcaaatgccggatttgaactttcttga

SEQ ID NO: 115301 - DNA, 771 bp, Glycine max
  Peptide Sequence Number=SeqID_232079
atggcgtcgagacggcaattcaaggaggagagagcggaggcagcggccaaactggcagcgaaagacatcggcgatatcaacagagcaaacgagcgcgacgaggggtacgacttgcggaacgaagccaacttcaagcaagcacgagcggaggcagctgcaaagctcgccgcgaaggatctggaggacgctaacagattaagggacagcactctaatcaacactacatgtcatgatcacgatgagaacaaacccagtttgatagggtccatgttaagagccgccaaggaagccgtggttggcaagcctcaccacgacgaagttgacaacagctcagggttttatgagaaggccaaggaaacaaaggtcgacgcggctgggtccaagatgggtgaatacgcagattatgccacacagaaggcgagggaaacgaagcagaaggcaaaagaagcaaaagactatgctgcggataaggctaaggatgctaaagatacaacagtgcaaaccgctgctaaaagggctatcggtttcttctcggggggcaacaaagaccaaacaaaggaggaggaggaaacgagtcggagaatgcaggaggtgagggtgcaagataaggaatacggaacgggacggggtggagagaagttggtgataaaaatggaagagtcgaggccaggagcggtggcggatgcgctcaaagcagccaataaggccatggacggcgttatggaggaagaaggcgtgcttcatgtggagcgtcgtagagagaaaatttga

SEQ ID NO: 115302 - DNA, 840 bp, Glycine max
  Peptide Sequence Number=SeqID_232080
atggcaggcagcggcggcggcggcctccactgcaaatccttcttgaagtcttccctttctcctccatactccaaaccaccgccctccctctctctccgtcatggcaccctccacgccacgctcctcaaacgcgaccaagacacccatctctccacttacctcaaactcaacctcttcccccacgctcttggtctttgtggaactcttggtcatcttgatatgggtaagcaaatccattgccatgtggttaaacgtggcttgggatgtaatttggaagttggaaatgcagttgttagcatgtattttaagtgtgggagtgtggatgatgcaatgaaggttttcaatgatatgccttgtactgatatagttacatggaatactttgatttctggcaatcttatgcacagacagggggatagagcattggaaatatgggtggagatgctgcaggagggcatgaagcctaaccaagttacatttgttttgatcatttcagcttacaggaaaactaacttaaatttggttgatgattgtcgtagtttgtttaattcaatgagaactgtttatcaaattgagcccacatccaagcattatgcttccttcatcagtgttttgggttactggggtcttctgcaagaagcactagaaactatcaataacatgcctttccagccttctgctcttgtttggcgcgctttgcttgatggttgtagattgcataagaatgcgttgattggaaaatgggctgctcagaatattcttaccctagaacctaaagatccttcaacatttatacttgtttcaaatttgtattctgcttctgggatgggaccgctctga

SEQ ID NO: 115303 - DNA, 825 bp, Glycine max
  Peptide Sequence Number=SeqID_232081
atgtatcatggaaaaccactatatgttgctcttgctcagaggaaagaggataggaaagcacaattgcagctccagtacgcacaacaactggcacgactatctggaccttcgactgccattatccctagtggatatcctccttactactatgcagctagtggcgttatttcacacgtgcctcctcgagctgggctgatgtatcaacatctggcattgagaccgggatggggggctaatggctttgcaccccctgctagatcatttcaacaatcaccagttcctgcagtttctaacaatactaggcagcataggcaaaacaggggcaagttgaatgggaattcaatagcacagggaaatactcactctggtacttatttaccacaagcccagcagatttctcagccagtgatctcttcaagagattcaagtactcagcagagaaccggacaggctaggtacatacctagtggacgccagcgtgatgtggaaaaaggatctggatcctcatctgttggttcaaactctggcagaggaggatcccaggggtcagaaatgctgcatagcttgcttgctggtgctgctcctgagcagcagaaagagattctcggggagcatctttacatgcttcctaccctagcagcaaaaataacagggatgcttctggagatggacaatggagaattactgcttctcctggaatcgccagagtctctttctgccaaggtggaagaagctgtccaagtgcttaagaactctaagaccaaagtttctggccaggacgtacttcattcaaatttcctttcagctgaggttgcagttaactga

SEQ ID NO: 115304 - DNA, 1902 bp, Glycine max
  Peptide Sequence Number=SeqID_232082
atgattgctgaatcaaacatgagacccaacttccatttttgctatgcctttcttcttatccttgtccttggccatcacacttcttcacagaagacttgtacaaattgtggctctatgcaagttccgtaccctttgagcacagattcaacttgtggtgatccacactacaagcttcgttgtgatccccactctcaaaggcttttcttcgacaccctcaacggaagttcctatcttgttctaagaatcatgtcttcaaaccaacgcatggtggtagagccatcaccttggttaccaggttcatgtgtcacacaagacatgcctagaagcaatggtatatggttaaaccagtcactccctttcaacataacttcatccaacacagtgttcctctttaactgttccccgcgcctcttggtttctccacttaactgcacttcttctagtatttgccatcgttatttggagaattcaggccatgttgacacaaaaagagcacttgagtgtgcaaatgatcttcacccttgttgcacttttctagctggagggataccttcagcttacagaatcaggcttcatgattctggctgcaaagcattcagaagcataattcatttgaaccaagacaagcctccgaatcagtgggaggaagggcttgaaatccaatgggctcctccacctgaaccagtgtgcaagacacaaagggattgctctgaagactctaagtgttcccctacaagtagaaatggcctatttcgctgtctttgtaatgggggacacatttggaacccttttgaagcaacctgtgtcaggtatgagagaaaatccaaatggaaaaccagcttggtggtctcaataggggttgttgttacttttttctctcttgctgtggttctgaccatcatcacaaagtcctgcaaactctctacctataaagagaatcaggccaaggaaagagaagataagctgaaatcaagtgctgtggagaagccttgcaggatgtttcaactgaaagaggtgaagagagcaacaaacggtttttcccacgagaggttcttggggagtggtggctttggggaagttttcaaaggtgaattacaagatggaacattggtggctgtgaagaaagctagagtgggaaacctgaaaagcacccaacaagtgcttaatgaggttgcaatactctctcaagtgaatcacaagaacctggtcaggctcttggggtgttgtgtggaatctgagcttccactgatgatctatgagtatatctcaaatgggaccctctatgaccatcttcatggtaggtattgttccaactttctagactggaaaacaaggctcaaagttgcttttcaaactgcagaagcattggcttacttgcattctgctgcacacactccaatctaccatagagatattaagtcaacaaacatactattggatgatgaattcaatgccaaggtctcagattttggactctctagattggctagcccaggactgagtcacgtgtcaacgtgtgctcagggaacgttggggtacttggatcctgaatactaccgcaactaccagttaacagataaaagtgatgtttatagttatggggtggtgttgctagagcttttgacatcacagaaagcgattgacttcaatcgtgatcaagatgatgtcaacctagccattcatgtgaaccaacatgccagcaatggtacaatcatggaagtggtggatcaaaggcttcttatttccgtggagaccttgttgggggataaaatgttcacaagcataaaactcttcttggagcttgcacttgaatgtctaagggagaagaaaggtgaaaggcctaatatgagggatattgttcaacgcttactatgcataattaggattgtagaacaagagtga

SEQ ID NO: 115305 - DNA, 219 bp, Glycine max
  Peptide Sequence Number=SeqID_232083
atggccattgatctttttagtcaaatgggaatgagaggagccaagtttgattctaaaattgactgtatttacaacaatgcagttatggagttgatgagtggtgttagaaatcagttaactgaactcatatttggtctagctattcaggacatggctccaatgagctggggtttatctcacagcttatccagatacaaattgaagttaagcgcagagtag

SEQ ID NO: 115306 - DNA, 645 bp, Glycine max
  Peptide Sequence Number=SeqID_232084
atggattggcatcatggcacaaaaccatttgttcctcggccagagaccttaagcttcttctacaactatgacaacaacaactcatatccaggagtggaagtgaaacaagcggcattgatggagacaggagaaaggtcggttccggcaatggaccgtggaaacaaagagaagaagaagcggttaacaaataaccagatagagttattggagaggagttttcaggaggagataaagttggaccctgaaaggaagatgaagctttcgagggagctaggtctgcagcctcgccaaatcgctgtttggttccaaaatagacgtacaaggtggaaggccaagcagcttgagcacttgtacgatatgcttaaacaccaatatgatgtcgtctccaacgaaaagcagaagcttcaagaagaggttattaagttgaaggcaatgctaagtaaacagcaaggttattggacgcaaaaatttggaggttatacagaaatatctggggaagaaacagtagaaagcacgtcagagggtctaaggggaaagagtaacattgagcatgttgcagatcaaggctactgttctttcgctgtggaggattataacaccactgtttcactgcctcactgccactggccagttgtgccttattag

SEQ ID NO: 115307 - DNA, 1701 bp, Glycine max
  Peptide Sequence Number=SeqID_232085
atgtccaccaaaggcttcatcatctatctcctatcctctttctctgtcgcgcttctctctgcgttgttactcccccgaaccagcaactacaaacattattcgtcaatatctcctccctcgcatgattatggattcggaaacgataaactttggcccgaattgaaggtgggttggagagttgcgttggccacagttattgggtttctgggatctgcttttggaaccgttggaggggtaggtgggggtggcattttcgttcccatgctcactctcattgttggttttgataccaagtcagctgctgctctttctaaatgtatgataatgggggcgtcaacagcgtccgtttggtataacctgagagtgcctcatccaaccaaagaggtacctataatagactatgatctggcccttctttttcagcccatgctcatgcttggtattactgttggtgtcgtcctcagtgttgtcttcccctactggctcatcaccgttcttattattattctcttcattggttcttcttcaaggtctttctttaagggaactcagatgtggagggaagagactcttctcaaggcagttctaattgacacagaatatgagcagttgtttcctaaagaagagaaatcatctatgaatgatgtaaagatctgcagtgtatggtattgggtgcttttctgcttacagtttcctattgcacttttggtgtttggctacgaagcagtgaagttgtacaagggtcacaaagagagagtgagcacaggaaacccggaatccatatgtgaggcatcaattgaatggactgttctgcacattttattttgtgcactatgtggaatcttaggaggaactgttggaggcctacttggttctggaggtggcttcattttaggccctcttctcattgagattggtgtcatccctcaggttgctagtgctacagcaacgtttgtgatgatgttttcatcatctttgtctgtggtggaattctaccttctcaagaggttccccattccttatgcattatacctcaccgcagtgtctgttttggctggcttttggggacagtattttgtaaggaaattgatggtaattcttaaaagggcctcaatcattgtattcatcctctcaggggtcatttttgctagcgctctcaccatgggtaaaggtttacaccgagcagccacacctcccgcagcagccatggttctcaaaactgaactatgccgattcagtggtgccaagatctacccaggaaagggcatcagatttgttcgtggtgattctcaggttttcctgtttgcaaactcaaaatgtaagaggtatttccacaatcgcctgaagccttcaaagctcacctggactgcaatgtacagaaagcaacacaaaaaggacattgctcaagaagctgtgaggaagaggagacgtgctgccaaaaagccttactctaggtccattgttggtgcgaccttggaagtaatccagaaaaagagagctgagaagccagaagttcgagatgcagctagggaagctgctcttcgtgaaattaaggagaggatcaagaaaacaaaggatgagaagaaggctaagaaagcagaagttgcttccaagtcgcaaaaagcaggagggaaaggcaatgtttctaagggtgctatgcccaaaggtcccaaacttggcggtggaggcgggaaacgctga

SEQ ID NO: 115308 - DNA, 294 bp, Glycine max
  Peptide Sequence Number=SeqID_232086
atggtattgtcccttcacaacaccttagaagatatgaaagaaagagctctgtatcgggtgacaaaagaggatgcagagtcgtgttgcgatgaaaacatgagaaacagggcaatggaagaaggaacaggagaaaacagactgtgcggtggtggtggcgctggtggggtagaagaggttgagcaaattaggaaaaggacaatggattgcaaatgttacacctctgttcgtgtaaaacttgtgagccttttctgcaagtttgccctgtttgtagtatgcctaaaaagtctagcatag

SEQ ID NO: 115309 - DNA, 282 bp, Glycine max
  Peptide Sequence Number=SeqID_232087
atgggaagggcgaggtcccacataaagaagttaagaacatatttggggatcgtcgctcatgataaggtcgatgtcacatacgagaattggaaacaagtccctgctaatcagaaggatttgatatgggaggatattcaactgaatttgatatccctgaaatgggcactttcagccgacaaggaaagtgtcgatgacactgtatgcgaaaagtacgacattagcaaggagaagtggacccaattttgtcagacccgtaggcatatggctgagacaagtatgtga

SEQ ID NO: 115310 - DNA, 198 bp, Glycine max
  Peptide Sequence Number=SeqID_232088
atgcagaattcaaaacgggatgtgtacctaggagcctacctgaatggtataataacctatattggtctccactgtagggcacattggcaaatggtcatcattttgcctaaggaaaatgttgtcatctgtgctttgaaaggacttgatgatactccacaaagtaaatccaagactggtgctaggtggatttttgttgaa

SEQ ID NO: 115311 - DNA, 345 bp, Glycine max
  Peptide Sequence Number=SeqID_232089
atgatcgaccctcttgatgagtcaatctcttgcattctcataagggtggacccgtgggtacacgccctcaccttcagagggctgcacgccctcaccttcagagggctacacgccctcgccttcagaggactacatgtcctcacctttagagggctgcacaccctcaccttcagagggctgcacgccctcgccttcggagggctacacaccctcgccttcagaggactacatgtcctcaccttcagagagctgcatgccctcaccttcagagggttgcacgtcctcgcctttagagggctacgcatcatcactttcagagggctccatgtggcgtccctaaattaa

SEQ ID NO: 115312 - DNA, 557 bp, Glycine max
  Peptide Sequence Number=SeqID_232090
ggcgtgtttggggatggtggtggttctcctcagtcaaccctgagcgtgtttgagaacagcggcaaagggtcgagtccaaacgacgccgttccaccccacgtgaactcctcgtccacgtgggatctcctccgcgccgccgcaggagaagtcgagaggatttgcgacgaaagctgtaaccgttacggtcaaaactttctgacaccctcttccattgatgcttctgttcaacaacccaatgccgttaattgcgctaacggcgttgggttgggattttaccctcaacagaagcagcaccaacaacaaccatcgctttgtcaccagcagttacagattgctcaatttgagatgatgaagaagcagcaacaacataggcaaatggtccctcccaacagaggaataaacaacaacaacaacaacaacaacaacaacgttgttacggttgggaacgttgttaatgggttgggtttgtctggttctgcatgggttcctcctcctgggtctcgcatgagggctgtttttctcgctgggaaaatagaaaaaagcaccggaactggcgt

SEQ ID NO: 115313 - DNA, 261 bp, Glycine max
  Peptide Sequence Number=SeqID_232091
atggtgacgcgggttatgctcaggaacggatttgagcccagaatgggtctaggtaaggacggcctcaggaatgccgacatggtcgatatcaagggaaatccatacaaatatggattagggtatgaacccgggatgccggggaggaggaatgtgccgtcaagacttcgggtggatagggaaaatcctcactataaagtcctgaatggccagttcacaactctattcggagtcatttctttcttaccgctcataattctctaa

SEQ ID NO: 115314 - DNA, 543 bp, Glycine max
  Peptide Sequence Number=SeqID_232092
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaaaccgcagcgtcagctttcaacccaggacaggattatcctcaggggctgccaggcctcagccagatatgtggcaacactaggcctaaatacagagcaccaatcaggtgggtaaggctgccccctccaggcaggccaggagcactgatcaagcttatcgataccgtcgacctcgagggggggcccgcggagtgtatactggcttactatgttggcactgatgagggtgtcagtgaagtgcttcatgtggcaggagaaaaaaggctgcaccg

SEQ ID NO: 115315 - DNA, 227 bp, Glycine max
  Peptide Sequence Number=SeqID_232093
aacctttcacaggcttcctggtcgaatctggctgggctgcaaaccctagcgtagattgtgaggcacaaaatgcaataccaaagtccaaacacacgtcgtttgttcaggaccagaatcaacgtcatcatcatcatttcgatggcgaagtagttatgcatgcatgtttcgggtttgtttgggaaattttggtggcaatggtggtgcccgtggtggtgcagtggcaatga

SEQ ID NO: 115316 - DNA, 684 bp, Glycine max
  Peptide Sequence Number=SeqID_232094
atggcggaatgtacatccactcccaccaacagcagtctcaggttaacagccaaagtagccattgtcacaggaggtgccagtggcatcggcgaagcaacggcgcgtgtctttgcggagcaaggcgcgcgtatggtggtaatcgcagacatccaagacgatctggtgaatcgagtggcagcgtccattggcactcacaggtgcacctacgttcactgcgacgtggcagacgaagaacaagtcaaatacctcgttcaaacaacggtcaatgcgtacggtcagattgacatcatgttcagaaacgctgggatcgctagtccctccaaacagacagtatccgaactcgacatgtcccaacaactgttcgcggtcaacatgcatacgtggaatagcggcgtgcgtgaaacacgcagcgcgtgcgatattggaggggcgcgtgaggggaagcattatttgcacggcgagcgtgcacgcggtgttggggttgatgcgttcggcgagcgtgcagcttgcggaacacgggataagagtgaactgcgtctcgcccaatgggttggcaacgccgttgacttgagtggttctcacgcccaaagacgtggcagacaccgtgttgttgtctccgatgactccgcgtttatcactggctttgatcttatagtggacggtggctttaagtatggccagtga

SEQ ID NO: 115317 - DNA, 399 bp, Glycine max
  Peptide Sequence Number=SeqID_232095
atggtgacgacaaaatgttggaatgcaaggaagaggaggcacaagaaagatgatgtgctgatgaacttacctgctaacggagtaaacacaatggagaggcgaagaggcaaagaagcgcgaggaggagaacaaacaagaaggcaaacagacaagaagatgagaaagaatgcgcgcgagaaaaaatatgatttatgtccgcaaatggttgttgacggcattccttctgtctcacatgtcaagcttgggaaggttcatggccacttaccccgtatgaggaattgcaaagaaaaaattgatggtcctaatccctcagttgatatgatagcaactttatcatatgttgtacctaacacattggcacgtagcaaaactttcacctgcattccttactgcaaataa

SEQ ID NO: 115318 - DNA, 1257 bp, Glycine max
  Peptide Sequence Number=SeqID_232096
atggagttggcacaactagaagcattgtgtgagaggctgtataattcgcaggactcggtggaacgtgctcacgcggagaacacactgaaatgcttctccatgaacactgaatacatttcccaatgccaatacattcttgatcatgccttgacaccctatgcattgatgctggctagttccagtttgttgaaacaagtcactgaacatagccttgccatgaagcttcgccttgatatatggacgtaccttatcaactatctagcgaccagaggacccgagttacagccatttgtcgctgcttctttgatccaacttttgtgtcgagtcacaaagttcggatggtttgatgatgatcgattccgggacctggttaaagaatccatgaacttcttgagtcaggcaacaccgggtcattatgccattggtttgaagatcctaagtcagcttatctctgagatgaatcaggccaatgctggtatgcctgcaacaaatcatcgaagggttgcttgctcgtttagggaccaatatctttttcagatatttcagatatctttaacatcattgggtcaactgaagaatgatggtaaaatggttgtcaatcaattgcaagaattggcacttgctctgtctttgaaatgcttatcatttgattttgtggggacttctgttgatgaaagttcagacgagtttggcacagttcagattccatcaccttggaagcctgttttggaggattcttcaacactacaaatattttttgattactatgccattacaaaaccccctctttcaaaggagttgtcagagcttgttaatgtggaaggctacagcgattggatacgtttggttgcagagtttactctcaagtctttgcaatcatggcagtgggcaagcaatagtgtgtactacctgttagggctgtggtctagattggtgtcttctgttccatatttaaaaggtgatgcaccaagcttactggatgagtttgttcccaagattactgaaagtttcatcacatcaagattcaactctgtgcaggctggattacctgatgatctttctgagaaccccttggacaatgctgaacttcttcaggatcaattagattgcttcccatacctatgtagatttcagcctgatgccacaatgaagatgcctttagttaatactctgaagcaacgtttttgggcatcaaattaccaagagccaaaaatcttttctctccctgagcaagttgacctcccaatgaaaaaatga

SEQ ID NO: 115319 - DNA, 345 bp, Glycine max
  Peptide Sequence Number=SeqID_232097
atgatttgtaatttgatgttaatggtttgtaacaatgatttgccaccattaaggattattctttcctgtattggcggaaaatgcagggtccaatggctgcggagtgaaaatgttgctcgagttgacaacaattgcaaccgtcaattttcattcaagatttgctatataagtgtagacacggagagggagatttataggagggagtggtcggcgacggtggtggtcttggaaggttggggaccaagttttataagttgttccggtgacagttttaattctccggtgatcaccgttgcggagagcagagaaggaagcaggactgtgtttaaagaatatgaggcctaa

SEQ ID NO: 115320 - DNA, 864 bp, Glycine max
  Peptide Sequence Number=SeqID_232098
atgatgtcagtggaaacggggcatgattgtttgcactatgattccgatgaagaaacctctagttgctcttgcggtttcattggatttcggagaaaccaagtgtttgattgcagcaccaacgagataaacaatgaagattcagaggagctatttgagatcaatctgaaggagcaattggatacaatatcagaagaagactgcgaaagcagtgtgttctcttttgattttcataacgacaaagatgttgttcatgttgcagtggaccacgttggggaatcaagcatggaagcacttttatggactttgaatcatgctgtcacaccctctaccactgtctatctcgtacacgttttccctgaaatcaggctcgtcccaagtccatttgggaaatttccaaggagtcatgtaaatccagaatatgttaactttcacttgacacaacagaaaagcaagacaaaagaactccttcaaaagttcatcgacttgtgccttgattcaaaggttaaggtggagattatgcttattgagggtgacaacattgccaaagctataacagaccatgttagagttcatagtataaggaaattggtgattggaattaccaaatctaatttaagcaaatccgtctctagaaggcgaaatgccatagcaaacaaggtcctcaagaacgtaccagaaatttgtgatattaaaataatatgcgatggaaaagaagtgattgatcagatgataggttgcaactcatcatgttccagtgacagtagaagttccagagtttcacaagaagaaaatgaatcctgtggttttgttcctcttatgcgttttgtgccaaatcctatatggttatttagaccaagattttga

SEQ ID NO: 115321 - DNA, 447 bp, Glycine max
  Peptide Sequence Number=SeqID_232099
gtcggtcagccactgcggtttccagaagcacccgttgtgagttttgcggcaagggatcttataagggggttgcttgtaaaggaacctcagcacagattggcatataaaagaggcgctactgagatcaagcaacaccccttttttgaaggtgtgaattgggcattgatcagatgtgctaccccacccgagatccccaaggctgtagagtttgagaagataccctcaccagcttcatcaagtggtggtgaaaaggctgttaaccatatgtcaatagctaatcagaaaggattacgtttagttgagaaatttgtatcctctcctcttggtaaagttcctccaagggatgaatgtaatattggtggtaaattgccagatggcggtttaataaattctagacagttgttggaatgtactctttcaccggaactgggccagatcctaaaataa

SEQ ID NO: 115322 - DNA, 1014 bp, Glycine max
  Peptide Sequence Number=SeqID_232100
atggactcgaaaactagttctagagctctcccaaaacaccatcagaagacggctgggattcaaacccttgaggcaaaagacacagggtcttctttgcagaagggggagaaaacagagctggctgctcctgtggatttgtctatgtatgcagcgaacgcatccaagcagaataccggggaaactgctgaaatcaagaagttaggaggtttaaccctaaaggggtctgctgattccatgagcattaaaagtggttctggtgcttcctcatctgttctcgacaaagtagttcatgctgctaatgagaacataggctcacaggaaagctctattgatctagacaaaaagacgtcggaagatggaagtgtgaagaacagttctgtttctgccaaagttagtgatggggccagcagtcttgcaaagacaagtggaagtgccaagatcagcaaccgggctgattttgttgagagtggtaagagcagtatttgcagaggaagcacaagcagtgatgtgagtgatgagagtacttgtagtagctttagtagcagcataaacaaacctcacaaggctaatgacttgagatgggaagctatccaagcagttcgaagtagagatggggtgttgggtttaggtcactttagattactgaagaggctgggttgtggggatattggcagcgtttacctctccgagttgagtggaactaaatgttactttgcaatgaaggtaatggacaaagggtcccttgcaagtcgtaaaaagctacttcgtgctcagacagaacgagaaattctgcagtctctagatcacccttttctcccaactttgtacacccattttgagacagagaagttctcatgcttggttatggaattctgcccaggtggtgacctccatactcttaggcagaagcaaccagggaagcattttcctgagcaggcagtaaaattacttaatccttgtatgcggattaagaaaaacgatgactatacttatgtaaagaacattaaattttaa

SEQ ID NO: 115323 - DNA, 216 bp, Glycine max
  Peptide Sequence Number=SeqID_232101
atgagtcaaacttgccagcaaaaattggagatttttggagagataaaaaaaggtattggggtggtggcggaaaattaccagaagcagcggtttaaagtggaatcagaagcagatccgaaggaggagagagagacccaaatggaaaaagagttaaacttgaagggttatggagaaaacccaggttgggaagggaagaattggaagaggggaaagtag

SEQ ID NO: 115324 - DNA, 348 bp, Glycine max
  Peptide Sequence Number=SeqID_232102
atggttgctgctatatgtggatcaacccagaaggagcctgttgtggcggggaaaccgtcaacctttatgatggagtttttacttaagaagtttttctctgcatataacttactctctttggcagattcaatttcttcatttagcgtcttattagcagtttggctcttctctgttgtaaaactctggcttattcattcacaatcaaagttcttagaaaaatttacttccacggcttggtttgagggacgcggcaagagcatgatgctatttacctttttattgatggaatttggaagtcctgaatgccaaatgaccacaattggaaatataatgcataatctgaggtaa

SEQ ID NO: 115325 - DNA, 303 bp, Glycine max
  Peptide Sequence Number=SeqID_232103
atgtccaactgcatcacggttggtggcaatgaaaaggcatcctggattttcacaattctcaatacaggacacgtaactcccaactatgttgctgtcaaagaccaggatcatgaagtgggatcaagatttgggcttcaagacccatatcaagattcaggtactcaaagtaacaatgagcaaggtgttacattacactcttatcatattcaacaaagcagttctgcttcaggtttattgttttatttgcatcgccctgcaatcaatgaatgctttagtgaggatacttcagtgacaatcctgtga

SEQ ID NO: 115326 - DNA, 288 bp, Glycine max
  Peptide Sequence Number=SeqID_232104
atgaaggacgcggctctcaaaaagccaatgaatcagcaagaagccttccagtcatatctgcttggttggtgcaaaccaaccggcgggcatcatgcacagagaagtcaaacttccaatcatcaatcagtgtaccttcaaatgaaatccatatcaatgaattttggatcaataatggaacgagatgaaaagaggtttgtgtaccgtatccgctgttcttcagatgaaaacaatgaggcagagggaatagaggaaggaatcggcgtttcctatgtctcggaataccgttga

SEQ ID NO: 115327 - DNA, 585 bp, Glycine max
  Peptide Sequence Number=SeqID_232105
atgaacccaaaactttgcttattcggaccaacgattggaagtttccttttgattaaacttaaagatcaagcgggccggcccagacatgccttaattgattatggtaaaaggaaagggaaagaggatgtgctttctctctctttgaattggcattggaattcaactcttctctttctctgtcgaagaacaagtagtttcagaaagatgctagagaatcttcaggctcctccgtcaacaacggaatcggccccagtggtgaagcgctatgctccacccaaccagaggaaccgttctgctaacaggcgcaaatcatctgatcggcttgatcggacaaacagtgtcgggaatgacttagaaaagaatcaagttgcttcttcaagaagtgttcacattccagatcatgaagatgctggtagcagtaatcttcttaatgagaatcactattcaagattcatagctttagaagggtgtagttgcagtgcagctgcccagcttcttaatgatcgtaaatttttggggtatatggatcatgatggtttcattgagcttgttggtggaatggggatgcctaaggccaacttttaa

SEQ ID NO: 115328 - DNA, 1014 bp, Glycine max
  Peptide Sequence Number=SeqID_232106
atgttgcctgtgcttctcatatccaaccttctttctgactgctgtataattttgcagatttcctccatcaaggttattcgcaataagcaaactggcctatcagagggttatggatttgtggagttctattcacatgctacagctgagaaagttttgcaaaattatgctggaattttgatgcccaatgctgaacaaccattccgtctgaactgggcaacatttagcacaggagacaagggttcagataatgttcctgacctttctatttttgtaggagatttagctgcagatgttacagatagtttgttgcatgaaacttttgctagtgtatatccttctgttaaagctgcaaaagttgtttttgatgccaatactggccgttcaaagggctatggtttcgtcaggtttggagatgacaatgagagaacccaggccatgactcagatgaatggtgtttactgttctagcaggccaatgcgtattggtgctgcaactcctaggaaatcatctggccatcaacagggtgggctgtcaaatggcacagccaaccaatctgaagcagattctactaacacaactatatttgttggaggactggaccctaatgtttcagatgaagatctcaggcagccattctcccagtatggtgagatagtctctgttaagatacctgttggaaagggctgtggctttgtccaatttgcaaacagaaataatgctgaagaggcattgcagaagctaaatgggacaacgattggcaagcaaacggtccgtctttcttggggtcgtaatccagcaaataagcagtttagaatggatttcggcagcccttggactggggcatattacggggcccctatgtatgatggttatgggtatgcattgccccctcgtcatgatcccagcatatatgctgctgcttatggtgcttaccccctttatggaggccaccaacaacaaacaagaatccctcctaattgtggagtggagatgaattttgatagcctgaggtag

SEQ ID NO: 115329 - DNA, 975 bp, Glycine max
  Peptide Sequence Number=SeqID_232107
atgcaagaactcggaccttttagagtcaacagtgatggaagaacactttacacaaatcaatatgcatggaacaatgtggcaaacgtgattttcctagagtctccagcaggagttggtttttcatattcaaacacttcttctgactacactaaaactggtgacaagagcacagctatggactcttacacttttcttctaaactggctcgagagatttccacagtacaaaactcgagacttgttcatcactggagaaagctatgctggacattatgtccctcagcttgctgacactattctcacttataataagcttacaaatcacacagtgatcaacctgaaagggattgcggttgggaatggctggatagatgataatatgtgtggaaagggaatgtatgaatatttctggacacatgctctgaactctgatgaaacccatgagggaattcaaaggcattgtgactttgagaacggtaacttaacaagtgagtgcagcaaatatcaaattagaggggatattgagattggaaccattgacatatatggcatatatgctcccccttgtgattcagctgcaacaaaagctggtgccagtcctgccactaactctgatagcaattacgacccttgttctgacgattataccaattcctacttaaatctcgcggaagtacaagaggctctacatgctaaagcttcagtatggtatccttgcagtggcgatacagatgggcgtgttcccataacatcatctaggtattcaataaattccatgaaacttccagtggagacaacatggcgtccatggtattctagcaatgaggttggaggatacttggttgggtacaaagggctcacactaatcactgtaagaggagctgggcacatggttccaagttaccaaccgcagagagccctaaccatgatctcatttttcctacgaggagaacttcctcctgagttcacctcttag

SEQ ID NO: 115330 - DNA, 896 bp, Glycine max
  Peptide Sequence Number=SeqID_232108
catggcttaaagcaatgagtaacctacctcccaaggtgattatcacagaccaagagcaattcttgaaagaagctgttatgggaatgtttccagataaacatgagcagtttgataagagatggtggaaattgattaatagatttgaactaaaggatgatgaatgggttcagtcattgtttgaagatcgaaaaaagtgggtgcctacatacactcgggacatttctttggctgggttgtcaactactataaggcctaggaagaagtctataaacactgtgaatgcaaacaattctgctagaagcactttagagtccaacaagttggttcttaatggttttgatgttgaagagaaaaatgatggctgctacagggcaaagcctactaagaaaaggaagtcatttaataaaagggaatgctctgatccagaaagaatcaaaatcaagatgctggatgatttccaaaagagggaacagagaaatacaagagcacacaactttgataattgttacatttctcagcaggacattcaaacagtggcatgcaatatttctgtgcccaacttggattctagagcttcgactcttgatgtctattatggggctcaacacaatgcgcagctgaactcagtttctgtcatgcatgatggctactatagcagtcaaccggccattacagggctggggcaattgcattccgtgccaagcagtggttcacatcatgaaatgcagcacagcatgcaaggaccgcttcaaggacagctcactttcagaacgccaacagtgcaagggttttttgaccttcaagatagtctagaagctatggaacaacctattagggtctcgcagttccatggcattacatctaagcaactagatgttgacagatcactttcctag

SEQ ID NO: 115331 - DNA, 519 bp, Glycine max
  Peptide Sequence Number=SeqID_232109
atggataaggaggagtgtaaggaggtaagtgtctcctccatgaggttagctaagaaggaaagtcattttgcaataaagacaaaaattaaagaaacttcccctcttagacaacctccacatcttctcctttgtaaaatgatatttgttagcactgtcacacctcttgggcttaaggttattcttcaagtaaaggagttgttggatgagggtttggttcgtaagagcttaaatccttgtgttttgttggtgcccaaaataggaataatcaacatgaaaatacagaaaaaggtatcaaaggaaggagcccatagtatcaagaaccctgggaaagagcccaaagtatcaagaacctccaggaaagggcttttctattgtcttccccttatcatcttttggcctagaaggcgcgcgcccctaagatgcattgaccttggtctttctttggatatgagtgagagccataagattttgaatagacttccttttaagttgttgctttatccttatttctcaatctaa

SEQ ID NO: 115332 - DNA, 633 bp, Glycine max
  Peptide Sequence Number=SeqID_232110
atggggccaagagaattgacaggttctgtggatctattaaatcacttcaaattactcccacattttgagtttttctgcaagaggccacttcctgtttcaatttcagatgcacactatttatacaatgtagtaggagacattgaaatcagaaaaggagatgggatgcagttggatcaacttattcaggatacatctttgtccagtggttctaattatcgtatacagcctttggacctcaatattctaaaggaggcttttcaactcaaggaaactgttcccattgatttgcctgctgccgagaaggggattctgactgttgcaggaaaatcaaaaggtgaatctaaagatgaggagaagaagcataaaaaacacaaagacagggacaaagataaggacaaggagcataagaagcacaagcatcgtcaaaaagatcgaagcaaagacaaggaaaaggagaaaaagaaagacaaaaacaggcatcgtgattctagtgctgatccttcaaagaaacacaatgagaagaaaaggaagcatgatggagatgatgatcttaatgttgtgcacaaacacaaaaaaagtaagcataagagctcaaaaattgatgaattgggggcaataaaggttgcaagctaa

SEQ ID NO: 115333 - DNA, 450 bp, Glycine max
  Peptide Sequence Number=SeqID_232111
atggagaacattccagagtcttcatcgagagggacgaaacgccggcgagacgaagattccgatgccggaaacacctcctcactcgaagacgatcttacattcaccgacacgctggtcgcgcttcgaatcatgcgagctcagtttccccacgttcacaagagttcggttgagccttttatattgaagtcacagttgtacagtattgtgaaggacagaacacaagtggatagggaattagagtctctaaggagggacaaagtactgcgtgttttcaaattaaatactggacaagatgatcatgccataatgtttttggatgactacctaaaccagctttgtaacctggaggtaacaaggtcaaatcctgaaaatggtctccttgcttgtgagggtaagactgtatacatctaccctcccaagatcccactaggtgggagccttgtgcactga

SEQ ID NO: 115334 - DNA, 1682 bp, Glycine max
  Peptide Sequence Number=SeqID_232112
gcacaacaagagaaaattgtgggagtagcagaagtgagaattttaagatggatgtgtggccagacaagaagggtggattggatacaaagaaggtcaatggaagcatcaatgaggagattcagtggttgtggaaaaggataaaagagagacgaagaaggaaattggaggaagttcttatgaggaatttcatggagaatgatttctctgagaatttggtaaggagtgagactgggggatggtcccccaagtgcttgggtgcttatcaattggtatcaaagttggttgccaatgtctgggaaagggctacttacaaaggggctgaacttggttattatggggtgcctaagtccctcattggacagtatgggatgatcaatggaatatttaagtgcatggtgataatgttaatacaaacttctgtccttagttcagttgaagctggtctatgttatgtatctgatgatgggaaagatgttctatgtgaccggatgcctagtggtgaaacttggcaggtgtgtctgaaatgcaataagtaccctcttgactggtgtagaaaagctgaaccagtggaagaagatagaaggaatgctgatgatccttacagatcaagctgtgtagttagctttggtcagccgtcaactgctagtataatgacagaaaatactacacctaatatggtatacaggagaaagaagctccgtaaggactcaaatttcaacctagggccaactaatgtgcaggcaagtgcaaacatcccttcagtcataagttccgctgcacatttatcatcagcggaggatcagccaactggttttcaagttaagcatgcaattgaaattgttaaagatcctacgatgccttcagtcttatttgatggagtaaccaaagatagcacacataaaaacttaggtattaatagtgtaaatgatagttgctcctcttcaaagccaaatatggaaactgaaatggatgaaactggtgaatgctcctcctccagtattatagtcatggattgcacaagggaagaagtaacagaaaaggatttctgcatgaatattttaagaagccatggacttcttaaagaaaattctccggtagataatgtgacttctggggaagatgctgtcaccactagtaataactgctgttccaggtcatgcaaaatatgtggtgatttagacaattcattgaacatgcttttatgtgatcattgtgaagatgcatatcatctgtcttgctacaatccacgtttgaaaaaattaccaattgatgagtggttttgtcattcatgtcttataaagaggcagaaaattctcaaggagacagttataagatcaccaagtatccacaatgaattgggaaaatgtagaactgccccagttaaggctgaattgaatcctatactgttgatgttgagagacaccaagccctatacaactggtgtgcgagttggtaaaggttttcaagcagaagttcttgactggtcaggcccgataaaaagtagaataaaggggttcaaccacttggagcactttcagttattagataaaggggttcaacaacatgagtttggacaggaagatgcattcatagatttagggtccatttgttgcaatgaggctaatggtcttggacaaaggccaagcatccaagataaagaggaatggatgctaggatcctag

SEQ ID NO: 115335 - DNA, 393 bp, Glycine max
  Peptide Sequence Number=SeqID_232113
atgtcgtatagcactagctgcaaaaccccactctctaatttcgaggctgctgcaaataaagtgaaagtatctgaccctgaagcattcattaagttgcatagtgcatcttttgtagcatggatgacaattccattgactcttccgagcaatcttgctctgtgcgtcaatgccaattttacctatgtgaaggttcctaataagtattcaggcaaagtttatattgttgctgaatctcttctatctgcaatccataacccaaggagcaacccaaagaagctgttgttaacagtgcaaaagacgttcctagaaatacaaatgcaaagatcaagggagcctcaggtgaaaaaatggaaaatgggttggattctttcgaagtgctggagaaagtcttag

SEQ ID NO: 115336 - DNA, 210 bp, Glycine max
  Peptide Sequence Number=SeqID_232114
atgtggacgagagacactgttgcgccttatctttctgctgcaacaacaacaacgccttatcccactaggtggggtcgactacatggatcaacttctgccataatgttctatcaacaatggaatgaaaatatagctcacttgtgtattaggagtggagcaggctcaaaggcaaggaagggtgatataaaagaaatctattctgatgagtga

SEQ ID NO: 115337 - DNA, 828 bp, Glycine max
  Peptide Sequence Number=SeqID_232115
atggatgacggtggcactggcaggccctgccggcatagtgtgaaatttgagcgagaccctaagaagaagaagaagaagaagaagaagaagatgccgaagaagatgggggtgaacacgaaggcggaggcggcgagggctcgtaagagcgcggcggatacggagcggaaggagaaggagagtcgagagaaggaggaccagtactggcgagaggcggagggttcaaagtcacgcgccgcgaagaagaaggaggaagaggccgaaaagagggcggaggcagccgcgcggaaagcggaggcgcgacggttggcggagcaggaggagaaggagctggagaagtcgatgaagaaggtggacaagaaggcgacacgggtgtcgatcccggtgccgaaggtgacggaggtggagctgaggaggcggagggaggaggagcaggcggaggctgagaggaaggcggaggaggctaagaagcagcagagtcggacggcggcagaggaagagtacgagagaatggtgcttatttcgaacactaatcgcgacgattcgatcatcgaagcaagaacattggatgatgccatcgctcagatgaccgtcgtggataacttgcccccagatcgccatccagagaggcgcctcaaggcctcattcaaggcgtttgaagaagctgagctgcccaagttgaaggaagagaaaccgggtcttactcacactcagtacaaggacatgatatggaagttatggaagaaatctcctgacaatcctcttaatcaagtcggtcacactctctctctctctctctttgcatataaaaaaatgacatttctctcataa

SEQ ID NO: 115338 - DNA, 1035 bp, Glycine max
  Peptide Sequence Number=SeqID_232116
atggaagggttggcgttggcggttccagttgcgcaatcacaactgttgccgtttcccacagcttataggtttgtctctctcaaacgacaccgtggacgcgggtttcgttttcggacttggttatgttctcaggctcaaggcgttcctcttcccgaacaagtcactgtcccagacacagagaattccgtgaccggggattccattcggcagagatttctgaatttctatgcttcccgcggtcacaaggttcttcccagtgcttctcttgtcccagatgatcccactgttctactcaccatcgcagggatgcttcaattcaagcctatcttcctaggcaaggttccaagacaagtaccttgtgctgctactgctcaaaggtgcatccgtactaatgatatccacaatgttggcctaactgccagacatcagacattctttgaaatgcttggaaacttcagctttggtcattacttcaaaaaacaagctattctttgggcatgggagctttccaccgcagagtttggtttgcctccagacagattgtggattagtgtttatgaagatgacgatgaggcttttcagctctggtccgacgaggtcggtgtcccagttgagcggataaagaggttgggagaagaggacaacttctggactagtggagtgacaggtccttgtggtccttgctcagaaatttattatgattttcatcctgagaggggatatgtagatgccgatctcaatgatgatacaaggtttatagagttctacaacttagtattcatgcaatacaacaaaaaagatgacagttctcttgaacctctaaagcagaagaacatagatactggccttggactggagcgtatggctcgtattcttcaaaaggttccaaacaattatgaaactgacttgattttccccatcatagagaaggcctctaaattagcaaatgtttcatatggtattgccgatgatcagacaaagagaaatctgaaagtaaatatgactatcttcatacaagctgcagtacaatcttag

SEQ ID NO: 115339 - DNA, 246 bp, Glycine max
  Peptide Sequence Number=SeqID_232117
gacgtttgcaccgctgcacctggagagggagagagggggtcggtgattcttgagatactggccaaaggtgttccagtcacggcgcttttggttctcgtagcggctgctggtggtggaggaagccgaaggggaattggagctagcaaccaagctgttgctggaggtgttcatggtggttgttgcggtggtggtgatggttcttgttctagggttcctaagacaatgaggggagagagtgagggatga

SEQ ID NO: 115340 - DNA, 270 bp, Glycine max
  Peptide Sequence Number=SeqID_232118
atgggggtagagccttcatatcaaggagtccatatgattaatactgggacacctatcaatatgagatattcatggggtatgcctaattggagaccccaaaacatagggatgtactcgttccaaccatttaatggtttttctggacataattcaattacttcacaaagcagaaatcaaatcaaacaaggtagaaatttggataatgagactgtcaacaacgatctcaagcaataccttaacatccttaagacaacaaatggatcacaataa

SEQ ID NO: 115341 - DNA, 786 bp, Glycine max
  Peptide Sequence Number=SeqID_232119
atgaacaaagcatctcgtatctttgaggagttgaagagagaggagcttcgatttgtgcagactctagagagaggagaaaagttgctcgaggagaaactttctgatgctttatcaagtgcagaaagaaatggaaccgtgccttgcttggctggtgaagatgtgtttcttttgtatgatacttatggatacccaatggaaataacaaaagaagtggctgaagaacgtggagtgagtattgatatggatggttttgatattgagatggagaagcaaaggcgtcaatctcaagctgcacacaatactgtcaaacttgacattgaaaatggagaaaatattgcagagaatgtacctgacactgaatttattggatatgataaccttcattgtaaagcaatgatagaaagcctaatggtaaatggaaatccagctccacaggtcagtgaagggagtaatgtggaagttttactgaacaagactccattttatgctgaatcagggggtcaaattggcgatcatggttatctatatatttcaaagggtgagaatcaaccaaaagctgttgtggagatattagatgttcagaaatcttttggcaacatatttgttcacaagggtacagtccaaaagggtgttgtagaggttggcaaagaagttgaagcagcagttgatgtgaagctgaggcagcgagctaagatgaatccttacatcatcatagtcatgtatatttccagattccaaacttacaaattgttcaagattataataggtatagttggtgctttgtag

SEQ ID NO: 115342 - DNA, 264 bp, Glycine max
  Peptide Sequence Number=SeqID_232120
atggcgtgcggtgacgaggttggtggtggttgtcgcgcatgcggacctggtgtggtagagagttgtagtggggtcacaattgcgcgtaaagaggaggtgaagggcacgatggtcgatgcgacgacagtgttagtgggagaggtggttgcacatccagatttggcgatttctggatctgaggaagggacgatgatttgcgatttccagatcttgtcgttgttgccattgcggctgcagatgttttgcagtcgttggctttcttga

SEQ ID NO: 115343 - DNA, 921 bp, Glycine max
  Peptide Sequence Number=SeqID_232121
gagacctcacaagctggttcactggtggcatttgatcgtctcaggtttgatttcaacttccaccgaccacttcgtgacagtgagcttgctgaaattgaagtgctaataaatggatggattgaggatgcaacgcaacttcaaaccaaagtgatgcctcttgttgaagcaaaaagtgctggggctatagcaatgtttggagaaaaatatggagaagaggtacgtgttgtagaggttcctggtgtatcgatggaactttgtggtgggactcatgtcagtaatacttctgaaattcgtggttttaaaattatctcagaacagggtattgcatctggaatcagacgtatcgaagctgtagctggggaagctttcattgaatatatcaatgcccgagacttttatctgaagcagctatgttccactctcaaagttaaaccagaagaagtgacaacaaggatagaaaaccttttagaggagttaagggcagtgagaaatgaaaattctgctgttcatgcaaaagcagcaatctacaaagcttcagtcattgcaagcaaagcaatgttggtggggaattcaaaacagtacagggtactggttgagtgctttgatgatgctgatgctgagtcacttaaaagtgccgcagaatatttactggaaacactaacagatccagcagctgtggtactgggctcatgtccaggtgaagggaaggttagtctagttgctgcttttactccaggggtggttgatcaggggatccaggcaggcaagtttattggacaaatagcaaaattatgtggtggtggaggaggtggaaggccaaattttgctcaggctggtgggaggaagcctgaaaatttggcaagtgcccttgataaggctcggtcagagcttatagctactctatgtgaaaaagggaattga

SEQ ID NO: 115344 - DNA, 186 bp, Glycine max
  Peptide Sequence Number=SeqID_232122
atggggagagttaacttagagttaaatgtgagaatggtagtgttggaagtggaaaagtgggagattttgagggttagaaaagccaaattcagggttagtggaaattggagtctaaagaaagcttggtcagagcaaatgagaaaaatgagtgacaaatgtgaaagaaaagagccatttctaaagtaa

SEQ ID NO: 115345 - DNA, 252 bp, Glycine max
  Peptide Sequence Number=SeqID_232123
atgggtcgtaggcaacgcactaacttttttgtggatgagctgaggggctttggaggtggcaacggtgcgtctgttgcccgctgccagccatccccaggttactgtggtgtcttgccctacgcctgcctgggggcgcagtacttcttgatgaaagcccggcccgtaatcagagttggaaaccccaagaccctgttggactttttcgggtccactgggtgtcttacaggcgcgatccctgcaaacaatagatga

SEQ ID NO: 115346 - DNA, 323 bp, Glycine max
  Peptide Sequence Number=SeqID_232124
atggagtcaaatgatagtggagatctattattacatccaagaatgacagaattgccatcaagatcttccacaagcccttcaaactcatcttctcctgtcagggaagaaattacatctgctaaggatgaaaaatccagtacacaaaaaacaataactggaagaattgctcaaatctttagtaagagctctgatatgtcttcaactgcatcccgtagaagcattgacttggaccaatctgaaattagtaaagtagaagttagtgagatgaaggctgaggatcagtcctctaatgagacttttgaagaagctatgagaaaacttca

SEQ ID NO: 115347 - DNA, 585 bp, Glycine max
  Peptide Sequence Number=SeqID_232125
atggctctctggaaggtcaggtccttgagtcctgaacagaaggttgagtttgtcgaagaacaatctgatagcaaaagtcttataagtgatgagagtggctcattccttggcctggatgatgcaagttacctcatggagatatttagcgggggtgagttggaccgtcgggtcatggaaaagcttggttatcttaattattcttatactccttgggtatctgagaacctagatatctctgagagagcagtatattacaaatttgagaagcgtatttcaagttataaaggtgaagtgacaagtactcaacaaagatctccccttccggatggaaagggttggcttgtggaagagcttatgaaccttcatggagttcctcttggtgattatttcaatatacaccttaggtaccaaattgaggatttacccccaaaagcaaagggatgtagagtgcaagttttatttggaatggaatggctgaaaagctcaaagaatcagaaaagacttacaaagaacatcctagaaaatttgcttgaacgttttaaggtgacctttagtctagctgagaaagagcttttaccaaactag

SEQ ID NO: 115348 - DNA, 2237 bp, Glycine max
  Peptide Sequence Number=SeqID_232126
atattgaagacattcaggttattcctcctacattctcatcaatggggagtccaataattgtcataactcttcggaagggtagaggtgtagatgcaaggcatggtgcaaaaacacaagatgaacaaggcaggctgagcgagtggacaacagtggtcagagggagaggaaaacagagggaaggggagagaccgagagtggatcccaaaacgaactacgacaacaacaagcttggtcaatttcagaggtatcaccaccataactggagggataaggatgacatcacaacgttttacttcacacgcttccacgaacacataactgaagaggatctctgggctcagttcaagaaatggggggacgtgagggacattttcatccacaaacacaggaacaaaggaggtagaagatatggttttgttaggttcaaaggggtactggacaaatacagactagaaaaacagcttgacaacatcatcttagaaggactcaagatgtatgttaatgttccaaaatacgggagaggaaaggcgagggtcaaggagtgtacctccaaacttggtatcctgaaggaaggccatagcagggaagtcgaggctgggcgacacagagcagtacagcataggaatccacagaagtcatatgccaaggtggtctccactatccaaacggatgacggtaagatgaagcaccccaaactcccacaactgagatatgttgagtcccactcctcagtacaccttcaattggcagtgggggaaaagaaatggttcacagatgcatgggtgggcaggcttaagaaattgcaggctctggaaaggatagaggatgacataccttgggagttaggtgtgaacgtcgtgctgaaatatctcggcgacgacatggtactccttcttgggttggcggacaacaaagcagagcatatcattgccgaagagactcagcatggcacatctccattccactcactagaaaggtggaacccaacgatgagactgggtcatagacttgtgtgggcccaatgttgggatatccccattgaagcatgggacttggggaacattcgtaaaatcgcggcggccattggagagcttgttaaggttgacgacgatgtcaaagagatgaggaggatggacagggccagaatcctcatcaggacccccaacgacgggaggcacaatttctcgggtcgaagaccgtcatactcatcggaagagcttgattccgatggtatcgacggagagtcaataatatctccgtactcgccccggtatgagatccggcgtcaaccaaacaacccacatgatgacccaaaagctgtcgtagatagcggtggcggtccccgcataggcaccggtatacccatcggaagagcaacagacccaccggaagcgaaccactccgacgaccccggcggcaaccctctgaacgtggctcatgtgcagtcgatctcgtgccgggggaggaaagcctcctccgacggagacacggttcctgtcgctaccgacaaaccgaggtcccctttacccaaaggacctacaacaatcgaaaacacagtggatattaaccagggaagctgggtaatactccccaacctcggaaatggctcgcgtatctcgtctgaaagggttatggagcaggaagacaaaggcaagggatcagagacaacaatcaacaatggagaaataaatgtaggtgaggcacaaaaaaggaaacagcaaggggaaattgaatcactgacagagacagttgttcacccagaagctacaataagggaaatagctgttgaggatgtccaatttcaaatgagagttgaccatacagttgtccacccagaagctacaataagggaaatagctgttgaggatgtccaatttcaaatgagagttgaccatgtaactccctctgggccctcccactcacagctgccacctccaattgaaacactgggccctcctcaacattttcaatccagcccatcttatcaagttaaggaccatgaactactaacaccaccaataggaatccaagacttacaaaatgtcgaggatgggccaaacaatggggggtgtaaacagcagatgacccaaaaggaccttactaacggaaaagctacaaagtctatatttttgggaattaaccctcacacagaatccataggaacagccacatcaaaacgatcaaaagaagccaactcacagatacctgtaaaatccattggagctgatgaagggtag

SEQ ID NO: 115349 - DNA, 213 bp, Glycine max
  Peptide Sequence Number=SeqID_232127
atgcgtgtgttgtttgagccttgtcagtcctcactctcactcattttttctttttttcctctgcggtctttctattgtccagcttctgtgcggctttctctgtgggtgaagcgagttttggcgatggagaaaggaggaaagggcgcttcgctgttcagcaaaggggggagagaggatgaccctctaccaatccaagatagggaaagcctttga

SEQ ID NO: 115350 - DNA, 276 bp, Glycine max
  Peptide Sequence Number=SeqID_232128
atggagcttggagaaggagatggtatgagatggaaagttaaaggagaagaaaagagaggttacggagacagaaagaggactgagtatatacagaaatgccatccaagacaaaatcaaagagcaatcaggcttgtttacatggttgagttgctatatcttcaacaaatagaaagaggcaaatatatacgtgcaaacagttcagaggacaagtgtttgggtaagagtggagacatgaagaaagaggacacatcagttgggggcataattcttttttaa

SEQ ID NO: 115351 - DNA, 198 bp, Glycine max
  Peptide Sequence Number=SeqID_232129
atgaaatatacaggcgagttagagaagatagtgagaaaagcagctttgatcattgctgtttcatggctcttactggtggcattcatagtggtttctgctaatgcagacaacacaaagattcaccccccatcttctaagaatatggtgctgctggttcatatggaagtcaatgatcaaatgtgggaaagtttgctgtga

SEQ ID NO: 115352 - DNA, 422 bp, Glycine max
  Peptide Sequence Number=SeqID_232130
gactaggatcccaaaaagggaaagatgacagtgcaacaaaatcagcaaagaagaggatggttcagttttcttctgatggtccatcatttgaatctggagtaagcagtagttcactcccttcacaaaaatctggtggaaaagatcctttgacaagggactgcaatatgccaaaagcagtacgaagtatacagatctgcattctattagacgcattcttgagtatccttaatttcagtctgatcagtcctcttgcaaaatgtggtctcactgatagtgagatatgtgtgattggtaatgtgtgcccagaaactattgatgaagtttttgctcttctcccatccttgaaggataagagaaacattgacagacaggttcttaaggattcactgagtcagcttgctaagtttagacaatcaatgtaa

SEQ ID NO: 115353 - DNA, 450 bp, Glycine max
  Peptide Sequence Number=SeqID_232131
atgggcacaagagatgttgatgatgatgatgatcaagactcaaagttggaggataaagaatcagcaaaggcagagaaatggaaaaaacattactcatcaaagcataggattcttcttgttggagagggtgacttttcattctccctttgtctggccagggcttttggttctggccacaaccttgttgccacttctcttgattcctacgataacattgggaagaagtatagtaatgtattgagtaatgcgatggaacttcaagaaagaggttgccttgtctttcatggtgttgatgccaaggaaatgagtcagcattttttttcaagactcagaggtttgatcgcattgtctacaacttccctcatgttggctttatatacccagagaatagtctctgccagaaaagagagggctggttttgcaacaagttgtgccattcttcgaggatga

SEQ ID NO: 115354 - DNA, 117 bp, Glycine max
  Peptide Sequence Number=SeqID_232132
gtcattgcggtgtttgagcatctggtcgaagctgctcctggggatgatgctgctcagatcacctcctgcaggaccaccacatcgactttggcacccctcgccgcaatattccttctt

SEQ ID NO: 115355 - DNA, 1113 bp, Glycine max
  Peptide Sequence Number=SeqID_232133
atgagaggttgtgccactgatggggtggtggcatggcacagaacactgagaaaagcatttcattccttttgttctccaacttcttgtatttttggccccaacctccctgatgtttgggttcccagagagcacacaccccctcacaccctttttccagaaagtctccaatgggctaataatggtcacaatgctttgattcttgagggaaaaccaattgctaaacagataaagcttgaagtggctgatgagataagaaggatgaagagtggcattgggaagtttcctagactggctgtggttttggtgggtgataggagggactctcacactttcattcacattaagttgaaggcctgtgatcaagttggcattgaaacagtgacttcccagttgcctgaaaactgtgatgaaagtgaactgcttgatgttgtttccggtttcaatgaggacccggatgtgcatggcattcttgtgcaacttcctctgcctcaagtggatgttgatactaatgccttggttattctaacatatttgatgcagcatttggacgaggaaaaaattatcaatgttgtgagtcctgaaaaggatgtggatggctttcatcccttaaatattggaaatcttgcaataagaggaagaaagcccttctttgttccttgtgctcccaagggctgcattgagttgttacttaggcacggtgtggaaatcaaggggaaaagagcagtgataattggaagaagtaaaattgtggggttacccacttccttgctattgcagaggcaccacgcaacagtcagcgtgttacacgcgtatacaaagaacccagaacatataacttctgaagcagatattgtggtagtagatgttggagtccccaacatagttcgtggcaattggctaaagaaaggagctgtggtgattgacatgggaacaaatcaagttaaggatcccagcggccacggcttttgtgtctcgggagatgtttgctttgaagaggcggttaaggtggcatcagccattacccctgttcctggaggcgtgggaccggttacaatatcgatgctcctctccaacacccttgattctgcgaaacgtgcttttggaatggtttga

SEQ ID NO: 115356 - DNA, 360 bp, Glycine max
  Peptide Sequence Number=SeqID_232134
atgaaaaatcaagacgaaccaacaactgagggagaaagcgaagaaaacaatggaggcgttaagagaaaaaataacactgcaaccaacttcaaaaggaagaagacaccagggacatttagggaattaaaaaaaattattgggtgcacaaacaataatgttggtgtacctagcatcaccctgttggtccttaccagcgatactgtattttctgttccgatggcggagacatacagtcttcttggggttgattcaaaagacatagttacactcgagaagtatttgcaggactacttcactaacatattaaagaaattgaaggatctcaaggcccagtcaaagcagacagatattatcttctga

SEQ ID NO: 115357 - DNA, 1035 bp, Glycine max
  Peptide Sequence Number=SeqID_232135
atgaactaccgcagcaacattctcatccaattgttttcctcgcctcctgcatgggcaactctaatcgcagctgcatttctcctcctaactctagccctctccatgtatcttctcttcgagcatctttccgcttacaagaaccccgaggagcaaaagttcctcatcggggttatcctaatggttccctgctattcttttgaatctgtaagttcgtgttctacattacattcatatgatattatttcaattctaactcactttcctctttcccccaaccccaaccagtttgtatcattggtcaatccctcaatcagtgttgattgcgagattctaagggactgctacgaatcctttgccatgtattgctttggaagataccttgttgcctgcctcggtggtgacgaaaggaccgttcaatttatggaaagacagtctcgtctctctgttaaaactcctcttctacaacattcttcttcttctgacaaggccactgtcaaccatccctttcctctcaactacttcctcaaaccctggaaacttggtcgcgccttctaccaagttatcaaatttggcattgttcaatatatgctaacgaaggctttcactgctattctcgctgtaatccttgaagcctttggagtctactgtgaaggagaatttaaagtaggatgtgggtatccttatatggcagtggttctaaatttcagtcagtcatgggctttgtactgccttgttcaattttatacagttacaaaggacgaactggctcatataaagccattggccaaatttttgacatttaaatcaattgtgttcctcacttggtggcaaggtgtggcaattgctctcctatccacctttggtttgttcaagagtcccattgctcaaggcttgcagttcaagtcaagtgtccaagatttcatcatttgcattgagctgactgttgtaaggaaacattttttgctaacattaaccatgactgactcagttcttggtcctccatggtccagaatgcctggcgaacatgacctgtga

SEQ ID NO: 115358 - DNA, 1245 bp, Glycine max
  Peptide Sequence Number=SeqID_232136
atggagggctcaaaggaaaactgtgtgcctcggattccgctcataccctcttcaaatcttcaaggtttgatttccccgttcattgaagaaggtccaagaatgaagcctctcctccatcaccggctgcctctcggcaacatcagtcagaatgttaatatgcctcattctcaagtcaacaaactagatctttcccgcaagtgtacggctcacacaattcagcaccacttccctcaagaaactaagaaacagaacctgttggccccgaacccgagttgcaagttagattgtgatatcgtagatattgatgatgacgatggggatggcagtgacgatgccgttccagtatttgtcaagcacactgaagccatgcttgatgaaattgacaagatagaggaagttgaaatggaagatgtggaggaggaacctgttttggacatcgatgcctgtgataggaaagatccacttgcagtggttgagtacatagatgatatatacagtttctacaaggacattgagaattcgagctgtgtctctccaaattacatgactagtcaacttgacattaatgagaggatgagggcaattcttattgactggcttattgaggttcactacaaatttgagcttttggaggagacgttgttccttactgtcaatctcatagacaggttcttggagcgtcaggcagtgatcagaaataaacttcagttagttggtgtcacagctatgctaatagcttgtaagtatgaggaggtcacagttcctaccgttgaggattttattctgataacagacaaggcatatacaagaaatgaggttttagatatggagaaattaatgatgaacatcttgcaattcaagctgtctatgcctactccatacatgttcatgagaagatttctcaaggcagctcattctgataaaaagctggagctcttgtccttcttcttggtcgagctttgcttggtagaatgcaaaatgctgaagttttcaccatctttgctggctgctgctgccatttacacagctcaatgtagtctgtaccagtttaagcaatggactaagaccaccgagtggtacactgattactcagaagagaagcttctcgaatgctcaaggctgatggttactttccatcagaaagctggatcagggaaactcaccggtgtatatagaaagtacaatacatggaagtatggctgtgccgcgaaaatagaaccagccctgtttctactggataattaa

SEQ ID NO: 115359 - DNA, 1326 bp, Glycine max
  Peptide Sequence Number=SeqID_232137
atggctacaacgcaatcctacgaagatttggaagcgaaatatgaaacagaggaaacgtctgaatcagtcatcttggttgttcacatgcctgatggttttgcaagagagcatattggagctaaaattgagtacgattttggaagggtgagagttcacggtgaaagatcacttggaaacaatagaagggcacgtttcaatgcattatatcaagttccagaatattgtgacatcaacaaaattaaggggaagtttgatggcaaaactgtcatcattacaattccaacgattccagggaaagtacctaagaaagaaacacaaccaactgaacaagaaccacccaaagaaccatcacaagaagcagaatcaaatccagaggaagaaaaagaaggtactcctccttcagatgataatcaagaaagtaaagaagagactggccatgtgacttcaacttcaaacccaccaaatgcctcacaagaagagtctatggatcaaaagggtcaagagggaattccccaaaaagctacacttaacaaagttgaaagtgaaaaacatgttggtcaagaggcttcttcaacttcaacgccaccaaaagacacacaagagtctaaggctcaaaagggtcaagaaggaattcccacacaagttgctcacgaggcttctttaacttcaaccccaccacaagacacacaagagtctatgcctcaaaagggtcaagaaggaattccctcaaaagacaccattacaaaagtagatagtaaaagtcaagttggtcacgagggttcaacttcaaccccatcacaagacccacaagagtctatacctcaaaagggtcaagaagcaattcccccaaatgctacaccaacaacaaatgccaagcttcaaggagaggaaaagtttgaaggggaaattgatgaaaatgtggaaaagcaaaaggttcttggaaaggaagaaactaaagaccattccgagaagcctttggaatcaggaaagccacctaagaaggctgtggtggatgattcccccaaaaaagaaggcaaagaagaaagtaaagggttggccgcatttgaaggagagaagggaagggaaataaatgggaaaattggcaatgatgttgttggaagaaagagtgataagaaggccaagcctgactcaacaacaagggcaacaattaaggaagtggttgcttcagcttctcaagctatgactagtctagcaaagaagttcaatgaagaagataaacaaaggatagcatacatgggtacagcagttcttgtggtggcactaggagtttatgctacctacaagcttcgttcacgtgtaccatag

SEQ ID NO: 115360 - DNA, 603 bp, Glycine max
  Peptide Sequence Number=SeqID_232138
atggagaacagggtaatattacaggaatggtttgaccgcgttgactcggagaaaagtggaagcataacagcggtacagctgaaggtgaggtgggtggtttggtttgaattgttagttgtgattatttgtggcgatcttattgtttactcttactcttatcagactgctcttgctgtgggcaacctggaatttccgctctcagttgttcagcaaatgatcaggatgtacgatttcgacaggaatggtactatgagctttcaagaatttgttgcactcaacaacttccttcttaaggttcaacatgcattttctgatctagagaggggtcgtggttttcttgtacctgatgatgtatttgaggtcctttgttggtatattggtggatgttctcctcttacactggtgcccttgcaagatctgttttttccttttccaggatatgagaatattactgatgagagttgtcatgacccactcttggatcatgaccagctcatagactataattttcttagtctggttaacttaagagtacctcactcccaatcacaattaaaagatcgaccaaaaggggttataaaaaatcagcagagttttccctaa

SEQ ID NO: 115361 - DNA, 147 bp, Glycine max
  Peptide Sequence Number=SeqID_232139
atggagaagaagagggagggtttgagagatgggggctttgggaaaaattggtttcatgctggattctcctgctttttactctgtctgcgaggaacctatttaattcatttgatacagctaaacaaggcagagttactctcgatctga

SEQ ID NO: 115362 - DNA, 435 bp, Glycine max
  Peptide Sequence Number=SeqID_232140
atgccatcctatttgaagcactgttttgcttactcttcccttttccctacagattttggctttgctggtgctcaaatttcaagtctttgggcgggacttggattgcttcgatctccagttggaagtcgacaggtagagcatattgcagcacaatatatagatgagttacactcgagatcatttctggaggattttgaggactttggccacatttactatttcaaactacatgatttggtgcatgatcttgctctgtatgttgcaaaagaggatcttctagtggtaaacttgcgtacttgcaatatacctgagcaagcaaggcatttatcagttgttgaaaatgattcacttaaccatgctttgttccccaggtccagaagtgtgagaactatactgtcatgccttgaatttaaatcactcccacaaacattctaa

SEQ ID NO: 115363 - DNA, 1119 bp, Glycine max
  Peptide Sequence Number=SeqID_232141
atgtgggtgtgtatctctgattactttgataagaggcagataattattaaaatcatcagttctgctttggcttcagctccaactagtgctcttgctaaccaagaaaatgttaacagcttagatattaagcagttacaaatttatcttagacacaagctttctggtcagaagtatttactagagatggatgctatatggaatgatgacagtgcaaaatggatagagttgaaagatttaataaaagttggtggaatgggaagcaaaatcttgttgagctatgatcaaatgccatcctatttgaagcactattttgcttactcttcccttttccctaaagattttggctttgctggtgctcaaatttcaagtctttgggcgggacttggattgcttcgatctccagttggaagtcgacaggtagagcatattgcagcacaatatatagatgagttgcacacgagatcatttctggaggattttgaggattttggccacatttactatttcaaactacatgatcttgctctgtatgttgcaaaagaggatcttctagtggtaaacttgcgtacttgcaatatacctgagcaagcaaggcatttatcagttgttgaaaatgattcacttaaccatgctttgttccccaggtccagaagtgtgagaactatactatttcccattgatggaatgggtgtcggcagtgaagctctcttggatgcatggataacaagatacatatacttacggcttttagagttaggatatgtgcagcttgaaacattgcctaaaggattagggatgttaatcagccatcaacacttgcatttaaccacaaagcaatctattctgtcagaggaagattttgcaagcttgagcaatgttcacactttaacttttgagtattgtgacaatttgaagcattgtccaaggcaacagacattgcctcaatggattctaggagccgctgacactctgcagacattgctaatcataaattctcatagtcttaagatggttcccgagtggctgacaacaatgactcatcttaagatgcttcatattgttaactgttctctgctgttgtgtctgccaagtgacatgcatcacctcattgccctttaa

SEQ ID NO: 115364 - DNA, 2032 bp, Glycine max
  Peptide Sequence Number=SeqID_232142
atggccaaagctgaaggtggcaaggaaccaataaatgaacaagcagtagcaaatatgtatgctgcaatgaggtctgagctcaaccaaatttactccaaaataactgaactggagatggaagttagtgagcacacattggttaccaatgccattcaaccacttgaccaatctagacgatgctatcgtatgattggaggggtgcttgtggagagaaccatcaaagaggtcttgcctgctgtgcagcgaaataaagaaggactcgaagaggttgtggcaaggcttaacgaggcgttggaaaagaagaaaaaggaaatttctgagtttgaggctaaatataaaatcaggataaggaaggctgatgctgaggtgaaggatgaatctggtaggaaggaagggtctgctcagggggttcttgtgggtcctgcagatccattgcagggcgatttcccagaagtgatagaggagtatttggaacatggctgtatgaaatgcattgccttcaatcgccgtggcacccttcttgctgctggatgcaatgatggaagttgtgttatttgggattttgaaacccgaggcattgctaaaattctgcgtgatgatgaatgttcttctcccataaccagcatttgctggtcaaagtatggtcatcgaattcttgtatctgctgctgataaatcattgttattgtgggatgttatgagtggtaagaaaataacgcggatagttctgcaacaaacccctctacaagctcgtcttcatccaggatcctcgaccccgtctctctgcttagcatgtcctctttcatgtgctccaatgattgttgacctgaatacaggagacacaactttacttaaagtttctgtctcagagacatgcaatggaccaacccctccttcacgtaataaatgttctgatggaattacctccttcacaccaactgctgcttgttttaataagtatgggactctggtttatgtgggaaactcaaaaggggaaattcttgtcattgattacaaaaatggtgacgtgcgtgctgtagttccgatctctggtggttctgttgtaaagaacattgtgttcagcaggaatgggcagtatctgctcacgaattcaaatgatcgaataatacgaatctatgaaaaccttctgcctctgaaagatgaagtcagagcccttgatgacctgagtgggagccacaacgatctaaataatattgagaatttgaaggctgttggatcaaaatgtttaactttattccgggaatttcaagattccatcacaaaggtacactggaaagcaccttgtttcagtggtgatggtgagtgggtagttggtggttctgctagcaaaggtgagcacaagatttacatatgggatagagctggacatcttgtgaaaatcctggaaggacctaaggaagctctgatagatttagcatggcatcctgtgcatcctattgttgtatctgtttcgctgaatggtttagtttatatatgggcaaaagattatactgagaactggagtgcatttgctcctgatttcaaggagcttgaggaaaatgaggaatatgtagagcgtgaagatgaatttgatctgattcctgagactgagaaggttaaaggacctgatgttgatgaagatgaggaagttgacattgtaaccgtggagaaagatgccactttcagtgattctgatatgtctcaagaagagttatgttacttgccatcaacccctagtcatgatgttcctgagcagcaagagaagtgtgtagaaagttcttcgaagttgttggacagcaataacactggatcccctctttcagaagaagctggaccaaatggacatatgatgaatcatgcatcaagtcctcttgaagatgatgctgggcgcatgaaaagaaagcggaaaccttcagagaaggtgttggaattacaagcagaaaaagttaagaaaccttcaaaatctagcaaatcggaaaaacctaagagcaaatctttggccgatcaagataatggtaacggttttcatggtg

SEQ ID NO: 115365 - DNA, 390 bp, Glycine max
  Peptide Sequence Number=SeqID_232143
atggaaggcgcactagaagagaaaatgcatgtcaagattgcccacaacattgtggctcaatctgtagaaaatgccaaagaagagaaggttaaagcagctgatgactcgtttagcgaagcatatccgctcagcgagatgcatccatttagtgagacatcttgcccgcttagcggatgggaaaccctagaagaggagaagtcagagatctgtgcgctcagcacgcaaccagcccgcccaacgagaatgttgtttcttctcgcgcttagcgcgcccactctcgttaagcgaaaattcactaactctcgcttagcgagccatgctcgctatgcgagccttcagaagtttaatagtccaagagcctttaaaacattgagattgacggagttttga

SEQ ID NO: 115366 - DNA, 2358 bp, Glycine max
  Peptide Sequence Number=SeqID_232144
atggaatatggtgggttggtgcagaatagtgcatatgggagcttctcagaaatttttggcccagaaacggatttcatagatgaactgtttgtggaaggatgctgggtggaaacaagggttggatcgtacctgaattgtgggggggaggctaattcctcaaagccaaacacgatggctagcatggagacgtcggcgcaaataatattccaagaagaatcattatcagacccggaaattagtttgatggtggggaagagatggtggattggaccaagggagaatccggggccatcttcctctgtgaaagagagattagttattgcagtcgggtacttgaaagaatacgccaagaattccaatttgctgattcaggtatgggtacccgaacggaggagatctgcacgtgctcagcctcaggataactacccatacgccgcgcttcttaatacaacatcagcttttcagtttcaggaggattgggttcatgaccagtggactcccaacatccgcttcttcagaagtcacgagtacccgcgccatctacgacgtcctggatctctcgcacttcctgtctttgagagtggctccgccatgtgtctcggtgttgtcgagattctcatgcccaacaaccccgaccttcacgcccttcagagtgttgattttacaagcagtacttgtcatcagaactttattccacctgcagccgtgaccgcgaagggttttgacgagttgtaccaaagtgcattaaatgagatagtagaagttttgacgtgtgtatgcaaggcgcataacttgcctttagctctcacatgggctccctgcatccaacaaggaaagagtggatgtgggcattcaaacgatgagaattatgtgtcgattgtggatcctgctagttttgtggcggatgtagaggtactgggtttcctggaagcgtgctctgagtgtcaccttttgggggggcaaggagtagttgggacagctttcacaaccaccaaaccttgttttgcaaatgacataactgccttcagcaaggcggaatatcctctggcgcaccatgctaacatgtttggcttgcatgctgcggtggccattccactcctgagtgactccgctgattttgtgttagagtttttcctgccaaaggattgccatgacacccaagagcagaagcagatgctcaactccttgtctatgctagtacaacaagcttgcaggagtttgcatgttgtcatgggaaaggaggaggaggaggaggaggaggaggaggaattaatcgcgttgccgcccgttggcaaagaaatggagtcatcatcatcatcatcctggattgcacatatgatggaggcccaacagaaggggaaaggtgtctcggtgtccttggaatacctccaagagccaaaacaagagttcagagtgacaaccaactgcaatgaacaggttagtgttggtgttgagagtgggggaggagaagaatcatatactgcagcttttggtggccgccggggtgccaggaaatcagctggcgacaagagacgaaccaaggcagagaagactatcagcttgccggttcttcgacaatactttgcaggaagcctgaaagacgctgccaagagcattggcgtatgtcctaccactcttaaaaggatatgccgacaacatgggatcacaaggtggccttcaaggaaaattaagaaggtaggccactccttaagaaaacttcaacttgtcatcgattccgtccagggtgccgaaggtgccattcaaattggctccttctataccagtttcccagagttgagctctgccaatggtgtttctgaatcatccaacatcaataataagtttttttctgaatataaccaaggagctactactttcaaatccccaacttcgccttgcagtcagaccactattctgatttcagagaaccaacaaccacttgtacttggtgcatcaatccaggtccaagaggaagcaaaacatttcgcccaccatcttgagcctctaccaccagctcccttgccccaatctagtactagtctctggaacacggccggcacttttagagtcaaagctacttttggggatgaaaaaatccgctttagcttgcaaccaaactggggattcagagatttgcagatggagattgctagacgtttcaatctaaacgagattagcaacattcagctcaagtatttggatgatgctcgagagtgggttcttttaacatgcgatgctgatcttgacgagtgtaaagacataaatacatcatctcagagccgtacaattagactcttcctctttcaagcttcgcctctaaatcatgcaaatgcatttcgaggcaccagcccctcctag

SEQ ID NO: 115367 - DNA, 318 bp, Glycine max
  Peptide Sequence Number=SeqID_232145
atgttgcggcacgccgcagcaacgacgacggatagggtggagttgatgagatttttttgtaaaccaaatgaaacaaagttgaatttggcaaaagagaaatcactagaggaagaagagcatcgatccaataaacaaagtacaagtagcgacgctataaaggggggggggggaaacaagcgcaagagcatgaaaatagtaaaaactgtaaaagtaaatagggatcctggagagagagatgttgggggaatcaagaaaagtgtgggatttcaccttacatttgtactccaacaatctctgagccagtcaccaagggtttag

SEQ ID NO: 115368 - DNA, 390 bp, Glycine max
  Peptide Sequence Number=SeqID_232146
atggcaacgtgctcttcgttcagtgacatggatgcgttactaaagctgaaggagtccatgaaaggagacgaagccaaagacgacgcactccatgactggaagttttccacatcgcattctgcacactgtttcttttcaggcgtaacatgtgaccaagaccttcgagtcgttgctatcaacgtctcctttgttcctctcttcggtcacattccgccggagatcggaaacttggacaagctggaaaatctcacaatcgtgaacaacaatctaaccggtgtactccccatggagcttgccgccctcacttccctcaagcacctcaacatatctcacaacctcttcaccggcgatttccccggccaagccactcttccgatgacggaacttcaa

SEQ ID NO: 115369 - DNA, 1554 bp, Glycine max
  Peptide Sequence Number=SeqID_232147
atgaagaaaaagaattcacttgggagtgagaatgttgtccttgctgcatccattgtgagcaaatctggcaaagttctagtttctagacagtttgtggacatgtctcgtatcagaattgagggtcttctagcagcatttcccaagttaataggcactggaaagcaacacacatatgttgagacggagaatgtgcgctatgtttaccagccaatggaagcactatacctgcttcttgttcctgaatattcttactcccttgatgaagaggatatttgccaaaatgcatttgagttgatttttgcatttgatgaagtcatctctcttgggcatgcggaaaatgtgtctgttgcacaagttaagcaatactgtgaaatggagagtcatgaagagaaactgcacaagctggttatgcagagcaaaatcaatgatactaaggatgttatgaagcggaaagctaatgagattgataaaagcaagattgaaaagaacagaggtgataaagggggatttggtcctttacagtcactaggctctggaaaaattgaaaatagctttagtgatttgagcataactagcagcggacctggttttggaagtggctctggttttggattgagttctgatgttggttccttttctaccaagtctaaaggtggtccaacttcatctgccactgctccaccaaaaggtcttggaatgaagcttggtaaatctcaaaggacaaatcagtttttggaatcattgaaagcagaaggtgaggtcattcttgaacatgttcaaccaaaacttgctcaggcagctgccccaccatctacagatcccatttctttagctgttgaagagaaactaaatgtgacactaaaacgagatggtggagtcagtaattttgatgttcaaggcacattgtctctccaaattcttgacaaagaggatggacatattcaagttcaggtccaaactggggagaatcaagccatcattttcaagacacaccctaacatgaataaagaattatttgccaatgaaaatgtactaggtctaaaggatcccaataggcctttccccacgggtcaagctggtggttctgaaggtgttggtcttttaaagtggcgaatgcaaagcactgatgagtcaatggtgcctctgacaatcaactgctggccctcttcttctggaaatgaaacttatgtcagcattgagtatgaggcttcatcattgtttgatttgcggaatgttgtgatctcagtacctcttccagctcttcgagatgcaccatctgttagacagattgatggggaatggaggtatgactcaaggaattcctttttggagtggtctgtccttctgattgataattcaaaccgcagtgggtcaatggaatttgttgttccacaagccgaatcatcagcattcttccccatttcagttcgttttatagcaactgaaacatttagtgacctgaaggtcaccagcatcataccgctaaatgggggtaatcctcctaagtattctcagagaacacagttgatcacagaaaactaccaaattgtgtga

SEQ ID NO: 115370 - DNA, 819 bp, Glycine max
  Peptide Sequence Number=SeqID_232148
atgaaggacgcagatgtgtcaaggcagatccagcagatgatcaggttcatccgtcaagaggctgaagagaaagctaatgaaatatctgaattcaatattgagaaactgcaattgctagaagctgaaaaaagaaagatcaggcaagaatacgaacgaaaagccaaacaaattgacgttagaagaaagattgaatactcaacacagctgaatgcagcccgaataaaagtgcttcaagcacaagatgacgcgatgggttctatgaaggacgctgctaaaaaggggcttttacgtgtctcaaatgacaagaaagtatacaagaaactcctcaaagacatgattgttcagggtttactacgcttgagggaaccatcagtgttattaagatgcagagagagtgaccgtaagctagttgagtcattgatagaggaagccaaaaaagaatactcagagaaagccagtatgcaatcccctaagatttcccttgatgatcgtgtttacctcccaccaccgcctaagaacggcgccgttgattcccatgaaccttattgtcatgcaaatcgtaaaagacattggcgagttcaggctggggtgacacgtggcactggtctcgttagtgtaacaggcgatctgagctccatgggactcgccagtttgactggcgagttgagcttagtctctttattaagttccatgcaactggaattaaaaatatattttattaatcttttgataaagtgcacaagtgccggcatggcaattagaggcggtgatcacgtgacatgcttgtgtagagagcactgcaatcccatggaactgtaa

SEQ ID NO: 115371 - DNA, 2451 bp, Glycine max
  Peptide Sequence Number=SeqID_232149
atgaaggaaaagagagacttttctgagtttctgtcagagttaatagtcctggctgatgaggttgctttgttttctaagaatcctgaaattgatatagaggatgcttttactgagtttgctatgttggttgagaaatttgctccaatcttcaatgatctgagagacaaatgcacaatcatagacaagccagctatcagaaagtccttggaatctcttatgaatgagcttacccgagctaaagctttgatcagaagctcctctttgaaagagcgcaacaagcgaattgaggacatagcgcatgatctcggtcgatcattaggcatgctgcttgtggccagccttgaagtgtccatagattttagagaaaagattggcacattgcaaaaacagctgatgaatgcgagatttggtgggaatatgagtccaacttcaagttcgatatcaagatttgtcaatgaagcgaaggagggaggggaaatagaagaggagataattgatgttactagtgatgatgttttactacagcttaagaatggtgatgccgaggaatttgcagttgcactcttaaggctaaaaaagttcatcaggggtggaaaactggatagcggtttaattaatgtggaagctgctgtttccattctttttaaccgtccattttcgtctaaggcaggcaataggttgacaatcattcaattgctaagaagtattgctatgcgaaatgatgagatgaaggagaagatgacaaatattgagttattatcagcagtggtgaaatctcttacaagagacactgaagagaggagggaagcagtgggtctgttgctagaactctctgcccttcctgcagttagacggaagattgggagaattcaggggtgtattgttatgttagtttctatccttaatggagttgaccctgtttcttcacgtgatgcagcaaagttgttggatatactatcaaataatactcaaaatgcacttcttatggccgaggctggttgtgacatgaccaagattctcatggcaacaacactttccaggctggtgctcactgatcatagcaaacttacccttggacaagatggggcaattgagccccttgtgagaatgttcaattctgggaaacttgagtccaagttatcagctctaaatgcactgcaaaatctttccagcttgacagaaaatgtgcggcgtttgattggaactggaattgtaggatctctgctgcaacttcttttctctgtaacatctgtgctcatgactctacgggagcctgcatcagctattcttgcaagaattgcagagtcagaaactgttcttgtcaatctaggtgtggctcagcagattctctcacttttgaatctttccagccctgtgattcaaggtcatctattagaagctctaaatagcattgcttcccttccttgtgcttccaaagagagaagaaaaatgaaggaaaaaggtgcacttcaactaattttaccccttttgaaggaaacaaaaatgaaaataaggagcaaggcattgaatttgctgtatactctctcggaagatctaacagatgagtcgactgcacattttgatgaaactcatcttttttatattgttaacattgtcttatcatcaacatcagatagtgaaaaggctgctgctgttggcatactgagtaaccttcctgttagtgataaaaaagtgacagatgcactgaagagagcgaatttgttgccgattttggtatccattatggatttaggcacaggaagtaactcacctgcaaaaagtatcttaatggagagtattgcaggcattgcaatccggttcacaagctcctctgacaagaaactgcaacttctttcagcaaaacatggggtgattgctttgcttgtaaaactgctctcaagtggttcagcaatcacaaaactcaaagctgcaaccgctctcggtcaactatcgcagaattctccatctcttaggcggtctaggaagtcgaggtggttgtgtgttgctccctcagtggatgcatattgtgaagttcatgatggttattgctttgttagcagcacgttttgtctgatcaaggcaggtgctgtttctccccttatccaaatattggaagataaggattgggaagcagtggaagccgctttgaatgccctttcaactctattgcaagatgaaatctgggaaggtggtgccaattgcatagccaaattgtcaggtgtacaagctattgtaaatgtattagaagcaggtgatgtgaaggttcaagaaaaagcgctttggatgttggagagaatattcagggttgaagaacacagaatgaaatatggagaattggcacaggtggttcttattgaaatggcacagaggagtgattctacattgaagtcaacagttgcaaaagttttggcagtgctggagctgctactagttcaatcaagttatttctga

SEQ ID NO: 115372 - DNA, 432 bp, Glycine max
  Peptide Sequence Number=SeqID_232150
atgcaggaaagaaaaattgtcttcatcttccagaccctcatcaaacatcacaataatatcctttcatggctcgttacctccaactccaagccaccaaacccacgcacggaaactaccggtttcgcttggtgggccgggaatgcccgacttatcaatttatccggcaaactactaggagcccatgtagcccatgctggattaatagtattctgggccggagcaatgaacctttttgaaatggctcatttcgtacccgagaagcccatgtatgaacaaggtttaattttacttccccatctagctactctaggttggggggtaggtcctgggggggaagttatagacacctttccatactttgtgtctggagtacttcacttaatttcctctgcagtattgggcatcattaaatccaaattcccttccaaataa

SEQ ID NO: 115373 - DNA, 1342 bp, Glycine max
  Peptide Sequence Number=SeqID_232151
cttatcggggaggattccgaagagtttgtccaagttgaagactctgaggattctcaaactcggatacagcaacgcttacgaaggtggaattcctccggagttcggcaccatggaatctctgagattcctcgacctctcaagctgcaacctcagcggcgagattccaccgagtcttgcaaatctgacaaacctagacacgttgttcttgcaaatgaacttcctcaccggaagcattccgtctgaactctcttctttggtgaggctcatggcactggatctctcctgcaacagcctcaccggggagattccagagagcttttctcagctgagaaacctcactctcatgaacttgttccgcaacaatcttcacggccctattccgtccttgctgagcgagcttcccaatctgaatacgctgcagctctgggagaataacttctcctctgagctcccgcagaacctggggcaaaacgggaggctgaagttcttcgacgtcacgaagaatcacttcagcgggttgatccctcgggatttgtgcaagagtgggaggttacaaatcttcattatcacagataacttctttcatggcccaatccctaacgagattgctaactgcaagtctctaaccaagatccgagcctccaataactaccttaacggcgcagttccgtcggggattttcaagctaccttccgtcacgataatcgagttggccaataaccgttttaacggagaactgcctcccgaaatttccggcgattcactcgggattctcactctttccaacaacttattcactgggaaaattcccccagcgttgaagaacttaagggcactgcagactctgtcacttgacacgaacgagttccttggagaaatcccgggggaggtttttgacctaccaatgctgactgtggtcaacataagcggcaacaatctcaccggaccaatcccaacgacgtttactcgctgcgtttcactcgccgccgttgatctcagccggaacatgctagttgaggatattcctaaggggattaagaacctcacggtcttgagctttttcaatgtctcgagaaaccatttaacagggccagtccctgacgagataaaattcatgacgagcctcaccacgctggatctctcctacaacaatttcacaggcaaggtccccaacgagggtcagtttttggtcttcaacgacaactcgtttgcagggaaccctaacctctgttccattcacggatgcactttaagcattgtgggggcagctgcccctatcaacattttaacatttgtaaatatagtatgtacaattatagtaatttataaattgcttgtataa

SEQ ID NO: 115374 - DNA, 378 bp, Glycine max
  Peptide Sequence Number=SeqID_232152
gaaatagagcataaagcttactgggctgtaaaaacctacaatttctctattgatcaggcaggagaggaaaggaagtttcaagaaagtgagctagatgagatccgtttagaagcctatgagatttccaatttttccaaggagaagcccaagaatttccatgacagcttgatagttaagaaggacttgggggttggacaaaaagttttattgtataactttaggttgggattcatgagtgttgggatcaaaagggaatccatagataagagcttcaaggtcaatggatactggctgaaaccattcctcacaaatccctccttaggggatgtagtggggggggagccctccttacttccccttattttttttccgccatga

SEQ ID NO: 115375 - DNA, 555 bp, Glycine max
  Peptide Sequence Number=SeqID_232153
atgaagcaaaagattgtgatgaaggtgcacatgaattgccaaaagtgccgcacgaaggcactcaaggttgttgctgcagcaagtggtgtgaattttgtggggttagagggagaagagaaagacaagttggtggtgattggagatgaagttgatcctgttaagttaacaaattctttgaggaaaaaggttggacacaccgatatcataagcttagcagaggtcaaggcaagtgtaaattctgtgaacatagagggggaaagcaaagatcgagtggtggtgattggagaggatgtggatgctgccaatttgacgagctgcatgaggaaaaaagtggggcacactgaacttgttactgttgtagagctaaaggcacttttaaaatcgttcagaagtataattgcttgcaaaaatgcagccttcgggctcttgaggcttgaagtgagagaaataaaaattttagttgttaaggaactcatggttagcgatcaattctcagatgatgatactcatcacatgaatatctatcttgagaggatcaaagttttggagcagtga

SEQ ID NO: 115376 - DNA, 333 bp, Glycine max
  Peptide Sequence Number=SeqID_232154
atggcaggaagtgacgaaggcatgcaagacttggagaacaacgttagtagcactattactactcattctacatcaaatgaaagcactactactaatcaagaaaaaggaaaagagattgacactacaactgctaatccagaaaacaacattggagtattttcaggtgtgattgatacggaagaagttagaggaatgatggtgtctgatccatttattaaacaaactgttgagtcctttttgaaatattcagagccagagaacaaagaagacagtcaaaatgatgccaaccaaggatcaacaattgcacctgctaagcataccaaaacaccataa

SEQ ID NO: 115377 - DNA, 492 bp, Glycine max
  Peptide Sequence Number=SeqID_232155
atgtacacagtggaattccaaaaacgagggcttcctcatgtccatttattgttatttttacacgccaacaacaaatatccatctccaaatgatattgataatattatatcagcagaaataccttcacagaaagatgatccagaactctataaattagtccaaaatcacatgattcatggtccatgcgaaattttgaggcctgcatctccatgcaggaaggaaggcaaatgcagtcgattttatccaaaaaagtttcagcccacaactcttatagatggagatggttatcctgtatatcgtagaagaaatactggtcagacaataaccaagaatggtattataattgataatagatgtattgtaccctacaatccaagattgttgaaaaaataccaagcacatataaatattgaatggtgcaaccaaagcacttctatcaaatatttattcaagtacatcaataaaggatatgatagagttacggctgtgatg

SEQ ID NO: 115378 - DNA, 555 bp, Glycine max
  Peptide Sequence Number=SeqID_232156
aaaggtggcaaagcgatccagcgccaggcggcgcatcgagatttcgtttttcagttcgcccatttcagcgaatgtctggtagccgaggacggttttggcggtcacgcccgggctgtccagcccattcaccagtttggtaaagcgttccgcgttcagccggctccagaagatgcgcgtcagtccggcgggcaggccattgagcccatccagatacagaccggctttagtcagtttgtcacgaaccagctccacctcattttcggtctgaatctcttcaatacggcgcgcaatgggcaccacttcgacacccaccggctcaaggatgtccaacctggtgacgcgtatccggctgcggttccggctgttattgtccggcacgctgtcgccgcgccgcgtggtcattctactctgcggcgacgtcactggcgaggaacaatcgggtcgcgctgcgcgcgccttcgccggtatagcgcatcgcttatcgctggcggcgttaaatattgcgccctgaatgtgttaatagcgctatttgacgccgcttatgtcaaatattaa

SEQ ID NO: 115379 - DNA, 195 bp, Glycine max
  Peptide Sequence Number=SeqID_232157
atgtatcaatctcacacagtgcgtggcgagaaagttgctagcgcacagggtaaggattatggtgagttaggattttggctcaaggcttgtagaacggctggtcatgatacatgtctggatttggccagcggttcggggataaaggggatgtccccacattattcccatgatacacatgcaacaaatgatgattag

SEQ ID NO: 115380 - DNA, 324 bp, Glycine max
  Peptide Sequence Number=SeqID_232158
atgtccccatcgacgatgccgccgccttcaaatccttcgtccccgaaaaagttgacgtcgccgtgtggcttatccccaaccccaattttgccgccagcagatttttctcagcgagacgccgtcggtgataaattgtcgatgaatgtgatgagcaagacgttatggtggcaacggcgatgcgggcctagccgccaaggatctatcggtggcgacgtgtgcttaggatccgtcggcgactctggactgtggttagcaagacggatggagagagggagttgcgctatggactccttgtccaagccacagatcgtaccggaatcttag

SEQ ID NO: 115381 - DNA, 498 bp, Glycine max
  Peptide Sequence Number=SeqID_232159
atggccggttcggttagaactgggggaaagggcaccgtgagaagttctcttaatgttttgtcttatgctcggtctagaaagaagaaggctgtccacaagacaacaaccacagatgacaaaaggcttcagagcaccctgaagagaataggggtgaatgccatcccggctattgaggaggtcaatatctttaaggatgacgtagttatccagtttctaaatcccaaagttcaagcatccattgctgctaatacttgggttgtcagtggttctccacaaacaaagaagttgcaggatatactccctagcattatccaccaattaggaccagataacttggaaaacctgaagaagctggccgagcaattccagaagcaggctcctgaaggagccactggttcaaccaccgcccaagaggagaatgatgatgacgatgtcccagagcttgttccaggccaggattttgagacagctgctgaggagaccaaggctgcttcctag

SEQ ID NO: 115382 - DNA, 294 bp, Glycine max
  Peptide Sequence Number=SeqID_232160
atgatggtgacggtgcatatcgctaccattaccagaggtcatcttcctccccttctctcgtgcacgttgctgaatctcaccatctccaaggtgggcgtgatggacctcattggtgcccacagcatagcagcgaggaatgatggtgtggcggctgtgggaaagctaccaaggctggaggggttttaccaatttgatgatgaagaggactcaccggttgctgacatgttaatgcctgagagccacgtggaggaattaaaggacgaagcttcgtttggcgatgatgatggagtttga

SEQ ID NO: 115383 - DNA, 366 bp, Glycine max
  Peptide Sequence Number=SeqID_232161
atggcagcgccatggtggaaatcctactggctgccatacaaaggcagtggcattgtggatttttcatggcacgccatggcggctgctatccgtgttgtgcttatggtgtccagaacggctatggctgaagatgacctagttgggtcattgtggcagaacctctggtttgaggctccacacgatcattcactagaggtggtgttgcagtttcacttgcggttggtgcatgaagagaatgaattggcactggtcattgccattttcaccattggagataacaaggccattgccaaggtgaaaccagtgttgttaaatggcggccatggcggcgccatggcggtttttcgaaaaaacgccaccgaatag

SEQ ID NO: 115384 - DNA, 234 bp, Glycine max
  Peptide Sequence Number=SeqID_232162
atgggactgttaaaacttcgtcttctccgcgagaacttctcgctgcaggccgccgttcctgacaggtgcgtcgctgccggagctcgtcgctgccgtttgtgccggtgcgtcgctgccggaggtcgtcgcggctgcgtgcgcgtgcggctgcgggtgtcgcggctgggtgcgcgtgtggggtgcgggagggacgcggctggtgcaggggaggctcgcggttgggttctctcttag

SEQ ID NO: 115385 - DNA, 777 bp, Glycine max
  Peptide Sequence Number=SeqID_232163
atgatagaggcagaatccccatcattttaccaggtgacaatgaggagtaaagctctaaacttggttcatgtccttgatagtgctgctgctgctactacaactgcacctgttgttgtctcacctatgagactttggattcatgaaatacaacagaaaagcctcatggatgggttttcccaaataacaggagttcaatacaagttcattatgtttggagatggacacaagaacccaagctactgtgatcttgtcaacatgattacttctaatgtttttgatgctgccgtaggtgacattgcgattgtctctctccgaacaaagattgtggattttactcgaccatatatagagtcggggctagttgtggttgctccagtaaaaaaaattgaagtcaaatgcttgggctttcttgcgaccatttactccacatatgtggggtgtcactgcttttttttcctctttgttggagcagtggtgtggattcttgaacatagaacaaacgatgagtttcgagggttaccgagggaacatatagttacagttctttgttttagtttgtcaaccatgttgtttgcgcacaagaaaacacacttagtccacttggttgagttgtgtccatccatgtcctgcatttacatactcacttccctcacatgcatctcacccccgaaagtgacagacatgttgaattgggccacatttgtcgttgatccccctcttcgtcgctctaccgacaccactctcacactcgatgtgtttagcatgcaatttccttaa

SEQ ID NO: 115386 - DNA, 159 bp, Glycine max
  Peptide Sequence Number=SeqID_232164
atggcggcagatatcttggaatccaacaaattgtttttgtatttgaaaaatagacaagaagagcaagagagtaaagcagcagaaggggtgaagatagggatggcaggcatgtttggatgtagttgccgttggcagtgggcggaggcgaaatccatgtga

SEQ ID NO: 115387 - DNA, 393 bp, Glycine max
  Peptide Sequence Number=SeqID_232165
atggagataaccaaatcacttgtctccaacaacaataataaaaagaacaaatgcacaccttccaggttagtagggcctgatggtgttggactgttggtactgcctcgcaaagttgaacttaaggatgactcaagcttgctagttgcaacctatcaaccactaccagcagcattcacaaagcaaagcagctactacaccaaagcaaatagtttctatataacatgctcaaaactaaagtactcaaatcaaaactggagaaacaatgttgggcttggttggaaaaggatgaaagagaggctgagggacaggaaaatgcagagggtacagagaccaacaaagcatgaacaagtgtttggctgctggaaaattgagagagcaaagtgcagagagtga

SEQ ID NO: 115388 - DNA, 1824 bp, Glycine max
  Peptide Sequence Number=SeqID_232166
atgagtggagctgttcttgttgctgttgctgctgccatcggtaacttactacaaggatgggataatgcgactattgcaggatctatcttgtacataaaaagggagtttcaattacaaagtgaacccacagttgaaggtctaattgtggctatgtcacttattggagccaccgtggttactacatgctctggtgccctatcagacttgcttggccgacgtccaatgttgattatctcctctatgctttattttgttagttctcttgtcatgctatggtctccaaatgtttatatcctcctctttgctagacttttagatggtctgggaattggtttggcagttaccttggtacctctttacatatctgagacagctccttctgagattaggggattactcaatacacttccacagttcactggttctgcgggaatgtttttctcctactgtatggtgtttgggatgtcactgatgaaggcgccaagctggagaatcatgttgggtgttctttcaatcccttctcttatttactttgcactcacactgttgttcttgcctgagtctcccagatggctcgtcagtaagggccgaatgcttgaggccaagaaggttttgcagcgccttcgtggaagggaagatgtttccggtgaaatggctttactggttgagggtcttggagttgggggtgatacagccatagaagactatataattggtccagccaatgaacttgctgatgaagaggatccgtccagagaaaaagatcaaattaagttgtatggaccagaacaaggccagtcctgggttgctagacctgttgctggaccaaattctgttggccttgtatctaggaaaggaagcatggcaaatccaagcagtctagtggaccctctagtgaccctctttggtagtgtacatgagaagctcccagaaacaggaagcaccctttttccacactttgggagtatgttcagtgttgggggaaatcagccaaggaatgaagattgggatgaggaaagcctagccagagagggtgatgattatgtctctgatgctggtgattctgatgacaatttgcagagtccattgatctcacgtcaaacaacgagtctggataaggacatacctcctcatgcccatagtaaccttgcaagcatgaggcaaggtagtcttttacatggaaattcaggagaacccactggtagtactgggattggtggtggttggcagctagcatggaaatggtctgaaagagagggcccagatggaaagaaggaaggtggcttcaagagaatatatttacaccaagatggtggttctggatctagacgtgggtctgtggtttcactccctggcggtgatttaccaactgacagtgaggttgtacaggctgctgctctggtgagtcagcctgccctttataatgaggaccttatgcgtcaacggccagttggaccagctatgattcatccctctgaaacaattgcaaaagggccaagttggagtgatctttttgaacctggggtgaagcatgcattgattgtgggggtgggaatgcaaattcttcagcagttctctggtataaatggggtcctctactatacgcctcaaattcttgagcaggcaggtgttggttatcttctttcaagcctaggccttggttctacttcttcatcctttcttattagtgcggtgacaaccttgttgatgcttccttgtatagccattgccatgaggctcatggatatttcaggcagaaggtattcatctccccattaccattttccattgacttctttatcaaatactaagaaatatgtttaa

SEQ ID NO: 115389 - DNA, 381 bp, Glycine max
  Peptide Sequence Number=SeqID_232167
atggatgaagacagacctgagacccacgatggaaggcccaagagaagtaccaagcgatctgagaagccatcagagctgaagcccaatgtttcgctgtctggtgttaaggtcgtgactgatttggtagtggtctttgatgatgtggagccatgtctgattggctctgtccgatttcttggaacaaaattcgttgatagtgatagtgatgtcctagttattgataagtcatttggttttgacactgctgttgaagaggcacaaggagccataaactttgctcatgtggaagcagaaagcactgagaatggtaacgatattgtcaagcttatcggtcgttacagtggtaagtatcatttacattatggtagtttacaattttag

SEQ ID NO: 115390 - DNA, 738 bp, Glycine max
  Peptide Sequence Number=SeqID_232168
atggttactgatggaaccaaaaagcctcaagtttcagtacctacaccaccaccaccttggaaaatcaatttgcagaaatatgctgaatcccatgctctcgaactccatagtcttcaatctatcatagaaaatagagtaaacagtgattataggtctcaaaagaacaagagaagaaggaaaactgtgtttgataaccaaattgcaagaaaagggtgcagaagaaagaggcagaaactgggaataattgataaagcccttgccaaatcaggtttggaggagaatcaccaaaagaagcttcctcggtgtgttcatcggagatatgaactaaagaaaaacccagagaatggtttttgcacttctggggatgtaaccaagaggctgagaactcatgtttggcatgcaaagtggtttgctatgaccaagctttggggttaccaccttcctttgtgtcttcaaggaaggttcgagggcgctcttgaaaaaggctcaaacaagaggtgcttgtacatgatgcaagctattatactgccctccaattggagggtccagaggctctcctgtatacatgattcattaatgtctgtattaagaatgatgctggaaccatatccgacaacaacaccacatcctggaaatcatgatgactctgttctttacagtgtaacctatggaagagcaatgctgcatcaatgtggagcaccagtttctcagccaattgctcctgtaacctacatgtag

SEQ ID NO: 115391 - DNA, 207 bp, Glycine max
  Peptide Sequence Number=SeqID_232169
atggagccgccagtgaagaagcagacggagagtgcccgtacaagaaacctatggatgtggaagagtgtgagtttatcacgggaacccacaacgagagcctcgtctcctgcgtgtgaacctccaacgaaaaacgatgatggcaaccaaggttcggattcatggattcacgacgtgctgagggggaagagcggatggcgatgctgctga

SEQ ID NO: 115392 - DNA, 467 bp, Glycine max
  Peptide Sequence Number=SeqID_232170
atggacgttgataagatccttccatctagcagcaccttaggatggcatagccttaaagttaagggcgagttgaaaataagcgtagatccggggattcccgatataggtcaacctttcgaactgctgctgaatccacgggcaggcaagagacaacctgcgaaatgggagcagctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgg

SEQ ID NO: 115393 - DNA, 273 bp, Glycine max
  Peptide Sequence Number=SeqID_232171
atgttgtgcttagtgtcaccttcgcttttagcgcgagtaagtggatttgagcttagcgccagtcgtgcgctgaggcaggctgaagataatgctgcgcttagcgcactgattcgatgtctgtcgacgtctgtgtttgcaggaccacatcggaaccctcttcagtggtgcccctttctggacctcttcgcggggagcttcttgggagccatttctagtgaagacacattggcaaaggcaggggatatggaaatgccatttgaaggccaaaattaa

SEQ ID NO: 115394 - DNA, 519 bp, Glycine max
  Peptide Sequence Number=SeqID_232172
atggcttgtatatacacaatcatggccttcatcatgtcctcatttatacatttcattctaaaattcagagatggatgcaaagattattactcacagctagtcgttcactcacagtttaagatcacactctcaccgattttggttcaagtttttctttctcaatcaatctgtctactgactaacaattctaattgcaatattggagtagttggaggagaagtgtctagagtcaggaccagtgtggtcgggtcctcaggtatctctaggataggtctattgtatgctgaggtgaaggtaggtcctccactggtgcagaaggctctaaagtggcctcaagagatctctcaggagtggcagcaactacctgtctcacctgcctcttcccctacaacaaatggctttggaatggtggcctcagatggctcatcctccatatgctgtggtacctgggctgaaggaatggatcctggaggcgccaccacctataaactctgcaataaaatgatctgtcccttatga

SEQ ID NO: 115395 - DNA, 273 bp, Glycine max
  Peptide Sequence Number=SeqID_232173
atggcaagtccgatgacatgcgagggggcaaacgagcccgttgacgcgcagagactaacatcgtcttcctcaccttttgtcatccatggacaacaagtcaggtggcaggcggagataccctatggtgattcgcacctttcatcaaccaggggcatcaagcccgttgacgcgcagggactaacgtcgtcctctgcacctttcgtcaaccatgggagaagcaagcccgttgacccgcaaagaataacatcgtcttctgcaccttttgtcatctag

SEQ ID NO: 115396 - DNA, 144 bp, Glycine max
  Peptide Sequence Number=SeqID_232174
atgacaaaaggtgcagaagacgacgttagtctctacgcgtcaacgggctcgttttcccctggctcacttccccccttgttgacgacaggtgcagaggacgacgttagtccctacgctgcaacgagcttgtttacccctggttga

SEQ ID NO: 115397 - DNA, 261 bp, Glycine max
  Peptide Sequence Number=SeqID_232175
atgtcaactgttcggccaactgatgacaagaaagagaggcaactaatgcacaagctgttcattaaagaaattgccacttggcggagagagggtgacatcttcggatcagacacactggggatgacacttggggaaatagagggtaagattgaaagtgacccgacgtcgcatcacaaacactcggcaatcttcaatggggaagatgccactagggtatatcaaaatagtgacggggtaaagcccggcatatgcagcaactga

SEQ ID NO: 115398 - DNA, 396 bp, Glycine max
  Peptide Sequence Number=SeqID_232176
atggaggttgaggaaaccaagcaggggttatggctatcattgaattatcgaatagatataagagcaagtttagcatatgacactggaatttggggtgaatcctataggctttttgttgcaaaattcctttttggctttgtggttgatttagggatggcctttatggataattgggtggtggggaatgagaagttgcatcctatccggaaccatatcaaaattgtactgatattgcctaacgaaggcaaccattatgtccttcctagaatggactcgggaaggctccaagttagcgtaccaggtaacagctaccccagtacgactttcttggaagaaatgtatcagcagttcctcatcttttgcttatgcccccatcttccgacaatacatctttag

SEQ ID NO: 115399 - DNA, 600 bp, Glycine max
  Peptide Sequence Number=SeqID_232177
atgaaggaacacgaccggctgagccatgcgcgggagcggatgatgcgcaagttggccggccgccgttcctcttcgcgattgcccgaactcgtcgagctggtcgtctcccgccccgtggtctcggcagccatgatcgtgaaggaactcggcaccacgccacagggcgcaatcggcctcgccaaccagctggaattgcgggaggttaccggtcgtggccgtttccgcgcctggggcatgctgtcaacgaagcggctatgttcctcgctgcgttgcaacaccgatttcttctccggcaacgcggtcgcattcggcccggcaacttttctctgccgcccgcatttaagtgtccatcatcagggagatgcaataatgacaatttcagtttcacaacccgattccgatcacgaaaccgatgctcctttcgccaaaaaggtcctggcagcgcgtaatcttgccggctatacgatcgagcagcttgccgtgacctgtggcctcaccacgagcgaaatacgtgccctggaagacggcacggacagcgatcccctgcgcatccggcgtgttgccgccgcgctgcatattccggtcgaaaccgttatctga

SEQ ID NO: 115400 - DNA, 327 bp, Glycine max
  Peptide Sequence Number=SeqID_232178
atggtagcaggaaatgcaattatagaaaaacctagggaacaatgggatgaagaagaaaggaaaatggtacaatataacttaaagtatcaaactaccagaatgcaaaaaaatggaaagtgttatgaatgtaatcaaccaggacatctgagagttgattacccgagtttcaagaaaagaatggaaatatctgagaggaaaaccttcaatgataagaaagcaaataaagcttacgtcacttgggaagataacaatatggattcatccgaagactcaaaaaatgaagtcatgaatctaagtcttatggcaaaaaattatgaaagcgaataa

SEQ ID NO: 115401 - DNA, 1300 bp, Glycine max
  Peptide Sequence Number=SeqID_232179
cagagggctacacatcgtcaccatcagagggctacacgcccttacctttagaggactacacgtcctcgccttcagaggactacacgtcctccccttcagaggactacacgtccttgccatcggagggctacacgtcctcaccttcagagagctacacgccctcgccttcagaggtctgcacgccctcgcctttagaggactacacatccttggcttcagaggactacacgtccttgcctttagagggctacacgccctcgccttcagaggactacacgtcctctccttcagagggctacacgccctcaccttcagaggactacacgtcctcgccctcagagggctgcacgccatcgccttcagaggactgcatgccctcccctttagaggactacacgtcttcgcctttagagggatgcacgtcgtcgcattcaaaggattacacatgttcgccttcagagggctgcacgccctcaccttcagaggactacacgtcctcactttcaaaggactacacgtcctaactttcagaggactccacgtcctcgccctcagagggctacacgtcctcgccttcagaggacttcatatcctcgccttcagagggctacaagccctcgccttcagaagactacacattctcgcctttagagcgctacacaccctcgctttcagaggactacacgtcctcgccttcaaaggactacacgtcctcgtcttcagagggctacacgccctcgcctttagaggaccagacgtcctcaccttcagagggctacgcgccttcaccttcaaaggagtacacgtcttcgccctcagagggttgcacgccatcgccttcagaggatatcatgtcctccctttcagaggactacacgtcttcaccatcagagggctacacatcgtcaccattagagggctacacgccctcacctttagaggacgacacgtcctcgccttcagaggactacacgtcctccccatcagaggactacacgtcctcgccatcggagggctacacgtcctcaccttcagagggctacacgccctcgccttaagaggtctacacgccctcgccttcagaggactacatgtcctcaccttcagaggactacacgtcctcgccttcagagggctacacaccctcgccttcagaggactacacatcctcgccttcagaggactacacgtccttgcctttagagggctacacgccctcgccttcagaggactacacgtgctctccttcagagggctacacgccctcaccttaagaggactacacgtcctcgccttcaga

SEQ ID NO: 115402 - DNA, 642 bp, Glycine max
  Peptide Sequence Number=SeqID_232180
atggcgccaaaggacatggagaagatgacatttgtaaccctgtggggaatgttctgctataaggtgatgtccttcgggctcaaaaacgttggggcaacctatcaatgggctatggtagcattattccatgacatgatgcataaagaaattgaagtctacgtggatgacatgattgccaagtctaaaaccaaggaggaacatcttgtcaacttgcggaagttgttcgagagactacgaaagtacaagttaagactgaatcccgccaagtgcaccttcagggtcaagtcgggaaaattgttcggcttcatcgtaagccataaagggatagaggtggaccgcaacaaggtgaaggccatccttgaaatgcatgagctgcacaccgaaagcaagtccgagtggcattcggaaggtcaagcaatgccttatgaatcctcctatgcttatgccaccggtgcccgggagatccctgtggaagcaaagctttccaagtttattttgatgatgccaaagactcaagtcaagaatcaagagtcaaacaagtttcaagaatcaaagagtcactcaatcaagaatcaagattcaagtgaagattcaagagaagactcaagatatgcaagaacttcaagaaaagcatcaagataa

SEQ ID NO: 115403 - DNA, 432 bp, Glycine max
  Peptide Sequence Number=SeqID_232181
atggcttctaggaaaagaaaggcacattctacgcctacccaagtcagatttgacagatccagattcacttcccaagaggcttgggaaagatacgcagatgttattgtgcctaggaagcctttgcttgagaggaacatggttgtttataccatagagtttgatgaattcttagatgagatagcgagacgccactgggatgaggaattgactgatttcattgatggtagcatcgatgttgccattgtgaaggagttctacgccaacctctatgaccctgaggacaaaacacctaagcaagtgcaggtgagaggtcatttgattaagtttgatgaggacactcttaacacatttttgaagacccctgttattgtggaagagggggaatcactatgtgcttattctagatttgcactcctgaggcatgatccttag

SEQ ID NO: 115404 - DNA, 423 bp, Glycine max
  Peptide Sequence Number=SeqID_232182
atgatggaagccatgatgagtatgagaaggatgatggaggtcaatgcggctatagttgttgtcgcaagtaccgccacaaaagtggacctgactcacccacctggctttaatcaaatatgctaccgaggggtgaacatttggtggctacccctgccaaacactttagggggccctcagtatcacccacaaccacaacccttgcattttgtggtgggaagagcccctcctgctatagtggaaagggagaaattggatcttatagaggaaaggataagggtcattgaaagaggcagaaattatgcctttgctgacatggcaaagttgtgcctagtgtttgacatggtcattcctccaaagttcaaggtgccagacttcaatatgtacaaggggactacttgccccaataattacttaaagatgtaa

SEQ ID NO: 115405 - DNA, 201 bp, Glycine max
  Peptide Sequence Number=SeqID_232183
atggcagacacctactctgcccccgaggagatccacggaattctcagctatttgcgaatcaagtcactcccgcatattatctctagcatgcattgtatgttggtctcgtcctttgtcacgggaagccggaaggtccatatcaccttcttgattgtacacatggggcactgggcccccaaatgcgcaagtaagaagagataa

SEQ ID NO: 115406 - DNA, 186 bp, Glycine max
  Peptide Sequence Number=SeqID_232184
atggagaatgtaattatcaaattgagatgcccgaagaaacatcttttcttagttaaccatgcattagaggaaaacgcaaggatgagcaaacatgaaaacaaatggtatgcaattttgcagatcaaaagtttgttgaacgcatatgatgatgccatgactcatgcaaaatgtgaggctggaatatga

SEQ ID NO: 115407 - DNA, 396 bp, Glycine max
  Peptide Sequence Number=SeqID_232185
atgcgggtagagtttcctggagatgtcgtcgaagttttcacagtggtcatggcacctcttcttgatcggagcagacgagaaaagaggtttttcagcggaggagtgaggaagagggaggatcctagttttttgttggagacgctatcattgtcggtgatggcaaaggacatgaaggaggattttaaggagatgtcaaaggtttctttagagaacttgaggtccatggatttggcattggtggtgttgaagatgttaggttttgtgaaattgagggttagactcgatgactgcgaagggttagtcggtgcaggggatggggcgagagtgttaaaagtggaaggaaggggtgtgcaacctaaacgagcatggccggtgcagcggttgaaaaaggattga

SEQ ID NO: 115408 - DNA, 468 bp, Glycine max
  Peptide Sequence Number=SeqID_232186
atgcctaggccattcatgtgcaagatccccaagcttcctctcaaagaagaatctccacactccaatggaaatgtgaagcatcacacacccttaggcaaagaaactctgaaagtctatgtccttaacaaaagcaaccatcaagagaaggaatcctattgtgaacaacaacaagccagagaaggaatcagaggtgtcaatcagaagctgatcatggggtgttgtcccttgaagcttgcttgcggtctcggatctatggccaagcacagagatctctttggagtagaatatcatcaaagctccacaaatgacaaaggagatcagaagcatgggagaaaaatttcgaggaaggcacagcacggcaagttctcaggaacgagagaaaattttagggttcagaaaaatgaggaggattcccaaaaaggagatttgagaagctgggaatctaagcttgagaggaagatctgctga

SEQ ID NO: 115409 - DNA, 783 bp, Glycine max
  Peptide Sequence Number=SeqID_232187
atggctaggtccttccatcaccgctacctcttcgagcccttctctctcgaagtcctttctctcaagagtcaagatgagccacaagccacgacccatgagccacttctcttagggatgagcccctgctcagacccttacttgcacaaagctcgttctcgattctcgaccatcactcaagttcttcaatctctattgaacattaacccagccttgtatggttcatcatctggttgggataacactggcatcaaagagtggaggagaagaggcttttcgtctaagaagctattaattggtttaccttatcatggatatgcatggacacttgtgaaccctagagaaaacagtggcgtgggagtgccgacgtcaggacctgccattacaatggatggttccatggcttataagttcataaagagttacattagaagctttggaaatgttgtttcacattacaatgctacttttgtggtgaaccagttcactgttgcgtccaccattggggccaaagtttcttatgcaaggaaaaatgggctacttggttacaacgtgttccaaataggcaatgacaaaaattgggaactttcaaaggcagctcaagaagtagatgaagaagttgaagatcatcataagaagaggctggtgataattgttctgcttgcaactctgactttggtacttttgctggggatagtattttgctactaccgccgaggcaaaactcctctagctgcatcatatccttctgctacactatataacatccagaaatttatatcataa

SEQ ID NO: 115410 - DNA, 321 bp, Glycine max
  Peptide Sequence Number=SeqID_232188
atgtcatcttcgtcgtcatgttcatcaaatatacaaattaagtctggtccaatagatgatgacgttttatggatgcaagctaagcatgtttcagagcatgcttggaatgaggaagaagacagaaaattacacatcagacgagttgtccccatttgtcaaggtcaagaagaaatactagaggaaattattcctctacttcggcaatctggtctgcgtgttgatgaggcaccattaattggtccaacaaatcttggttgggctgatttatgtgaagaattgttaagagtcaaaccacaggaaggtgaacttcaaggcagcgtg

SEQ ID NO: 115411 - DNA, 1560 bp, Glycine max
  Peptide Sequence Number=SeqID_232189
atggatggtaggaggcattctgttgatattcctatttccaaaactcttatggcactgaggagagtgaggtcattgagggatccatcaactaatggtgttagcagactctctcctttgattgatgatggagattgggaagatggttctagtaatggtgtttctctgagtttgaggttcctgaatggttctcatgcatgtgattctaatggtaatggtcttttaagatcaagtagtttagattttaagggacaaagggagcaggacactgctgagtttgaattagacatgtggaactctaagatgaaccattgtgggatctcatgtcaggaagggcaacaagatgatggactagtttactctaatcctaagcagcaatgtatttctggagacaaatcttcaaatgaaagctgttgtagcaaccatgaaggtagaggattggatttggtttccatcatgccttcttctaatcatttgaaggatggagagtcctgctatttgtcaactgcaacaagagtagaacactcaaagtcggcaagaaaatccctacgcaagaatcaagtgaaaccatcggaagtgattggtgatattgcaagccatgtaggaagccaacaatgcctttctgtttttgatgcaccctcagctcgtagtgcctcggaacatatcactcaggatgaggacgttttggataattaccatggatgtggattaaggagttgttggtcaaagtcaccaaggtttagagaatcaaatcattattctgaaatagaaggccttcccttgatattgcaacacgtaagtgagacggatctcaatggacatagaaacatgagacacattggtggtgaaattagtccaactttggaaactcctagaagtttatccatgaaattcaggccaaaatctttcagtgatttggttgggcataatgtgataggaaagtctcttttgggtgctatctctacaggaaggatatcatcattttatctcttccatggaccacgtggcactggcaaaacctctgcgtctaggatatttgccgctgcactgaattgcctctcccctctggagcaaaagccatgtggtctgtgtagagaatgtgttttgttctttttgggaagaagtaaacatgttaaggaaattgattctttgagaatcaaccgtgcagacaaggttaagtcccttgttaagaatgcatgcattcctcgagtttcctcgtgttttaaggtgttcattgttgatgagtgccagttattgcatgcagaaacatgggcgtgtcttttgaatagcctagagaatgtttctccacatgtggtttttgtgatgatcactcctgatttggataagcttcctccgagtgcactttcccgggctcagaggtatcactttgcaaagattaaagatgttgacattgcaataagattggaaaagatttgtgttgaagaaggtcttgaatctgaacaagttgctttggacttcattgctgctagatcctgtggttctcttagggatgctgaaactatgcttgatcaactgagtttgcttgactggggtcatttctga

SEQ ID NO: 115412 - DNA, 351 bp, Glycine max
  Peptide Sequence Number=SeqID_232190
atgagacatgatctatcattgttcatagtcagatgctccacaagcgacctcacatttagaagttgggcaccgagccagaccacgttacagaggagttggattattgattcatggaaacgcggagatgaagttctacatatcaacgaaggggataaagagagtgacgatatcgaacggcgagggaaagggatcggcgaagacgacggcggtggcggccggcgccggtcgccggatatcggctcggacggtgtttccggtgatggtggtgctcgggatcgtgctgccgtttctgttcgtgaggatcgcgatcttgatgctggaatctgctgcggcgtgttcctcattgggtaa

SEQ ID NO: 115413 - DNA, 105 bp, Glycine max
  Peptide Sequence Number=SeqID_232191
atggttgtagggaagatattcgaacaacaactgatacctacttcactgggatgcaaacagggaaatttgtgtttgcctgcatttatgtgtttacagtgtatgtaa

SEQ ID NO: 115414 - DNA, 948 bp, Glycine max
  Peptide Sequence Number=SeqID_232192
atggatacagatggtgatatctgcagtacatctcctaaaggggacagcttggagcatcttgctacaacaggtcaatgtgatgacaagtcagatacattaggattaggagtacgggaggatcacagaagaacattggattctatatggtataaagctactgagatgtgtcaatctaacaggctcaaaacttttctcaggaaacaggggaagttgtcttcagtttgtattagtcaagttgccgagttggagttccaccaccgtgactatgtaagtagggctgagaagtcttggaggctgattgcaagttctctgcagttcatattgggttgtaaccttgagctcagaatcaattgtgtaccttcttgtacttcggattctatctatgctaaattgaagaggacatctttcagtttcttcggttgttctcggagaattcgttggaaatctatatcatctaatgaacaaggaagtgaatcagactatgctgattacacctctcaaaggcccatgatgaagactcaaactctaacttgttcctctaatcgtgaacctcgggtgccatcatttgagtcctacaatggaatgcaggtcgtgacaactttgagaagtagtgaaggaaatttgctaagctcagggaaaatgtttttgaataggccagatcaagagactccaagaatttcttgttcaggagttgattctctcaaggaagagggatgcaactatgagcttctagctccatcaacccttgatttagataatcagtctgactgctttccccgaactcgctggcttcataaaaagttctcttcttcatatgcatcacaagagaagaattttgttttatctatccccaagttcaaatgttctgaggcttatggatatgatctggaaccccgtgtcttttcccacagctctaacaactgcatcaatgccattgaggaaaagtag

SEQ ID NO: 115415 - DNA, 2106 bp, Glycine max
  Peptide Sequence Number=SeqID_232193
atggcttcgagcgaggggtttctgactgatgggcagagggaactgctaaaaattgcaagtcaaaatgcggagaatctgtcttcgtcgccgaagtctccgtcgtccttgctttctgaccatcatgtgaaagcccctgctggtggtaagtcacaaacctctgggatagccgtgaggcatgtgcgtcggtcgcactcgggaaagtatgggaaggtgaagaaggatggtgctggtggtaagggtacttggggaaaattgcttgatacagatattgattctcacatagaccggaatgatccaaattatgacagtggcgaggaaccctatcagctggttggaactactgttgctgaccccttggatgaattcaagaaagcagtggtatccatcatagaggaatatttcagtaatggggatgtcgaattggcatcatctgacctcagagaacttggctcaagtgaatattatccatacttcattaaacgccttgtgtccatggcaatggacaggcacgataaggagaaagaaatggcttctgttctgctttcagcactgtatgctgatgtcatcagccctgcacagattagggatgggttttttatgcttattgaatcttctgatgatcttgctgtggatatactggatgcagttgacatccttgcattattcttagcacgagctgttgttgatgacattcttcctccagcctttcttgccagggctaggaaggctcttccagaatcttccaagggagttcaggtaatccaaactgctgaaaagagttatctctcagctccacaccatgcggaacttgtggaaaggcgatggggtggtagcactcacataactgttgaagaagtgaagaagaagataggtgatttacttagagaatatgtggatagtggtgacacattggaggcctgtagatgtatacgtgagttgggggtttcattcttccatcatgaggttgttaagagggctttgatacttgccatggagattcgttcggcagaacctctaatgttgaagttattaaaagaagcagctgaagaaggacttgttagttccagccaaatggtgaaagggttttctcgtttggcagaatccctagatgatcttgctcttgatattccatcagctaaggcattgtttcagtcatttgtccccaaggcaatatctgaaggatggcttgatgcttcacttaccaaacctgcaactgaagatggggaaatccaagaagatgagaaggtgagaaagtacaaaaaggaatctgtaactataattcatgagtatttcctttctgacgacattcctgaactgattcgaagtcttgaagatcttggagcacctgagtataatccaatatttttgaagaagctaataactcttgctatggaccgaaagaacagggaaaaggaaatggcctctgtactgctctctgctcttcatatagagatcttctcaacagaggatatagttaatggttttgtcttgcttctggaaagtgcagaagatacagcactggatatattggatgcttcaaatgagctggctctgttcttagctcgggctgttattgatgatgtattggctccactgaatttggaagaaattggcagcaggttaccaccaaaatgcagtggtagtgaaactgtgcgtatggctcggtcactcattgctgctcgtcatgctggtgagaggctattgagatgctggggtggagggactggttgggctgtggaggatgccaaggacaaaatcatgaagctcttagaagagtacgaaagtggcggggttgtgagtgaagcttgccaatgcatccgtgatctgggaatgcctttctttaaccatgaggtagtgaagaaagctttgattatggcgatggagaaaaagaatgatcatatgctagatctactgcaggagtgcttcagtgagggcctgatcaccattaatcagatgacaaaaggtttcacccgaataaaggatggtcttgatgatctggctctggacattccaaacgccaaggagaaatttggcttctatgtggagcatgctcagtcgaagggctggcttctacccttatttgattcgcctgccacagatgcctaa

SEQ ID NO: 115416 - DNA, 189 bp, Glycine max
  Peptide Sequence Number=SeqID_232194
atgatcttcatggactcgaagggagacaaaattcttgctcaagttaagattcaagacattgacagatggaaagatcagctgaaggagaagcaaacttatattgtcaaaaactttgaggttgaaaatagcattgggcaatataggccatccaatcacaaatacaagcttacatttgccagagtgatgtag

SEQ ID NO: 115417 - DNA, 1041 bp, Glycine max
  Peptide Sequence Number=SeqID_232195
atggggaaagcaagtttgtatgattttttctcttgcccaaaccattattatcaaaggtctgggggttgtaagtttggtaaatcttgtaaatataaccacacaagaggaaaaatttcaacagcaccagcaccacttttggaacttaactttcttggcctgcctattcgtctgggagagagagagtgcccctactacatgcgcactggctcttgtaagtttggagcaaactgcaagttcaaccatcctgaccctacagctgttggaggagtaggaggtgatcctgcttcagggtatggtaatggagggtctatttcattacaaggtgtatcacaaacatctgtaccctcctggtcttctccaagaacattaaatgaatcatctccttttgtgccaatgatgctttcacctactcaaggagtttctacccaaagttctgattggaatggatatcagacttgtcatttatcctatgtgttttgttacaggcatattaaagagtcatgcagattaagcaatgcacatttggctttatgcccaggagcaattttactgatccctaaaaaagcatctgtctacttacctgagaggaacatgcatccaccttctacatttgtcatgaacaacccagcaattgatacaaatgtttacatgcaccatcaaaagcagatgcctgttgatgagtttccagaaaggcctggtgaacctgaatgcagctacttcttaaaaactggggattgtaagttcaagtctaattgtaaattcaaccatccaaagaatcgggttgcaagattacctccatgcaacctcagtgacaagggtctgcctttgagacctgaccaaagtgtctgctcccattacagtcgctatggaatttgcaaatttggaccagcttgtaagtttgaccacccgataaacttgcagcccgtgatgattcctggacttggtcagcaatcctactcaaactcagctagtgttgaagtggctgggatatttggaagtacaggtgttgtaactgatgcgacaattcagcaatctgtgtaa

SEQ ID NO: 115418 - DNA, 270 bp, Glycine max
  Peptide Sequence Number=SeqID_232196
atggtaatcgattaccagaggctaatttgcagataccacccaagatacatagctggccagccgccacacaagcctccttgcttcatggactttgttcttttattggttgactgccaagagcttgcctgtttaggtggcgatcgagcgatggcgcaaatcaactctcccacttccacaagtcaggcacaagcataccatccccagttgcccacctttaacttgagctcacgcactcctacgtgcccttatcctcgttcctctcagtactag

SEQ ID NO: 115419 - DNA, 207 bp, Glycine max
  Peptide Sequence Number=SeqID_232197
atgcaggggaagaggaaaaaagaggataccagcaacctgaaatcagtagaaaaacgtagaagaagaaggataagaggaaaagtggagccgaggtgctgtacaatgatgtggatcacttccttgatcatttctcttgttagtcttgtgctctactcaatgatcggaatagagcataactttttgattgcaaaaagcacgagaatataa

SEQ ID NO: 115420 - DNA, 276 bp, Glycine max
  Peptide Sequence Number=SeqID_232198
atggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggatgtggtgattcagtgactaagctccattgtgatatgtctgatgcagtatgctctatttgcttatttctttcctgggctgttattttcaaggatttcttctaa

SEQ ID NO: 115421 - DNA, 405 bp, Glycine max
  Peptide Sequence Number=SeqID_232199
atgaagctttgcttctacaagctatacaagcaaaaggtgaaggcttatcatgacaagaagctgttgaaaaaagacttccaaccgggccaacaagttctgttgttcaactcaaggttgaagctgttcccaagcaagttaaagttcaaatggtctggaccttttactatcaaagaagtaaaaccatatggagcagtggagttatttgaacctcagtcaacaactcctgagagaagctggatagtgaatgaccaaagattgaatctgtaccatggttggccacaagcttctctgaagctaaggatgggaaataacttagaaaaattttcagtcatccaacttgctgagcaagtaacgctcttgctaagcgcgccaaccctcatctattggcttttggggtcctgctaa

SEQ ID NO: 115422 - DNA, 459 bp, Glycine max
  Peptide Sequence Number=SeqID_232200
atggagcctgaggtagctccttctactgcctgtgtcagcacaaaggaaagttgtatagatccctcgggaatttatgagagatcgacaaccgtgtgcaaggttcctttggacaatgatcaggataaacatataccaaagaaaccaatgaagcctattgataggccgaaacttgatgatgatcctgtataccaaatgacaatgatgatcccgcaacttttcctcaagcctatgcaggtgtcgtgggatgcaattgtgtttggggtgtacaatgataatgtccccttgtacataaagcatgaagatctcgaggaaatagcacatagtggtcaatgtctgaacatcactattatacaattgtggattattgctttgaagggattgaacgatagtcaaggaagtaattctaagccaactgctaaatggatttcagttaaagttagtcatttaaacaatgtttga

SEQ ID NO: 115423 - DNA, 1197 bp, Glycine max
  Peptide Sequence Number=SeqID_232201
atgggctcaaaagtctatcctaaggttcatgagaaccctagggccatctttagtagctctagcccaagcctcttggagccttctatccaatacccttggggggtaggattgcatcaggaaggtaactttatgataaatggggcatactgccatcaagaggtagaaaaatggggcactccagccatttctcatgaaacacataaacaactgggttacaagagcatattgccacaagctgctactttaggaattcgcatcactgtaagtaatcttcttgaccatcatagtgctagggttcaggatagagcaagaacattgtttgacaactggaaaggagttggaaatggtgatactgaatctcatgaggtggaggttgctaaggttgaaaatgcaaccaaagcaccagattctgtgaaagaaccaactttagagcaaaatgttgaacacaatgaggatgatgtttgtcataaattaactacttttgctagtataaggacacttgcatctgacaggagtggggaagatgatgcaactagcattacacaaatttttaaagctgcaaaaaatgataatgattgttgttctaatgccttgcagggcacatcaatcagtgacagtaacttgggaaagactaaagtgttagacatgtctgtctctggaatagaatatgtcacagcattaaaggaagataagggccacgaaaaagatacatcaattggttctgattgtagtaaacctggaatagatttcagaggctctaagataattcacaagagaggttctaacaatgaacttgacaagaatctcattggatccctgagatttaacaaggcacacattagggtgaaactcaaggctaagaagaaggaagtggaagaagaggtttgtcaactttctgctaagcttaaggggaatcatgccaaagaacgtgctgcattaggctatatcagtggtaatggaaatgaaaaaagcaatttggacagtctggtcaaggccatagctggagtatctgttactagtcaacctgaagatacaaaggtcaacaaggccaaacagaggcgagacaaaaaagctcaacaagaagcagaaagggagcagagaatccaagcagagcagagtgacattataagcgatcgtgtgattaagaatgagaaattggaaaacaagtttcaagcctcttggcttgactgtttgtga

SEQ ID NO: 115424 - DNA, 210 bp, Glycine max
  Peptide Sequence Number=SeqID_232202
atgttccttttcctaaaagataatgaaaattctcctaataagtcatcagattgtgctcaacaaattacacgtgggatcgttgaagggaagggaaaatctttggactgtgttgttgaagtggaacgtggaaaaaagcgaagagcaaagtggctaatgaagggatcaaccatgcatgtggttgacactattctttgtgtcctggttgcttaa

SEQ ID NO: 115425 - DNA, 708 bp, Glycine max
  Peptide Sequence Number=SeqID_232203
atggtggctctgacttggttacaatggttgtatcacacctacgttgctagtgagacatacgtttgggctactacaacatatttgttgcatttgctttgcaataccatctttgttgagaagagctcgacacatgtacacatttgctacctacaataccacaatgatctggatagttgcattgagtatgcttggggggtgttggattatgaccgtaagaagccatttgcggctaggtggttgccattgaggggtaatgataaggctactaggattaggcagttgtcaaatcagttccagatgattgatgttgcctggattcccttagacctacttgagcgtcttactacatatgataagtgttgtgaggcatgggctgagtgggagcagcatttggtggcattgggtaaggcttctccacatgggacttcatgggcctacactatagactacctaccttggtattacgagcatttacatccatacatgatttcggcacaggagggagagccaccatatcatcttgtatgtatttcgtctcaacctcagccacaacctggtcgtggtcagataccagattatgtactaggattgattccaaatgatgtcaatatcgacacaaagattgttggacatgagactaaggagcagccaccgttgaggaagaaagccattagagatggcatagaatgtaaccgcaagggcacttaa

SEQ ID NO: 115426 - DNA, 369 bp, Glycine max
  Peptide Sequence Number=SeqID_232204
atgggtcatcttcttgtccctgttaattccgctcttcaatctcttctgccactagaagtaggagctggtaacaatggcggtagttgcttaggagtgacttgcttagctggttctatggtattgcatgtcgtcgtcataaacactcgtgtcaccggtggagaagtaacaatgtcaggaggttatgatcgaacgaaacaaaacagattcatccatgggggtcttccccctcatagcagggaacatccaacttcaagtagtgtttctaatgtgttggtgaggatgaattggtgtaaggtgaagaatgagaaattggtgaacgattatccaaaactacaacacagtttgcaacttcatccattttgttcatga

SEQ ID NO: 115427 - DNA, 294 bp, Glycine max
  Peptide Sequence Number=SeqID_232205
atgttgcttgctgctatgagaaaagcatttacgaatgccattggaggtgagggttgtgttgagtatgtctgtatggagattaaaaatgacaatgaagtggggaagatatttttcatcttttcgcagtttagttctaaatgtctaatcgagttgtatgcaatgattgacaaatctccaaaagaaattcttgtccttttgtgtaaaccaagaaaaccacgatctgtcgaagatgttatcggtctgatgcatggatcaatggcaacaagctctaatgaagatgataagtctatgtag

SEQ ID NO: 115428 - DNA, 1413 bp, Glycine max
  Peptide Sequence Number=SeqID_232206
gcatcaaagcattgttatttcatctcctatcttcccttgaaacggatatcaaagagtaactggcaatcatcttatggacgatctggactagaagaaatcagaaaatttttgaagctgtggaaatcccacatcatatctctatcaaattcatctcagttactcgtggagtggaagcatgaaagaaaacggaactccgtgaacactcccagtcctcaaagtcaagctcatgcaatctggattcctccaacatctggctcgctgaaattaaatgtggatgctgcaattttcctgagcatatcttgctttggtgctggaatgtgtatcagggacgaaaatggtagatttctacaagccagaacgcagtggaactatggtgaaccaagccctctggaagctgaagcctgggcgttgttacaagggattaattggatacatgaactgtacattcgtggcgatgtttatcaacaatggcctttattcgattgtgagctttcaaaaggttcttttagagcaaggcaaggatctcatcatgttccaagaggacaggatcacaagcagcaatttgtagaagaatttcacccacaaggaaggtttgacatggatgaaatcccacaaatactactcaatggtcatgttcataacctcggtttgcccatttgtctctggatgggtggcaaaccagtgatgaaatcaagggaaaggtctttctatacatggaaaggaatgggaagaggttgtaacaaccctatcgacttcttggagcaatacttaggtgacaaaccagtgatgaaatcaagggaaaggtctttctatacatggaaaggaatgggaagaggttgtaacaaccctatcgacttcttggagcaatacttaggtccaaagccatggtaccctaagagacaatatgtcccaagtaagcaacttgaaactgacaaaagagcatttttgtatgttgagatggaagttattttgctagagtatagtaaagacctgagcaagatgttcccaatgaagttctggcgaacgactatataccagagtatcgccaaagaagacgatgacgtgcttgtggagaagtggccagaaaaggtcattcatggtggcttgcaaagtgattggcgcattgcagagctcaaagggcatgatacggtattcataatgtccatcgtgggtgcaaaatgtcgttttggaaatgtcctggggttgaaggttcatcaaatagagatgaaaactaatgaagaagatgttgcaattgcggatgagaaagaggatttgatattgcctatggatcctttaaggaattggggccacacccaaattgagaaatattgggcctcttggctgctttgggccaatttttgtagatgcattgcgagggttgataatccatcaggatatgccccaattgtttga

SEQ ID NO: 115429 - DNA, 306 bp, Glycine max
  Peptide Sequence Number=SeqID_232207
atggttcatgtctccctccctcctcccacattcaccgcgttcatctctctccctccctccctcccacattggccttcttcttcgtggttcttcttccaagtggttgctggtctcagaaaagctttgtccgcgctatgttccccccgcgagcttcgtcttcttcctccgcaccgggagtccgtgttctgcgactgtgctgtcgttggtgttgagtattccaggcattttgaggctggtggtgtccctctacgccggcattgtcgaggttactcatcaagttggtggcttgagtttctttctctgtag

SEQ ID NO: 115430 - DNA, 1536 bp, Glycine max
  Peptide Sequence Number=SeqID_232208
atggccaacacctacaagccaaagaacattctcataacaggagcagcaggcttcattgcatcccatgtatgcaacaggatagtgcgaaactaccctgactacaaaatcatagtccttgacaagctcgattactgctcaaatctgaagaatctcattccctcgcgttcatctccgaatttcaagttcatcaagggagacattggaagtgctgatttagtaaactacatcctcctcacagagtccattgacaccatcatgcactttgcagcacaaacccatgtagacaattcctttggcaacagttttgagttcaccaagaacaacatctatggcacacatgtgctcctagaggcttgcaaggtctcaaagggtcaagtgaagaggttcattcatgtgagcactgatgaggtttatggtgagacagatgaggatgctgtggttggaaaccatgaggcttctcaattgttacctaccaatccatattctgccacaaaagctggtgctgaaatgcttgtcatggcgtatggtagatcgtatggtttgccggttataacgacgagagggaacaatgtttatgggcctaatcagtttcctgagaagttgattccaaagttcttgctcttggccatgaaaggaaggactcttccaattcatggggatgggtctaatgtgaggagctatctctattgtgaagatgttgctgaggcttttgagatcattctccataggggtgaggtagggcatgtttataatatagggacaaagaaagagaggagggtgattgatgtggctagggatatatgtaggtttttcaatttggaccctgacacacatgtcaagtttgtggagaataggcctttcaatgaccaaaggtacttcttggatgatgagaagctcaaggatttggggtggtctgagggcactacttgggaagagggtctaaggaaaaccatggattggtatgtcaagaatcctgattggtggggtgacgtttctggtgctttgcttcctcatccaagaatgctcactatgccaggagttgagaagtactatgatggctctgataatgtgaccggaaccgcttccaatggtgatgttaaccattctaatcagaacagaatggtggttgttccagccacaaggaataatgtgtcaccacaaaaggcatctttgaagttcttgatatatggtggtgcagggtggattggggggcttataggaaacatttgtgagaagcaagggataccctttgaatatggcatggctcgcttagatgatagatcacagatcttgtttgattttaggaccattaagcctactcatgttttcaatgcttctggggtgattggagcattaaatgtgaaatggtttgaagctcataagccagaaactatacgtgctgttgttgttggtgtgttaacattagcagatgtctgcagagatcatggtctcctcatgatgaattatgcctttggtggtaacttggaagacaaagcatattccactgatgccttctattttagaacacaagccaag

SEQ ID NO: 115431 - DNA, 1434 bp, Glycine max
  Peptide Sequence Number=SeqID_232209
atggtgaaagaagattgttattcttgttatgttctgttagaagttgaagaatgcatattttatgccaacccttacattctgtcagagttagcacctttggtcttaactcttattgccagttgtctatcccataatggactcgaagaatcaactaacgatgaagtggatgttccattgaatgaagtatctagcaaacagattgatcctcaagaagatggtaatagtgctccaaacatttacaaaaatcctacactgaaactggtggccaaagtagttaatgggaataatgagcataggaatgccaaaagagatattgatcatcaagaaaaagttttgaagagggcaaacaaggtcctgccttgtcctcgttgcaatagttcggagacaaagttttgctacttcaacaattataatgttaaccaacctaggcatttctgtaaaaattgccaaaggtattggacagctggggggacaattagaaatgttcctcttggggctggtaagcgtaagaataagcactcgactttgcagtattgtctgatacctgtgactcctgatgctgcatctgtcagccagacagattccaaacctgctagtgatatgcttttatcatctagcagacttatcaaagggatggagaacatctcaagtctcagggaggaaactcctcttagtgaatccttagaaactgtgttaagtctcaatggccagacaaatattgaaatggcctcttccactctcaaagatgatgctgaggagtcttccagctcttctatgagatctaatgaagtagagcaggtttgtttggcacaacactctttagttcctttacaatcatttcaatattatcctgttccttcatggtcttaccaatggaatccatgttggaatgtcaaggagcttaggcctagaagcttaagttctagacctgtttacacaggttctccaactatgattgcagttcctggcttctccttaccaacagtaatacttccaggggtgccttattcatattcgggttttatgtcaaactgggatgaacaaaaggaagatgcttcattggttggatctgcatttagtggcatatcattgtctccatcttcagttagcaacagtacttgttcaggtaataggtccccaaccttgggaaaacattctagagatggaagtacactgggggaagatgcaatgaaacagaatctttgggtgcccaagactgtaagaattaatgacccagaagaggctgcaaatagttctatatggtcaactttgggaacaaagtctgaacagaacaaactcattatgaaaggaagtatttttaaatcatttgaacctaaggcaagtgccagttctcatattttagaggataatcaaattctaagggccaaccctgcagctttctcgcgctctgagtcttttcaggaaagcatgtaa

SEQ ID NO: 115432 - DNA, 2166 bp, Glycine max
  Peptide Sequence Number=SeqID_232210
atggcaccaaaaccagtttccctttcacatttactccatttaaccttgtttcttgccaccatccaactctcagagcagttagagttttctcagtctcaaacacttctcaaggttcagcaacttcttggctatccatcagcactaggtactctaagcagcaacatagacttttgcaacattgaccctacctcatatttgacattagtttgctatgaggatagcttgacacaactgcatgttgttggcagcaatgagtatactccactgcctcaaaacttctcctcagatactctatttgctacactaggcactctttcaagcttgaaagtcctctcattggtttctcttggactctgggggaacttacctgaaagcattgctcaattgtcttcattggaaatacttaacattagctcaaatcacttcaatggagccatcccttctcagctttcacttctgaggaaccttcagtcagtggtgcttgatgataacaacttcaatggtgaaatttccaactgggtaggctcactacaaggtttggctgtgcttagcatgaggaacaactggcttagtggaagccttccaacttcattgaatgctcttcataccttgagggtgttagatctatcaaataatcagttatctggggaacttccccatcttaagaatttggcaaaccttcaagttcttaacttggaaaacaacacatttggacctcattttccttctctccccaccaagttggtttcccttgtgcttaggaataacagcttcaggttaagtgtcccttctaatttaagttctttctatctgctccaaaggctagacctttctttgaatggttttgtggggccatttccaccatccttattgttaatgccttccattaattaccttgatgtttcctcaaataaattcactgggatgcttttcaataacatgtcatgcaatgatgatctccactttgtaaatttgtcttcaaatcttctgaaaggtgaacttcccacttgtttagaaccaaagaccagggttgttctgtatgctagaaactgcttatcaaacaagaaccaagatcagcacccttcagatttctgcagcaatgaggctttggcagtgacaatcataccccatcagcagaagcacaagagaacaactagtaaagcaattatcgtatcaagtatgggaggtcttgttggtggaatgttgattgtaggagtggttatcttggttgttagccgagttcataagaaacaagtagggaaaataccttcaaagtccactttggagcatgttatcagccaggagcacaatgaagatgaagtgaaaactactacaaggtccataatggagcatatcatcaaaagggttcctgacaaaggtgctgtggaaacactaacaagatccataaaggagtacgtcatgagccgagtgaataacaagcgtgttgtgagggcatcgacaatgtccataatagaacatgtatcatcagcaaacacagcaaaactactcacagatgcaaggtatatatcagaaacaatgaagatgggagccagccttcctgcttataggacctttgctttggatgaacttaaggaagctacaaataatttcgatgaatcatctttcataagtgaaggcccacatggtcagatttataagggggttctctctgatggaatgcacattgctattagaggtttgaaaatgagaaagaaacaaggccctcagacttacatgcaccatgttgagataatttcaaagctaaggcattcacacttggttagtgcacttgggcatgcttttgagtgcaaccaagatgattcaagtgtaaacaatagaataacagctgcaattggagtggtgaaaggcattcaatttttgcacacagggatagtgcctggactatattcaaataatctgaagataacagatattcttttggataacaatcacaatgttaaaataagcagttataatctaccactctctgctgaaaataaaagaatgatcagcaagggaacctcccctggattaaaaggaaaagtccaagcaaggatccaggatgcagacaagaatgatgtctatgatattggagtagtcttgctagaaatcattctgggaagaccaataatgttccacaatgaagttggaacactaaaagatctt

SEQ ID NO: 115433 - DNA, 788 bp, Glycine max
  Peptide Sequence Number=SeqID_232211
gtcacaccctagcaatcagttcaacaaagaccagggtggaccttcgaacaggccaatccaacaggggcctaacatctttcagaggactactaagttggaggagactttgactcagtttatgcagatagctgacaagtcatccaacagttttatggcaaatatagaaaagaatcccaaggaggattacaaagctgtgatgacaaggagtaagaggtttgtggaggctgaggatgaggatagtgttgtgcccaagaagaaagctactaaaaagaaaggtactgatgataagaaagatgatgtgagagtaccatatccagtggtaccttccaagaaggagaaggaccaccatttggcgagatttttagatattttcaggaaactggaaataaccatgcccttcggagaagctttacaacagatgccactctactccaaatttttaaaggatatgttaacaaggaagcataagtacattcaccaggaaaacatcattgtggaaggaaattgtagtgttgtgattcaaaagatccttctacccaagcataaagaccttgggagtgtaaccatcccttgttcaattggagaagtcactgtgggaaaagctcttattgatctaggagccagtattaacttaatgccactctccatgtgcagaaggttgggagagttggagatcatgcccactaagatgactatacaacttgctgaccgctccattactagaccatatggagtaattgaagatgtgttggtcagagacacattttatcttcccggcagactttgtg

SEQ ID NO: 115434 - DNA, 765 bp, Glycine max
  Peptide Sequence Number=SeqID_232212
atggatgatggccaggttttattgtatgctaattcagtgaatgcacgttaccagaccattccttacccttggttggtttttggtgagaaagtcaaggtcaatgctgtttttatccgtgattccactggtgtatctgattcaatacttatcctttttggtggtgctctaagtaatgggatacaggctgggcatctgaaaatgttagatgggtatgttgacttcttcatggatcctaatttagctgacagctttttgaagcttaaggaagagctcaataagcttatccaaaagaagctggaagatcctagcattgacattcacaaggaagggaaatacttgatgcttgctgttcaggagctggtttcaggggatcaatgcgaaggaagatttgtatttggccgtgaaagccggaagcctaaggcctccaatgatgaaaacaaattcacaaaagatggaacaaatcccaagagcttgctgcagactctgttgatgcgagcagggcactccccacccaaatacaaaacgaaacatcttaagacaaatgagtttagggcattggtggagtttaagggaatgcaatttgttggcaaaccaaagagaaacaagcaacttgcagaaagggatgctgctatagaggcattggcttggttgactcacacctctgacaataaccagcatgaagatgataagtctcctcctgatgtaactgacaacatgctaaaactcctagggaagcgtagaaaatcaaagcgaggccatggttga

SEQ ID NO: 115435 - DNA, 243 bp, Glycine max
  Peptide Sequence Number=SeqID_232213
atgaattcccaaaacctgttagaaaacccgaatctaaattcgcaattgatggccacaacgacattattgggtattgggtggggctatgccagagtgacgttagggatggtggtgggtggaactagagctcacgttgtacgggtcgtcctcatcggaggcggtggcaacattgtcgtagcctcattggaggtaattgagcttcatctagaggaggaacgacagtggctccgactaaggctttag

SEQ ID NO: 115436 - DNA, 786 bp, Glycine max
  Peptide Sequence Number=SeqID_232214
atggcagtgatggctgaaaaatggagaaagatatggaaactgcaagaatacaccacaaattgggtgagaagaggtagggctggtcgtgtgcagccaggagaatgttaccacctttaccccaaatgtgtttatgatgccttttctgaatatcaacttcctgaactactgagaacacctttgaattctctatgcttgcaaataaaaagtttgcaggttgagagcataggagggttcttatcagcagctttacaggcaccagagccacgggctgttcaaaatgctattgattttctcaagatgattggagcattagatgaacaagaaaatcttacgaatcttgggaagtttctctctatgcttcctgttgatcccaagcttggaaaaatgttaataatgggagctatatttcgatgctttgatcctgttcttacaatagttgctggccttagtgtcagggatccttttcttttgccccaagacaagagggatttagcagggacagcgaagtctaggttttctgctaaagattacagtgatcatatggctcttgttcgagcatatgaaggatggaaagatgcagaaagagaagggtcggcttacgagtactgctggaggaattttctatcagcccaaactcttcaggctattcattcacttcggaaacagtttagctttatcttgaaagaagctggcttggtagatgcagaagctaacgtcattaacaaattgagtcacaatcaatctcttgtgcgtgcagtcatatgttctgggctctttcctgcatag

SEQ ID NO: 115437 - DNA, 263 bp, Glycine max
  Peptide Sequence Number=SeqID_232215
atcaagaagctaagagaattattaaaagaggccaaatagctggagtattatttggagatgataagaacgatgttgttcacacgttcaaagaaatagaggaaagggactggaaggaaatccaaaggattaagatattgaccttaaacatcaaaggcttagagggaaggattaagtggaaggagatattcctttatcaagccagcgcttcacttggttcaactcctcaggaaatgtggttagcagaattgataaatgtctcgtga

SEQ ID NO: 115438 - DNA, 720 bp, Glycine max
  Peptide Sequence Number=SeqID_232216
atggagaggaaaagaagccatgcttctttcaccatgtttgcaatgcttgttggattgctctctcagagccttgtcattcctgtaatatccaccactgttgcagatcagaagaactactacaccccagatccacatgctggaagtccccccacaggctcacacaatagtagtcctccatctcatggccatgggagctctccaccctcacatcacaatagtccaagtactccatcaacaccctcaggtggaaactgtggatcatcacccccacaacatcatgatccaacaccctcaactccatcaacaccatcaaaccctccctcaggtggatactatggaggtagccctccaacacctgtcactgtgagcccaccatctactccagttgaccctggcaccccaagcatcccctcaccaccactcattccttccccatctcctttcactggcacatgcaactactggaggaatcatcctgcaatcatctggggaatccttggctggtggggaaccctaggaagtgcatttggtgttacaggagcactctacagagaaggcacagcttccttcctcaactccatggtgaacaacaagttcccttacactaccaaccaagtcagggacaggtttgtggcctcactcaactccaacaaggccgcagaagcacaagcccagctcttcaagatggccaatgaaggaagaatgaagcctagaccatga

SEQ ID NO: 115439 - DNA, 381 bp, Glycine max
  Peptide Sequence Number=SeqID_232217
atggtagctagttggcctcctattggtctttggtccttcatttggcctttggtccttaatttggtcatcagcattgttaaacaaatagtagggattcaagtgaaacctgacaggccatgtccttatcatgctgacaatgtacgagggaagcttcatgttactcaggagactgacaggaggaacacctacaatgttagttttttcgattcaaacgaaggaaaaatggggattgggtcacatgtggcgcgacaccgtggactgaggtctgaacacagggggcacgagcttaaagttacacgaacaacacgagcggatagcttgaccaggctacggagattttggatgatgccacttccagtgaaggaagataagtcagggtag

SEQ ID NO: 115440 - DNA, 339 bp, Glycine max
  Peptide Sequence Number=SeqID_232218
atggccaaacaacattcttctgaactccatgatatcacactccctctcaataagacgctggcatgtaactttcaacaaagcggtgatttgcctgtcattaagccttttcgagtacctttaaccttccataagcatacaacattttatctgaagcagatagcaaggcaaactgataagcttttaacgttttttgggttaataatgaacttggcgaaagcagttttagcaaaccatgcatataaaattcttgtcgaaacaacattagtggaataccctgttggagtactgaccaatgctgggaaattgatgacgtctatcccttggagattcaactcgtaa

SEQ ID NO: 115441 - DNA, 935 bp, Glycine max
  Peptide Sequence Number=SeqID_232219
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggatggtttattccaaatcgttcaacgtctttatggtattcaaatcatcgagcgccatgctcctgtatggcagaatgatgttcgttattttgaaattgaagatcaaggtcaagtcgttggtggtttctacttcgacctttatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 115442 - DNA, 315 bp, Glycine max
  Peptide Sequence Number=SeqID_232220
atgtatgagacagataagaaacaattgaaggtcttgctaaaaaatgttagcaatatcatcttgagagttgatatgtgcaaatcaagtcaccaagttgttgagtacatgattctcacaagtcattttattggtgcggggaatcttaaagataacttatcactaagcacaaagctagttttgaatggtgacttgagtcatgttagatgtgcatacatattgaacttgttggtgcaagatggtcttagtaaaatttgggatattgttcacaatgttcgtgaaagtgtgaagtatatcaactatactaattcaagatga

SEQ ID NO: 115443 - DNA, 225 bp, Glycine max
  Peptide Sequence Number=SeqID_232221
atgagcaatctcaatggcattcatatcaattcagcacatagagctaaagttacacccaagtgcaaggaaaaccatcccaaaatgctacctatagaatccctaaatatgcctccacaagcagcaatgccatgcactcatctagcggctccatctgagttgcattttgtccattcacagaggggaagcttatttgacccctctttgactcatattttcccaccttaa

SEQ ID NO: 115444 - DNA, 324 bp, Glycine max
  Peptide Sequence Number=SeqID_232222
atgaaagcagctcgtagctctatgctcctggagtttgatcttggttcttcaacttcttattgtcctaagcatatggtgttgtggcctgaatgtggttggcagtcagtttgtgtgaatgatttgattactgttgctgctattagaaaagtttataagaaagttacattgtgcactcatcctgataaagtacaacagaagctgattgaggtacgaggtttgtttgctacgtcatcagtctcttggctggacttgctagacgtaatcttgcaaatactgaggtacgacttgatcgaggtacgagctgatcaagatacatttccttga

SEQ ID NO: 115445 - DNA, 426 bp, Glycine max
  Peptide Sequence Number=SeqID_232223
atgtcaggatttacatgcgattctcctcaaagttcagccagcccgcatcaattagaccttgcaccttacgcttcaggcccctacaatgctcaatggaatgccccggggcttctccatgacaagcacacgttgcgttcgagtcgtattctcggagaaatggaggttgatgagccttggttacggctttctcgctacaaaattcatttcttggttggtgttttggtttacgctaaaggaatggcctttgtggataactgggcggtgggtaaggagaaggtttgttattggctgagtaatgacattgttgggttggtgggaaacttggctacccacatcgatcctttcactggcaaagaccaaatccgcaaagctttgaaggtgccacttgagctgccaggttctccacctttgggcgtattcttttga

SEQ ID NO: 115446 - DNA, 639 bp, Glycine max
  Peptide Sequence Number=SeqID_232224
atgaagagctctaccttgttcgctctctttctactttctgccatcttcacctcatacctaccttctgcaaccgctgatgtcgtgctcgacacggatggtggtgttcttcaaaatggtggccaatattctgtgttgccggtcatgagaggaagtggtggtggactagtagtacgtgcaactggaaatgaaagatgccctctcactgttgcgcaaactcgcaatgagctcgataaggggattggaacaattatttcatccccattacgagtcgctgttatcgccgaaggccatcctttgagcatttcgttcggtttttttccagttatgccgtcttgtatccctcttactggtgattggggtattgtggatggtctacctgaaggacccgctgttaaacttgctgagtacaaaaacatagtagatggttggtttaaaattgagaaagctcaccctctcggttataagcttttgttctgtccactgcttgagggtagcacatgtggggatattggaattcaaactgatgatgatggaatcaggcgtttggtggtgactaagaacaatccattactggttcagtttcagaaaattggatggatactgacgaagaacaatcttttgcttcctggcagtgagtga

SEQ ID NO: 115447 - DNA, 516 bp, Glycine max
  Peptide Sequence Number=SeqID_232225
atggaggcggcgaacggcgtcgtgtcgaagaagatcgaggcgttggagcgcgagaacgcggccaagaaggacgagatccggaggctgaagaaggagatcgattcgctccggcgcgaggcggcggagctgcgggactcggagacgagcgcggcgctgaagaacctcctcgaagagagagaacgaacggtgacattcctagagagagaaacagaatctctgaaacagttgaaagcagagagcgagatgaaggttcgcgatctggagcggaagctaagcgttgtggaagtgagggagagcgaggagcgcagcaagagggttagggcggaggaagagaccaaagagaaggttggggagaaagagagagagattgaagagatgagacagagaattgaagatttggagaaagttagagttgtggaaatgagagagaaaggagagagagtggatggcgaatggacgaagtggttggggattgtgtggccggtggtggcgacggggagtggagccgttgctgcg

SEQ ID NO: 115448 - DNA, 1938 bp, Glycine max
  Peptide Sequence Number=SeqID_232226
atgttgaatatgctacagagttcagctgagatggactttttctccgaatatggtgatgccaaccggtacaaaattcaagaagtcattgggaagggaagttatggtgttgtctgttcagccattgacactcacacaggtgaaaaagtggcaattaagaagattcatgacatcttcgagcatatatctgatgctgctcgtattctccgtgagataaagctgcttagacttctacgacatcctgatattgttgaaataaaacacattatgctgcctccgtcaaggaaggactttaaagatatttacgttgtttttgagctcatggagtctgatcttcatcaagtcattaaagccaatgatgacttgacaaaagaacactatcagttttttctttaccaattacttcgagcactgaagtacattcacacggcaaatgtctatcatcgagatttgaagccaaagaatatacttgctaatgcgaactgtaagcttaaaatatgtgattttgggttagctagagttgccttcagtgacacaccaacaactatattttggacggattatgttgctacaaggtggtatagagctccagaactatgtggatcattttactctaagtatacaccagcaattgatatatggagtataggttgcatctttgctgaagtactaacaggaaagccactttttcctgggaaaaatgtagttcatcaattggatctgatgacagatctgcttggaactccttcactagatactatatctcgggtacgtaatgagaaggcaaggagatacctaactagcatgaggaaaaagcagcctgtgccatttgctcaaaaatttcccaatgcagaccctttagcactaaggctactggaaaagttgttggcttttgatccaaaaaaccgacctactgctgaagaggctttggctgatccttacttcaagggactggcaaaagttgagagggaaccatcctgccaacctatcacgaaaatggaatttgaatttgaaagacgaagagtcacaaaggaagaaattcgagagctgattttccgtgagattctagagtatcatcctcaactattgaaagactacatgaatggaacagagagaactaattttctttatccaagtgctgttgatcaattccgaaagcagtttgctcatcttgaggaaaatggtaaaaatggccctgttatgccacttgatagaaagcatgtttctcttccaaggtcaacaattgtacattcaaatacagtacacccaaaagagcaaacaaatattgcttccagcaaaaaccgaccaacagccgaggaatataacaagcaccccagggatacagaaattccagtgcctaggtcaatgcagggaccacaaagaattccactagcaaaacctggaaaagttgttgggcccgttgttccttacgagtacggtaacattgtcaaggattcatatgatcctaggtcatttatcagaggttctgtgcttcctacacaacctgttcccccagcatattattatcaaagatccagcactggaaaccaagaaaggccatcaacagaagctgacaagagtgtgcctttgcaggcaaaacatgcacaacaatgtggagttaatgccaagatggcaccagatatagctattaatattgatacaaatcccttttttatgaccagggcaggagttaacaagttagagcaaggtgatcaaatagccatagagacaaacatgctgcagccaaaggcacatcaatatggtggaatcagtgctgcagctggggccactgctcatagaaaagttggtcctgttcagtatgggggagcaatccttgtagagaaaaaggaactttttagggatggagctgctgtagtctctggtgatggtttgtataaaaatgagagagtgaggggcttattagaggcagtgcttccctag

SEQ ID NO: 115449 - DNA, 276 bp, Glycine max
  Peptide Sequence Number=SeqID_232227
atggcagcaacaacgacgagggcaaaggctttgtgcttctacttccttcatgcttctatgatatcggcggcaacgacaagagccacaaagatgttcacacgaagaagggcaacgggagaaggacaaactggaggccaattgatcgaaagccttagagaaaacttgatagagaactatccaaggaggaagagtttggcttgggtggactcaacatcgatggaccaatcacttgagcaagaagtaagagatttcaagaaaagcttgacgagaaactaa

SEQ ID NO: 115450 - DNA, 165 bp, Glycine max
  Peptide Sequence Number=SeqID_232228
atgtcatgtgaaggtgttgttgttgagaaaggttttgaggataataaggttgatgcagggaagtgggtgggtgaacaagttatacctttgaaggacaaggtgcaagtcactgttgatttaagagtgctagagtcaagatataatagaaaacttgggatctttcag

SEQ ID NO: 115451 - DNA, 291 bp, Glycine max
  Peptide Sequence Number=SeqID_232229
atggtgcccgtgtcagaacaaaggaaaactgtgttgatccctcggggcaggacccagacactgatgcataagacagacatgggtttttatgaggggtcaacaaccgcgcaccatgtgcctttgggcaacgatatggtaaaggtaggtgttaaggaagttcgagatgttgatgctcgtgtccatgtatccactgaagaggataaacaggtaccaaagagaccaataaagcctgctgataggtcagaacctgatgacaatctcatataccagatggcattaatgaccccgtaa

SEQ ID NO: 115452 - DNA, 663 bp, Glycine max
  Peptide Sequence Number=SeqID_232230
atggaaatcaaactgcacgccaatgccaccaccacgccgcgcatccgccgctaccttcagcagtctgataaaagcgaccgggaactggccgttgagctggggatctcggtcactaccgtcaggcgctggcgcaaccgcgatcgggtttcggataaccacactacgccaaaagtgatacacaaagcgctgagacaagagcaggttgcactggttaatgccctgcgcgacatatcaggtgcgccattagatgaattgctgcagatagttaacgacatcctgggcatccccgtctcacgggcaacgctgagtcgctatctcaaaccggcacccgcgaaacaaaaaggggcttcgttgcagggaaaaaaggcgctgaaagctggcatcaggccgcatacgctgctgctgtatcatcagcctttgtcgctgcatatggatgatgggggcgaacaacacctgctctgggcgcgcgaaccggtgagcggctgttgctcactacctggacgcgcgcgctgctggaggcctgccccgctgatatacaatctgttgagactttcggttttgaaccgacgctgcctgcacaagacgttgttgttaacgctcatccacacaagcacaatgcgctgcaggtggcgctaccgctccgggatattattccgcgagtga

SEQ ID NO: 115453 - DNA, 683 bp, Glycine max
  Peptide Sequence Number=SeqID_232231
tgccagctcgcaggtcaaactcggcagcctgcaacaggcccgctacgacgcgcgtatcgaccagctgcgtagtctgcaacaacgctttaagccgtacgagaagatgtaaccaaggagaagtcatgacagacgcggtaaaaatttatcataaccctcgctgctctaagagccgcgacacgctcagcctgctgaagtctaacggtatcgaccctgacgtggtgttgtatctcgacacaccgccggacgcgcagacgcttcgtcagctgctgcacatgctgggaatgggcagcgcgcgcgaactgatgcgccagaaagaagatctgtataagtcactgaatctggacgacacgtacctcagcgaagaccagctgattcaggcgatggttgagaatccaaagctgattgagcgcccgattgtggtggcaaacggtaaagcacgcatcggccgtccgccggaagatgtctcgacatcctctagtccttacgccgcagcgcttccagaaacgcctgcggcgtactttctcccagttttttctgcgttttaccccgcgttaacaacaacgtcttgtgcaggcagcgtcggttcaaaaccgaaagtctcaacagattgtatatcagcggggcaggcctccagcagcgcgcgcgtccaggtagtgagcaactgcggtgaaagacccgcatag

SEQ ID NO: 115454 - DNA, 357 bp, Glycine max
  Peptide Sequence Number=SeqID_232232
atgcaaaggaacttcgagttggagtcagtggcattctgggtcacaggaagctccaattccttcctccattccctctgggtcattattctcatcagaggaacagcgtatacgatggtcattgaccaatccctattctatgatttaacaaaattgcctagtgaaggtgtgccttttgagggtgcactgattgatgaatggaaattcgatttctctgtgcatgatgcccgccggttggtttgcaccaaccaagcggatatgaccggaagacttcttgccggttcattggcttttgaatgtcgcatcctccattaccttatagtttgcattttgcttcctagatcttcaaaccttgcccag

SEQ ID NO: 115455 - DNA, 584 bp, Glycine max
  Peptide Sequence Number=SeqID_232233
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaagcatcaacggcaaagtatatagtgcaacaatatatagcagcaacgggaggacagccagcattgaatgcggtggatagtatgtgtgtgacagggcagatcaagattagtgcatcagattttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 115456 - DNA, 189 bp, Glycine max
  Peptide Sequence Number=SeqID_232234
atgaatgttgactcgcaaatcatgatcgacttggcctttggcacaaattgtaactcgaacaacccgcctgcgagtagatacttcactatggagtctagtttacgtgtgctcatagttgtttgtggtgaaatccttgttgttaaccttcttaatattacggtaaagttccatacagtgggatatttttag

SEQ ID NO: 115457 - DNA, 200 bp, Glycine max
  Peptide Sequence Number=SeqID_232235
atgcaagaagtagaatgcaatggtaagcacagtgcaaatgtttcgatatgctcgcttagcgcgagtgtttcgctaagccagcactctgtgacatgcgcgcttagtgagttctataactctgattggtctgcaacttccgctaagcaggccatgaatggtgtgaaagcaaagcttcatgatgaatcaacaatgattcaaag

SEQ ID NO: 115458 - DNA, 243 bp, Glycine max
  Peptide Sequence Number=SeqID_232236
atgttgaaattcaacttagtttgtaggccaaagaagagaaggtacaaaaagatgttgatgaactcgcttaccaaggtagattggctaaacaagccttatccgcttagcgaggcagtcagctcgcttagcggatgcaaaaccctagaagaggatgagtcagagatcagctcactcagcgtgcaaccagcccgcccagcgaggatgttgtctcttctcgtgcttagtgcgcacaaggtcgcttag

SEQ ID NO: 115459 - DNA, 1116 bp, Glycine max
  Peptide Sequence Number=SeqID_232237
atggcctcaaagaagagacgcgcctcatcctgtagacctcaggagccatatgatacatctagatttgtgtctgaggtcgcttgggagagatacgagaccaacgtgcataacatgaacatcctcccagcgaggaatgttgagctggtgtattcatattataatgagttcctcagggaactagagaggcgccaatggcacagagccttgaccaggcagatggataatcacatagacctcgccttggtcaaggaattttatgccaacctctatgatccagaggatcgctcccccagacagtgcaaggtgcgggggaagttgatcaaattcaatgctgctacgcttaatgcatttttggagaccccagtggtcctacagcttggggagaggtactctgcatactcacgattctgtcatacccatctagacgctcaggaacttgcatcaaaagtatgcatacccgggaaggacatgaccaccctcgtgcagacattgagtgtcctctcttactccaacctcgcccctacttctcacacttctgatctgaacatggacagggcgaggttggtatatggccttgtaatgaagatggacatggattccaactcctctaggttggacttccctgctcttctcactgccctatctattgccagaggagttgtctctgattccctcacctttgagtctctcagcccaaccattaatttggcctatatcaggaagaactgctggaacccagatgatcccactatcacattccctaggtcccgcgaggctaaggctagggctccttcagacgcttcatcttcaattcccgctcccacaccagcaccagtccctccgacaccagcaccgactccagctccaagcattcataacttagctcaacagcggccgatcatcagaatagaggatttcatggcccaagtggcttggctcggagtccaaccttccttttcgggggaggagaccccggaggagacacctgcggacacacctatggaggcgactaaggaggaaggtgcagcaaaggcaggcatcgacgaggattatgtagaggatgtcactgtggcgcagggggacttgcgatccatggcctacttcagcttaagatga

SEQ ID NO: 115460 - DNA, 441 bp, Glycine max
  Peptide Sequence Number=SeqID_232238
atggaaagggaaaaatttgatcacctagaagaaaggctaagggccattgaaggaggtggggactacccttttgtcgacatggcgaaactatgcctagtacccaatgtcatcattcctcccaagttcaaggtgccaaactttgacaaatgcttttatactacttgccccaagaacgacttgaagatgtactgtcggaagatgggggcgtacgcaaaagataagaagctcttgatgcatttttttcaaagagagtttgaccggggcagtaatcacttgtacgagaagatggtggggtactatcgcaacctatccttcggcaggagggcgacgcgagactcactggtgcatcttccaaggaaggaaaacgcgtggagtcgccaccaatgtttatttgaggaaaacatcggaaaaaccagaaaagacgtggtctacgaactttaa

SEQ ID NO: 115461 - DNA, 1316 bp, Glycine max
  Peptide Sequence Number=SeqID_232239
agtcagaaaaaggcctgcttcctgagagtgttcttgcatttaaagaatatggtttggaaataaaggcgtgcgaggatttaaaatcctacaaaaaaatcattcctttgcttaaagaggattctaattcctttatagttactgcagatgatgatttatattatcctgataactggctgaatgatttgattggtgcatggaatggaaactataaaacggttgtagcccatcgcgctcataaaatccttcttaaccaggatggtatgccggttccttacagtaaatgggaatgggagtataatttatctacagatgagtcgtcattaatttttccaacatctggagcgggtgtgctttatccaccacattgtttctatcgtgacgtgataaatgaaaatcttttctctaagctttcacctggagcggatgatgtctggctttactggatgtgccgtatgaatggagtgaaatttaaagtcgtgggcaagaaaatggaactccttgaatgggagggtattacagaaaaaccattatggcatgaaaacctgttaaatggtgggaacgataataatattaataagatgattgctcactacggtttgaaaacaaacgatgatgaacaaggttatgatggttcttttgaggatattttctcgtttagttgtgaaaatcagcttgtgcgcatgcatcttccaaataaaaacgattatatacaaaatgtaatcaagtcaactgggaccttctatgaacctgagatgcttttggatatctcaaacagagtcaaaaaaggaagcactattctcgatgtaggcgctaacataggtaatcatactctttacttttccttgttttgcggggcaaataaagtgatttctttcgaaactcagaaaaacgtttatgataccttatgtgaaaacatcaagcttaatttccttgaagagaaaattgtggcttaccaaataggtttaggaagctacgaaactacagctaatcttggtgcagttgatgaaaaaaacatcggcatgacaaagctagatattaatagttctggagatgtgagaattgccacgctcgactctgtagtcgaaaaagagccattaaattcaatatctgtaattaagcttgacgttgaagggatggaaatggaagttctgcgtggtgcaattcaaacctttgagcggcatcagcctgtgctctatgtagaggcagcatccaaaaaggagtttgatgaagtttctgcatttttgctgagttttaattacattccaaccagaagatttaatgcaacagcgacatatctttttgagaagaaaatttaa

SEQ ID NO: 115462 - DNA, 1449 bp, Glycine max
  Peptide Sequence Number=SeqID_232240
atgatcaccgatattgccacattattggtacttgctgtggttgtagaattagccggcattgaagccatcatcggggcattttttgctgggcttgcattaaacagactgattcctcatacatcttctctcatgaacagggtggaatttgtagggaatgcgatatttatccctttcttcttgatcagtgtgggaatgctgatcgattttaccgtattcttcaaaagttttgaaacccttaaagttgcagcgatcatgttggtcgcatcaatcggtggtaaatatatttcagccgtgatcacccaaaagacattcaggtttacaaaagaagaaggtaaactgatctttggtttaagttcagcttctgcagctgctacattagctacagtaatggtaggatacaacatcattgtttccgaaacggaaacaggagaacctgtaagattactgaatgaacatgtattgaacggaagtatattacttatccttatttcatgtaccatttcttcatttgtatctatggccagtgcacagaaaatcgcagaaacggataatgaagatacggtatccggaaacagccatgaggaggaaagcctgctattagccatcaatcatcaggaaactgtagagcgaatggtcaatctgggtattctgattaaggcacattccaatactgaagatttttttgcattgaacgtcatcaatgaagataaaaatgagtcttctgtaaaaaatgccgaaaaattactccaccaggctacagatgctgcagcatcggccgatgtcaaattacaacctctgaaaagatatgataatgatgttgtaaacggcgtcaataatgtgatcaaagagcaggaaataacggatcttatgatcggtcttgaagatgaaaaaggtttttctccttccttcgtttacaatctttataatggctaccttcagaatgatcacgtgaacgtactggtataccatgctgcccagcctatttctacaataaaaaaatatgcagtgatgattcctgaaaattcagataaagaagccggcttttttcatgctcttttaagggtatggaacattgcccggaattcaggagcaaccatgatattttatgctcctgaaagtattattgatcttttacaaaggatcatcaaaaaagccaatatagaagctgaatttatcattatgaatacctggcatgacggtgaaaaaacagctgcgggactaaaagaggatgaagcccttattgtgtttatggctaaaagaggaatggtatcctatattcctcaaatgaggctcatgccggaacttctcaacaaaaatctaaaagaaaacaattatcttctgatctatcctttttcagaatatgacaaaaacagtcctgaaaaaagatcattcggaaatcacagggatttcatcgaaatcggaaatgttatccagaaaattttcaagtaa

SEQ ID NO: 115463 - DNA, 1113 bp, Glycine max
  Peptide Sequence Number=SeqID_232241
atggaggccgatgtggacggtctgatcggcgcgggtcgttacgagcggtctggcgagcgcagcacctaccgcaacgggtatcgcgaacgcagcctcgacacgcggctgggctcgctcaacctcaagatccccaagctgcgcaccggcagctacttccccggcttcctggagccaaggaagaccgtcgagaaggcgctggtggcggtgatccaggaggcgtggatcgcaggcgtgtcgactcggcgcgtggacgacctggtgcaggccatggggctgtcgggcatctcgaagtcctccgtgtcgaagctgtgcaaggacatcgatgagcgggtgaacgccttcctcaagcgcccgctgtccggcgcatggccctatctctggctcgacgccacctacctcaaggtgcgtgagggcgggcgcatcgtctccgtagccgccatagtcgccgtggcggtggacaccgaaggtcgacgcgagatcatcgggctgcacatcggcccgtccgaggccgaggtgttctggaccgatttcctgcgcgacctggtcaagcgcgggctgtcaggtgtgcaacttgtcatctcggacgcgcacgaggggcttaaagccgccatatgccgcgtcctgaaggcgacctggcaaaggtgccgggttcattggacccgcaacgcgctcgcttatgtgccgcgcgctcagcagaccatggtcgccgccggcttgcgccacgccttccagcagcccgaccaggaggcagcccgagccgcgctccaccatctggctgagcagcttcacaaccgttggccgaagctcaaaggcttcatcgatgccacgagcgaggacgtgctcgcctacctgacgttcccgctgcagcaccgaacgaagttgcactccacaaacccgctggagcgtctcaacaaggagatcaagcgacgcgccgacgtggtgggcatcttccccaacaccgactcgatccagcgtctgatcggagccgtgctgttggaggccaacgacgaatggcagctccagcaccgctacatgcagatcgagggcatggctggcttcaccccgagcctgctcgacgacaccctcacagcaattccacctcaggccgcctga

SEQ ID NO: 115464 - DNA, 234 bp, Glycine max
  Peptide Sequence Number=SeqID_232242
atgttcaataactgctgctttgagacgcatgtgatcctttggcatcatcaaaacatcagcttgatcctttgtctacagctcagactcatgagtgttgagatcaaaagtgaatccacagataagagcttcaagctcaatggacaccggctgaaaccattcctcacaaatccttccttagtggatgtcgtagtggaagagacctccttactccacccgacttcttttctgccatga

SEQ ID NO: 115465 - DNA, 472 bp, Glycine max
  Peptide Sequence Number=SeqID_232243
gtacacgatgaattcggttataacagtgttgtatttcaatggaagggtatatgaagataacgatggtgtaatatttgaaggaaaatatattgccttgctaatttgcgatgacgaagacgttgatatgatgctggaaagttttaaacaacaacaagaaatgtcagttctagaattgtacatagaaaaggatgtggctagtggttcaatgtttcattctgcaaattcccttacatcatgtggaaattatttatctaatgatgacacacaatcgccaacaaatatgagcaatttaaatcttgacgaagatgatgatcatgatgatgatgattatcttgtgtctaactcatacgttgaagagtcgttagacgaagatgacagtgttgatggtatatcagatacagacaatgaagtccccgacatgattccaccagtaagaattgttcatccagcagaaggtgtgatttcctcttaa

SEQ ID NO: 115466 - DNA, 453 bp, Glycine max
  Peptide Sequence Number=SeqID_232244
gctgtggatgaaagtgaatctgcggctgataaaagaatggcaaggaagaaaagaattctgcgtgatcttcaacgggagcacacgcttaaattacatgaaaatgaggatttaagaaataaacttgcagccgttaatctcacaattgataaaaaaagagccactgccaaaaatataaagaaaataaagcttggtatcatcaagtcaagagggaccttagaaattgcacaagctattcttaacccacctaagtctgtggaagctcaatgcgatacacctaacttaggctcagaaaaaacagtcgaggaccagattctggagcctgtgtgttcagctgcaaatgttccctccaacaaacgagagattggtgcccggaaacgtccattgttgctgcctgatctaaatcaaccaccagaggagtatttgaatacggaatttcttggattcagccaatga

SEQ ID NO: 115467 - DNA, 1749 bp, Glycine max
  Peptide Sequence Number=SeqID_232245
atgtccgagggaaatgcagggaaaggaaagagaatcgccatcattggcgtctcaaccttattgttggtggctatggttgtggcggtcacaattggggtcaatctcaatgagaatggttccaacaatgatatagaggacaacaagaaaaatcatgttgcttcttccataaaagccgtccaaaccctttgtcatcccacaaattatgagaaagaatgcgaggaaagccttatagctggggctggaaataccacagatccaaaagaactcatcaaaattttcttcaacatcaccattacaaaaattggtgataaactcaaagaaactaatattttgcatgagattgaggaggaacccagagccaagatggcacttgacacttgcaagcaactcatggatctttctattggggaattaacaaggtcacttgatggaataaatgagtttaacctcataaatgttgacaaaatcctcatgaatttaaaagtttggcttagtggtgcggttacataccaagatacttgcttggatgggtttgagaacaccactagtgatgctggcaaaaagatgaaggatttgttgacgataggcatgcatatgagcagcaatgcccttgccattgtaacagatttggctgacactgttaatgattggaatatcacaaaatcatttgggcgtcgcctccttcaagattatgagcttccgtcatgggttgatcaacatagactccttaatgaaaatgcaagtccattcaaacgcaagcctaatgttactgtagccatagatggtagtggagatttcaaaagcatcaatgaggcattgaagcaagtgcctgagaaaaaccgaaagccatttgtgatctacatcaaggaaggcgtttaccaagagtatgttgaagttacaaagaaaatgacccatgtggtgtttattggtgaagggggaaaaaagacacgaatatctggtaacaaaaacttcatagatggaacgaacacatatagaactgccactgtcgctattcaaggagatcactttgtggccatcaatatggggtttgagaattctgctggacctcataagcatcaagcggtggcattgagagtccaagcagacaagtccatcttttacaattgctcaatggatgggtatcaagacacactttatgcacacaccatgcgtcaattctatagagattgcaccatttcaggtaccatcgactttgtgttcggtaatgcactagctgtttttcaaaattgcactttcgtggtccgaaagccaatggagaaccaacaatgcattgtgactgcacaaggtagaaaagagagacaacaaccatctggaatagtaatccaagggggatccattgtgtctgaccctgagttctactctgtgagatttgagaacaaggcttacctagctcgtccatggaagaattactctaggaccatcatcatggacacatacattgatgatttgattgacgctgatgggtatttgccatggcaaggaccagagggtccttctggtatggatacttgcttctatgccgagtaccacaacattggccccggttcagacaaatccaagcgtgtgaaatgggctgggatttggaacctcaattcaaaagctgcacgttggttctcaccatctaagttttttcatggaactgattggattgaggttactggaattccttgctttcctggcgtgcccaaacaccataggcacaaaaagacaatacttaattggcaataa

SEQ ID NO: 115468 - DNA, 207 bp, Glycine max
  Peptide Sequence Number=SeqID_232246
gagcattttctagatgtttttcgtaacctcttgtatctttcaaaccatttttgcaacctacccgtcgatgggagggtgaggcgaaaggcaaagggtcactttggggcagttatagctcgcccaagcgagctgaaacttagtgttgaagcaatgagctcgcccaggcaagatggagctcgcctaggcaagttggtttcttcaccgtga

SEQ ID NO: 115469 - DNA, 312 bp, Glycine max
  Peptide Sequence Number=SeqID_232247
atggagaatttgggattccgttttagtcgaagtcatagtcacttggtttatgaacaagaggaggtgtggaaggtttgttactttgtgcgcatgaggatcatgatagtcgtagggagatggaactgtcttttgtttgcatgtaagttaggtttttttttgaagtctgttgaggtggcgaatggttgtggtccctttgtgaggccaactgaagaacaaacggtgaggttaaagattcaccatggtgggatgttcatttatcagcccttaactgtgtatatcaatggtcagattgaagaagaagaatggggttga

SEQ ID NO: 115470 - DNA, 2592 bp, Glycine max
  Peptide Sequence Number=SeqID_232248
atggagaagaaaatgaaaattttcagaggcgaagctattggatgcttgaaccggttcttcacctttcaggttaacaaaaccaatgttggtggaaaaacatattctgacgaggttacatcagattcccagaagagcagttctttgtcatctggctttcccagaaattatggtagtgtgccttctggaagtacagattccatgagcccaacaagcactttgacatctttatgtgaagatgctgattcaggtgatcatgggcagttaccagtttctggagcagaatatatcccacatgttctgggggataagtctagagctagtgatactacttacattgagggtcagagagcacagggcattgcatcttgggacaataccatggaacagtctgcaggagagtatgctgatccttctcttgtatcatctacaaccattccatcaagtgcagtgggaaacatccttgaagaaaaccatactgttcctggcaaacttttagggcgtaaaaatgccctaactgaagaggaaaggggctctcagcctgtccaatcaaattggcagattccttttgaagacaatacaggagaattgcctaattggggcttcacccaatcattgggtttggaatttggatctgattatggtgctagtttactgggggatgtaactaataatgcaggcccagaaattgttcctgagctgttcacttttaatggtgagttaaaagagcagtctgtgcaccaaaacttctcaaagctgtatacacatgggcaatctcaacctacactgaaatccaattctgaatatgaagttcctggtgaagcaagtatcaattatgccttgaccatgaggcgtggattattggatggagaggagagcctcaagaaggttgatagtttctctaggtggatgactaaagaatttgcaggtgtggatgatctgcatatgcagtcttcccctggtatttcatggagcacagatgagtgtggggatgtgatagatgatacctcattgaatctgtccctgtctcaagaccagctgtttagcataaatgatttttctcctaaatgggcttatgctgaatcagaaattgaggtgttgattgttggaacatttttgaagagtcaacctgtggtggcaaaatgtaactggtcctgtatgtttggggaagtggaggttcctgctgaggttttagctgatggaattctgtgctgtcaagctccacctcataagattggacgggttcccttctatgtaacatgttccaataggtttgcttgtagtgaagttcgggaatttgagtacagagagggctttgatagaaatatacaatttgcagattgttttaacaattcaactgaaatggtgcttcatttgcgactggtggggttactttctttaaactcagtacgcacttcaaatcaagtgtttgagggtgatatggataaaagaagcttaatattcaagcttatttcactgaaagaggaagaggaatattcaagtaaggaagagacaactgcagagatggatatatcaaaacacaagttgaaggagcttatgtttcacaagcaggttaaggagaagttgtactcatggcttcttcacaaagttactgaaactggtaaagggcctcttgtattagatgaagaagggcaaggcgtgttacacttaattgctgctcttggttatgattgggccataaatccaatcataactgctggagtcaatatcaacttccgtgatgtgaatggatggacagctctacactgggctgcattctgtggccgagagcgaacagttgctgtccttgtctccatgggtgcagcagctggagcatggacagatccatgtccagaatttccttcgggtagatcacctgcagatcttgcttctagcaaaggccataaaggaatctctggttttcttgctgagtcattattaactggccaccttgaatcactcacaatggatgaaaataaagatggtaggaaagaaacttcaggaacgaaagtagtgcaaacagcttcagagcgaactgcgacacctgtgctttatggtgatataccagatgctatctgccttaaggattctcttaatgctgtccgtaatgctacacaagctgctgatcgtatatatcaagtattcagaatgcagtcatttcagaggaagcagtttgctcagtatgaagatgatgaatttggattgtcagatcaacaagctctttctctcctagcttctaagacgtgcaaatctggtcaaggagagggtttagccaatgctgctgcaatacaaatacagaaaaagtttcgtggttggacgaagagaaaagaattcttgatcattcgccaaagaattgttaaaatccagtcgcaaaggacgagccctggtgcagcggtaaagttgtgccttggtgacttgttggtcatgggttcgaatccggaaacagtctctttgcatatgcaagtttcacctgataacattgcattggagggttcaattgatgaaaacttagggttcaaatacttcgccatttctgtttgccctttatataacttgcatgcacgtagagatcacgttgggtgtcaatattggtaa

SEQ ID NO: 115471 - DNA, 696 bp, Glycine max
  Peptide Sequence Number=SeqID_232249
atgggtgcgggttggtctggtgtatgctgtggtgggctgttgttgctatcaatacccgccgctggaaaaccaaccttctccttaaggttggacaataaaaacaagctgaaacaagggattgggtttgtgacccacaccgtggagcaatcaaggaaggcgttaaagacgggtggcggagatgatggtggaggcggtggcttcggtggtggtggtggatgtggtggcagggatttcgtggcaatggccatggcgcgcaaaagcgacagcagagccattggtgcgactgttttgagttcgggatggtgggaaacagccaagggaggcggagctaacgtgggtgttgttgttggttgtggtttgggaaaagatggagatgtggtgggtgttgttaaggtctccacaggtggtggtgcatctgttggggatgagttgggaggaaagggagtgagtatgagagcggatagccggtcaaggatgacgtcaagcttgacaatcatctctagagtcttggtggtcatctccaaagtttgggtggtcatggaggataggttcaaggtagaggcagccataggaggcaaccatggatggcaggagcacgaacagcttggttccaacgcaggacctcaagttgcggttattcaagcggaaaatcgaatctttgggaggaggaaggaggcgagaagagggtacgagtag

SEQ ID NO: 115472 - DNA, 756 bp, Glycine max
  Peptide Sequence Number=SeqID_232250
atggcatttggactcaggactaagagctttgggttcatagaaggagagggtgagtttgtgggtgcacttcaatggtggaaccagattgatgactcagatcaatggcagagaggcacttactatgccctttgtgccgcttatacgttggtctccttcgttgccctggtgcaactggtgcgaattcaaatgagggtacctgaatatgggtggacgacgcagaaggttttccacttgatgaattttgttgtcaatggattgagggctgtccttttcggtttatacagaaatgtttttgcaattagaccaaaggcactagagcaggtgctaatggaggttcccggtcttctgtttttttctacttatgcattacttgtcttgttctgggctgagatatatcaccaggtctgcctctggatttacatgagtgtaagcagaactgcagctggtttgggagctgcaaaactcttccttgcagttatatcattctttgctgctcttggatttttattgtatggtggaaggttgtttttcttgttgagacgctttcccattgaatccagaggccgtcaaaagaaactttacgagcttgcattttctgcatttgatgagaatgcagatcttgatgtcttggaccatcccattcttaacctagtgtactatttgttggtagagattgttccatcaacgttggtgctcttcatattgcgaaagctgcccccgagacgagtttctgatcagtaccaccccattagatga

SEQ ID NO: 115473 - DNA, 960 bp, Glycine max
  Peptide Sequence Number=SeqID_232251
atggcatgggaaaaactatcttctttggctccaacaagtggaacctgtgatcaagagtcatcttcttcatcattatcttatcacgatactgacactgtcattgatgtgtttcgtgcttggaaagaacaagatcacttccttcttgcgtggcttcagtctactatttttagtgacatattggttacaaatcctcatggcagctatgggacaggattcaatcacactttcaattgcttactcgagctcaatcttgttaacgagctcacctttattggtgaatcgatgccgacatttgaacatctaaatccgattcttgatggctttcctaatgagtatgattcttctatttttgttatcaatactggatttgatcccctttcgattaatgaaaatgcttttgatcccaattttgcacctgttatgaaccctaattctcagggtcaagtcaatctgactactcaatcctcctctagtgaaaattcctctaatgattatggtggaacccatttttttaatggttgtggtggtcgaaactccggtcgtggaggggttggtcgaggtagatttgccgatgtgcaatgtcaaatctgttataagtttggtcatgttacatcattctgttatcatagattaaaagagaattatgttcctactcttcctccaacaacttcacttgctcctgcttttgctcaaactgcttccacacaatttgttcagtggacctctattatacctgcacaacaagttcaatatgcacaacctgttcaatacatcattccatctttacatggaaatgctcaaccatatattgttgttgttcaacatcagttagctgatattcaaccacctctacagaccaatcaccaagtttctcaacaacaagctaatcctcaagtttatctcacgagttcttctgttccttctcaaaattggtatcctgattctagtgcttctcaccat

SEQ ID NO: 115474 - DNA, 411 bp, Glycine max
  Peptide Sequence Number=SeqID_232252
atggcggttaactatgacggtgaaaatcgtctgtttccgaagtttacgcttgcacccgtggcgtttgaccaattattgtcaaccatggaggaaagcatagtgttctatgtggagagtgcccttttaacgattgcatcagccatagctagaactataaaggttggtcatctgagtatcctgaacatggatagagggcggtttggccgtgtttgcatgcttagaaatggatttgaatctgttcaaaaagctgcacagggaattgtaccaggtgcggatacgggtttggttcctagtacgactcaacctagtccggataaacgcttgaagaccgggaggccccacatggggagtggcttgttgctactaggaaaaaacgaaaaccgcaagagaataaggtggaggcgcaaatga

SEQ ID NO: 115475 - DNA, 441 bp, Glycine max
  Peptide Sequence Number=SeqID_232253
atgaagagtgaatgtgagtggggaagtggtgttggccgtgtgatgttccttgggaaggaagggtggtgttgtgattggtctagatgccatgcatggcgccatcagcactggcgccttcggggaggagatgacacgtggcatgtcgccattgtaattggcgacacaggctgcatgtcgccactcagatgcaggcgtaggctgcagcacctgctgctggttaggcgtagctggatggtgccacccatgttggcgagttgcgtctgggagggtgtcgccaaccgtggtagcgcgttcagcttggtggataaatatccccaagtgcagagagggtggttgcgcttccttgtgaaatacttgtgtcgtgaaggtgaaaaaagagggtgctttgtgtcgagagaggtagctggtggtgctcaaactttgtgttcttctattttctaa

SEQ ID NO: 115476 - DNA, 339 bp, Glycine max
  Peptide Sequence Number=SeqID_232254
atgcagcaacctttcaacgccggttttctaaaaactgccttaaaaacagcctttcaaatatgcggacatgtgacaccttctcataagctcagtgcttatattcctctttcgtctttccaacttcaaacttcaaattctaaccccattccaaacctttccctcagcaatggaatccaccaaactcctgcatcaatcttcatttctttagacagagagagagagagagagagagaaagagcgtgcggtgtcggaatcatgttctccgattgcaccgatggttcggtttatggtcatcagagaatcgccgatctcgttgagagttttgaatcgcaccggtga

SEQ ID NO: 115477 - DNA, 984 bp, Glycine max
  Peptide Sequence Number=SeqID_232255
atgtcttccagaaaaagaaagagcattgatgcaaggcccacaactcaatatgacataagaagattccactccttcgaggcctggaccagatacacagataatgtgctaggaagacatatactagctgagaggaaggtagaaatataccatacggagttggatgagttcaaggctgaattggagaggcgtaacttccataagcgcctcaccaatttagctgacagcagcatcgacctagccttggtgaaggagttctatgccaacctttacagtcccaaggggccttcaccagaacaagtcagaatccgaggacacttgataaaaattgatgcagacagcctcaacaccttcctggagacacctgtggtactggctgagggagaatccttacccgcttactccagatactgcaggatgcccactgatatcggagagattgaggctgctttgtgtatacccagccgaggtgttctctcatactccaacctggctccgacttcccacacctcggatttgactttagatagagctaggttaatctttggcctagtctctcagctggacatgaatgtaggagctctcatctctagccagatcacatcgatggcccaatctaactcctctagacttgggttcccagctcttatcacagctttatgtaggtccagaggggttgcttctgatagcctagtcttcgaacgcttaagaccggtcattaacttggcctatatcaggaagaactgttggaacccagctgatctgacagttactattagaggggctaggagagcaagggcaaggccagctgaggctccttccacatctgcagctcctcctctaacacgtaccttagcagctccttctaccccatcttctgcagactttcaacactctatcccttctgttgaacgatttaatgaatgggtagcctggcctgggactcaacctccccttcacagggaagacgaaggtctcatagctcag

SEQ ID NO: 115478 - DNA, 99 bp, Glycine max
  Peptide Sequence Number=SeqID_232256
atggagatgaacgctttggcctatctatttggccttcgccgtctcgttgtagggagtggaggtcaatctgtggtcatgatggatcttcaactcgcttga

SEQ ID NO: 115479 - DNA, 246 bp, Glycine max
  Peptide Sequence Number=SeqID_232257
atgtcaaagagggacaaaaaagaaagcttacaacaaaacaagggttcagtttgggcaaacacgggaaggggtgaccttagtcacgagaggctaggggtgcaccgtcccagaaggggtgacctgagtcatgatgaccaccggcgcacaactcagtcttctgaggtcacgagagtgttgttcgagtcacgtgactatactgacgcgccaaccacgatggtgttcaccaaagcaaagtcgtcgaagtaa

SEQ ID NO: 115480 - DNA, 294 bp, Glycine max
  Peptide Sequence Number=SeqID_232258
atggatgagaactgggaagcaactagaaagatggtagcaggaagatttgtgaatgcttactcgaggactgactggatgcttggagttgccttccgtgccaggaacactaacatcgccttagaaccgtattttaagtggaagtttttactcacgaaaggattagctggaatccaacctgtcgatattcctgggatccaaaatgtcgatgtgacagaacacatcgaaggccattcgtcttatctgtgggctacacaaaagatcttagaccaacttcaattggatacatactatcct

SEQ ID NO: 115481 - DNA, 327 bp, Glycine max
  Peptide Sequence Number=SeqID_232259
atgcaagtgggtaccattggcaatattgttagcatttctggtccctttttaaccaaactttctgccccctaccctttactcctcccactcttttggacaatggaaagtggagtacccttccttgactgtctcttgcaaaacactcttagaagcatttgctcatttcccacttcttcaacttcttccaagtgggtgtatgcagtcttctggaggatagtacctcgaaactttcctccgcctaggtgggaatttggaggaacagctcttgatcgctcaaagggaaacaaaagaaactggcaagtttggtggaactgtgataaaccatag

SEQ ID NO: 115482 - DNA, 327 bp, Glycine max
  Peptide Sequence Number=SeqID_232260
atgagatgttggttggaatgggtttcacggtggttccttccgcttccgccggaatcaccaccttccgtcgatgtcaacctctcatatttggccttcattggtcccttccccgtcgatctgaatcctgttctctatccgccgttgtcgcttgcgatggcaatctctgccgtgcccaaaatcactccctgcgtttgtgttcaagccaagtcctacatcggagccgatggtgatggaggcgcatctcactcttccggcaacaccttggacaagagtttgatagttttgaagaagaagaagaagaaaaacttatacgcacctatcatttaa

SEQ ID NO: 115483 - DNA, 270 bp, Glycine max
  Peptide Sequence Number=SeqID_232261
atgtgcgcaacggtggcggggttgccggtgatgacttggcggcgtcctatggggcggtggagggtgaacgtggtagccggtgagattttgacgatgtcggatagccactggatacggcgtgggtatggttttgggatagtgatgcttcttttagtaggacatgaggacgtgagaaagaagaagaaaaacactggaaagatgaagaaaaggaagaaaggagctaacagctgcaaattcagaagtatctcaatcattttccctaagttttga

SEQ ID NO: 115484 - DNA, 240 bp, Glycine max
  Peptide Sequence Number=SeqID_232262
atgggatgccaacttcctaagaaaatggtatatggtgttcgtccaagcgttgatgagtatgacaagttaatacagtctctctggttggaggctttggattgcaaaatgacagaaaaggtacatgaggaaatgaaagggagtggtttgcgtgtgaagggcatcacagggggtttgattagagttgtcaaggagacgaagaaggaggttgtggaggctgagagcattactacagtggcataa

SEQ ID NO: 115485 - DNA, 1688 bp, Glycine max
  Peptide Sequence Number=SeqID_232263
gcagaactgatgttgccggccatcgacgtcaccacttccagcggcttctgcggatcggcaaaacgttccaggccgcgctcgcgcagggtattgaaggtcacaattctggcgccgtgatcggcggcgtgacgcaggctgtgcagcatgcgcggatggttggtgccggggttctggccaaagacaaaaatcgcatcagcgtggtcgaaatcgtccaggcgaatggtgcctttaccgacgccaatgctacgtttcagtccggtgccgctggcttcgtggcacatgttggagcagtcagggaaattgttggtgcccagcacgcggccaaacagctggtacagccacgaggcttcattgctggcgcgaccggaggtgtacagctccagctgatccggatgatccattgccagcaaatgctgcgcgatcagcgcaaaggcgtcatcccagctaatcggttcatagtgatcggtcgcgctgttgtagcgcatcgggtgggtcagacggccctgatactcaaggaaatagtcgctctgctgatacagagtgctgacgctgtgctgggcaaaaaattctggctcgacgacgcggcgtgtcgcttcccaggtcacggctttcgcgccgttttcacagaagctaaaagtgctcttgttatcatcgccccaggcacagcccgggcagtcaaagccgcgcgccttgttcatgcgcatcaagttacgcatgtttttcagggcagctttactgtcaaggacaaaacgggtggtggcttccagcgagccccagccgccagcagcggcgcgatagggctgaatcttacgtttaaatttcatgatagtcgcaggcttattgtttatgaattgttatcagaatatgacttctgttggggtaaaagcgtgatcggcatcataaattatccgctgccgcgcgccggcggggcgcgctccatgaagcaacttgccagtcaggttcacgcattcggcaaagccttaatgatgccgatctccgtcattgctgccgccggtatctttctcggtctggccgccgcgttgcagaatccggcgatcaccggtgaagcatttgccagtttgcaggtgccgcagttgatcatcggttttattcgtaaagtggcgggcgcgctgtttgccaacctgccggtattttttgccgtcgccagcgcaattgggctggccaaagcggagaaacccaccgccgcgtttgcggcagtgattggctatatcgccatgaatgtggggatcagcgccacgctggcggcgaaagggctgacggcagccaccaccacgcccgaggcgctgcagcaggcgggcatggaccagaccagcgccatgatgacgtcagccgagtacatcgacatgctcggcatttttacctacaacatgagcgtgctgggcggggtgattgccggcctgctcactgtgatgctgcacaaccgcttctatacccagcagttgcccacggcgatcagcttttttggcgggcgtcgctttgtgcccatcgtgacggtggtggtgctgccgctgacgggcgtgctgctggcgctaatctggccaaccatcggccagggcattgcgtgggtcggccagatgatcggtaaaagcggtcagtacggtgcctttttgctcggtgcctgcgagcgcctgctgattccgaccgggcctgcatcacatcctcaatga

SEQ ID NO: 115486 - DNA, 681 bp, Glycine max
  Peptide Sequence Number=SeqID_232264
atgaattactcgcatttcactattcgcgttcaggagcagacgatggccgcacaacgtaacgctaagatttctgaaagaaaaaagccgcagcaggcgcgatccagtgagctggtggcagccattttgcaggcggcgactcaggttctggagcaggaaggtgccacgcgctttaccactgcccgcgtggccgaacgggcgggcgtcagtattggatcgctgtaccagtattttcccaacaaggccgctatccttttccgcctgcagagcgaagagtggcagcgaaccggcgatctgctgggttcgattctgcgcgacagcgcatctacgccgcgtcagcgcttgcatcagctgacctgggcgttcctgcactcggagtgtgaagaggcggcgatgcgcaccgcactgaatgatgccgcgccgctttaccgggatgcgccggaagtgcaggccgcgcgcgccaatggcgagaatgtgatgtgcgaatttctgcaacagctgctgccgcagcgggacgcggctgaggtggcgcgggcggcggatttaatcaacagtacgctgggggacgtcggcaagcatttttccgaatcgccgcgcagcgcagcagaaattcaggcttacgcacgcgatatggcagacatgttctgtgcctggatcagagaaaaaggggccgaattgcagtaa

SEQ ID NO: 115487 - DNA, 234 bp, Glycine max
  Peptide Sequence Number=SeqID_232265
atggcgcatcccaccaatgaagcgtttcgcgtgatgtccgatgaggagcaaacgcgtctgctacagagcaaaaccgattaccgcgaactttacggtcatttaaaagatgtgccgctggcggtttcaagggaaaccggcaaactgctgtatatgctggcgcgcagcagccgggcgcagcatatcgttgagtttggtacctcgtttggtctctccaccctacacctggcggcggcg

SEQ ID NO: 115488 - DNA, 534 bp, Glycine max
  Peptide Sequence Number=SeqID_232266
atgagcagagcgcgccgcctgcactcacttcagcgtgccgcattccgccacggcgagataatcggtatacagctgcggcgaaccggaaaaggacgccagctgcttccactcttcatacatctgtttggtatcccggtgcgcgcgcgcaaagtcagccgcgctggcggtggcgatatcaggctgcggataaaacacattcagcgccgcttcactctcaatctccatcatcaccacatagccgtccagccggttgccgctgtggcctttcagcagatgaaacttccagccgggataatcaacgatacgcgcggcattctgcgcgatgaattgctcaaattcctgcggctgcacgcccggccgcagcgccagatagtgggtaccgagaatgcgcgcggtgccgctgcgggcatcaaagcgcgggccacccggcagcgtactgtgaggattctctgccagcagatcgaaatgggtgaaaattgtcgggcgccgcgcgaaggttgccagctggcgccactcgctgagcagcgcgtccgc

SEQ ID NO: 115489 - DNA, 339 bp, Glycine max
  Peptide Sequence Number=SeqID_232267
atggagattgagagtgaagcggcgctgaatgtgttttatccgcagcctgatatcgccaccgccagcgcggctgactttgcgcgcgcgcaccgggataccaaacagatgtatgaagagtggaagcagctggcgtccttttccggttcgccgcagctgtataccgattatctcgccgtggcggaatgcggcacgctgaagcggcgatgcctcactgtaattacacatcagtacctgccagttgccttcaacttccggcagcagcagtggctgcgcgctgtgactcaggttcgccaccaccagcaggctttcacgcggcgaattgcgacgataacaccagat

SEQ ID NO: 115490 - DNA, 913 bp, Glycine max
  Peptide Sequence Number=SeqID_232268
agggctgcacgccctcgccttcagagggctgcacgccctcgccttcagagggctacatgccctcaccttcagaggactacacgtcctcgccttcagagggctgcacgcccttgcctttagagggatacatgccctcgccttcaaagggctacacgctctcaccttcagagggctacacgccatcaccttcagaggactacatgtcctcgccatcagagggtcgtacgccctcgccatcagagggctacgcacccttgcctttagaggactacacgtcctcaccttcagagggctgcatggcctcaccttcagaggactacacgtcctcgcctttagagggctgcacgccctcgccttccaaggactacacgtcctcaccttcagagggttgcacgccctcaccttcagaggaatacacgtcttcaccttcagagggctacacgtcctcaccttcagagggctacacaccctcgccttcagagggctacacgtcctcaccttaagagggctacacaccctcgccttcagaggactacacgtccttgccttcagtggattacacgtcctcgccttcactgggctacatgccttcaccttaagagggctgcatgccctcgccttcagaggactacacatcctcgccttccgagggctacacatcctcacctttagaaggttagacgccctcgccttcagagggcttcacgccctcaccttcagagggctgcacatcctcaccttcagagggttgcatgccctcgcctttagagggctacacgcccttgccttcaaagggcgacacgtccgtgacttcagagggttgcacgccctcgcatttagagggctatgcgtcctcactttcagtgggctccacatccgcactttaagagaatttaaggtcctctacccttaa

SEQ ID NO: 115491 - DNA, 308 bp, Glycine max
  Peptide Sequence Number=SeqID_232269
actactactactactactactactactactactactactactactactactactactactactactactactactactactactactactactactactactactactactactactactactactactactactactactactactactactactactactactactactactacacacacatatataagggagaatccttgaggtttcgcacttgcacatttgagaagaaaactcattcggccaagagctcatggaaaatgctcaaagacgattgtgacagatcagcccatgtcatcaagttttag

SEQ ID NO: 115492 - DNA, 273 bp, Glycine max
  Peptide Sequence Number=SeqID_232270
atgacgatgacaacaacaatgataggaatggttttggtgttgacaggcatggtagcggtggtggtgtcgacggtggtagtggtgacaataatgatgatgacggtagtgatgacaatgacaataacaataaaaaggacaatgtcaaatgcaaaattctcttacatccatttaattaaacaacaactcaagccactcctctgcataacaaaatgtacaacaacccagatagtagcaaagggaaagaaacaagaacgcccttgtgcaatgaattag

SEQ ID NO: 115493 - DNA, 125 bp, Glycine max
  Peptide Sequence Number=SeqID_232271
atggttgttatccagaaaccaagcactgaagtgaataatggagcagtgttggcaactgatggggcagatattaatgccaagatgaggtcaatccttgtggactggttgatagaagtgcataggaa

SEQ ID NO: 115494 - DNA, 2127 bp, Glycine max
  Peptide Sequence Number=SeqID_232272
atggctactattgaagcctattgtcgcaaaaaggcccaagagccgtcaaaatcagctaatgttgcccaagtcaccagcattacctcttctgccagccctgactctcctccggatgtcactatttctgcctatgactatcatgacttccttcagtttcaggcagcccaacaatctgcctcgcctatcactatcatggctcagtctagtaatcttgtagcctttatctctcagtctccttctcttggaccttggattcttgactccggtgcatctaatcatatgaccggtaaccaatcccttttcactcaattgtctttatcagactccttgcgatctgttactcttgcagatggttctcagattaaaagtccatggcattggatcggcataccaaacggacgattggagcaagacattaggagattgcatcgtctttcattgctagttacgtgtgtctcctcttctgccgatcttgctcatagcgtcttgggtattcttcatcagacctcttgtgctcatacaccacagcaagatggtgttgttgagcgcaaaaaccgtcatgtggttgagacaacttgtactcttctccttcatcataaagttccactttgcttctgggatgatgcgattctcactgcatgttacttgattaatcgcatgccttcctctatactcaacaatcaaatcccatacaacatcttgtatccgcagcatgacctctaccccgtcctacttcgtgtctttggttgtacaactgacgtctcgttctttgaatcctctcctttcttctctgaggatgctgacagtcttactcatctagatgatcaacctgatgtttcggttgcagctccggctgcagttgctgatccaccaccattactagtttatcgacgaagggaggagcatccacaggtggttccacatacagatcccctagcaccatctcctgctccaaacagcaatctggcaacgcctcctacacatgaacctcctttacccgagtttcccattgctattcgcaaaggaattcgatccaattgcaatcctgcccctttatatgcatttggttgtcaatgggtgtacacagtgaaggttgcaccggatgacagtatttaccgctttaaagcacgattggttgccaaggtctatactcagatctatggccttgattatggggataccttctctcctgtagccaatatgacttttgttcgtttgtttcttgctatgaccgctacaccagtctatatggatcaaacccctggctttattgcttctagtggctctcaccttgtttgtcgcctccgacgttctctttatggcctgaagcaatcccctcgtgcctggtttggtcgtttcagctccgccttaattgagtttggtatgactcgctgtgaggctgaccactttgttttcttccttcactcctcatctggtctctgcacgtatttagtggtatatgttgatgacattgtcattactggtgatgacttcaatgatattttccgcctaaaatctcaccttcagcgccagtttcagatgaaagaccttggcccactcaaatattttttgggcatcgaggttgctcaatccgctttcagtttatttcccaacagaaatatgcactggacattctcacttagactgggggagccattagatgatccggaaagatatcgtagactcgttggcagactcaattatctaactgtcaccaggctggacatcacattcccagtaagtgtgggagaagcaagaagcaaaatacaattgctagatccagtgcagaagctgaatatcgccctacggcagcagctgcgagtgaaattacatggctacaacaacttctttagcaactccaaattggagacacttagggaactaaactcatgtgataatcaagttgctctttgcattgcctccaatctggtcttccacgagcggattaagcacatagaaatagactgtcattttgtaagagagaaagtgctctcaggagagatcaccactaagtttgtctactccagtgaccagttagcaaatgtgttcactaaatcgcttaaagggcctcaggttgattacatttgtaacaagttaggtgcaaatgatatatatgctccagcttga

SEQ ID NO: 115495 - DNA, 177 bp, Glycine max
  Peptide Sequence Number=SeqID_232273
atggcgtcacgtgccagacaaactagtgacccaaaaagtggttttgcaactgttgagaaggatcttcctgggggcttgacacctatgcttggtgatcgaaaggtagagcattttctgggaattaagaggaaagctgaaccatcaagctcggataccccaaaaaagcctaaatcataa

SEQ ID NO: 115496 - DNA, 2226 bp, Glycine max
  Peptide Sequence Number=SeqID_232274
atggctgaaagaagatcgaagggcctatgctacttttgtgatgaaccatttacacctgaacatggccttacacataagagattgcatatccatgtgttggaaattgaagatgaagaggagggccctggacctcaacaacttgatgctaatgtgggtactgaacctgattcagaacctttaatttctgtgaatgcattaaaaggagaaccatctggtcttcccctttgtcgagttggccatgatcacaagattcctttaatgcaaggagctaaccctgtcaacaagaggccctatagggatctcaataaggcaactgtcaagaacaaattccctataccattagtagaagaccttatggatgagttgtatgggtcaaccattttttccaaaattgacttaagagctgattacaatcaagttcgaatggatgcagttgatattcacaaaattgctttcagaactcatgcgggccactttgaatacttagtgatgccctttgggcttaccaatgctcctgccacgtttcaagggctgatgaattcagcttttcagcattacttgagaaggttcttacttgttttctttgatgatatactcatatacaacagaagtatggaggaccacctttctcatctatatcaggttcttcttactatgagaactcactccttgtatgctaagaaatccaaatgctactttgctgttgacaaggtggaatatttgggccattttattactaaagaaggagtttccacggatccttcaaaaattgcagcactaaaagattgggccctaccacaaaacttgaagcaattaaggattttcttaggtcttgcagtccaaaaatggaggcactacttactccccaagaagttcatcattagaactgatcatagaagtttgaagtacatcctagagcagagattgtccacaacattccagcaaaagtggttggtaaagttgatggaattcgatttcaacatagagtatagagagggtcgagaaaatatggcggcatatgctttatctagacttgattcccctgagatcatggccttacaggttcatcagcctgattctagcatgctctctaggatccaacaatcctggcagaaagatcctatcttacaacatcttgttagtgacttaaaaagcaatccctcttctcacaaacattatacttgggttcggaatgagctgaggaggaaaggcagattagtcattggctcagactcccaactaagacaggacattctcttttggattcatgtttcagcttgtggtggccattcaggcttgtccaaggctattaagatgccacttgccaaaggagtaaatatgacacaactgcatctccaagcttgcttaggcctttacctattcctaagcatgcttagtaaggcaactcatttcatggccttatcacatccttatactgttgcggatgtggcccaatgcttccttgataatgtctttaaattgcatgggtttcctgacaccattaccacttatcacccacaaactgatggtcaatcagaagtggtgaataggtgccttgaaacatatctcaggtgcatgtgtagtgactctccaacacagtggtccaaatggttgcctcttgcggaatggtggtacaattccacttaccacaacattattaaagcaagcccttatgagattgtgtatggccaagctcttcttgttcatttgccttctcttctgggggaatctaagattgctttggttgatagaagtttgcagaaacgtgaggaaatgttaaagttactcaaattccacatgaagagagcccaggacagaatgaagcaacttgtagatagaggcagatctgataggagttttcagattggtgacttggtttatgtaaaattacatgcttatcgccaagtttctgtgcaggctagaaccaatgcaaagttggcccctaagtactatggcccatttccaatagtagacaagattggtgctattgcgtacaagcttaaattggctcttggatcaatggttcataatgtcttccatgtttctcacttaacgaagtttaatggtactgctactgttgggaactttagtccttcacctttattggatacttctcaaaaggaacctgcagctatcattgacagaatgacagtcaagagaggcagtcgtgctataaccaaagttttggttcaatggaagcatcagctacctgaagatgcaacttag

SEQ ID NO: 115497 - DNA, 243 bp, Glycine max
  Peptide Sequence Number=SeqID_232275
ttgactcctaaggaagcctttcggatgatctctcataagttccatggtaaaggacctggaaaaatgaagcaagaaaagcgtatgaagcaatattacgaagaattgaagatgaagcaaatgaagagctcagatacaccatcactgtctgtggagagaatgagggaagctcaagctcgtttgcagacaccctatcttgttcttagtggtcatgttaaaccagggtatgattttaacaattcctga

SEQ ID NO: 115498 - DNA, 474 bp, Glycine max
  Peptide Sequence Number=SeqID_232276
atggctgatccagtatgtttagcagtagttcatttcgaaggaaaagcactacagtggcatagtgcttacataaaatctgtaggattggagaatttgccttcttggaatgaatatcagatcttgttacttgatcattttggagatgtttgtgaagatcccatggcggatttaatgaagctcaggcagacaggatccatcatagagtatcatgaggagtttgactcaattgtatcaagagtggatctttctgatgagcatcaacttagctgctttttaggaggattaaaacaagaggttcagatgattgttcaaatgtttcagccaaattctattcgaaaggcttattcccttgcaaagatgtatgaatcttccttctccaatacacaagccaaaccatttgtcaagaaccagaaatcttcctttgttcctaaaccacccctacttccaaacctcctagatcaaccaatcctttaa

SEQ ID NO: 115499 - DNA, 309 bp, Glycine max
  Peptide Sequence Number=SeqID_232277
atggaatcttggaaagtccaacctagccaatcgaaagaagaaattacaaggaggaggttgattacagattctatgtggcacaatgtggaggcatctgctgcgaaggaaaagacaatggtgcacaatgttgaggtcgagccagtgagggaggtggaagaagtcatcatcaaagtcccatattcagagggagtgtgtggggatgccgaatcacttgtcatcgtggttgtcatggaggtgagaagaggagggacacaagcaggaaaggttcgacagagtaaaacgaaggaggcaaagggaggagggagataa

SEQ ID NO: 115500 - DNA, 297 bp, Glycine max
  Peptide Sequence Number=SeqID_232278
atgtccaagtactcgacctgggtacacaaaagagtagggcctcatatcatgggcaagagcatgagtactcagatattcgggcaagccaagtacttgggttctttcaagagtaggtccttttacaatggtcaagattgtgagtacctaattattcgaccaagtcgagtacctagcatcagttcttggttgagtgtcgaagattcagaggattcaaaagggttaggggaacattctctgttaccaacgatggtggatgttgttgatggatcgacaagtaaaccaatttgtcccacgtag

SEQ ID NO: 115501 - DNA, 1122 bp, Glycine max
  Peptide Sequence Number=SeqID_232279
atgtctggtgctccagtacttcctcgggaactcatagtggaaattctgtcatggcttccagtgaaggctctcatgcgattcaggtacgtttccgagacttggaattccctcattttcgatcctacgttcgttaaattgcacctagaaagatcccccaaaaacacccatgtcctattagagtttcaagcaatctatgacagagatgttggccaacaagttggcgtcgcaccctgctctatacgccgtttagttgagaacccatcattcactattgatgattgtttgaccctattcaaacacactaacagtatctttggttcttgcaatgggttggtttgcatgactaagtgttttgatgttcgagaatttgaagaagagtgccagtaccgattatggaacccagccacagggatcatgtctgagtattcaccacccttatgtattcaattcaaagataataataatacctactatccttggaaatgtggctttggattcgatgattcgagtgacacttacaaggtggtggcactcctttgcgatattaaatcgcagacaaaggagatcaaagttcattgcttgggtgacacttgttggagaaagacttcgaatttccctgcttttcccgtgctgggagaaggacattttgcgtgtggcactgttaactggctagcactacgcgtgtcaagttttcattatctatgggaaaatgttactatcgatcatatcgatcagttagtaattttttcctatgatcttatgtacgagacatacacatatttgtcgatgcctgaaggtcttcttgaagtccctcgcatggagccttattttggggttttgaaaggttgtctgtgtctttctcttgatcacatgaaaacccattgtgttgtttggttaatgagggagtttggagttgaaaattcttggactaagttgttgaacgtaaattacgagcaacttctaaatcatgaccgtcctttgtgcatgtctcaagatgaggatgtcgtgttgctgacaagttatgcagtatatggattggagattatttatcgttctgaagaatcatctccaattctaactctacttattgcttaccgtcatcatcatacttggaatttatag

SEQ ID NO: 115502 - DNA, 1611 bp, Glycine max
  Peptide Sequence Number=SeqID_232280
atgagcatgcagagtgttgttgggactaatctggacgtatatgctgggtgcaacaacggaagttgcgttatctgggattttgaaacccggggcattgctaaagagctacgagataatgaatgttcatctccaataaccagtgtctgttggtcaaagtgtggtcatcgaattcttgtatctgctgctgacaagtcattgttgctgtgggatgttatgagtggtaagaggataacaagaatagttttacaacaaacccctctacaagctcgtcttcatccgggttcctctaaaccatctctttgcttggcatgccctctctcatgtcctccaatgattgttgacttgaacacaggaaacacaacttcgcttaaagtttctatcttggagatatccaataatggaccaacccctacctcacgtaacaagtgtgccgatggaattacctccttctcaccaactgctgcatgttttagtaagtacggaaacctggtttatgtgggaaactctaaaggggaaattcttgtaattaactatgtagatggtgaggtgcgtgccatggttcctatacctggtggttctgtggtgaagaacattgtgtttagcaggaacggacaatatcttctaacaaactcaaatgatcgaataatcaggatctacgaaaatcttctacccctaaaagaagaagttagaacacttgatgagctaaatgggaacctcaatgatctaaatgatgttgagaagttgaaagctgtaggctcaaaatgcctaactttgttccgggagtttcaagattcaataacgaaggtgcactggaaagcaccctgcttcagtggtgacggtgagtgggttgtgggtggttctgctaataaaggggagcacaagatttacgtatgggatagagttgggcatcttgtgaagatccttgaaggacctaaggaagcccttattgatttagcatggcatcctgtacgtcctattgttgtatctgtttctttgaatggcatagtttatatctgggctaaggattacaccgagaactggagtgcatttgctcctgatttcaaagagctcgaggaaaatgaggagtatgtggagcgagaagatgaatttgatttgattcccgagactgagaaggtaaaaggatctgatgttaatgaagatgacgaaattgacattgtaacggtggagaaagatcctgctttcagtgactctgatatgtctgaagaagagttatgtttcctgccagcaactcccagttgtgatgctcctgaacagccagacaagttcgtaaatagttcttcaaagttggtggacagcaataactctggatccccactttcagaagaggctggaccaaatgaaaataccatgaatcataactcaagtccagtggaagtttttacttacagccttcaaaatttctttgcagatgatgctggggggacacgtatcaaaagaaagtggaaaccttcagagaaggtgttggagttgcaggcagaaaaaatgaagaaacccacaaaatctggcaaatcatcaaaatccaaaagtaaatatttggttgatgaggatgatggtattggtttttatggtgatgatctttctgatggataa

SEQ ID NO: 115503 - DNA, 324 bp, Glycine max
  Peptide Sequence Number=SeqID_232281
atggtcgaggtctccacggaggccattgcctccctcgcccaatattatgaccagcctttgaggtgcttcacctttggggacttccagttagcacccacggtggaagagtttgaagagatcctgggatgccctctgggaattagaccgcgggaagcaagtcaaaaatggggtagttggggtaccaaggaaatgtttggaagcaaaggcgagagtcttggcaagtcaaggcgaaggggccccgttcatggacatcttggcacttttgatcttcggggtggtcctctttccaaatatggatgggttagtggaccgggcagcgattga

SEQ ID NO: 115504 - DNA, 213 bp, Glycine max
  Peptide Sequence Number=SeqID_232282
atgactcacgtatcagatattaaactgataagaacagatactacacttgatcttagccaaaaggccgagaaagagacaactcataatattatggattctgttgctgggccatatccataccctgtgatggtaagagagtttcatgcagtgattgacaaggaaaccagaaagcaagctttggaaaaatgcataagaaaccaaatgtgttggtga

SEQ ID NO: 115505 - DNA, 276 bp, Glycine max
  Peptide Sequence Number=SeqID_232283
atgaaaaaggttttggagggcacagtagtagaagaatggttatgcggtgatttgggtgcttcctcttatgtgtcaagtgatgcgtatggtaatgtatttgtggatgaagatgaagaggatgaggttgaagatgatgacaatgacaatgagaaagatgaggagtcgattgagtatagggtggaagaggattatgattctcacagtattggatgtggaaaaagtggtggtttttgtgcagaagatgactggagatgtagtacagttgaatttctgtga

SEQ ID NO: 115506 - DNA, 1277 bp, Glycine max
  Peptide Sequence Number=SeqID_232284
atgacagaggaggaagagctgaactctttgcattcatgtgaaacccaagttaggacaatgggcatggcttcttgcaacaatgaattttccacaaccacttcaggaaaaaaattgtctggtggtgattatagaggctggactatagcaaaagataagttaactgaaaataaaaaggaaatgaatggctcaaataaatttgagagtgaaaatggcagtttttgtgcatctaatggagttgcttccattgatcagaaccaggctgttcccaagaacggggatagcaatattgtactgcaggatcctggtgcacatgtcccatcttctgttaactattctgtattaaacaattcaaaggtgttaatggattctgaaagggtgattcaccagcataacggatcttcactggggattggtaaagagaaagtcccagtagtcaatggtgatcatggtttggatggaactgcaaaggattcaactaatgtaacacttactaaacaggcacgtggtactgaccaatcaaagctccgggataggctttgtagtatctatgatgatattctggttgttgataatattcatcttgcagaggaagttgctaagatgcttacaacaaagtaccggcatcttatttatgcatgtgatactgaggtagccaagatagatgtcaaacaagaaactcctgtagatcatggggagataacatgcttcagcatttattgtggtcctgaagctgattttggaggtggaaagtcctgtatctgggtagatgttcttgatggtggaggcaaagagattttagaaaaatttgctgaattttttagcgattcttccatcaagaaggtctggcataattatagctttgactgtcatgttatagagaattatggattcaaagtttcgggatttcatgctgatacaatgcacatggcacgattatgggattcttcaagacatttggatgggggttattctcttgaaggacttacaggtgacagaagggtcatgtctagggctcagctgaaccatgaaaaggacttgattggtaaggtgtcaatgaaaactatatttagtaagaaaaaattgaaaaaggatggatctgagggtaaaacaagtatcattgctcctgttgaagagctacagagagatgagcgtataccttggatatgttattctgccttagatgctagcagcactttgaagctgtatgagagcctaaagagccatctttcagacatgccctggaaatttgatggtgtgccagtttatgggaaaaccat

SEQ ID NO: 115507 - DNA, 225 bp, Glycine max
  Peptide Sequence Number=SeqID_232285
atgtggaatgactgcatttttcttctgcaattcacatcatgcaacaaaaataaagaggctgagaaggtaaaatggaaggaagagagaagggacttgagaagcggcggcggcggcataaagggcagtgtggccttaaagcagagacctccattgaggcagaaatcacctccgagtgctcctgctccctccacagttaaacagattaggagccagctacttaaataa

SEQ ID NO: 115508 - DNA, 1248 bp, Glycine max
  Peptide Sequence Number=SeqID_232286
atggcgtcctccatagcctcgcaattagaagttatcagatccttcgccaaaaccgactctgaccctctcaagaggccactcactcgcccttccatcttgtatgatcccaaaaaagccgctgacatctccaccgaggctattttcaccgaagctcttcgaggcttagagattcttattggcatggatgagcggttcaggaactataagaacgatttgtttagccacaggagtacagagttggatagagagttgatgggaatagaacagaacaatcaacttaatgtctccattgcttcatacttgaaactactttctggatattttcttcatactgccgcccttcaaacgcttgagtacttgatacgtagacacaagattcatgtatacaacaacgaggatttgatgttgtgtgctttgccgtaccacgacgagcctgaatttgttcgaatagtacagatacttgatacaaggaatactaaatggggatttcttgatggtgtgaaagcctctggtgcacggctacctagaatggtcatagtgcagcagtgcatccgtgataagggcatattagacgccctatgcaactatgcatctccgacaaaaaagtctggaccttcagtgcctgcaattcgcttttgtactgctgttttcgttgaagttttgggtactgttgtgactgttgatgatggtcttgtaaagaggatacttccttttgtgagtcttcagcctggcattaaggaggtttcagatcacaaggctggttctctgatgatcattggtttgcttggaaacaaaactgcattagctcctaaacttttgaatagtttgatacgtttggttgctgaggttgctcgtcaggaggctacagagttgacagatctccattggtttcgattgtcccttattaccttaattagtcttgttcagtctcaaaatgttgaaatactcccattgaaggctttggagatattaaaggaaataagggacctggcaggggttttattagaattatctaaggagttcaatattgaaaagtttctccttgtgcttttggactccctgattgactgcagttcttctgatgaatactgtcagcggactttgctatccttaatagaaaaagtccccataaatggtcttgtttatcatgtggtcaccaagatcctttcaacttgtgtgaaattatcacaaaaagttagcgactcaacttcttccatgtcaggtgtgtattctgattttgaattgtag

SEQ ID NO: 115509 - DNA, 1272 bp, Glycine max
  Peptide Sequence Number=SeqID_232287
atggtagtttttcttggtacccgaatccagagcatcacctggttcaggttcaacccttcgcacagccacaagctccttcagcggagagccctggagatttcgatgttgacaatgcaacagggccaatctaaaagacccatttgcccttcttgttccaaacccagccgaacgtgtctctgctctcgaatcctcacaccgggtctccaaaattctgtgcatgtaaccattctacagcactcgctagagcgtaagcatcccctcaattctaccagaatcgctatattgggcctcaagaatctcaccgttgcaactgtttctgatgttaatttcgaagcccggttcctgattcggttgttggatccgaattaccattcgggtcatgctggaaacgagccaactgcgttgttttctcgtcagtgttgggaaattggagacacccagaaattgctttctgagaaagattctaacttgattgatactgatagtgctggaaaatgtggtttgagaaatgatgttggagatgttctggattctgcttctaatgcagaagttgtgaaacaagtgagtatcagtgatggtgcagtgatggacgatgaagttgagaaaaatgcaattagtccaaagtgtgatttagctagaggtgtacatgaagagagtggagaactagctgttactgttaccattggcaaatatggtgccattagctctttgtctcatatttggatgactcaagcacaatgtcaatcccccgagttaagctttgacaatattttggcgtacccggaagcttgtgaagcactctcaaaagggtttttggtgaagaagtttcaaaggaagcaactgaatagggatgaagaattggaagaatgtgaagaatttgagcttgaggttcgtcctggatcggtactactatttccctctgaaatggctgttgatgttagtgacctggatgctataggttttgaggtgaagaacttgattgttctggatggaacatgggctaaggcaaaaagaatttatagtgaaaatccttggttgaacattttgccacacgtgaagttggaagtgaacaagacaagcttatatagtgatgtgagacatcagcctaaagctggttatttgtccaccattgagagcattgtatttgccttgaaggcagttggggagttgaatcatgagggtttggaaggtctcttggatacttttgagtccatggttggagatcagaggcgctgtaaagaggagagactgagcaaacacttttcctgttga

SEQ ID NO: 115510 - DNA, 849 bp, Glycine max
  Peptide Sequence Number=SeqID_232288
atgcagcatcgggctcagagggcattcatcacatatttgagatccatccatatccaaaaggataaagacatatttgatgttatgaaactacctattaacgagtattcagcatcattaggtttaccaatgacccccaaaatccgttttctaaacccgaaaattaattctaaagatgtgtcaaaatcaattttagttgaaccagaggattcagacaaggaaactatctttgaggtttcgaggaagctagacacagctgctttcaaggatgaggaaactgaaaatgatattcttcagttagcggatactgcaaatgaaggcgaagttaagtcatctgaaattgaagaaatcataccagcaactcgtgtattgaagaaaaagaaactcaagattaatgtacacaggccacttgggactagggttgtatttgatgatgagggccacacacttcctccactagccaggatagcggacacacagagtggcaaagaaatgttgctcgatccagaaaaaaaagctgaatactatagaaggatgcgagatgatttgaagaaggctgacaacgaagacaagcttatagagcgtcagcggcttagagaaaaaagaatcaagcagaagatgaaatggaaggctgggaatgcggaagaggacgaccaagatgatatatctgggtcagaagtagatgagactgttgatagatggcataaaaagagtaaagtatactttgatagtgacagtgacgagggtgaaagaaatgatgttacagggaatgcaggtataactaccggtgcggttacgttggaggagcaagaagctctggctttgaaattgttaaattccatgcactcatag

SEQ ID NO: 115511 - DNA, 1031 bp, Glycine max
  Peptide Sequence Number=SeqID_232289
atggataagaaaacaaagactccatccatccatctggtccggtcaacccatgttcatgtactttatttcagcttgagagcgaggagtcagccagacaagcaagccaccctctgctaccgcttctcatccatcatgtcgaatgaactaaaaaactatgatgtttttctcaattttcatggcaaagattccggttacaccttcactggtactctctataatgctttgcgcagcaagagaatcaagacctttttcacaaaacatgaatatggtcgtaaactacacactgatgacagccacattccaccctttactcttaaagcaattaaggaatcaaggatttcggtggttgttttgtcggaaaactatgcatcctcctcaagatgtcttgatgaacttgtggccatccttgagtgtaaaaggacgataaaccaactggtgtggcccatcttttacaaagtggatccgtcgcaagtaaggcaccagaaagattacaacgattccaatgagagggtgaagcaatggagagcagctttatctgaagtcagcaaattgagtggatggctttacaatgatcggtcccagtacgaatatgaattcatcgaaaggatcgtggaatcaaccgtgcaagccttgcccggatatgatgtttttctgagttttaccggagaggatacccgctacactttcacaggttttctctataatgcctttcgccgagagggattcaaaatcttcatggatgatgaggaattggagagtgggaaccaaatttcacagaagcttatgagagcaattgagagttcaaagatttcaattgttgtgctctctgaaaactatgcatattccacctggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggag

SEQ ID NO: 115512 - DNA, 729 bp, Glycine max
  Peptide Sequence Number=SeqID_232290
atgactgaagggtatagaaaagttctcctccaagttcctcagccagataacagatatgttttggtactagatgaggctgatcggattctagacagtgggttcaagaaggaactaaatgcaatcatttcccaactaccaaagcgtagacaaaccttgcttttctctgcaactcaaacaaagtcaattcaagatcttgcaagactaagtttgaaggatccagagtatctgagtgtgcatgaagaatctgtgacttccactcctactctgttgaagcaaattgtgatgattgttcccctggaacaaaagttagatatgttgtggagtttcataaagacacatctacagtcgaaaacacttgtctttctttcaagctgtaagcaggtaaaatttgtctttgaagcatttaagaaactgcaccctggcataccattgaagtgccttcatgggaggatgaaacaggaaagaagaatggcaatatattctgagttttgtgagaagcgctctgttctcttctcaactgatgtggccgcaagaggccttgattttaataaggcagttgactgggttgttcaggtggattgtcctgaaaatgtagcttcttacatacatagagttggtcgtactgctagatataaatctgatggaaagtcagttttatttctgttgccttcagaaattcaaatgcttgaaaagttaaaagcagcaaaggttccagtgcattttaataag

SEQ ID NO: 115513 - DNA, 411 bp, Glycine max
  Peptide Sequence Number=SeqID_232291
atgggggagacacatgaaatgccccaccacaatctagccgacttcgagccttgcctcggatatgccactaaagggcaaacagttggtggtataaccctgcaaaacactttggagggccctcaatttcgcccccaaccccaaccctcacattccacaatggttaaaaacccttatgcatggctgaaatgggagaagttggatcctctagaggaaaggctcaaggccattgaaggaggtgaagattatgcctttgctaacctaaaagagttgttcctagtacccaatatcatcacccctcccaagttcaaggtgtcggactttgacacgtacaaggggactacttgcctcatgaaccatctaaagatgtattgtcggaagatggggtatacgcaagagatgaggaactgctga

SEQ ID NO: 115514 - DNA, 684 bp, Glycine max
  Peptide Sequence Number=SeqID_232292
atgagaaggccgaaatcgaaggagtttcgcaagcaacagcgagtttcagaggaggaagagataaacctcttgaattcatggatccagtttcagccaccggactccggttcgaacccaatgtcgctgccgcgtctccccaaaaactcccccgttggtcgcctcgaagataacacctactctcgctacgccggcgcgtcacggtttgatcaatttccactctcgaagaaaaccaaggacgccctaagagagtccaagttcgtggccatgaccgacatccagagagcgtctcttccccacgctctctgtggccgcgacatcctcggcgccgccaaaactggctccggtaaaaccctcgctttcattatccctgtgttggaaaagttgtatagagagagatggggacctgaagatggtgttggcagcatcatcatatcgcctacaagagaattggctggccagttatttgatgtgttgaaagttgttggcaaacaccataattttagtgctggccttctcattggtggtcgaaaggacgttgacatggagaaagaacgtgtaaatgagctcaacatattgatttgcacacccggtagactgctgcaacacatggatgaaactcccaattttgattgttcacagatgcagctatactatccccccccccccccccccccactattataa

SEQ ID NO: 115515 - DNA, 2361 bp, Glycine max
  Peptide Sequence Number=SeqID_232293
atgagtggagtggggattgatattggaaatgagaactgtgtgattgctgcagtgaagcaacgtgtgattgatgttttgttgaatgatgaatccaaacgtgaaacccctggtgtggtctgctttggagagaagcaacggtttatagggtcagctggtgctgtttctgctatgatgcaccccaagtccacaatatctcaagtgaagagactaataggcaggagatttacggaccctgatgttcagaatgatttaaaactgctcccagttgaaacttcggaaggcccggatggtggcattctgattcgcttgaaatacttgaaggagattcatgcatttaccccggttcaaatagtagcaatgctctttgctcacttgaagactatagctgaaaaggattttgggaccgcagtttctgactgcgttattggggttccgtcatactttaccaacttgcagagacaagcatatctcgatgcagcagcaattgttgggttgaagcctttgcggttgatccatgattgcactgcaactggtcttagttatggagtttacaaaacagatattcccaatgcagctcatatttatgttgcatttgttgacataggtcattgtgatactcaggtctctattgcagcatttcaggctggtcaaatgaagatactttcacatgcttttgacagtagcttaggggggagagactttgatgaggttctgtttagtcattttgcagcaagatttaaggaacagtatagcattgacgtgtattctaatggcagggcatgtaggaggctgcgtgtagcatgtgagaagttgaagaaggttttgagtgcaaatgcagtggctgatctgagcattgagtgtttgatggatgaaaaagatgttaagggctttatcaagagggaagaatttgagaatttggcatcaggattactggagaaatttaatattccctgcaacaaagcattggctgatgccggcatgactgtagaaaagattaattctgttgagttagttggttcaggttcacggattccagctataactaatttattaacttctctatttaagagagaactcagccgcacgctgaatgcaagtgagtgtgtagcacgtggttgtgctctccagtgtgcaatgctcagtcctattttccgtgtcaaagaatatgaggtccaggattctattcctttttccattggactttcatgtgatggaagtccaatttgtgaaggatcggatggtgtactcttcccaaaaggccaacccattccaagtgttaaaattctaacatttcagtgcagtaatttgctccatctggaagcattctatgctaatccagatgaattaccacctgggacatctcctaaaataagttgcttcacaattgatcctttccatggatcccatggaagtaaggcaagaattaaagttcgagttcaactaaatttgcatggcattatcagtattgaatcagctacattgatggaggatcatgtggatgattcagttacaacaggtgattatcattcaaattctgaagcaatgaatgttgaacctgtttctgagacagttgaaaatgtcacagaagatagtatcaacaaaaagtgtgaagctccacgccatttggctgatggtacaaaaaaagataaagctaacagaaggcttcatgtacctgtgagtgaaaacatttatggtggaatgaccaaggctgagatattggaagctcaagaaaaagaactccagttagctgatcaggacagaacaattgagctgaccaaagacaggaagaattcgttggagtcttatatttacgaaacgaggagtaagctattcagcacatatctaagcttttcaagcgaacatgagaggaaggacatatctaggagcctgaaagcgactgaggattggctttatgatgatggtgatgacgaaactgtagatgcttattctgcaaaactagaagatctaaaacagctggtggatccaattgagtttcggtataaagacacagaagcaagaccacaagctacaagagatttgttaagttgcattgtagagtatcgaatgtctgcagattctcttccaccccaagataaagaacagatcatcaatgagtgcaataaagcagagcagtggctaagagagatgaggcaacagcaagatctttaccctaagaactttgatccagtattattgtcaagtgatatcaagagcaagacagaagatttaaactcgtatgattttaactttctgttttccttttcagagatgcataactgtaggagtatgccaacagatattgaaatccaagggttctccatttccaaaagacaagggcgaagacaagcagaatacttctaa

SEQ ID NO: 115516 - DNA, 2142 bp, Glycine max
  Peptide Sequence Number=SeqID_232294
atgaagttttccggcaaggggagttttccggtgggcattgctttgaggagcgtgaacaacccttcgccggactcagatcttgaaccggcgaagccatttctgcggcggaatccgagaactccggggacacggttgaggagacacggtggcaaacggagcagacccgaaacccctcttttgaagtggaagatccatgacgatccacttgaagacgaccagaagtcttccgtcgctgggtcccgccggagaacgtgccggagcgccaagaagcaagccgaagtcgctgtgtcggcgaggagactcgccgccgggctgttacggttgcatctaccggagacggccacgggtgatggccggaaggggttggaacataagctacatgctactaggttacttcatctactgtattgtaggccacccctcacggaggaaaaagaattaatacatggaattggtcacccagggctccagtttcttggtcatcctaatggcatgacccatggttctgatctgaagaagaattcatctcaaagtccccgttccatatttggtacaaggaatggacacttctgtgagcctgaaagtttccagcttcccaacaatgaaatggagggtgcaacaaaatgggatcctttatgttcaaaaacatcagagggagcgcagcatatctacagccacatgaaacatcttgaccaaaaggcaagtgctgtatctgttgtatctgctctaggagctgaactagagcaggcacgaacacgaattcaggaacttgagactgaacaccactcctccaaaaagaagcttgagcattttctcaagaaagtcagtgaggaaagggcccaatggagaagcaaagagcatgagaaaatccgcgcatacattgatgacattaaagcagagttgaatcgagaaaggaaaaatcgccagaggattgaaattgtcaattcgaggttggttaatgagttggcagatgtcaaactctctgcaaagcgctacatgcaggattatgagaaggaaaggaaggccagagaattgatcgaggaagtgtgtgatgagcttgccaaggaaattggagaagacaaggctgaagttgaagcattgaagagggaatctatgaaactcagggaagaagtggaagaggagaggaagatgttacagatggcagaagtatggcgtgaagaacgagttcaaatgaagttgatagatgctaaagttgctcttgaagagaagtattcacagatgaataaactcgttgcagatttggaaagctatatcaggtcaaaaagcacagagccgaacacaatggacatgaaagaggcacagtcacttcaacaggctgcagctgcaatgaacattcaagacattaagggattttcatatgaaccccctaactctgatgacatttttgccatttttgaagatgcaaattttggtgaagcaaatgagagggagattgaacaatatgtttctcacagtcctgctagtcatgcctcaaatattcacatggtgagtcctgaagccaatgaaataagtaaaggtggcattcagaggcgttctgatgtatttatggatgataatggggatatagaaggagatgaaagtggatgggagactgtgagccatgtcgaggatcaaggctcaagttattcaccagaagggagtagccgatctttgaacaggaatcaccgagagagtaacgtctcagggagaagtgtacttgaatgggaagaaactgcaggtgaggagacaccaataactgaaataagtgaagtgtgctctataccaactaagcaagcaaaaaaggtatcatccataacgaagctttggaggtcaacatatccaaacaatggggataattacaagataatctctgtggagggaatgaatgggagactttcaaatggaatgttatctaatggtgtcatcatgtctcctgatcatggatcaggtaaaggtgggctgagtccccaagaccttctataccagttgagtcccgagtcaggaagtccacatgcacatcaaggcatgaagggatgcattcctcgcactgcacagaagaatagtttgaaagccagacttatggaggcgagaatggaaagccagaaggttcagttgcgccatgttcttaaacagaagatttag

SEQ ID NO: 115517 - DNA, 1812 bp, Glycine max
  Peptide Sequence Number=SeqID_232295
atggcgaacttcgaagtgccctcattttccctaggcctcgacgatacgcccccccattccccaatccatccacctctttctcccgatcttcacgtctccgactccgactccgactccgatcccgaatcccgacccgacccgcctcgccccctcctcaaacgcctccgccgcgggcccccgccaccgtgtctcgaccccgatgccgacgccgacgatgacatcgaggatttctcctcgcaagaagatcccgatcaagggcatgcggttccatcggcgtggaatcgaaatcattctgtgtgtagcagctcgaaagtttcgttgaatagaagtggggttttgacccctcattcgtgtagcaactctttcagggataggaaaagaaaggaactttctaatgatgttccggcttcagccaggttagagacagggaagagtggcttgatgtttcccaagttaaccactagtcctctccgaaggtttcaattgattgattcggactccgatgatgctgatgttggtgttggtgctggtactagtgatgccaataaagttaaccctaatagtcatttggaacaagagaagaaaacatctgctgacgagaacagaaatgaggatctgtggaaggatttttcgccggtgaagaatgtttctgttaataggtttcaattgctttcagattccgatgattcggatgttgatgttggtggtgccaataaagttaacactaacagtcgtttggaacaagataataaaacttcggttgatgtgaacggaaataaggatcagtggaaggattttttgccggtgaagaatgtttctgttagtaagtttcaattgctttcagattctgatgattcagatgttgatgtggatgtaggtggtgccaataaagctaaccctaaccgtcatttagaacaaaataagaaaacatcgcctgatgatgatctatggaaggattttttgccggtgaagaatgtttctgtccccacgcccgccttcaatgagatatgtgaagaatactttcgttctgccaattgcaaggaagtaggtggtgatgcatctaaaagttttagtgagaggaatcctggggttagttctagctgccagaggtatcaacaacgatgggaatcaacagaccccgttcatcctgctcatagttattttttccatgaggatccgagaattcagcagttagtccgcagccgcctgcggaattttaatccactaggtaccatcaacacagtgaatcagcaacctaatttctcacacattgattacatgggacaatttggtaatggaggagcctcaaacatgcagggagttcaaaatggttttattaattgctcaacaagggggggaaacaaatcaagtaatttgaatgttgatggatcttttaatgcttctggaggctgggtggatcccaaaattgtttctccattcagccatggggaatcttctagaaagaaagcaacaaagaggaatggctctaagaatagtgtctcaaaaagtaatagtaaagcaaacaaatcaaaccctgcgaaccaatcatgtgcttctgggggctgggtggaacccaggagctgcaccagtttgccaaaggatgcaggcaaaaggcgtgttcaagcaagtggtgaatctgctggtcattggtttacatcgccagaaggaagaaaggtttatgtcaacaaaagtggggaggagttgacaggccgcaatgcttatagacaatatcggaaggagagtggagcaggattcaagaaatcaagaaagaaaaaaggtgccaagacgacaaatgccaagaagaggaactga

SEQ ID NO: 115518 - DNA, 756 bp, Glycine max
  Peptide Sequence Number=SeqID_232296
gttggtaagttatctacaatctgcatcatggaaggtgttattctgagaagggtcattccttcggataacagttgcctcttcaatgctgttggctatgttatggatcatgacaaaaagaaagctgctgagttgagacaggttatagcagcaacagtagcaagtgatccacagaaatattgtgaagcatttcttgggaagccaaacacagagtattgtaactggattcttgactcagagaagtggggaggtgcaattgaactttcaatattagcagattattatggacgtgaaattgcagcatatgatattcagacaactcgatgtgatttgtatggtcaggaaaggaattattctgaaagagtgatgctgatttatgatggtctccactatgatgcattagtggtgaattgggagatgtctccctttgaggaagctccagaggagtttgatcagaccatatttgctgtacagaaaaacagaagcattggacctgttgaggggcttgctctaaattttgtgaaggaccagcaaagggcgagccctggtgcagcggtaaagttgtgccttggtgacttgttggtcatgggttcgaatctggaaacagcctctttgcatatgcaagggaaacggagttacactgacacttctaacttcactctgcgctgtggagtatgccaaattggagtaatgggtcagaaggaggcagtggagcatgcacaagcaactggtcatgttaacttccaagagtatagatga

SEQ ID NO: 115519 - DNA, 408 bp, Glycine max
  Peptide Sequence Number=SeqID_232297
atgagtcttcattcttcatctagtgttaatggtgagggttatactcctaaggaccccttgtataagatattagatgagttgagatcccttaagttgtggaaagaaaaacaagagagaaaagaaaaaggatgccatagttcacatactaaacatcactcccaaagaagagaaaaggatataaggcctcaagaggttaacattaggctcccatatttccacggaaaagataatgttgaggcctacttagattggcaaatgaaggttgaacaactctttgcttgccatcatattagcgaagagagaaaagttccattggctacccttagctttcaagggtatttcctctattggtggactttccttgttaaggaacgaaggattcatgggaatcctccagtagagtattga

SEQ ID NO: 115520 - DNA, 1055 bp, Glycine max
  Peptide Sequence Number=SeqID_232298
cgaaaaatatcggaagcttagttatcgaggcgaaagaagaattaagcgcagcttcccttcagttgatcggagaagtaaaagactcaggaaccttaaaaattaacggtattgaatcagacattacagatcttgtagcggccaatactaatacatttgaaaatcttttcccgactgtagaaaaagaaaagatcacggttgaaattgatgcaaaacataactcggtcaacccaagaaatatcattattaaaaaacacggaatcgcacaaccgaaagtatttgctccggtattcccgggaaccaactgtgaatatgacacactgaatgcattccagaaagaaggcgctgtagtaagcagcttacctttaatcaatatcaatcaccagttactcgatgaaagcattgatgcatggttggaagagatcagaacatctcagatccttgcattctcaggaggtttctctgcgggtgatgaaccggatggttctgcaaaattcattgtaaacgttcttaaaaacgagaaaatgaaaaatgcagttcatgaattgttagacagggacggtatgattatcgggatctgtaatggattccaggcgttagtgaaatcgggacttttaccttacggaagaatcaaagatctggatgagaattctccaacattagctcacaacgccatcagaagacacatctcccagatggtaacagtgcaggtagtaaatgacgaaagcccttggttaaaaggaatgaaaggacagacttttaccattccgatttcccacggtgaaggacgtttcatggcttcagaagatgaaatcaggaaattatatgagaacggacagattgctacccagtacattgatcttgatggaaacattgcccacgggatgccttttaaccctaataattcattattcggaattgaagggattaccagcccatgtgggaagatctatggaagaatgggacacccagaacgatttgctgaaggtctcatgaaaaatattccaacagcgaactatcacaatatctttaaaaatggagttgagtacttcaaataa

SEQ ID NO: 115521 - DNA, 360 bp, Glycine max
  Peptide Sequence Number=SeqID_232299
ggacttgcactacctccggagcctgaggttggtccctcaactgctcatgtcagcacaaagaagagttatgttggtccctcaaggaatgatccagacacgggtgactcagacaaatgcgggttgtacattaaagaaaatcctccccgcctgggttccctaggaagagtttatgagggatccacaactgttcacagcatccctttgttgcatgatcaagtgaaggttggtgttgaggaggttaaagatgcagatgctcctgttcctgtacccactaacgaggttaacttagtggggcagacacttaacacatttcttgtttggccaacccgcaactcagtgtactggagatgcgcttattaa

SEQ ID NO: 115522 - DNA, 912 bp, Glycine max
  Peptide Sequence Number=SeqID_232300
gctatttcgaaccgggtctcgatccgttctcgctaccgggcaaccacattattgatgcgctgccggcgctgatgttcgctgacttcccgcgcctcggcgatgcctacgattttattccggtagggcgttcccgcatggccgatcagatgtgcgaagtggtgcgcatcgtatcgcgtgacggcacgcgttatagctacgtagtgtggctggacgtcgataccaaactgccgctgcggattgatttgctggatcgtgatggcgagacgctggagcagttccgcgtcatcagttttgccgttgatgaaggcgtgcgcaatctgatgcaggggctggaaaaagccaatctgccgccgtcgctgtcgttaccggcgggcgacaaagtgcagctcagctggcaaccgggctggctaccggccggcatgaagctgatttcacaaagccggcgcgacattccggcgatgaacaaaaccgtagaatcccgtctgtacagcgatggcctgttcagcttcgctattaacatcacgcctgccgataaaagcagttcgccacagtcattgcgcactgggcgtcgtacggtgcagaccgaagtgcgcgataatcgtgagattaccgtgggcgtcgctactctgcattcggaagcgaaaacctcctgcaacagttgttcagcgcgcaaaggctgcggcagccatgcgctcaaccagctgggaccgaaaaacgcccatcctgctcggttctgcgctgctggtgtatatgacgccactgtttggtctgttcctggtcgcgggcctgttccagatgctgttccacagcgacctggcggcggcctgcggtgcgctgctggggggcgttggcggctttattgttgccaaaggggtttccagccggtttggcgatcgcgaagcgttccagccg

SEQ ID NO: 115523 - DNA, 234 bp, Glycine max
  Peptide Sequence Number=SeqID_232301
atgcagagttcgttgagaccacccggttatgcacgtaactaccccccccccataggtgatcagcctggggccaaaaggagttccctaccaagcgacaagccccctcagtacaaagtacactctgccacagttattatatttactatgttgtatgagctacgaacatggccaaaagcaagtgccaaagaccatggaccaattaaagcgcctaagcatcccctcagaaatgcttag

SEQ ID NO: 115524 - DNA, 165 bp, Glycine max
  Peptide Sequence Number=SeqID_232302
atgaaacagtaccagagtggaagaatagatgagatgcctcctcctcagcacctctgcagtaagggcatcacatatcctgaatctgcatttgtctgctgtgcagattcttctttgttggtaatctgtcccttagcagccgccaagcgaagaccgcaaacttactag

SEQ ID NO: 115525 - DNA, 135 bp, Glycine max
  Peptide Sequence Number=SeqID_232303
atggcgtctatgccatatgcccttagatttgtcaagtctagtgcgcagggccctgagaatgactctgttggctgcctctgcctggccattggtctaaggatgtccgacagaggtgacaaggtgcttgacacctag

SEQ ID NO: 115526 - DNA, 357 bp, Glycine max
  Peptide Sequence Number=SeqID_232304
atggaacactacctatttacatcccttctttttcataattttcttatatcgccaagacagggtgaaggaaccatcttgcctaggcaagctgcaactcgcctcagcgagctagttatttcaggactaagccttggctcgcctaggcgagccgccattgtcccaaatgcgcctttttctataaataggcgtgaaggggaggctgagagggggttccaagggttagaagtggagagaattgagaaaagagagaaagaagaagaagaaagaagaggaaacgaagtcgaggctctatcgaatcgtgactatgatcgtccctatgtcgtttcttgttcggtgttcttcgcaccagtcgattag

SEQ ID NO: 115527 - DNA, 174 bp, Glycine max
  Peptide Sequence Number=SeqID_232305
atggagtttgtcaggagggatgcgtggaatgtctacaaactcttggcatcgtctgcatctcttgatgaagtcaagggcatcggccctgagtgttgggcaatagtagccaacactttaacaagggtgtttgttgtcaaccctcttttgaatagctcaccatcaaggatgacgtag

SEQ ID NO: 115528 - DNA, 265 bp, Glycine max
  Peptide Sequence Number=SeqID_232306
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccagggcctctttgttgggggacgctggaggatttcaaagtcccacacgtgaaaccacg

SEQ ID NO: 115529 - DNA, 154 bp, Glycine max
  Peptide Sequence Number=SeqID_232307
atgaagatgaaagcaatcaaaacaagaaatgaattgaaagtctcggattccaacacttactggttgaattatgaaaaacggacgaagaacggtgaagaacggaggaaaatcttcacagatttgctcacagaaacgtctcagaagcgttacggaa

SEQ ID NO: 115530 - DNA, 234 bp, Glycine max
  Peptide Sequence Number=SeqID_232308
atgcaaggcaaaattgattgcaataacataaatgagataagggaagagagaatgcaaacacagttttatactggttcggccacaactcgtgcctacgtccagtactcaagcaacccacttgagttttccactatctttgtaaaatcctttacaacttctgaaccacatagggacaacccatcccttgtgttcaggaatccttacaactcaagagaccctcggtcccttaattaa

SEQ ID NO: 115531 - DNA, 141 bp, Glycine max
  Peptide Sequence Number=SeqID_232309
atggcttcaccactggccacaggattacaaaccttcaatgcacatgcccaggattacccagttttacaaattttcaatagtccaattttctttctaagaagcatggacaatgacgaagacacaggacataacacagacaag

SEQ ID NO: 115532 - DNA, 159 bp, Glycine max
  Peptide Sequence Number=SeqID_232310
atgcatatgacacagatgcaatttacgaatacgggagcccgagaaactgtctccttcttagatacaacgtctaggggtagcaaagtgccccaacaggggatcaagacagaacccatgtgcgatgcatatgcgaaaggcgcaacaagggaatgtacatag

SEQ ID NO: 115533 - DNA, 498 bp, Glycine max
  Peptide Sequence Number=SeqID_232311
atgcaaagggagtcccaatctgaatcggttgatgtacaaataggagatcgcttagaggaaatgatttgtgatcttggaaaagaatcttttcagcaagcacatgcctctatgtatgatacattgcaaagtgattcgaagaagcgtttgtatttgaggcgcaagaagtctttgacgttgttgtcaatggtgttaagtctggttatgtcaaggccagatataggtggagtgacaaaagcctcacttcacttcttcaggtggtgcaggatatgcttccagaggaaaacacgttgtcaaaaaattactatcaggtgtggggtatcaaggtacaaagtgaaggatgatgacgagtgtagcagtgatgaaagcaccaagaaaggccccctagcgaagatgacgcaaaagaccttacatgacatgcagatggaagaaattgcaatggaatgctccaccatccagctgatccctctcagtggaagaagattaatagtttctatctag

SEQ ID NO: 115534 - DNA, 141 bp, Glycine max
  Peptide Sequence Number=SeqID_232312
atgacagactcaaagagacctctaggggtcactgttgaaactgagaaaatacggaaacagcaaaggagcttacatcttttactgaagccagagatagcaaatctttgtgaaattctgcgtctccctatgatagattactaa

SEQ ID NO: 115535 - DNA, 306 bp, Glycine max
  Peptide Sequence Number=SeqID_232313
atgtcattgcctggcgctgttcatgcatcctccaccaacgagtctggagccccgcgaagttattgcgtagcgctcttcgccaattctccattctccactttttttcggagccccatgaatgtcattgcctggcgctgttcatgcatcctccaccaacgagtctggagccccgcgaagttattgcgtagcgcttttcaccaattctccattctccacttttttacggagccccatgaatgccattgcctgacgcagttcatgcatcctccagcaacgagtctggaaccccgcgaagttattgcgtag

SEQ ID NO: 115536 - DNA, 981 bp, Glycine max
  Peptide Sequence Number=SeqID_232314
atgggtgatcgttcagcattcgtctcgctttaccaggcaacaagcccgaagctttttgcgatctgcctgaaaatcctgcgggacagaacggacgccgaggaggcgctgcaggaaatttatatcaaggtgtggcagcgcgcccgcacatttgccgctagtgccggcaaaccggcgacatggctcgccaccatcgcgcgcaaccacgccatagacacgattcgcgcccgcagacctgctggcgatgacattgacgaggcatatgacctcgtcgacgaaagcgttcgcgatcctgaacagaatgttgttctggcggatgaaggccgcaggatcgacgactgcatgcgggaacttgagactaacctggctgcggcgcagtcttctcaaactcagagagtgcatgcagcgatgacgacgggcgaccacagcggcggaatgcactcgcgcgatgaaatactcgcaggcgaatatgtgctcggtgtcctgccgcttgaaaagcgccgcgaagtggaacagcgtatccaggaggacagggtcttcgcgcaactggtgcagcgctgggagaccgagttttcagagtttaacgccgattaccaggaagagacgcccagcgccgctattcttgcccgtattcaagagcgtctgttcggcagcagagcggtcaacacgaatggcaccttgtggaactccgcatctttctggcgctggatatctgtggccaccagcgcaaccgccgtggctgccgtcgtttatgccgcgttcccggatcaacgggacggcacaagcccgcttgtggccgagcttgcgacaaccgacagccaggtcaatctcctcgcgtcctacgacgcggaatcgggccgaatgcgtatcgttcccgtggcgaccggaaagacggacgaaaagtcactggaactgtggctcgtcatggacggcggcaagacccgctcgctcggcgttttccagcccggcacgaatggcgacctc

SEQ ID NO: 115537 - DNA, 504 bp, Glycine max
  Peptide Sequence Number=SeqID_232315
aggactacacgtcctcgccataagagggctgcacgccctcgccttagaggactacacgtcctcgccttcatagggctatacgccctcacctttagaggactattggtcctcgccttcagagggctacacgtcctcgccttcatacggctatgcgccctcacctttagaggactatacgtcctcgccttcagaggtctatacatcctcgccatcagaggattacatgtccttacctttagagggcagcacgacctcgccttcagaggactacacgtcctcaccttcagaggactacacgtcttcaccttcagaaggctacacgcccttaccttgaaaggtctacatgccctcgtctttagagggttacacgccctggccttcagaggactccatgtcctcgccttcagaggattgcatgtcaatgccttcagaggactacatgtcagcacctttataggactatacctcctgaccttcaaagggctacatgccctcgccttctga

SEQ ID NO: 115538 - DNA, 984 bp, Glycine max
  Peptide Sequence Number=SeqID_232316
atgacgtgtagtcctctaaaggcgaggacgtgtagcccccagaagaggaggacgtatattcctttgaaggcgagggcgtgtgtcccattgaaggggaggacatgcagtcctctgatggcaaggacgtggagtcctctgaaggcgagggcgtgtagccctctaaaggcgagggtgtgtagacctttcaagttctctgaaggcgagggttggagccctctgaatgcaaggacatgtagccctcttaagacgaagatgtgtagctctctaaaggcgaggacgtatagttttctgaaagtgagggcggatagccctatgaaggctaggacatgtaaccctgtgaaggcgaggacatatagtcctctgaaggtgagggtgtatagccctatgaaggcgaggacgtgtagtcatctaaaggcaaggatgtgtagtcctctgaaggtgaggacgtgtagtcctctaaaggcgagtacatgtagtgctcctaaggcgagggtgtgtagccccctgaaggcgaggacgtgtagtcctctgaaggtgagggcgtatagccctatgaaggcgaggacgtgtagtcatctaaaggcgagaacgtgtagtcctctgaaggtgaggccgtgtagtcctctaaaggcgagtacgtgtagtgctcctaaggcgagggcgtgtagccccctgaaggcgaggacgtgtagtcctctgaaggtgagggcgtatagccctatgaaggcgaggacgtgtagtcatctaaaggcgagaacgtgtagtcctctgaaggtgaggccgtgtagtcctctaaaggcgagtacgtgtagtgctcctaaggcgagggcgtgtagccccctgaaggcgaggacgtgtagtcctctgaaggtgaggacgtgtagtcctctaaaggcgagggtgtgccgccctctaaatctaagcacgtgtagtcctctcatggcgaggacgttagtcctaaggcgagggcgtgtagccctttga

SEQ ID NO: 115539 - DNA, 535 bp, Glycine max
  Peptide Sequence Number=SeqID_232317
atggacttgaaagaaaattgtacttatgtcatgcacaattttaaagtgctaaaaaacaatggtcagtacagagtgtgtgatcatcaatttaaattggtgtttattggggttactgttgtgagggagtgtgttctaggggacatcccttttagaaatacagatattattggtgtggtggaggaggttgtctttcagcaagtttcaggaaaaggtagaagggtagtcttcaaactaaagaacttgagccagcaattgctatcttgcactttgtgggatgattattgcttgcagtttttgaagttcttagatgattatgaaggtgatggcccaattacagttctattgagccattgtaggatcaaggaagcgcagggatcttatcccgcatcgatcaacaattctttcaaggcttcaaagttaattattaaccagcccatgatggagattcaagaattcaatgaacggcttgcagagttgggcattgaggcccggtcaggttttaaatcccatggtgaagggagtacacaactttcag

SEQ ID NO: 115540 - DNA, 1263 bp, Glycine max
  Peptide Sequence Number=SeqID_232318
atgatacaagattgtgatgaagacggtgtcatcctgaacgtccagcacgttcgaactcccctggtcccaatacatatcaagatgtgcgaggcagctctgtttgaccatgatcatgcagcgtgtgaaatatgtcctgtgaatgtaaaaggatgcccaaaggtacaagaggacgtacaaaggctgatagacaacagagaactaatcatcacgaggaaggacaaggaagtgtgcgtcatcacccctgagtttcagcggttggaaataagctataacagtggggaatcaactactactccactggtggttggcttgccaggacctatgccgtatgcttctctaaaagcggtcccttacaggtatagtgccacgatgttggaaggtgggcaggaggtgcctttgccctccctaactcctgcgatttctgtggacaacattgctagtgacggtaaagttctgaggaatggacgtgttatccccactttgtttgcaaagaaagtgaatgatccggcagttaaacaggcgacagtgaatggccccggtacaaggaaggaagtaggccaatccaatgggactagcaagaattctgatcatgacgagattctgaaactgatccagaagagtgagtataaagtagtagaccagctgctgcaaactccctctaagatatccattttgtctctgctattgaactcagaagcacaccgtgaggctctaatgaaagtgttggaccaagcttttgtggagagggacgtgactgttaatcaattggacagtatagtaggaaacattactgcctgcaataatttaagttttagtgatgaagagcttcctgaggaggggaggaaccacaatctggcgttacatatatcggtgaactgcaagtctgatgctttgtcgaatgtacttgtggacattggttcctcattgaatgtaatggccaaatccacattagaccaactttcctaccgggggcctcccatgagaagaagcggggtggttgtcaaagcgtttgatggatcaagaaagtctgttatcggggaggttgatttgcccgttacaattgggccgtttgttttccaaattacattccaggtgatggatatccaagccgcatacagttgccttttgggtaggccatggatccatgaagctggggccgtgacatccaccttgcatcaaaagctgaagtttgtcagaaatgggaaattgatcactgtgagtggagaggaagccttgttgaaggaacctctttccaaggcctga

SEQ ID NO: 115541 - DNA, 180 bp, Glycine max
  Peptide Sequence Number=SeqID_232319
atggctcggtcacaaccatctatatatatggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaa

SEQ ID NO: 115542 - DNA, 846 bp, Glycine max
  Peptide Sequence Number=SeqID_232320
atgggggcaggcgccgggttcatcggtccggtgctggttgcgctgggctccgaactggtccatgaacagcagcgcggccgggccatcggcatggtactgctcggggtatcgatggcaagccttgccggtattccgctcgccgcctgggtagccagcctgtggggcgcgaaagccctgtttgtgctggtcggattgctaagtctgctgagcgggctgaacattttgctgacggtgccggatgacagtgccgggacgcgcatccgcctgcgtgagatggccggcgtgctggccgatggcagatacctgacggctttcctggtggtgttttttattacttgcggcgtttacagcttttacgcttttatcgcgccgctcattcgcgacacctacactggcggcacgcatgcggtctccgcagcgctggccgtgctgggcgttgccggcgtgctgggcaatctctgggtcacccgcgcggcgacacgctttaccgctgagaaactgctgctgagcggcatgacgctgctcatcgtcgatacggccttgatcgccgtgctgccgaaagcgctgggcgtgctgctggcggcactggtggtctgggcgtttgccaccgatctgctctggcccagccagcagcgccggatcgtcgagctggcatcagtccgccatcgcggcattgcgctggcgctgaccagtgccttcatgtttggcggtatcggctttggctcggcggtcgcatcatggatatatccactcgccggcttttacgggctgatcggcatgtcggtggcttttattctgctgggatgctcagtctgcagctgtcagaaaagcgcaggcaaccggtaa

SEQ ID NO: 115543 - DNA, 132 bp, Glycine max
  Peptide Sequence Number=SeqID_232321
atagtagagctcaaaaagaattgactgctgagccggatgagtcaggaaatgctcaaggagactcggaagttgcggagtcttggtttaatcaagccgctgaatattggaaacaagctatagccctaacccctg

SEQ ID NO: 115544 - DNA, 390 bp, Glycine max
  Peptide Sequence Number=SeqID_232322
atggcagaatcatcaaagaggtgcaagggctcatcatcctccaccaccaccgccacggtccttccggtgaccctctggtaccacccaatccatctctttcctcaccgccctctctcactctattttccactaatgtccaacgtgagagtggatttcatgactaagaaattgccctattaccctaaattggttcgattgttttataacaacttggaaattcatgaaggagtgatattttctgaagtgaataaaataccaattgttgttgatcaatccttgttttactccctgtttcgctctctgggatactacttgtttgtgtggatgcaaaatctaccggcaagtgcaccaggtcgtcaagctcaagtactagacaccgatgtctcgtga

SEQ ID NO: 115545 - DNA, 277 bp, Glycine max
  Peptide Sequence Number=SeqID_232323
caacaccgatgtgttgaccgatcatgtaggatttatgttggtagatctaaagaaactcgcttaccagaatgaccttttcatgatggcaaaacaagctaaacaggggaaaacaattggtgttaatgttgaagatgatgattcatacattgatacttatgcaaatggctacaccacccagctctcctcctcctcttcctcctactggtgtagcatcacagttgccatctaccttgaagcgcacaagaaacgtcacacggctaaaatcattggcgactag

SEQ ID NO: 115546 - DNA, 552 bp, Glycine max
  Peptide Sequence Number=SeqID_232324
atgcagattctcacaagtgggttagtcaccgaaatcataggggaaatatctgtggtgttgacttcatttggctttgcaatcccaaccaagcacttccagttacgaaaagcatcgttatctgaagatgatgcatttgcctttctgaagggtgacaactatgctgattctgtgacatattttagcttctccgaagcacttcggcaggtgaagttaattggtgtgccttatggactacgttttcaacagttgcaagatctatggaatcaagcagatgctgatggaaatggtgtcatagactttgaagaattcaagcagaaaatatggaattctacatgtccagagcatgtgttggaaaatctgaatggttgcacggaagattgtaacacagaacaggagcaagaagctattggttttaaggtgaagaatgcaatgctgtatccgcgtgaagtggagaaaggactatggccagaagattattctctttctgatcatgctagactcacagctgtgttttcaccagcaaggatgagatgttctgcctcacaaaactga

SEQ ID NO: 115547 - DNA, 165 bp, Glycine max
  Peptide Sequence Number=SeqID_232325
atggtttttggggcttccgtggcttccgtaaaatttccgaaaaccttggaaaattcatgccgaggtgcttccataacgcttccaagacgtttccgtaagcgattctgtggaaattcttcatcattcttcactgttcttcgtcattcttcggtcttcaaccagtaa

SEQ ID NO: 115548 - DNA, 690 bp, Glycine max
  Peptide Sequence Number=SeqID_232326
atgacactttcgaccaaagatgtgagaagagcagtacaaggattgcttgctgtactctggccctctatgtatggttggtttcacacctttttcgccaagaggatttccaaatgttcccttgatggggacaaggggttgcatcagttacaatcccgtggacgattacaacaccctgtaatcgattaccagaaggcttactactcctaccctaagtacctagacatagatttcttcaatgatgagacatttgattgttatcaagtgtttcaaaattctggcttggttgatttcatgtctttaaaattgccttataatcctgaacttgtcaaagtcttttactgcaatttaaaaattcaggatgacattctttcttctgaggtgcatggtattcccatgatcattgatcaatcattgttcttttctttgactaaactacccaatcaaggtgcaccttttgagggcaccattgttgatgactggaaatttgattattcttgtcatgatgctcgccgtatggtttgcaatgaccaggctgaaatgaccggtagattgctggccggatcattaacttttgataatcgcatcatgcactacattattgttagaattttgcttcctcggtcttcaaatttggctcaagcctctgaggaggacttgattttgatgtgggctttccttaccggtcgttag

SEQ ID NO: 115549 - DNA, 321 bp, Glycine max
  Peptide Sequence Number=SeqID_232327
atggcacgcagagaccaagtttggtcattctgcacacatgatacgcggagataccttacggctatccgcacccctttgctaggcagacacagttgtgtccgatggcacgcagagaccaagcagacacagttgtgtccgatggcacgcagagaccaaggttggtcattctgcacacatgatacgcggagataccttacggttatctgcacccctttgctaggcagacacagttgtgtccgatggcacgcagagaccaagtttggtcattctgcacacatgatacgcggagataccttacggctatccgcacccctttgctag

SEQ ID NO: 115550 - DNA, 747 bp, Glycine max
  Peptide Sequence Number=SeqID_232328
atggccggatccaggtccaccagggtgacgtgctccacatgcttgtacttgaggatctcgcgcaccgccaggccgtcgccgccgcccagcaccagcacgttgcgggcccacggcagcgcttgcaggccggggatcaccaaattgcaggttgccgttgatgtacagccgcaggtcgtcgtgccagcgcgtcacgatcagccgctggtagggcgtggtctcggcgtgcaccacgtcgtcgccgtacaggcccttttcggcccacgcggtcatctggccggaaaacaggaagcccagggccagcagtcccagcaccacgccgccgcgcacggcgcgttcggccggacgccggatctcggcgcggaacagccaggtggtccacagcgccacgccggcattgagcatgccgaacaggaaactggtgcgcagcaggcccagcttgggcgccagcaacagcggaaagatcagcgacacggccagcgcgccgagataatcgaaggtcagcacgcggctgacgatttcgcggaactcggccttgcgctggttgaacacccgcatcaccagcgggatctccatgccgaccatcagtccgataatgaagacgcccgcgtacagcgccgcgcgaaacggcgccgacagccaggcgaacaccaggaacaggaccgcggcggaaaccccgcccaacaatgcgacggccagctcgacgtcgatgaatcgattcaaaacgtcgtcgtctcttacatattttga

SEQ ID NO: 115551 - DNA, 587 bp, Glycine max
  Peptide Sequence Number=SeqID_232329
ggtggacccttgggtactagtacctatcacttttagaggactacacgtcctcgccaacagagggctgcacgccctcaccttcagaggactacatgtcctcgccttgagaggactacacgtcctcaccatcagagggctgcacgccctcacctccagaggactacatgtcctcgccttgagagggctacacgccctcatcttggggctgcacgccctcacctctagaggactacacgtcctcgccttgagagggctacccgccctcgccttgggtactaggtaccctcaccttcagaggactacatgtcctcaccttcagggctacacgccctcaccttgggtactagttaccctcaccgttgagaggactacacgtcctcgccttgagaggactacacgtcctcaccatcagagggctgcacgccctcacctccagaggactacatgtcctcgccttgagagggctacatgccctcaccttggaggactgcacgcccttacctccagaggactacatgtcctcgccttgagagggctacacgccctcaccttgggtactagttaccctcaccgtcagaggactacac

SEQ ID NO: 115552 - DNA, 699 bp, Glycine max
  Peptide Sequence Number=SeqID_232330
atgcccaatggtgaagatgcgtatctgtactgggatccggaaacccggatgcagaatatccacaactcgctggaagtcggcgtaacctatctcagcaccgatattaaaccggtaaaaggtcagaaaacggatatcgggccaggtacgctctgccgccgcaaccgtcccggcggtgcatgccagtctccggcgaccccgcagaccgtcacggtgacctactcggtttatattaaagccaccggcaatccgccgccgtcaaacggcgtgattaacgacaccaaccgctacgctatcttccaggttgacggtgttggcggcctcaacagccgcccgaatagtaacttccgcgcgtgggtcaccgggcttggtaatattcgctttatcgcctgcaacccgaaaatcaccgtctcggcgaacaatggttcaacggtcaacttcggcagcatcccggcgcgcaatgccgtcgtcggcgccattgagaaacaggttccgttcagcgtccgcgccgacctgaccggcgccggccaggattgccagggtcagaccttaatggccagcttcagtacccagcagccgactcaggacaccaacaccattctgccatccaacgatagcggttttggcatcctgctctcgcgcgccgatgcgccgacgacctggctttccatgaataccccgacgcgagttgggcatgattaa

SEQ ID NO: 115553 - DNA, 650 bp, Glycine max
  Peptide Sequence Number=SeqID_232331
atggctttccgcaagagaaaggcccctacctcagtataccaggcccgctatgaccgctctagattcacatctcaggaggcctgggattgttactctgatattgttattagcaggaagatcctgcctgagagaaatgtcatgatatatcatacaaaatttgatgagttcaaggctaagctcaagagaaggaattggcacaaggagctgaccaatttcatggaccgaagcactgatgttgcaatcattaaggagttctatgctaacctctatgatccaaaggataactcacctaagcaggtgagggtcagaggtcacttgatcaaatttgatgcagatgctttgaatacttttctgaagacccctatgatcatagaggagggggaagagctatcttcatactcaagattttgtcatctaaggccagatccatcggaactgccagcccaattatgcatccctgggaggggatttgagctaaatgcagatgggctgcccttgaagatcttgaggaagaatctgaccactcttgctcagacatggagcattctttcattctccaacttggcccttacttctcacacttctaacatcacactggatagggccaggttgatctacggcatcatccagaagatggacatgaacttggg

SEQ ID NO: 115554 - DNA, 549 bp, Glycine max
  Peptide Sequence Number=SeqID_232332
gaagtggcatatccattggtaccttccaagaaggataaagagcgacacttagccagatttcttgacatcttcaagaagttggagatcacattgccttttggagaagctctccaacagatgtcactctatgccaaatttttaaaagacatgctgatgaagaagaaccggtatatccacagtgacacgataattgtggaaggaaattgtagtgttgtcattcgacgcatccttccaccgaagcataaagatcctggaagtgtcaccatcccgtgttctattggtgaggtcgctgtgggtaaggctctcattgatttgggagcttgtatcaacttgatgcctttctccatgtgccggcgacttagagagttagagataatgcctactcgcatgaccttacaattggttgatcgctccatcacaagaccctatagagtgattgaagacttttgcgcatcacttgtgctaagcgctatgtcttcacacgctaagcctatgttgcttgtgctaagcgctttgacccttcaccaattggctagatggttcagctaa

SEQ ID NO: 115555 - DNA, 549 bp, Glycine max
  Peptide Sequence Number=SeqID_232333
atgaatatcttgacggcacacgatcaagagtgggaacaggagttaagtccttacaatcaatatgaagaagaaagaactcctaatctcgaaagtgtgtttgaggaattcatggcataccatgccagctcaaaagataatcaaaactcaataaaaaatcatgaaattcattttagtaagagctacttaatagaaaactttcacgggggaccaaagttacaaccttaccatcaaaatgaagcagaaagagtatccaatctagataaattgttgatgcaattcatggaaacagctaaatcaactcaacaagcactccaaagtgtagaaatccaggttagtgagctggcaaaagcagtgactcaatttatggtcaaacaagaaatatcctttgtagaggttgaagctcaaaagaaaagcccagtaaaagagcatgagtcaagagaaaaagttgaggagaaagatgaggaacaagcacaacaacaatgcgagaagtactcaatagtaaaaaaccaacaagaaaatattttccaaagcaataaccttcctcattaa

SEQ ID NO: 115556 - DNA, 180 bp, Glycine max
  Peptide Sequence Number=SeqID_232334
atggcacgagaatgcttcccaaatgaatatatgatgtggaattgcccctccagtgtagataaatggcatgaaagtttcttttcaaatgcaagaattaatgaaacattgggcttaatccggattttggttgtggacttgaagagggcaaataaagcagcgcttaccttagttaatttctaa

SEQ ID NO: 115557 - DNA, 327 bp, Glycine max
  Peptide Sequence Number=SeqID_232335
atgataaattacctcttttcctgtatatgtcaactattgctaactgctatctttcatcatgatttttcgagcacgaaaaaggacgtcgaggaaaataacagggatgttgaaaatgaggttgcatgttcccgagcttggccgaaaaaaatcctggaagtagcactgctttggcgattggcaagacatatccgagtagcgctgcctgaacgaagcgtgggcgtaaagcatcaagtggaggcgccgaatccttgcaagaggggggcagaccggtcaaagccaagtccagacgagctggccaaaaggcatagggccaaggcggataattaa

SEQ ID NO: 115558 - DNA, 183 bp, Glycine max
  Peptide Sequence Number=SeqID_232336
aacaatgctttaaaaggtcttgataatgctccacagcctaaatcaaaggctgctgctaggtggattgtcgtcaagtgtaatagacaaaaaggaagcactgattgtggctattatgtcatgcattggatatccaccatcatattaggaagtttcacgaataactgggaagcgaggcctcaataa

SEQ ID NO: 115559 - DNA, 339 bp, Glycine max
  Peptide Sequence Number=SeqID_232337
atgcacaacaactgccacttgcagacatggacaaatcaagtgaacaagcagcagcgactgagcctcagagtagaagaagaagaagcaactcagcgtgggaagaagaagaagaagaagaagaagaagcaaccaacagcttcctacactgtctctggtagtagtgaggtggagcaaaacagtaccaagggcataatagttcattttgattcattatttagactatgggtgcaccaagcaaaaatagggtgtgctggtggactagacaggaaagtcctctggtaccctggtcccttctacattccaggtagagtgactgtaggagagcaccaagaggcataa

SEQ ID NO: 115560 - DNA, 159 bp, Glycine max
  Peptide Sequence Number=SeqID_232338
atggaagacatgcagctattcgaactgcaagaacaaggaggaacccaggaaaacccagataactgtcaattttttcaatgggttgaagaagaaaaccaactttctaattcgtcttctgtctcaagagaaacaatggtagtggctgatttgaggctataa

SEQ ID NO: 115561 - DNA, 306 bp, Glycine max
  Peptide Sequence Number=SeqID_232339
atgtggaaaaatgttgacggacacatcacgacaataaataatgtggaagttaaagagatgaaaggagtgtgtgttttgaaggagtttggtgcgcattttctaacaataaaaattggcaacaaaacaaccaaagtagcaaactccaaagaaataagtgttacaatagccacaaatcacagtctatcgaatgttggcaaaactggaactatcaaaaactacaaatcgcataacagagaggcccaaacaaagatcttaatagtctacatgaccttgaaaatctcttctcacacctatgctagattctga

SEQ ID NO: 115562 - DNA, 177 bp, Glycine max
  Peptide Sequence Number=SeqID_232340
atgggggacaggtctatgatcctcgacctacaaccaatggaagtaggaattgtttcctttggaggcatcagaaaaggaaagatcattggtatagaccgttacaactattgcatatggatctgttttgaccaactaggacatttaatctgggaggaaagaaatatggctttgtcatag

SEQ ID NO: 115563 - DNA, 228 bp, Glycine max
  Peptide Sequence Number=SeqID_232341
atggcggcgcagctaatccatgatcgagtagagatggagtgcctagagggaacctgggagaccctcgaaggcaacacgaggtgccgattttggggcaccattcgattcacggctacttctttggtgcatccagatgaacctgcacggacgcttcagcgcacggaatttgatgattgtatacatgtggctgaagccacaactatggacacctttgctctggatgacact

SEQ ID NO: 115564 - DNA, 778 bp, Glycine max
  Peptide Sequence Number=SeqID_232342
atggtccgttcgatgtcgcgctggctgccgctgctggcccttctgatgatgagcggttgcacttcgctgccggacagcgcgcgtggtcgcttcgaagcacgtgcggtgaaggtggagggggagaccgcctactatcaggtgttcattccggccggcgtgcaggccgccgctcccacccacctcccggtcatcctgttcctgcacggctccggcgagcgcggtgccgatggcgtcaagcagacctacgccgggctggggccttacctgcgcgagcatcccgacttccccgccctggtggtgttcccacaggtaccgggccatgaggagtggagcggccgcaacaaccgtgcggcagtggccgcactggacgcgacgatcgccgaattcggcgctgacccggcacggcagtacctgaccggcatgtcgatgggcggctacggcagctggaacatcgcgttggacgacccgcgccgctttgccgcgatcgtccccgtgtgcggcgcggtacttgcaccacgcgcgaagcgcccaaccctgttcgtcgagcaggtcgcccaggaaaccgatccgtatgccgtgatcgcgcagcgcctgcggcacacgccgatctggatcttccacggcgcgctggacgacgtggtgccgccggacgacgaccgcagctgcacgccgccttccatggcgccagcgcacgcgacgtacgctataccgagtaccccgaccgcaaccacaacgcctgggatgccacctatgcggacccggcaatgtgggcgtggct

SEQ ID NO: 115565 - DNA, 246 bp, Glycine max
  Peptide Sequence Number=SeqID_232343
atgaatgaaaccaccaacctgacaaaaagcgcgaaccctcaatcacgagaatgcaggggagggaagaacaaaccgcaaacagttaaaaaaccctacaagcaagttactacttatggtcacgtaataaccaaggaaccaaaacttaacaccgagctagcaacaaaacggtgcacatcatgttacaaccacctaaaagatggtgttgtcatgcattgggggtgcaataataagaaatttgctgcttaa

SEQ ID NO: 115566 - DNA, 180 bp, Glycine max
  Peptide Sequence Number=SeqID_232344
atgaattctcgtggttcatggggattctctggagctaatgaagggaacccacagatcagtgccaagtttgttgcaccatgttatatggtgaacaagattaagattgataccaaactccctgtagttggtgaccaatctgcttatttctatggtctttcactgatttatctattcaagtaa

SEQ ID NO: 115567 - DNA, 336 bp, Glycine max
  Peptide Sequence Number=SeqID_232345
atgcgtgccgccattgtcaatggcgagaagcttggtgacgtgaagggtgccgccattgtccatggcgagaagcatgctgacctggctgagagaagggtgggccgccattgtgtcctgccattgcatcttgtgagagccattaatgccgccattgcttcctgcgagacaggtcactggctagggcactgtttcataactttgcatgctagttgggtcacatgcattgcagctgtgcaaggttcacatggatacaatgtgcctgttaaatggccagaagactttggagaaaattggcttcacgggcatgctttaatggcttgtgtagttttcatttaa

SEQ ID NO: 115568 - DNA, 834 bp, Glycine max
  Peptide Sequence Number=SeqID_232346
atggcaccattgtcggctagtgacttcatcgttgacgaacatttgttttggggtttcgacgacgacgaatgtaatggcatcgtcgccgtcgcatttgtcgtggtggtcatcgtccatctgacctttgttgtcaaacctctttttttgatgtttgatgaaatcagtcttattttgcaccacaatggtaaattcatacaaaatgaaaatgaggcattagagtatgtcggtggtgaattttgtatctgggaagaagttgaaacatatttggttaatgtgtggacaccccaagaattgtgcaaagcttgctgcaactatgagaagtttatttcagtatgttatctggtgtctggtattggtttacaaagactgacgaatgatcatgatgtgttgtctatgtgtcaaactgggcttactgatccaaaaaaagaagcgcatgtatacttagaaaatgttgatccagagggggtcctgttaatgaaattggaaaatgtggctgaggttgttgctgaaaagtgtactcataatggtattgaagatatggatgttgatggtgctaaaggtggttcagatgatgaaaatgaagtagttggaactggtgtaccagatgcagaaactgaagttgttgaaacaaaacctgaagttgctagagttgaaattgaagttaacaatggtgcagataatgatgaagttaaaatcatgtatcctcaatacaatcctacaagtagttttggagaagtgcatttagaggttgggatggagtttgataccatcaaaatgtttattgaagttgtgagggactatactattttcagatctgaaatgggtaaaaattaa

SEQ ID NO: 115569 - DNA, 252 bp, Glycine max
  Peptide Sequence Number=SeqID_232347
atggcggtactatcttcacgtgagcttctcgccagtgggagcaacgagacagcttccacgtcagctgtctcgccattgacaatggcggcaccctccacgtcaccaagtttctcgccattgacaatggcggctagcgtttctcgccactactgctggcgacatccatgcgcgactactttcgtaagatgcgaggttcagggcagcatgtggttctacctgcacaatagcacattatattgtcatatgtcttaa

SEQ ID NO: 115570 - DNA, 1266 bp, Glycine max
  Peptide Sequence Number=SeqID_232348
atggcgatttacgggctggtgccgtctctcgtcgtcgtcgctgtccgcatccggcaccggccgatcctcgacaagcttctgtggaacacgatcagcatcctggtctgccttgccataaccggcatcatcagcttcgccaactccaagaccttcaccaccgccattcgccagcacaaggatatcgtcaagagcgtcaatccgttgtcaccgatcatgtcgacggtgcattatttcacgcaggccggcaaggaagtcgatattcaggtcagcccaatcggcaaggacgccaaagtcctgcccgcattgggtaacgtgcataagccacgcattaccgtcatcgttgcgggcgaaactgcccgcgcggcgaatttttcgctgaatggctacgggcgggaaaccaatccggagctcaagaagcgcgatgtggtctatttccccagcacaacgagctgtggcaccgcgacggcgatttccattccctgcatgttctcgcaattcacacgctcgcaatatagccacaagaaggcgcttgcgaatgaaaatgtcatggatgtcctcgtccatgcaggggtcagcgcgacctggctggacaataataccggtagcaaggacgtcgccgaccgtatcccctatttcgacctgccttccaccaatgacagccgcttctgcaccggcggggaatgccgcgacgacatctttttcgacaagctcgacgcctggctcgataacgtcaagaaggatagtgtcatcgtgctgcaccagatgggcagccatggtccgacctactacctgcgttacaccgacgagttccgcaagttcacgccagactgccgcaccgccgagcttggcaattgcagcgacgccgaaatcgtcaactcctacgacaacacgcttctttataccgaccacttcctctctaccgtgatcgacaagctgaaggcgcgttccgacaagctggcaacaggcatgatctacgcctcggaccacggcgagtcgcttggcgaaaacggcgtctacctgcatggcgcgccctatctcctcgcgcccgaccagcagacccatgtgccgtttctcgtgtggttcgatgacgattttgccaaatccatgggactggacaaggcctgccttgcgaaaagcgcggcagagggcgggcgctcgcacgacaattatttccacagcatccttggaatgatgaacgtctccacctcggtctacgatccctcgctcgatgtcttcagcggctgtacccaacgccggacgagctga

SEQ ID NO: 115571 - DNA, 414 bp, Glycine max
  Peptide Sequence Number=SeqID_232349
atggttgaaaccaagaataagaggataaagagcattgggcatagactaactgccaccaaaacaaaatctaagaaggagaaggagtctgcaaatggtggctcttcaaacaatgggtttatccttcttgaacttcttgagtgccataggttgaagaagttagtagagatgaaggacacattctacctagagttggtttgggaagacattgttggtttgtctttaaaatggatgatggtcaatgataaaggtctccaagatgctagtgtgaaattcaacaaggtcaccaaatacaatgccttgatgaaggattcctctacattcattgttattgtttccaaaggcaagggaaaggaaatatttggcataagccccttgttactggaacatagacttttggtttatgtgattgcctga

SEQ ID NO: 115572 - DNA, 246 bp, Glycine max
  Peptide Sequence Number=SeqID_232350
atggaacggaggactcacccttacaagcaacaaattttaagtactgatgatgctgagtacaccgagagtaccgtaacacggactacacatcatcacacttaccatactcaagtccacgttacagaggaccgaggtgaccatttggacaagtcgttcgaggagatggaggagtaccaagaactactgagacagttggaactgatgtctgaggaagagaatgatgattcttccaaggacgcgtcttag

SEQ ID NO: 115573 - DNA, 777 bp, Glycine max
  Peptide Sequence Number=SeqID_232351
atggtttttaggctgaatgatttggagaactacaatctttatagacgcaattatggtattgctaggaaaatggacatcctgaggcatttgcatctggcactagacaatttctcttgtgcaaataaaccacataaagggagagctatcaagtcatgcacaacagaagagctagacaataagaagttgaattatatgatgctacatgggactagaaacttgattgaggaaaagaagctattaagaaataaaaatatgtgccacaagacagatgatgcttcaagttcacgtcttctagagctcatgaagaatgtacagatgaaatatagttcttacaatcatcactgtaaacaaaaaaattgtgataaactccataaagaaatcaaacgttttgaagtgacaaggaaaaagtcagcacaattaaagcaaggcatcagaaatcatgtgaagattatgagtgatgagttgatggagatgaggaagaaaaagcatgcacttgagaccaaaattaagcatgttaatagagaaatagaggtcataaatgaagaaattataaggtcctttcagaagcacttgaaaggtagattttgcagaaatgatgcatatctttttatgcttcaggagatgaaaaataaaggatactgggtcctcaattctattgacttgggatatgatcaggcctttggctttcgtgacatctattcgaagaagtttttatgttataatataagcactttgaatgacgatgacctgtcttgtaataaagacttctccaaatag

SEQ ID NO: 115574 - DNA, 1105 bp, Glycine max
  Peptide Sequence Number=SeqID_232352
ggctacacgccctcgcctttagaggacccacacggcctcacctttagagggctacgcgccttcaccttcagagaactacacgccctcgccctcagaggtctgcacgccctcgccttcagaggactacatgtcctcaccttcaaaggactacacgtcttcgccttcagagggctgcacgtcgtcgccttcagaggactacacatcctcgtcttcagaggactacacgtccttgcctttagagggctacacgccctcgccttcagaggactacacgtcctctcctttagagggctacacgccttaacctttagaggactacacgtcctcgccttcagagtgctgcacgccctcgcattcagaggactacacgttctccccttcaaaggactacatgtcctcgccttcggagggctgcacgccctcgccttcagaggaatacacgtcctcgccttcagagggctacacgccgtcgcctttagaggaccacacgtcctcaccttcagagggctacatgccctcaccttcagaggactacacgtcctcgccctcagaggggctgcacgtcgtcgcattcagaggactacacgtcgtcgccttcagagggctgcacgccctcaccttcagaggactgcacgtcctcactttcagaggactcctcgtcctttccctcagaggactacacgtcctcgccttcgagggctacacgtcgtcaccttccaaggactacacgtcctcgtcttcagaggactgcacgtcctcgccttccgtggactacacgtcctcatcttcagaggtctacacgccctcagcttcagaggactacacatcctcttctttacagggctacacgtcctcgccttcataggactacatgacctcgccttccgagggctactgtccctggccttcagaggagtacacgtcctcggcttcaaaggactactcgacctcgccttcaaagggctacatgtcctcgccttcagatggctgcactccctcgccttcatagggctacatgccctctccttagaaggactacacctcctcgccttcagagggctactcgtcatcgccgtcatagggctacccactcgtcaccatcaaa

SEQ ID NO: 115575 - DNA, 189 bp, Glycine max
  Peptide Sequence Number=SeqID_232353
atggtgacagtatgtaaaagcaataaagaaggaaacatcttgctcttttgggagtgccctcttaaccatactacgttgtgcatgggtggaaatgagccgagtagcttgtcgaaggcctttggctcggcctatgtaaggctcggctcggctcggcttgtttactataaaggccaagctcaagctttttaa

SEQ ID NO: 115576 - DNA, 138 bp, Glycine max
  Peptide Sequence Number=SeqID_232354
atggtggacgtggatgtagttaaagaacaagtttcacaaaatcttgaacctaccaagtgtgatggttgggattggtacgagtgggatcatttgtcacaccctctgtttgggcctcttgagaaaatgattcttggataa

SEQ ID NO: 115577 - DNA, 795 bp, Glycine max
  Peptide Sequence Number=SeqID_232355
atggaatcaaaggacaatgttgaagataacgatcaatttcagatatctgagaagatgataagagaagaagcgcactattatctttatagacacaatgatagtactgtgaggcaaaaggatatactgaatcatttgcgtcaggcactagacaatatctcttttgcaaataaaccacataaggggagagctatcaggtcatgtacaacagaagaagagcttgattgcaagaagttgaattatatgatgctacatggaagaagaaacttggctgaggaaaagcagctatttagaaataaaaatatgtgccacaagacagatgatgcttcaagttcatctcttcaagagatcatgaaaaatgtacagatgaaatatagttactacaatcgtctctataaacagaacaattgtcataaactccttaaagaaatcaaacattttgaagtgacaaggaaaaagtcggcacaattaaaacaaagcatcagaaatcaagagaagattatgaatgatgagttaatcgagatggggaagaaaaggcatgcacttgagaccaaaatcaaacatgttgatagagaaatagatctcatatatgaagaattgaagccctttcacaaggactataaagaggcaaattgccaaaaggatgcatctctttttatgcttcagatgaaaagaagagaatacagggtcctcaaatgtagcaacttggaatatgatttcattcgctttcatgatatctatttggagaagcctttatcacaagagaggtcagtgtatcttcatttctttatggtttaa

SEQ ID NO: 115578 - DNA, 153 bp, Glycine max
  Peptide Sequence Number=SeqID_232356
atgtctaaaaaagttgatatgaatgaagaggaacctagtgtgaatgaagaaaatggagaggaacttgatgtgcatcaacatgttgattgttattatgctttcaatatttctcaggtgtttgctacacgtgatgatgttttacattgggcttga

SEQ ID NO: 115579 - DNA, 624 bp, Glycine max
  Peptide Sequence Number=SeqID_232357
atggcaagagtagcaaaagtggtcaaaatctcagcacaagagttagaccgagtgaagcaaaacaagaatggggtggtagggataccaaggaagcgcttggaggagaaggcagaagctttggaaaatcaaggagagtggacctcgttcattaacatattagcattgttggtgtttgggaccatactctttccaaatgtagacgagctagtggatttagcagtgatagacgcttttcttgcttatcatcatagtaaggaaagtctggtcattgttgttttggccaatgcatatgatacattcgacctgagatgcgaaaagagtgattcaagaattgtctgttgtacgcctgctctttttgtgtggttggtctcccacgtttttcgtcatgaaggtagacctatcggccctctacaaggctatcctatgagaggtgcaccgtcagaggagatcatcgcacctttcatcgcatggggtttcaatgaaggcaatgccaaaatacttcaaagaatccgtaaggtgtgggacatggtggaaaggaaagataaggagcttagggggagcaacaacgatgtcatcagcggctatcataagtggttgagggctaggatgcaagggatgacttag

SEQ ID NO: 115580 - DNA, 429 bp, Glycine max
  Peptide Sequence Number=SeqID_232358
atggcgccgttctttctggcgcaggcggcgctgccgtggatgcgccgccggggcggcggctgccttctggtgacttcgtcggtgaccggcccgcgggtggcctacccggggctggcgcactacgctgcctccaaggccggggtgaacgggtttattcgcgcggcggcgctggagctggcggcggagaaaattcgcgtcaacggcgtggagccggggatgatccgcacgccggcgatggccaacctgggcgacgcgcaggtgaatcaggcgatcgccgcctcggtgccgctcgggcggctgggggaaccggaagacatcgccgcggcgatggtgtttctcgcctcgccggcggcggcctacatcaccggccagacgctggtggtggacggcggcgcgctgttgccggaaacaaattctctgcttacttga

SEQ ID NO: 115581 - DNA, 405 bp, Glycine max
  Peptide Sequence Number=SeqID_232359
atggggttcttccgcccgatcctgaaaagccacaatttgaccgaacagcagtggcgcatcatccgcgtgctggccaacagccgctcgatcgaattccacgagctggcggcggaaacctgcatcctgcgccccagcctgaccggcattctctcgcgcatggagcgtgacaagctgatcttccgcctcaagccggtcaacgatcagcgcaagctgtacgtgtcgctgacccagcagggccaggatctgtatgaagtggcgcgccaccaggtggaacagggctacgccgagattgaagccgccttttcgcggcagaaaatggaccagttgatgacgctgctggacgagctgatcaccctgggcgacagcctgcccgccaacgtcaccgcgcatcccactaagaagtga

SEQ ID NO: 115582 - DNA, 1164 bp, Glycine max
  Peptide Sequence Number=SeqID_232360
atgggaacccttgtttctttgaagccagggaagtcaacgcaggctctcctcgtaatctttttcactgataatgtggttaaccagacggccgatgccctcgatctccaccaccacttcgtcgcccggctgcacgtcggccagccctttcggcgtgccggtggcgatcatgtcgcccggctgcagcgtcatgaattcactcaggtaggcgaccaggaacggaatgtcgaaaatcatgtcggcggtgctgccgcgctggcgcagctcgccgttgacgtaggtgctgagcgccagccggtgcggatcggcgacgtcgtcgcgatcgacgatgtacggcccgatcggcgtcagggtgtcgcggctcttcacccgcagattcggccggtagtagttctccaggtaatcgcggatggcgtagtcgttgcacagggtgtaacccgccacgtactccatggcgtgctcgcggctgacgttgcgcgcggtcttgccgatcaccgccaccagctcggcttcgtaatgcatgtactccacgccggctgggcgcaccgacacctggcggtgcccggtcagggtgttcggcgccttgaggaacaccagcggttcctccggcgccttgaattccagctcgctggcgtggtcggcatagttcagcccgagggcgaacaccgtgccctgcgccggcggcagccattccacttcgcgctcctgcagcacctcgccgttcggcagcgtgacgcgcagctggtcgtccacctggacgttgacggcctggccatgatggcgaatacgggcatgtttcatgatgcggctcctgcttgggtgacgcggttggtcagcgtgggcaggccggcggcgcgcaccgtcacctcatcccccggtttgatctccacccgctggtgcggggtgccgatcagtaccgcatcgtccggctgcatggtgatgaaatcgctgatggcggcgatcagttccggcaccgagcgcaccagatcggcggtggaccagcgatcctgctccacgccgttgatctcggtgacgatctccagccgatcggcagcctccagctggccgatctcccccagcgggcagaacccgtcgcggcatttggccttgatcgccgggcgagagaagctgctttccggtaggctgacgtcgttggccgacgcgtag

SEQ ID NO: 115583 - DNA, 324 bp, Glycine max
  Peptide Sequence Number=SeqID_232361
atggtccatgacatctttgtcaaggtgaaactggaagtaacaaggacatcaacaatcctaaatgtgtttggcagtagacgaagcagtgatgtttatgatcccaacatggttggctcatggtaccgaacacatgcaactaagaatgaaaggaaaacgcaaggatcatgcatgagtaaacatgaaaataaaagcccaccaaacctgtctcagaaaaacgacgatctcagactcattcactgttggatcgtcgtgaaatttgagcaccacgttcgcaactcaattctgagcattttcaccgttgggaattttgatatcatgtcttaa

SEQ ID NO: 115584 - DNA, 177 bp, Glycine max
  Peptide Sequence Number=SeqID_232362
atgcatttcggctattttgggcaaaaaacacgttttcgtgaagaaataatcgagtcgaagtgctttcgtaacgcctccgtaagcgattctgtggaaattcttcatcgttcttcgtcgttcttcaccgttcttcgttctttaacggttttattttcttccgtttttaacgtgctttag

SEQ ID NO: 115585 - DNA, 160 bp, Glycine max
  Peptide Sequence Number=SeqID_232363
gggcaggatcgttttaggaaatagtcaaataccgagccaaatccaaagacagagacgaatcgagggttacctcgcctgggcgagcaccccctgcacgaaatggtttaaaaagagagggggagtgcagttttcacccaaggaacttctccccctcacttaa

SEQ ID NO: 115586 - DNA, 255 bp, Glycine max
  Peptide Sequence Number=SeqID_232364
atggttacttccatgcttcaacttgactcgatgaaccttttcgtaaaagcacgagcttggttcaaccccataacccagggaatggcaattttgattgccaatacttcatcaacatttcatagggatgaaagactcgggaatatgcatgctatgcatgggaaatgtaattatgagattgagatgtccaaagaacatcctttcttagttaaccatgcattagaggaaaacgcaagggtcacgcatgagcaaacatga

SEQ ID NO: 115587 - DNA, 597 bp, Glycine max
  Peptide Sequence Number=SeqID_232365
atgtcagatccctatttcatcaaattgcaccttagtaaatctgctgcgaaggacgatttggaacaccttcaactgatgaaaaatgtctgcctcggatccatccctgaaatccacatggaatcgtgtgatgtaagttcgatattccattccctacaaatggaaacgttcttgttcaattttgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagtgtatctgagtggaacccttaattgggttgttattaaaggaaaaagaaaatcattcattctgaaatcgtaa

SEQ ID NO: 115588 - DNA, 825 bp, Glycine max
  Peptide Sequence Number=SeqID_232366
atggaggccattgcctccctcgcccagtattatgaccagcccttgaggtgcttcacctttggggatttccagtttgcgcccatagtagaagagtttgaagggatcctgggatgcccactgggaggaaggaaaccatatcttttctcggggttctatccctccttggaccaagggaagcaaatcgagaatggagtggttggagtaccaaggaagtgtttggaagagaaggcaagagccttggcaagtcaagacgaatgggctcctttcattgatgtcctggcactcttgatctttggagttgtcctctttccaaacgtggatggattagtggacctagcagtgattgacgctttcctcgcctttcacaacagtagagaaagcccggtcgtcattatcttagccgacctgtatgatacattcgatcgtagatgtgagaagagcagcataaggattgtttgctgcacatcggccctctatgtgtggttggtctcacaccttttccaccaagaaaagagacacgtttgcccgctagaaggtcatcgctcgtgcgtcgagaaaagagaggcaaattgggaccgcctcatagcaagcaaagaaggagcgtctgtcaattggttccctcaatggaaggaaggaagaaccgggattcttttcacatgtggaggatttccaaacattcccttgatggggacgaggggttgcattaattataatcccatcctcaccataagacaacttggctacctcatgaggggagcactgtcagaggaaggccttgttggatcaagtggcctcagaataattaagaagggggcactgaattaa

SEQ ID NO: 115589 - DNA, 252 bp, Glycine max
  Peptide Sequence Number=SeqID_232367
atgcttaaatcatctcctaacatgcatgtgaagcaagaagtatcaacaagagtcaagccaaggctattgtgcaagcaatcaatggggcaaaacacaccgaataaaatagatgatgatggctcaaattctcaccaaggagaaaaacaaggatttcaattcacaaaatgccaagaaactcctatttcaaaaacaattacccattacatgtacataacctataattcaaagagacacatgcaatgttgtacataa

SEQ ID NO: 115590 - DNA, 318 bp, Glycine max
  Peptide Sequence Number=SeqID_232368
atgggtgccaagtacctcgaagtggtcaagcgagggtcgtatcccaacagcggatggtccccgaacgaaattagggcgagaaaagcgtcgattgctgctaggtccaccaacccatccacatttggaaagaggactcctccgaagatcaacagcgcgagaatgtctatgaacggggcccattcgcctttacttgccaagattcttgctttttcctccaaatattttctcggtattccaaccaccccattttcgacttgctttttgtggtctaattcctgcgccgagatttggactatcttagaaattctagctaattag

SEQ ID NO: 115591 - DNA, 1224 bp, Glycine max
  Peptide Sequence Number=SeqID_232369
ggagagtccacgcctgttgtgggcactgccactgaagtgatacgcctgaccaccagcccgccaacgtgtagaaggagcatgaaggctaccgtgcgattgtggagcgaacatggagaaatcgtccgaaaaaggtcacagcacgcgtgcggttcaggcaacgccgacccagcctttcactacgctttcaatgcgttcccagcacggaacactggacgactttcacggcgtattgcacattgcggcaattccttgcttcgatgctgcccgaccgtgaaacaccctcgccgctggctgctgattggctcgatcacgacagcgactgtcggtgtgatcgtgctcgtcctgaccaccccactggtctcgaacgccctgctgctactgatggagcgcagcaacttcattcccgccgaatcctcgatcctcaccttcgagccgtatgcgatcaacgacggctcgtcgaactactggttgtttgggaaggaccgcacctactactaccacttcacctacgaggatgacgttccctacgtctacatcccgcaggacaaccgctgccccggtttcgaccggcagaatgcccggacctggtgcagcgccctgcccggcaaggcacgctggcgtggtggtggtgcaaccggttgcgctctaccaactgagctattcccgcagatttcgttcgacctgcgtcgaaggagcgctattgtgtcgatattgctgcacggcgtcaacaggaattttcacgtgacgtcagcggcggcgttcaggcgccgctgcctgctcccttcacgtgcgcaggccgcggcgatggaagtagatctgctcggcgatgcgccgcgtggcggccgtgtgcagcaacgcattgagcggccaatcggcctgcaggtgatccatcgcccagcgcagcaggcgcttgccgcggaaggccggggcgacctgctgtgctacccgttcggcgtccggcccttggccacgcagatggcgggcaatcgcctcgccgaccgcccagccgtgccgccacgaagaatggatgccgccggccgacagcggcgagacgatgcccgccgcgtcaccggtcaggatcaggcgagggccgctgatcgggccgtccggccggccgcacggcaccagaccggcacgggtggccgaagggcgcgccgagggcggaatgccgaccatatcgcgcacatgctcaaggaagccatcgatatctggcggccgcacccg

SEQ ID NO: 115592 - DNA, 634 bp, Glycine max
  Peptide Sequence Number=SeqID_232370
cgccctcgccttccgaggactacacgtgctcacttcagaggactactcatcctcgcttcagaggactacacgccgtcaacttcagaggactacacgtcctcaccttcaaagggctacacaccctaaccttcagaggactacacgtcctcgccttcagagggctacacgtcctcgccttcagagggctacacgtcctctccttcagagggctacacgtcctcgccttaagagggctacacgcccttaccttcagaggagtacacgtcctcgccttcgaggacaccacgccctcgctttcgtagggctacacgcccttcccttcagaggcctacacaccctcgcctttagaggtgtacacgtcctcgccttcagggctacacgtcctcaccttcagggggtcacatgccctccccttaagaggacaacacgtcctcaccttcagaggactacacatcctcaccttaaaaggagtacacgtccttgcctccagaggactacacgtcctcacctccagaggactacacgtcctcacattcagaggactatacgtccgcacctccagaggactacacgccctcaccttcagaggactacacgtcctcacctccagaggactacacgccctcacctttag

SEQ ID NO: 115593 - DNA, 305 bp, Glycine max
  Peptide Sequence Number=SeqID_232371
atggctctaacaaaagaatctccctccaacatcacctactgctacccatctgctcccactaacaaaggaaatagctgtgtccacgtggcactctcacttaggaaaactaggcagcaagtgtcgagcaacggtggctcgtggcagccaccgatggtgttgggtgataaaggaggagcgaaacttcacttttggcgttgggcgggacatttcgcgctaagcaaattacctcctcatgttggaattatgcttagtgcgcttgtctcgctaagtgaatatccttcttgggttggaattgcgcttaacaa

SEQ ID NO: 115594 - DNA, 135 bp, Glycine max
  Peptide Sequence Number=SeqID_232372
atggtgattgagggtggacagaaggtagtagaggtagacttggtgttggcacagatggtaaaggctaagcgggtggatattcaacatctccaaggacataggattgagtttgttgaagttcaagtagacgcctga

SEQ ID NO: 115595 - DNA, 213 bp, Glycine max
  Peptide Sequence Number=SeqID_232373
atgagtgtgtcagaaatatattttgctgttgatttgttcaagaggagaatgaatgaactaggaagagagagagataaaggtagtggtagaggccatgagcatgagagaaagcttattgagagagttgagagaatgtgccagtctagtgggtgttggaagttgaagaggacaagtgcatgggaaaggcattgggctggggatgttgttaaatag

SEQ ID NO: 115596 - DNA, 222 bp, Glycine max
  Peptide Sequence Number=SeqID_232374
atggaaattgaagctcgtgttggtaaactttatctaatatctaatacagctttatgtggaagtcggggccggtatggagtagaccctacattttcgtcgttaagatgtgagttgggtttgaggatatattcatcaggatttcaaagtcttcgaaactcaaaaaatatattcacaaaaatagcaatcttttctgcaaaaaccagtaatgcattgatacagtaa

SEQ ID NO: 115597 - DNA, 372 bp, Glycine max
  Peptide Sequence Number=SeqID_232375
agtttcttcaccaagataattattttcgaggacggcgttgcggaggccgaggaggtcttggagggtggagcaagcggggggtctaggagccgatgtcgtcagtggcgaccttctagtaggcaaggacccaaaggtcaaagcaacggaggaaggtggagagtgccaagttttgaccactttcatcattggcacattatcaatacaagaaggagagggaaaaagaaaaagtgtacaatattacaaggagacacacataaaggagagagaagtgacttgaaagtgaaggtgaaaacaagtgaagtgggtgacagtgatcacacatggagtagtaaggactacactgatccactcccgctccttcccttgtcatga

SEQ ID NO: 115598 - DNA, 300 bp, Glycine max
  Peptide Sequence Number=SeqID_232376
atgactttcaataatggcgatgcagctgctgcctccctcaacaaggtccccacggtcaacttcaccaagctcttcattgacggacacttcgttcactctgtgtcaggaaagacatttgagacaatagatccaagaacaggagatgttatagcgaggatcagcgagggagataaagaagacattgacattgctgttaaagcagcacgtcatgcatttgacaatggtccatggcctcgccttcccggttctgtacgttattttttcccttctctttttttatactatgcacaaggagattaa

SEQ ID NO: 115599 - DNA, 144 bp, Glycine max
  Peptide Sequence Number=SeqID_232377
atgggatcggagagtgagagagaaggtcaaagaaattgggcgggtgaagaaatggaagctaccatggttgcaagcaatgcaagggaaatctgctacgttgcagcagcgtcaaggatggaattaaccaactatattgataaatga

SEQ ID NO: 115600 - DNA, 378 bp, Glycine max
  Peptide Sequence Number=SeqID_232378
atgaattctggtggatatactatagaagttacgtgtctatctccaaaagctactgagaagcatcagtatgattttttgctttctgtggtgcaattgagtatgttgaaattgccaggtttctgctactgcaacggaaggttgctgaatgaagccagagaattggcctcaccaataagatatccgtgggagttgaagccattagatacgtggatcaaaagtatcacgtcttctgcatcattgacaggaagatcagtagcagcagctgccaacactatggtgaatagtagctatttttcaaagggtgccatgtgggtgtcaggtgctctaaatcaggtggccaaggttgctgctgatttgggcagtggggctaagcagtga

SEQ ID NO: 115601 - DNA, 4347 bp, Glycine max
  Peptide Sequence Number=SeqID_232379
atggccgaacacggaactcgccgtaccaccaccgacaggctcgaggacgccatttccatcctctctgagaagcactccgacctagctagcaaggtcgacgccatgtacgagcaactctcccagatacactccgcgtcacacccttcgccccagcactccggtcatcctcgacctccagtcaagctcgaagttccacgcttcgatggccacgacccgttgggatggatttttaaaatctctcaattttttgaataccaaggaacgtcggaggaggattgcatcacggttgcttccttctacctcgatggagcagctctcagctggttccagtggatgtacaggaatggcttcatcacttcctggtctgcccttcttcaagctattgagaatcgttttgccccatcattttatgatgatcctcgtggaacattattcaagttaatgcagcgcggatcagtcacggaatacctcacggagttcgaaagattagccaaccgcatcgtcggcctttctccctccgttttgctgagttgtttcatttcgggtcttagccccgaaatccgccacgaagttcaagctttgcaacccgcttcacttcctcacgctactgctctggcacgtctccaagaggataagataactgaccgccggagatcctctcgaccttcattctcttccccacacacaccaactccaaccccatcctctcagccatccacctctacacctcgccctaaaacaccttttatccaacgaactcaagaagagatgacgtatcggcgtgagaaggggctttgttacaactgtgatgagaaatggaactcatcacaccattgtaagggtcgcgttctcttcttcattacggcctccgacgacccttccttttccgatactacctcaccagaaatcacaacacattcacctaacgagccttcccctacctttgaccccacatctcttcatcctcacatcagtttacatgccatggccgacgtcccggcaacggaaaccttccgcctttatggtctggtcaaccatgcgcgtgttacaatcctggtggatagtgggagtacccacaactttatccaacctagggttgccaagtttttaaacttaccattggaagccacaactccccttcgcgtgatggtgggcaacgattccgttttggactgctggcaactttgcccagccactaagctgctcatccaagatcactccttcaccataacactccgcgtcctaccattaagcggagctgacattgtgttaggtgttgagtggttgcgtaccttgggcccgatagttacggattattccgcattcaccatgcacttcaaccatcaagggcagcctatcaccctccacgccgacgttcagtccgatactgacccggtctcggctaaccaggtgagacatatgttacatactcagtcaacctctgcacttttccacttatccttactacccgttaactccattgaagcacctccagacccacctcatcccatttctgcaattaatgccctcttactccgtttcaattccttattccaacaatcttctacccttccccctcctcgtaaccacgaccaccatattaaccttctcccatcagctagccccgttaatgtccgcccgtatagatatccgcattttcagaaaaccgaaattgaaaaacaagtcacagccctgctcgaatcaggattcatccaaccaagccgcagtccatactcttcccccgtcctactggttaagaagaaggacggcacatggtggatgtgtgtcgattacatggcgcttaactcaattacagtgcgggatcgcttcccacttccgactatagacgagctcctcgacgaacttggccgcgcttcctggttctccaaaatagatttacgtcaagggttccaccaaatattaatggccccaaaagacgtttctaaaattgcttttagaaatcaccatggacactttgagtatagggttatgcctttcggcctctgcaacgcgccatcgacgttccaggccgcaatgaacgccgtgcttggtcctcacctacggaagtttgcaacggtgttctttgatgacattctcatctacaacgagactctcccagatcatgttcatcacctagagcgagttttcacttcattaactcaggcccaatactatcttaagcgttccaagtgtctcttcggccagcgcaagctagactatttgggccatgtcgtctccgagaagggcgttcaacctgacccttctaagatacaagctatcctcgattggcctgcacctcgatcagccaaagaacttcgagccttcctcgggctcacagggttctaccggaaattcgttaaaggttacgccgcgattgcaacgcccttaactcgtctactttgcagagacgctttccagtgggtaccagaatcacaagaagcctttctcgcgttgaaacgtgctatgacggcagccccagtcctcgccctcccgaatttttccttacctttcgccctggaaacagatgcttccggcacgaccatgggtgcagtccttcagcaacaacgccatcctatcgcgttttttagcaaacccttctgccctcgcatgcaacacgcttccacgtacgtatgcgaactgcacgcgatcacggctgccgtccgaaaatggcgtcagtacttacttggccataagttcactaacttcaccgaccaccgtagcctccatgaccttatgtctcaggtcattcaaactctagaacaacagttttatttggcaaagcttctcgggtttgattacgacatacaatataaagttggctcctccaatattgtcgtagactctctctcacgcattgatcacaccggacaagcgcagtgccttctcctctctgtcccccaccacgagttcctcactcaactaaaacaggcccttttcgctagtcctgattttcagacacagaagaaagctattcaggctcacccaaaggatcacccccacttcaccatcgccaacaagctcattttcttcaagaatgccatctggattgactctcgcaatccattcattcctgcattattacatgagtaccacgcaacccctctcggaggtcactttggtgtcaagaagaccctccaccgtcttcgttctaatttccagtggaccaccatgattgctgacgttaagtccttcatccgcgaatgtcgtgtctgccaacaagtcaagcacgtgactcgcaagtcagctgggctccttcaaccaatctcaccccccactggtatctgggaagacctttcgatggatttcatcacccatctcccaagctctcatagcttcacagtcattttggtggtcgtcgataggttctcgaaaggcccccatcttggtgctttgccaactcagttcacggcttttaaagtagctacacttttcctggatatcgtgtgtaagctccacggtttcccttccagcatcatttctgatcgcgatcccgtgtttatcaattccttttggcgcgagttgtttaagctcagtggcaccaccctccgcatgaccaccgcctaccaccctcaatcagatggccaaacggaggtgatgaatcgcagcgttgagcagtacctgaggtccttcgtccacaaacgcccaaaggaatggcataagtttcttcccttcgcggaatgggcgtacaatacctcgcaacactccggaactggggtcactccctacgaagttatctacgggaaacccccaccttccgttccgggatacgtcttgggatcctctcgaaatgaggtcgttgacaccctcctccattcacgagctgagcttcacgaatcccttcgccgcaaactcctcaaagcacaagccgagatgaagcattttgcggacaagaaacgccgcgatgttcagtacgagatcgaccacgttgcttaccgtttgcaactacctgaagggtctcgtatccaccccgtcttccactgttccttactacgccctcatcacggacctcttgacctcccaacctcttcccttccggcggatacttcctccccacaccctatacttgagccactagccatccttgactctcgaatggacttctctgtggaccccccaactcgtttcgttcttgttcaatgggttggtcttcctccggaagactccacgtgggaaaagtgggacgatgtttgccatgctcatcaccttgaggacaaggtgagtttcacagggtcggatgatgttagtagcagcaacacaactaaggaagataacaaccacgatgaaccagtaccacgaagacaaaggagttccacacgtccgaagcatctagaagattacgtgttgtaa

SEQ ID NO: 115602 - DNA, 1512 bp, Glycine max
  Peptide Sequence Number=SeqID_232380
atgtacttcaaggtttggcagaagacggccgttcattctggcaggatctcttatgatatgtctggctgtgatacacatgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctatattttgctcgtggatggcagttgggaacatcctaggatattcttcaggtgctagtggaaagtggaacaaaaatacgctggcattgtctttgggtttggctttggctttgtttatgtgttttactgttgttctttctatgtttgccgctgattattatttcaccctttctcacctatgcagatggtttcctttcttgacaactagagcttgctgtgaagcctgtggcaatcttaaagcagcatttcttgtggctgtggtgtttctgacattatgcacacttgtcaccctatattttgctgatgaggttccacttactactgcaagtcaacatcatcacttgtcagattcttctcctttactggatgaacaacaacaaaatggtgttgatttttcaaaattaaagcctttatctgttatggatgaatccaatagtaagagaactgagaatcacattgagaaagatacagagctgaagcatgggaatttcaaagctggggaagatcatgctgaaaatgtaatggatgggcctggagcggtattggtaaacttgttgacaagtttaaggcatttgccacctgccatgcattcagtcctggttgtaatggctctcacttggttgtcttggtttcccttctttctgtttgatacggattggatggggagagaagtttatcatggtgatccaaaaggggacacttctgaagtagatctttatgatcaaggagttagagaaggtgcatttggtttgctattgaattctgttgtccttggaattagctctttcttcattgaaccaatgtgtaagtggatgggtgcaaaattagtatgggcactgagcaattttatcgtctttgtttgcatggctggcactgctatcattagtcttatttcagtaagagattattctggagggatagaacacataattggagcaaatgaaggaatcaagatggcttccttggttgtgtttgttcttcttggttttcctcttgcgattacctatagtgttccctttgccgtcacagcagagttgactgctgattcaggaggtggccaaggattggctataggagttctaaatcttgcaattgttgttcctcagatgattatatcccttggttctggtccttgggatgctctctttggtggtggcaatatccctgcgtttgttttggcttccgtgtgtgctcttgccggtgctgtcattgcaactctcaaactgccagatctctctagcagttcattccagtcaacaggttttcatattggctag

SEQ ID NO: 115603 - DNA, 264 bp, Glycine max
  Peptide Sequence Number=SeqID_232381
gcaatttgtgaaattccgggacatgccggaaaacaaaagaaaatattgatgcacaaatccgtaaggttccgtgacacaccggaaatcaaatggaagcatcgttgcgcaattagcccacttgggctctccagaagattcctccagaaggctgttgcttctggaggaagcaaccctgcttgcctgggcgagctgggtggcaagcttctcccccaattttctataaatagggggagaagtgaagtgaaaaagggttcagccccttag

SEQ ID NO: 115604 - DNA, 916 bp, Glycine max
  Peptide Sequence Number=SeqID_232382
aggactatacgtcctcgcctttagaggacttcacgtcctcaccttcagaggactacacgtcctcgacttcagagggctacacgtcctcgacttcagaggactacaggtcctcaccttcagaggactatacgtactctctttcagagggccacacgtccacgcctttagaggactacacggctacacgccctttccttcagaggactacacgtcctcaccttcagaggactacacgttcccgctttcagaggactacacatcctcaacttcagaggactacacatccacgacttcagagggctcacgtcctcaccttcagagggctgcacgccctcaccttcagaggactgcgtgtccacaccttcagaggactacacacctccccatcagaggactacatgtcctcaccttgagagggctacatgtcctgtccttcagagggctacacgccctcgccttcagaggaatacacgtcctcaccttcagaggactacacgttcccactttcagaggactacacatcctcaacttcaaaagactacacattcacgacatcagagggctacacgtcctcacgttcagagggcagaacgccctcaccttcaaaggaatgcacgtcctcacccttagaggactacgcgtcctcacctttagaggactacacgttcctaatttagagggttgctcgccctcgccttcagaggactacacggcgtcgccatcagagggtcgtgtacccacaccttcagagggctacacgccctctcctttagaggactacacgtcctccccttcagaggactacacgtcctcaccatcagaggactacatgtcctcgccttcagaggactacacgtcctcgccttcagagggccacatgtcgttgccttcagaggactacatgcctcgccattag

SEQ ID NO: 115605 - DNA, 180 bp, Glycine max
  Peptide Sequence Number=SeqID_232383
atgcagaacgagaaatttatgattgaacagactcggaagtcaaactcaggagcacaactctcttgggcaaacaaatcatcggcttacactcatattccagtgaaagttaaggtggtgtttggtattggatgtgcagcaggcgggctttgtggctggtttaggggtggcatttctagatga

SEQ ID NO: 115606 - DNA, 450 bp, Glycine max
  Peptide Sequence Number=SeqID_232384
atgaggtctcgttcgttaacggaattaaccagacaaatcgctccaccaactaagaacggccatgcaccaccacccatagaatcaagaaagagctctcagtctgtcaatccttactatgtctggacctgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 115607 - DNA, 171 bp, Glycine max
  Peptide Sequence Number=SeqID_232385
atgacgcgacgtagcgaaaaagtgcaaggttttgtgtcgcggtcgagacgcaaaatcaagtggtgtcaccaactgtcgcaacctacccttcggcgggagggcgacgcaaggctcacggatgcgtcttccgagggaggaaggcgcatgaagtcgccactaacgtttatttga

SEQ ID NO: 115608 - DNA, 375 bp, Glycine max
  Peptide Sequence Number=SeqID_232386
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatcttgcacagggtaaggtttatggtgagtcaggattttggctcaaggcttgtagaatggctagacatgatacatgtcagggtttggtttggttcaaggataaaagggatgccccacattatttccatgacacaaatgcaaaaatgatgatttggaaactttatgcaaaattggtcatgcatgcacctatgcggacactcaagtgtcaaatttttatggtcatgtga

SEQ ID NO: 115609 - DNA, 476 bp, Glycine max
  Peptide Sequence Number=SeqID_232387
atgtctggagcgtacggtcaagacggcggcggttccgcgccaccgtcctatggatccagcggcggatacagttccgtcggtggttacggtgctactggtggtggtggtgccggcgggggtggcagttatggtggcggaggctatggaggaggaggaggcggtgccggatacggtggtagtgatggcggtggaggttatggaaccaaaggcagcggaaacggcggtggatatggcggtaacgatagtggaggttatggcggaagaggcggctacggtggaaacgacggcggaggctatggaggaagaggcggcggtggaggcgctggtcaaggtggccggggaggtggtggatatggtggtcgaggaggtggtggaggtggtggatttcaaggcggagatcgtggtggtcgaggtggtggtcgcggcggcggtcgtggtggaggcagagatggagactggcgttgtcctaaccaaag

SEQ ID NO: 115610 - DNA, 285 bp, Glycine max
  Peptide Sequence Number=SeqID_232388
atgcaaaaaggaagaaggaaatacctgaaggtgagtgtgttgcggtggagaaagagaaatgtgaatccgaaaggagaaaaggttgtagtaacaacgacggtgctgaaggtgatggcgctttgcccaagcaagggttgcaataataggattcacagaccgatgttgaagaataaaggagttaatgacatgggtatagatagagggagggggatggtgatggtgaagggcacaatggacgtggcagctttggcaaagaagttgtcggagaagttaagaggaagatag

SEQ ID NO: 115611 - DNA, 492 bp, Glycine max
  Peptide Sequence Number=SeqID_232389
atgccatggaagttaaaacgcaatgatttgacttctcaatataatgttggtggatatatacctcaacaagatggagcaggggatgctgcacatggagtttttgaaattgaggcgctagcggaaggaactgattcacacacaactatgatttatggcccgggtgttgctggatggggagttggtggaatagaagcagaagttgcaatgcttggccagacctgtgtggttttgaccattggaggagttattcccatgagcatggtccaaccaggtgttgttgggctcaaattattaggaaaactacgagatggtgtcacagctactgacttggtgttgattgttacacaaatgctaagaaagcatggggttgttggcaagtttgtggtgataacaaagaaaaccattttccttttaggaagcattaacggtcatgcggttacattgttggtgatatgggttgaaagttatgtgtttggtgagatgcctaaatga

SEQ ID NO: 115612 - DNA, 243 bp, Glycine max
  Peptide Sequence Number=SeqID_232390
atgtggatcgtgttgaggttctccggttcccgaaccgccatggcatggagatcatggccatatacgtgcgctactctactcgcatgggcacgtggaagaagaaaggttaggcggagggggcaaaggaggtgggtgggggacaaagagaaagaaataaagaagagaggggagaaaagggtgggtggggaaggaaagaagagaggggtggaggaggtgggtagggaagggaagaagagaaactga

SEQ ID NO: 115613 - DNA, 204 bp, Glycine max
  Peptide Sequence Number=SeqID_232391
atggataccatgaagaacataatcttggcatgccttatattgtataacatgattgttgaagatgaacgggatacctacaatgataatattgatgttgattatgaccatattgacgaagagattttaaacatcggcgtatctcgtgatgttcatcccgacattgttgcatacttgcaaacaagacattatatgcatataagatga

SEQ ID NO: 115614 - DNA, 105 bp, Glycine max
  Peptide Sequence Number=SeqID_232392
atggagctggtaatggcatgtaaggaaacaacggaggaggatgttgcggatttttgttcaaaggaggttgttggtatagtaactcagtacacatcattcatataa

SEQ ID NO: 115615 - DNA, 149 bp, Glycine max
  Peptide Sequence Number=SeqID_232393
gttgggctcctcatgttttatttcatatgatgggagagagtgattctccttcccagcgaggaagccaaactccacatgcaacaacactagatgagtttaccttgcaaatgacggaaatggaaagtggtacaagatatgtgaatgtgtga

SEQ ID NO: 115616 - DNA, 366 bp, Glycine max
  Peptide Sequence Number=SeqID_232394
atgttgtcggtgtttcataaaggcaatggtgatgttgtttgtaccgagattaaagcagttataaaggaaggatacaaaagctttccaagtgagcacacttcatggtcctttgctggccttggtttcctttcatggtacttatcaaggaaagttagagtgtttgatcgtaggggcaatattgggaaactatgcctagtcttgcttcctttacttattgctgctcttgtgggaattactcgagttgatgattactggcgtcattggactgatgtgtttgttggaggccttataggacttaccgtgtcctcaatctgctatttgctactcttttccttgcctacccttccacatggtacaaattcttga

SEQ ID NO: 115617 - DNA, 183 bp, Glycine max
  Peptide Sequence Number=SeqID_232395
atggagtatgggggtgtcgaactccaacggaccccagcgatcacgaaccccgacaacggtcacgaaccccgaggacggtcacgaaccccgacggcagtcacgaaccctagcgacgatgatggtgaggaggagacgacagtgacaggtcttcgcggtgagggagaaaaatgcttttgtttctga

SEQ ID NO: 115618 - DNA, 231 bp, Glycine max
  Peptide Sequence Number=SeqID_232396
gcttgtgtggaatcgacaagcaaggacaaaaaggaatcttcaagtgacgcgacgaggaatccgtgggggtctttggcactagcttttggccacgatcatacgtcgtatgaagtgtatgtcatggggggtgctttaattggttcatggtctttggcacttacttttggccgtgatcatagctcatacgacacaggaagtagagtaactgtggccaagtgtactttgtactag

SEQ ID NO: 115619 - DNA, 1383 bp, Glycine max
  Peptide Sequence Number=SeqID_232397
atggagatgagcatgagaagagggactcacctacaccttcaaggacctgagcttccaaaaatggaggaagagaagaaagaaaaagcaaagaactccctctctctccttggccagccagcacataacaagaggggagggatagagcttacatcacttctaaaaagtctcttggagcttacttccaatgatgctatccttgcccaaaacaagctcctacctaagaaaattgaggcttttacagatcaattcaacaaaatcctgcaacaattgcactctcttcaacttactcaaccttctaacatgcaagtgaaaggatgcactctatgtggtagtgcccataaagatgccaaaatcgtcaaagctacaaacaaggaggcaaccaaggctacaatcgaaagggaaatcaaggctaaggtgctcataaggagcatgcatgaagagggcctagctcatgatgttgttaagggtgtagttgaggatgatagtaatgatgaggaagagaaaaatagagagagagagagagagagagagagagagctgagtgtggaaaatgcagaaaaaatgatgaaaataagaaaaattgtctcaaggagggtgggtattcatgaggtcttaattccaaaaaccaagagtcatgtagtgagaaaagctaagaagggagcatgtattgagcctaccaaggatgtaccttatcctttggtcccttcaaggaaggagaaagagcactactttgcaagatttcttgatattttcaatgagttggagatcacaatccccttcggtgaagctccccagcaaatgctactatatgcaaagtttttgaaggagttgctaacgaagaaagacaagtatattaataacgagagcatcattgtggaggaaaattgttgtgcgatgcttctaaagactccttccaaagttcaatggcccaggaagtgtgaccatccctttctcaatagaggaatttcagtgggaaaaactcttattgatttaggtgcaagcatcaacctaatgaatctttctatgctcaagagaattggcaacatagagctcaagccaacctacatgactcttcaacttgcagaccagtccatcaaaagaccacatgtcatcattgaagatgttcttgtaaaggttcaggaattcacatttttggtttatttcgtcataatggacataaaagaaaatgttgaggtaaccttgatctttgaacgaccatttatgctcaccgctaaatatgttgttgacatgaagaatggtaacttagagatttcaatggcagcggaatggagaaggaagaaagatgattggagacaccagttcaaggagaagatgagtcaaacacaagctcaccaccataggaagccatggataagagcttga

SEQ ID NO: 115620 - DNA, 747 bp, Glycine max
  Peptide Sequence Number=SeqID_232398
atggcctcctttgttgaagcaaaggaatccattgatgaagaagatcctagggctacaagctccaatggagcttacatcagtggtggtgcccataaagatggtctatgcataggccaagaagaggccaacagggagcttaattatatggcgagccaaaattgtcaaagctacaaacaaggaggcaaccaaggctacaatcaaaagggaaatcaaggctattaccgacggtggaagttccatttgaagaacaattttaacaaggatcaaggaggcttatccaatcaacctcctaaccaaggccccaatctctatgataagaccaccaagcttaaggacaccttaacccaatttatgcaagtctccatctcaaatcacaaaagcatcgaatcgacaattaaaaatcttgaagtgcaagagggtattgatgaggtcttaattccaaaaaccaagagtcatgtagtgagaaaagctaagaagggagcatgtattgagcctaccaaggatgtaccttatccttttgtcccttcaaggaaggagaaggaacactactttgcaagatttcttgatattttcaatgagttggagatcacaatccccttcggtgaagccccccaacaaatgctactatatgcaaagtttttgaaggagttgctaacgaagaatgacaagtatattaataacgagagcatcattgtggagggaaattgtagtgcgatgcttctaaagactccctccaaagttcaatga

SEQ ID NO: 115621 - DNA, 1743 bp, Glycine max
  Peptide Sequence Number=SeqID_232399
atggctggagatggaccatcgagactgactctagaggactactctagttcttcaactccacaatacttcactagtatttttaggttggatgtagtcaagaagttcttaaagaagtactttccgaagtccaaaactgctcaaggaaaagctaagatttcctccttccatcggttccctagtgagttgctcagtgaagccctaaaccactttcgtggttttcttcgcaagactctcactcatgggtttagtgagccaattcagttgaacatatctattgatggcttacagcctcatttgatgcaacttctagatgcttttgctagtggaaagattaagctgaagacgcctaatgaagccatggagcttatagggaatatggcagtcagtgatcatgccattctttatgatagagcctacacgcctacaaagaagagcggagctcatgagtcaggcaagtgcatgactcaagaggaagtgtcgaaagagggaggtaacttttctcataaccaaggtcaaggttggaggtcccatcttgggaacaacttcaacaaggaccaagggggtttgtccaatcgaccccctaatcaggatcctaacctttatgagagagctgccaagctaaaggacactttaactcagttcatacaagtgggccaacttgctaagcaattggttgagcaatctactggaaactttgtgaccaacacaaagaaaaacccaaaaaaggaacacaaggtggtccttactaggagtaagaggaaggagagtctagagaaagaagagggagttaagggagtagtggaaaataagcttgagataaccattcctttcagtgaagccctccaacagataccgatgtacaccaagttctcaaaagacctcctcactaagaaggccaagtacatcaataatgaaaatattatggtagaaggaaactatagtgttgttattcagagaatcctaccacaaaaatttaaggatcctgaaagtgtgagtattccatgctccattgtgacgaatggcaatctggagatgagtgtagaggaccaaaaggtgaacttcaacctttttgaagcaatgaaacatcccattttcaccaaaacatgcttcagagtggaaacaattgagcaagcaaaacatgcggtgcaacaatttaccatccattcaccgctagaaaaagcccttatgaacgccattgaatgtctcctaaacaaagaggagaaggacctcagggcttgtttagaagatttggttagattgaaggaaattccttctggggaatatgcctttgaagagctgaaaaaggacactcctacaaaaaaacataaggttgagttgaaggttttgccttctcaccttaagtacatcttcttggaagcagtgtgcaaagaagtcctcaagttgcttgaagtggtgcctaagaaaggtggtatgacggtgatccacaatgataagaatgatcttattcctacacagacaatcattaggtggcaaatgtgtattgactatcacaagttgaatgatgtcaccaagaaggaccattttcctctgccattcatggaccaaatgttagagaggttagctggccaagctttttattgttttttggatggttattctgggtataaccaaatagcggtgcatcttaaagatcaagagaagactactatcatatgcccatttggtgtctttgcttacagacaaatgtcatttgaactgtgtaatgcccctaccaccttctag

SEQ ID NO: 115622 - DNA, 141 bp, Glycine max
  Peptide Sequence Number=SeqID_232400
atgggtttagcctctcattttcatgagaggcttacaaatacaaaagaaattattagcgagtcgcatgatgctgatggaggccttgtttgggacaatgccgagagtagatgcatggtggaaggcacaaaggttgtagtttag

SEQ ID NO: 115623 - DNA, 895 bp, Glycine max
  Peptide Sequence Number=SeqID_232401
gtgtttggggtaatccatttggcggtgtccctgggcctcattctggcggtggacaagtttctgaagcaagcgttcgtggctgctgcaatcaagttcccgagcgcgttgtttggtatgttttgcatattctcggttctgattattctcgactccaccgtgcccgccgccgccacggcgttcgtgagcttcttcgtgcccgcgtttatgtttatacagagatggctccctctgttctatgttccttctctggtggtcttgccccttgccgtcaaagatattcccgctgcctccggagccaaaattggcctcattttagttggaggatggctggctacattttgtgttgctggttacgcggctatcgcagttagaaaagctgtgaaaacggaattggtagaagctgagcctatgggaaagcctgctccattttccttgaaatcactgggtacaagtgccagaacatgccttccatttttgcttgcagcttcagtgttaggctacatggttggctctgggttgccaccaaatgtgaagaaggtcttccatcctataatttgctgtgcattatctgcagatctgacagcatttgcttttgggtatttttccaggtcagggcttgaacctgtgcttggtatggttacaagatgtatcacagtggcattggccctcagcattgtatccttgtttgacggtgccaattcatctctcacagcagctgtggttgtattaactggtctggttggagcaaattttgtgcaagcaacactcgataaactcagttttcgagatccaattgctcggggaatagcaactgcttctaggcttggaacagcagctttgtctgccaaggaacctgaggctctcccattttgtgccattgcatatgctctgaatg

SEQ ID NO: 115624 - DNA, 231 bp, Glycine max
  Peptide Sequence Number=SeqID_232402
atgtcacttgatgatattttgtcagctgactcaaaaggatcaaaactgcatttggatggatttaatgatgatattggacaacaaaagaaggaaacttgggctatgcgtgaaacatgtgaatggattgtagattgctttcatgaacttgttcctgacatggcgctagagattccctttgaatggatgcattttagaaggagggtacaacaatcatactccacttatgcttga

SEQ ID NO: 115625 - DNA, 306 bp, Glycine max
  Peptide Sequence Number=SeqID_232403
atgtctaaaggttcccttgatggaacaaggggttgtattaattataatcccgtcctcgccataagacagcttggctacctcatgagaggagtgccatcagacgaaagcatcacgcctttcatcgcacggggtttcagtgaccacaacgcgaggctgaagccttggaacgagaaaccaagaaggcccgaaaggaagaacacgaccaaaacaagttttgaggggctttatagggcaacaatagtgagctcaagctccgaagaggtgaaaggaatcatgcctttgacccgtgaaggaaagctccgatga

SEQ ID NO: 115626 - DNA, 765 bp, Glycine max
  Peptide Sequence Number=SeqID_232404
atggttccttctacatatggttctaaatataactcttgcagatatgttgctgttggtgatgagccatttcttaaaagctatggtgaacaatttcatcccttcctaattggagctgctatgaacattcaagcagctctaaaaaaagcaaaattggacagcaaagtgaaagttgtggttccatgcagctttgacagttttgagtcaggatttaacctgtcctcgggagtaaatttcaggcctgacctcaacaaaaccatgattgagctccttgcatttcttgataagcatggatcacctttctttgtgaccatttctccgttcataacccaccttcaaaccaaaaacatttcactggacttctccctcttcaaagaaactgcacgccctcataatcttagccataaaacatacaaaaacagctttgacttgagctatgatacagtggctacggtattatcaacagcgggatatcctaatatggacattgtcgtggcgaagattggttggccaacagatggagctgccaatgcaagctcataccttgcagaaaccttcattaagggccttataaaccaccttcatagtaacttggggacaccacttaagccacacaagccaccacttgaaacatacattttgagccttcttgatgaggaccaaaggagtattacttctggaaactttaaaaggcattggggtttgttcactttcgatggccaagcaaaaaaccatgtggatcttggccaagttcaaagagcctcgtga

SEQ ID NO: 115627 - DNA, 225 bp, Glycine max
  Peptide Sequence Number=SeqID_232405
atggcggaaccatcgaagaagcgaaagggcacttcgagtcacagtcaacggcattccgggtcacaggaaatgccaattccttcctccattccctctggatcattgttttcattagaggaacaaagtatacagtgcttggcacccatcattaggcaatttgtgaaattccgtgacgtgccggaaatcaaaaggaaacatcgttgcacaaatagtgaggttccgtaa

SEQ ID NO: 115628 - DNA, 937 bp, Glycine max
  Peptide Sequence Number=SeqID_232406
atgaattcacttttgaaactagaattgaaagacaaagtttgcttcattggaatatggggcatgggtggcatcggaaagacgactctagcgagagttgtatttaagaaaatacgtaacaaatttgatattagttgcttccttgaaaacgtaagggagatttctcagaatagtgatggcatgcttagcttacaaggaaaacttctttctcacatgaaaatgaaagacttgaaaatacaaaatttggacgaaggaaaaagcatcataggaggtatcttattcaacaacaaagttctcctggtccttgatgatgttaatgacataagacaactagagaatttgagtgtgaatgatcaaaagtggttaggccctggaagcaggattataataattacaagagacatggaagtactaagatcacatggaacagttgaaagttacaaaattgatctcttaaattctgatgaatcccttcaactcttcagtcagaaagcatttaaaagagatcaaccattagaacatctattgcagttgtcaaaagtggctgtccaacaagctggaggccttcctctggccattgagatgatgggttcatccttctgtgggagaagtgaatctcaatggaaagaatttttggaagtgaaagaatacacaaagaaagatgttgtgatggacaaacttataataagctatgatgggttaccgccaaattataagattttatttcttgatattgcatgtttcttcaatgggtgggtaaaagagcatgtgacacaaattctaactatttgtggccgttatccagcaaatggaattgacgttctaattgataaatcgctagcaacttatgatggatcacgtttatggatgcatgatttgcttcaagaaatgggaaggaaaattgttgttgaagaatgtcctatagatgctggcaaacgca

SEQ ID NO: 115629 - DNA, 393 bp, Glycine max
  Peptide Sequence Number=SeqID_232407
atgatcacaattgagaatgaaaatgcttgggatgaacaatgcacttcgcataaatcggctaaaccgtttcgattcaaggtgcttcaaaactgggatgatatagtggatttgtgtgctaaagatagagccattggtcatggagctgaaatggctatggatgctgatgaagcgatgagtagagaaacaaataaagtggaatgcatcgggttaggtgttactgctaccatagacttagaagaaccaagctctaatacaaaaggaaaaagacaaggttcaacttgttcaggcacacattctcacaagagaagatgggagaaaaaagaaggaatatcagcttctttggataagatgaccaactcttttaaccgaatggtagaaaaaatggatggatga

SEQ ID NO: 115630 - DNA, 1362 bp, Glycine max
  Peptide Sequence Number=SeqID_232408
atgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccacgggcctgctgtcaacatgatacaagattgtgatgaagacggtgtcatcctgaacgtccagcacgttcgaactcccctggtcccaatacatatcaagatgtgcgaggcagctctgtttgaccatgatcatgtagcgtgtgaaatatgtcctgtgaatgtaaaaggatgcccaaaggtacaagaggacgtacaaaggctgatagacaacagagaactaatcatcacgaggaaggacaaggaagtgtgcgtcatcacccctgagtttcagcggttggaaataagctataacagtggggaatcaactactactccactggtggttggcttggcaggacctatgccgtatgcttctctaaaagcggtcccttacaagtatagtgccacgatgttggaaggtgggcaggaggtgcctttgccctctctaactcctgcgatttctgtggacaacattgctagtgacagtaaggttctgaggaatggacgtgttatccccacattgtttgcaaagaaagtgaatgatccggcagttaaacaggtgacagtgaacggccccggtacaaggaaggaagtaggccaatccaatgggactagcaagaattctgatcatgacgaaattctgaaactgatccagaagagtgagtataaagtagtagaccagctgctgcaaactccctctaagatatccattttgtctctgctattgaactcagaagcacaccgtgaggctctaatgaaggtgttagaccaagcttttgtggagagggacgtgactgttaatcaattggacagtatagtaggaaacattactgcctgcaataatttaagttttagtgatgaagagcttcctgaggaggggaggaaccacaatctggcgttacatatatcggtgaactgcaagtctgatgctctgtcgaatgtacttgtggacactggttcctcattgaatgtaatggccaaatccacattagatcaactttcctaccaggggcctcccatgagaagaagcggggtggttgtcaaagcgtttgatggatcaagaaagtctgttatcggggaggttgatttgcccattacaattgggccgtttgttttccaaattacattccag

SEQ ID NO: 115631 - DNA, 159 bp, Glycine max
  Peptide Sequence Number=SeqID_232409
atgcatattgttgcggtaagacaggggcaggatcatcttgagctacctttcggggtgaggaccaaatgtggacagcagaaaccaatcaaggtacttaggaatggatgcaagtggggatggggtcacgaccgactgatcgttgccctttctctgcgctag

SEQ ID NO: 115632 - DNA, 187 bp, Glycine max
  Peptide Sequence Number=SeqID_232410
gaggtttccagactatggaaagctaaatcctctgttggatctttcctgtaggtacctgattggaaactggtctgattctaaagtccttgatagtacgggactaagttgttgtgctatcacgaggaatcggggacaaggctgggctatcatgaggaatcggggtctagcagtccaggagacaacatag

SEQ ID NO: 115633 - DNA, 336 bp, Glycine max
  Peptide Sequence Number=SeqID_232411
atggcacttctcataggtcggggtagcataaatgtgtgtacgaataacccttggatatctccgcatgtcatcgaacttgatcgtctctgggactacgatagtcttcagataggaagggtgtgggcgaccatatgttatctccgggcgtcatcggacttgtcaatgaaaggagcggataaccataaggtatgtccgcatgctaccagaccctcgggtcacgataacagaattgagactttttcgcggtctcggccagaagacgctgacatctccgggaagggtgcagatgaccacattagtctctgcgtgtcaacgggctcgcttgcctctagctga

SEQ ID NO: 115634 - DNA, 528 bp, Glycine max
  Peptide Sequence Number=SeqID_232412
gctgacatagtggaacagattcgaacaactggactcttcaaacacgtcacaaggtggttggattctgaaagttcatgttgtaatactttagcaaaccttggtgacaaagatatgttaccagcacttgctgccaccaaagcatctgaagctatagccttagggaagctgaaaactcttactgagagtaccatcagagaaagagctttaacaacacaacatagttccatgatcactatctcaaaatttgagtatgagtatctaacaaatcatgcagcctcagtagaagaaattgctgataaaaaagtagcagcagctgaggcatggattgaagctctcaaggctagcgagaaggaaatactgatggaaacaaaaatagctcaaagaaaactcaaagaatcaaaattggagcaagagctggaggtttacaccaaagagaagatgctttcaagaagagttagtagtagtgaggagcttgacaattggccaagaaaacgcgagaagagttcatccaagaacttcatagtttaa

SEQ ID NO: 115635 - DNA, 240 bp, Glycine max
  Peptide Sequence Number=SeqID_232413
atgcaggttagctcgcctgtgcgagctgagctgacctgggtgagcaacccctgcacgaagagggttaaaaagggggagggggaaggtttctgcacccaaaaaactctcccccccccctcattcaaaaaacaaaggctcacgggattcacgagttttgcatcccttaggtcaccatttttcgcgtttttgattccattttgctctattattcatctccgacaagcctatggtgcattctga

SEQ ID NO: 115636 - DNA, 126 bp, Glycine max
  Peptide Sequence Number=SeqID_232414
atggctcaacctctaatcttgaggacttatcagatgaatacgagacttgttggatcaaaaatcatgatagtgatactgactcctcttccgggcccgaaggaattatcactttacgtattgaaataa

SEQ ID NO: 115637 - DNA, 2275 bp, Glycine max
  Peptide Sequence Number=SeqID_232415
ggtgatatatggagcgctggttgaggcgtttgtggctgagggtaaggttggattggcttttgatttgttgaaggatttggtgagctccgggtatagggctgatttggggatttatatttgccttattgaaggtttgtgcaatttgaatagggttcagaaggcatacaagcttttccaattgactgttcgggagggccttgagccagacttcttaacggtgaaaccgttgttggttgcatatgctgaagcgaatagaatggaagaattttgcaagttgcttgagcagatgcagaagttgggttttcctgttattgctgatctctccaaattcttctctgttttggtggagaagaagggaccgataatggcattagagacatttggccaattgaaagaaaagggtcatgttagtgttgaaatatataatatttttatggattctcttcacaagattggtgaggtgaagaaagcgttatcactatttgatgaaatgaaaggcttaagcttgaaacctgactcatttacgtattgtactgcgattctgtgccttgttgaccttggagaaattaaagaggcatgtgcatgtcataataggatcattgagatgtcttgcattccttcagttgcagcttatagtagcctcactaaagggctttgccaaattggagagattgacgaagccatgttgcttgttcacgattgtttgggcaatgttagtgatggaccattggagtttaagtatagtcttaccatcattcatgcatgtaaatcaaatgttgctgagaaggtgattgatgtattaaatgagatgatagaacaaggttgctctatagacaatgtcatttattgttcaatcatctctggcatgtgtaagcatggaacaattgaagaggccaggaaggttttctcaaatttgagggagcgcaacttcttgacagaatccaacacaattgtgtatgatgaattactaattgatcatatgaagaaaaagacagctgacttggtgctatcaagtttgaagttctttggtctagaatctaaattaaaagcaaagggctataactatgagtggagtagacaaaatgaagaagctgatgtcagggcagaggcacatcataattgggtggatgaggttatccggtgtgaaggtcggggtggttcagttattggtaatgacaatcgctctagttgcttgatcatccagcaacgaccagaaataaagggtccttcccttttaactagagaagaaattgaaaaaccagaaatatgggctcagatatgtattcaaagaatggttgaattagccaaggaaagcacaactatgcgtcgtgtgctggatccaatttttgtctactttgattctagacaacattgggctcctcagaaagggttagcaatgataattttatcaaggatggcctacttcatggagaactcagggaatcagcgcttaattctagcttctgtgatacatcatctggaccacaaaaatgtcatgaatgatcctcaacttaagacctgtgttattcaggttgccacatctttggctatgcaaattagatctgagagtggcttggcagagattggttttgttggtgtcctttgcagacatcttaggaaaagccttcaagcctctagtgaatttgttggagagcaagaattgaacttaaatatctcacttcaaaattccattgacgattgcttactagaaattgccaatggggtaattgatgcccagccactttttgacttgatggcgataaacctagaaaatattccatccggtgttgttggtagagcaaccattggatctctgatcatccttgctcgtgcagtcactttagcattaagtcacttacattcacagcagggatttcctgaagctcttcttgtgcaactcctaaaagtaatgttgcattcagatgaggaggctcgtgtcggagcacaccttatattttccattcttctttttccaagttccttccatacgaatgagatttcctctctgcggtccaggtatctaggtcaacacaacaaaaggcattctcatgctccatctgtgtctgcatctgcttcaattacagctttacttgaaaagctccgcagaaacagaaacaccaaggcagaaaatcatgtgaatattgttcatgatcaagaaagggatattgtggcagaagactggaagcagggctgtggcttaaagaattctcctaacttttacaaactcacttctatcattgataaggctacaggatcaccaagtttgactgacaca

SEQ ID NO: 115638 - DNA, 751 bp, Glycine max
  Peptide Sequence Number=SeqID_232416
atggcgataaacctagaaaatattccatccggtgttgttggtagagcaaccattggatctctgatcatccttgctcgtgcagtcactttagcattaagtcacttacattcacagcagggatttcctgaagctcttcttgtgcaactcctaaaagtaatgttgcattcagatgtggaggctcgtgtcggagcacaccttatattttccattcttctttttccaagttccttccatacgaatgagatttcctctctgcggtccagatatgtaggtcaacacaacaaaaggcattctcatgctccatctgtgtctgcatctgcttcaattacagctttacttgaaaagctccgcagaaacagaaacaccaaggcagaaaatcatgtgaatattgttcatgatcaagaaagggatattgtggcagaagactggaagcagggctgtggcttaaagaattctcctaacttttacaaactcacttctatcattgataaggctacaggatcaccaagtttgactgacacagattttccctcaaattcagcaggtgaagatgacacaatcagtgaagcatctgtctctgacctttctcgatttattccaaagatgcctctatcaccttcggcacctcatgttatcagcattggacaacttatggaatcggcattagaggtagctggtcaagtggcaggaacagctatctccacttcgccccttccgtacaacaccatggctagccagtgtgaatcactcg

SEQ ID NO: 115639 - DNA, 1290 bp, Glycine max
  Peptide Sequence Number=SeqID_232417
atgggtgtcatctctcggaagatcttcccagcatgtgggaacatgtgtgtttgctgtccagctttgaggtcaagatcacgccagccagtcaaacgatacagaaaactgcttgctgatatattccctaagtcccctgatgagtctccaagtgaaaggaagattaccaaattatgtgaatatgctgcaaaaaaccctttccggattccaaagatagcaaaatatcttgaagaaaggtgctacaaagaactcagatatgagcacatcaaactggtcaatattatagcagaatccttcaacaagttgctttccatttgtaaggtgcagatagcgtattttgctgttgatgtgcttaatgtaattttggagctcttgagctattctaaggatgagaccattcagacacttggttgccagtgcttatcaaagttcatctactgtcagatggatgctacttatactcataacattgaaaagttggtgccgaaagtgtgcatgctatcacgggaacatggtgaagcatgtgaaaagcgctgcttgagggcatcaagcttgcaatgcctttcagcaatggtttggtttatggccgaattttcacatatttttgtagattttgatgagattgttcgtgccactttagataactatgagtggagtagacaaaatgaagaagctgatgtcagggcagaggcacatcataattgggtggatgaggttatccggtgtgaaggtcggggtggttcagttattggtaatgacaatcgctctagttgcttgatcatccagccacgaccagaaataaagggtccttcccttttaactggagaagaaattgaaaaaccagaaatatgggctcagatatgtattcaaagaatggttgaattagccaaggaaagcacaactatgcgtcgtgtgctggatccaatgtttgtctactttgattctagacaacattgggctgctcagaaagggttagcaatgataattttatcaaggatggcctacttcatggagaactctgggaatcagcgcttaattctagcttctgtgatacatcatctggaccacaaaaatgtcatgaatgatcctcaacttaagacctgtgttattcaggttgccacatctttggctatgcaaattagatctgagagtggcttggcagagattggttttgttggtgtcctttgcagacatcttaggaaaagccttcaagcctctagtgaatttggtggagagcaagaattgaacttaaatatctcacttaaaaattccattgacgattgcttactataa

SEQ ID NO: 115640 - DNA, 141 bp, Glycine max
  Peptide Sequence Number=SeqID_232418
atgtcaccaaacttcacgggtttaggatcaacagaaatcgtttgtacggataactgctttgggtatctccgcatgtcacctgacttcacgggtcaggatgacaaagatgcagaagacgatgactctgagtttgacggatag

SEQ ID NO: 115641 - DNA, 361 bp, Glycine max
  Peptide Sequence Number=SeqID_232419
ctacatctatcttcctaacagatacatatgtccctgtgaatctacttggagaatctttgggtttccaatacatggcagaaaacctgctgttgaaagattgcacttccatcttccaggccaacatagtgttctctacgaagaccatgatgatattgatgatgtattgtctaagccaagtatctctgattcaaagtttatttcatggatgaacaccaaccaaaattctgttgaaggaagaaatcttacttatgcagaatttgtttctaagtttctatacaataagaagaaaagatgttggcaccttaggaagaaaggctacaccattggtagattactatgggtcccaccaattacaggctaa

SEQ ID NO: 115642 - DNA, 309 bp, Glycine max
  Peptide Sequence Number=SeqID_232420
atgaaggaagttcaatgggggagtgcttctggcaaacaggacttgtcccctcgagggggagggagagaagtcgctgatgaccagggggttatcaggaaatatggaagaaaggcccacatgtcgggattacgtaaagatattaacgtgctgcgcaattatcttacatctagaagactccagaagccacgagaccgaagcggaggtgaaacggagccgagcccttggcgcccgccttggagacctgggcgcccgcccccttacaggagtccaatcaggacactgctttgcgggagatctccaccgacctaa

SEQ ID NO: 115643 - DNA, 120 bp, Glycine max
  Peptide Sequence Number=SeqID_232421
atgtatatcagtacctcaggagttaaactaagaaggcagcaaaggagggtaaaacagttgcagagcgcagaggaagttagggaggtttggggtgtcgtgagcaacaacaaacaacaatag

SEQ ID NO: 115644 - DNA, 309 bp, Glycine max
  Peptide Sequence Number=SeqID_232422
atgttggctatagtcgggtatggggatgatgtggatgtaggtagcagagacaatccgcgtgcatcaatcaaggatggggatggtgtggatgtaggtatcgaggacggtccatgtgcatcaagatgtgatggagatggtctaacttcagtcagaggtggagatggtgtagatacaacatcagaagatttgactagcatagatacagtagacgaagatggggtagatgatgtcaaactatctctaggtggtagtagtctaaccacatcattttttcttcccacttgtccctttcccactagattcatgtga

SEQ ID NO: 115645 - DNA, 951 bp, Glycine max
  Peptide Sequence Number=SeqID_232423
atggaagacctccccttaatgatcttcctatgttacacttatcgatggagcgttgcggcaaaggctgtcactttgtccattaggcaacaatttggtcacctttggcctacatggggaggaattccaaaagatcgtcaagaactttttttccagtttcatccatctaaggttgcgacaaaagctgttactttgttcattaggcaacaatctggtcacccttggcctacatggggagcaattccaaaagattgtgaggaactttatttccagcattttaaggatactggtcaatttgttgatgatagatctaggcagacacatgctaaactatctcaagttaggtctaatgttgcatcaagtgttggtgaatcacaacacattcctgtagaccctgctgaagaacaaagacttatgagttggtgtcggttgcagttgggggaccaaagcgtaagggacaaatttatggcattggagaccttgctcgtacttatgaatttgaaaatgaaaacttcatgcaacatacgcaaggatcttccagttgcgctcaagatgccggaaagattaaccgaccaagggaggagtttcgtcaatcaaaggaataaatgtgtgaatttcagtcagttgtcctttagttcctacctcctgaagtgcgaaacattattcatcaacatcaacaatcccaccagcaacatcatgaccagcaacagtaggactagttccagcaacaagacaatgaccaagcagacgactagcaataacataatgagtagtagagacactctcgcaatgactattttgattattgatggcgtctccaatcattcttcttccttatccaatacactgccattgatcttcaagaagaaaatgactccattgatgaagaagatccaaggcctacaagctccacatggagctacgtcatgtggtattaagagcatcttcgtctag

SEQ ID NO: 115646 - DNA, 657 bp, Glycine max
  Peptide Sequence Number=SeqID_232424
atggcttattccctagtggatgcctccatagaagctccacaagcaagcttccatcactggcgctcaaaaggatttgacctgggaggatattcagatttgacctccaaatatgccctggcacacgacaaggagggcaaggatgacaaagtatgcaagaagtatgacataagcaaagagaagtggacccagttttgtcagagacgtagagacccttcatgggaggatgttcgaaagaaggcacaagccattcagaaacaaaacattgcccctcatggaaactttgtcgcccatggacgtcaggatgtactgactgctgccattaagcgaccagagcaccctagtcgtgtctgtgctgctggagtcggtgtcatgatcaaaaactactttggaccagcttcaaggagctctcgcatctcttcatccatggctattgaagacctagagtacacaaaggaaatttgtgtcgatccctcgagacaggacccagaaacaggagactcggacaaatgtgggttgtatgtcgatgatagtccccctcgactggttgctcttttaagagtttatgaggggtcaacaactgtccacaacattcctttgggtaatgatcaagtgaaggtcagtattgaggaagcccgacatgctgatgctcacattcct

SEQ ID NO: 115647 - DNA, 396 bp, Glycine max
  Peptide Sequence Number=SeqID_232425
atggcgtgcttagcggaaggttttgggcttagcgcgtgggctcgctcagcgaggaagcctctgccactggatgaggggttggtgcacttagggagagtatcagttgctcagcgcgtagcatatgtctcacttagtgcgggtgttgcgctgagtgatgcaagctccattggagcttgtaggcctaggatcttcttcatcaatggattcctttgcttcttggaagatgaatggcagcggaatgaagaaaggaagagagagaggagacgccacttcaaggagaagatgagtctagaagaagctcaccaccataggaggccatggataagagcttggaggaagaaggagatgaatgaaggaagagggagagaagagcacgaaattttgtgctccaaatga

SEQ ID NO: 115648 - DNA, 1023 bp, Glycine max
  Peptide Sequence Number=SeqID_232426
atggcctctaaaaagagacatacatcatcttccaggccccaagagccttatgacacctctagatttgtgtctgaaattgcttgggagcgatatgagactaatcttcatcacagaaacataccccccgagtggaatgtggagcttgcctattcatattatgatgaattccttcgggaattggagcgccaccagtggcacaagaacctcacaagacagatggagaaccatattgatctggctttggtcaaggagttctactccaacttgtatgacccagaagactattcccccaagcagtgcaaggtgcaggggaagatgattaagtttgatgccgccacattgaacatatttctagagaccccagtaatgcttgagcctagggagagatactcagcatactcccgctactgccacactaaccctgaccatcaggttattgcagccaaattatgtttaccagggtgggggtttattcttaatgctgagggggcttcgtggaagcttttgaggaaggacctgaccacccttgctcagacttggagtgtcctttcctactccaaccttgctcccacttctcatacctctgatcttaatatggacagagcaagaggagttgtgtctgattctctgaccttcgagtctctgagcccagccattaatttggcatacattcggaagaactactggagccctgcggatccttctatcacatttccaagtgacccgatcatgcctatgttgcagagtattcaccatggcctttgcctggtgatgcaaagcatgcagaacctatctcagcagcagccgatcatgaccatgcaggagtatctggcacaagctcctcaggcccaggatgcacaggcccaggctgttgagggttctccaaaggataaggaggctgctgaggacaccccagaggctagggaggatataggtgcagtagaggcagacgtggacgctgattatgtagcagatgtcactgcagcgcagaggacctgggatccatggcccataccagcatag

SEQ ID NO: 115649 - DNA, 462 bp, Glycine max
  Peptide Sequence Number=SeqID_232427
atgggagatcgcttagaggatatgatttgtgatcttgcacaagagtcttttcagcaagcacatgttcctatgtatcatacatttcaaattgattcgaagaagcctttgtatttggggtgcaacaagtcattgacgttgttgtcagcagtgttaagtctggttaatgtgaaggccaaatatgggtggagtgacaaaagcttcaagtcattgcttcaggtagggcatgatatgcttccaaaggaaaacatgttgccaaaaagttactatcaggcaaataagatactgtgtccaatgggtatggagtatcaaaagattcgtgcatgccctaatgattgcatactgtacagacatgagcttgaagaaatgcacaaatgccctaggtgtggggtatcgcagtacaaagtaatggatgatgatgaatgtagtagtgacaaaaacttaaagaaagcccccctagcaaag

SEQ ID NO: 115650 - DNA, 3012 bp, Glycine max
  Peptide Sequence Number=SeqID_232428
atggttgctgcatcaaagcaaatgttagataatgttcctcaaatgaagtatgatgtttttgttaacttcaggggcaaggacatccgtgacggttttctcggttatttgactcgggcttttcatcaaaagcaaatatatgctttcatagatgataaacttgagaagggagatgaaatatggccatcacttgttggagcaattcagggatcatcgatttcattgaccatattctccgaaaactatacttcttcacgttggtgtttggaagaacttgtgaaaatacttgagtgcagggagaaatacagacaaactgtaatacctgttttctacggggtaaatcccacagatgtgcggcatcagaaggggaattatggagaagctcttgctgtacttggaaagaaatataatttgaccaccgtgcaaaactggagaaatgctttaaagaaggctgctgatttatcaggaataaagtcattcgattacaagactgaagttgatctgcttggagaaatcatcaacactgtcaatcttgtgttgataagtttggatacgcatccatttaacataaaaggacatataggaatcgaaaaatcaattcaacatttagagtcattgttacaccaagagtcaaaatatgtccgagttattggaatttggggtatgggcggaattggaaagacaacaattgcagaagaaatgtttaaaaagctatattccgaatatgattcttattactttttggaaaatgaagaggaagaatcaagaaagcatggaacaatttcgttgaaggaaaaacttttttctgcactactcggagaaaatgtgaaaatgaacatattgcacgggttgtcaaattatgttaagagaaagataggttttatgaaggttttaatcgttcttgatgatgtgaatgattcagatttactagaaaaattaattggaaaccttgattggtttggccgaggtagtagaatcattataacaactagagataaacaagtgcttattgcaaataaagttgatgatatataccacgttggggcattgaattctagtgaagcactggagctttttagtttttatgcctttaaccaaaatcatcttgatatggagtattataagctatcaaagagagtggtcaattattcccaaggcattccattagttcttaaagttttgggtcatcttctttgtgggaaagataaggaagtatgggaaagtcagctagacaaacttaaaaacatgccaaatacagatatttacaatgcaatgagattgagttatgatgatctagatcgtaaagaacaaaagattcttttagatcttgcatgttttttcatgggattgaatttgaaagtagaccacataaaagttctattgaaagatagcgaaaaagatgattcagtggttgttgggttagaaagattgaaagataaggctcttataaccatttctgaagataatattatatctatgcacgacatcatacaagaaatggcttgggagattgttcgtcaagaatcaattgaagacccaggaaatcgaagccgattgatggatcctaatgacatttatgaagggactgaagccataagaagcataagggcagacatgtcagtaattaggaagctgcagttaagccctcacatatttactaagatgagcaaactgcagtttttgtattttcctagcaaatataatcaagatggcctttctctccttcctcacgggcttcaatctttcccagttgagctaagatatgttgcttggatgcactaccctctaaagtccttgcctaagaacttttctgccaaaaacattgttatgtttgacttgtcttgtagccaagtggaaaaactttgggatggagtgcagaatttgatgaatttaaaagaacttaaagtctccggttctgaaaacttgaaggagctgccagacctttcaaaagcgacaaatcttgaagtgctggatatcaatatatgtcctaggttgactagtgtgtctccatctattttgtctctcaagagattgtctatagcttattgttcccttacaaaaattacaagcaagaaccacctaccctcccttagttttctcaaccttgaatcatgcaaaaaactaagggaattttcagtgacatcagagaatatgattgaacttgatttatcatccactcgtgtcaattcattgccttcatcttttggacgtcaaagcaagctcaaaatcctacggctaagagacagtggcatcaatagtttgccttcaagcttcaagaatcttacaagactgcaatatctgactgtatataaatccagggagctttgtactctaacagagcttcccctatcccttaaaactctagatgccacagattgcacatcattgaagactgtattgtttccatcaattgctcagcaattcaaggaaaacaggaaggaagttctgttttggaattgcttgaaattggatgaacattctctcaaggctattgggttaaatgcacatattaacgtgatgagatttgcataccaacatttatctgcaccagatgaaaattatgatgattacgatcgtacttatgaatcttatcaggtaaagtatgtgtatccaggaggcatagttccagagtggatggagtataaaacaacaaaggattatataattattgatctctcttctagtccacactcctcacaattgggcttcattttcagctttgttatctctggtcctatggtgaaggcaataatgggttacagatttacattttatatcactgtcagtgatgatgaggacgaaaataaaaaggatagtatcgacatctacatgtctgactcaattgtctgggttgcatcagatcatttgcttctcgatggaaaggacacaatgcctatggtcaccaagggttgcttggtcattagcgctgacaaaggttacaaggccatttacattcttagtggaccttcttctttggtcctctgtgatgccatcaccaaggccattatactataa

SEQ ID NO: 115651 - DNA, 228 bp, Glycine max
  Peptide Sequence Number=SeqID_232429
atggaggccccttttccagaatcaatgaatccgtatctaaggcacaaaataatcagccatagaacgcgatcatcagaaggacatacttgtggatgttgtacagcaaatgagtgggtacctaggacacggcggagcgtcacaacaaactgggtttacgggaaggtggacatgacggtgagcgtaagcgtcacagtagactgggttcgcgttttggtggacacagggtag

SEQ ID NO: 115652 - DNA, 912 bp, Glycine max
  Peptide Sequence Number=SeqID_232430
atgtttactcacgccttgcagaacggctgttttgacccgggacactacgtgaacgaaagtcgggtttcccgggaattcggcagcgcacagaccacctgcgcgcgccacgaattctgggcactcacgccttgccgaacggctgtttttgccctctgccactatattcgtcacgtgaacgaaagtcggctttcccgggaactcggcagcgcacacacctcgtgcgcgcgccacgaattctgggcactcacgccttgccgaacggctgtttttgccccctgccactatattcgtcacgtgaacgaaagtcgggtttctcgggaattcggcagcgcacagaccacgtgcgcgcgccacgaattctgggcactcacgccttgccgaactgctgtttttgacccccggacactatattcgtcacgtgaacgaaagtcgggtttcccgggaattcggcagcgcacagaccacgtgcgcgtgcaacgaattctgggcactctcgccatgccgaacttctctttttgccctctgccactatattcgtcacgtgaacgaaagtcgggtttcccgggacttagccatctttgggcactgaagccttatatagtggacatgagtcattcgatagactcgtccgtgattatgcgaggattcagcccgccgcccgttaggaagggagcttcgaggcggccggctacggcgcgtcggccgagcaggctgagccaatggcacgggcccttggggcgcgaacgccctaatgtgggtcggggcgagcggcgggcacaggcgccggttgctagcttggattctgacttagaggcgttcagtcataatccggcacacggtagcttcgcgccactggcttttcaaccaagcgcgatgaccaattgtgtgaatcaacggttcctctcgtactag

SEQ ID NO: 115653 - DNA, 207 bp, Glycine max
  Peptide Sequence Number=SeqID_232431
atgagaagaagaccaggaattggagggttgcagatgcacgccgctgcaaagagatcaatttcaactgatttgatgaaggagcagcttgccaccattcgctctcagctcgaagatttcgctcgcaaacacagctcgaagaaagttagagcgagaaagcgagagaggctgtgttgtaagggatgttgtgcatggagaagaggggaataa

SEQ ID NO: 115654 - DNA, 279 bp, Glycine max
  Peptide Sequence Number=SeqID_232432
atggcgaataaggaggaaccaacgagaagatgcttcagtggtagtgttgagtttttggtattgggggtgtttggaggtatgggttgggttgagtttggtttttgtgaagatttgtttgactttgagtttttggaaatgagatgtgtgttttgcggtggagtgaggagggacttatttggttgggttttgggagtgtggagagggaaaagcactagtgcagcaagaggcttctaccacagtccttaccagccttctatgacggttgtgaaccgtctttaa

SEQ ID NO: 115655 - DNA, 2877 bp, Glycine max
  Peptide Sequence Number=SeqID_232433
atggatcaagaagacaacaagatggacactgtgaatcctcatgaaatgtcttctaatcctttgtcattagaaaaagatgagataatgggcactgagaatcctctgtcatcaggaaaagatgatgtgatgggtaccaagaatcctccagaagtgtcttctaattctctgtcatcagcaaaagatggtatggtggacactgcaaatcctactaaagttctttctaatcctacgctttcggtaaaagataatatgatgggcactgagattcatccgtcatcaggaaaaaatggtgagatgtgtgctgagaatcctcctgaagtgtcttctaattctccatcatcaggaagagatagtttgatgggcactgagaatcctactgaagtgttttctaatcctctgtcatcccgaaaggatgacatgatgagcagtgagaatcttcctgaagtgacttctgaccatactacttctagaaaagaagatggaaagaaggaaactgattctcctgaaggatctagtaaaccagagttgagtgacaagaatactccacaatctttgaaggtgaaatctaaaattgttaagaaatctcaaactgttaaacttaaggccaagaagaaaaatggttctcaacaaatttgtgggaaaagagttatgagttcaaaagaagtggtggacaattctgaaaattgtcacattgcagatgagaaacaaatttcagacgatagtgagctgaaggaaactaatgatgagccacctaaggggaagagtgaagaggctgaaaataaaatgaaaggtagtcaaaatacatgcaccggtaacaaaagtcctattgaagagttagatggtatccaactgaaggatactgatcctcctgaaggatttagtaaacctgagttgagtgacaagaatactctaaaatcattgaaggaaaattctaacattgttaagaaatctcaagctgttaaagttaaggccaagaagtaccatggttctcaacaagttcatgggaaaaaaagaattgtgacttcaaaaaaagtggtggacaatgctgaaagttgtcacaatgcagatgagaaacaaatttcagacaacggtgagctgaaggaaactaatgatgaagcacctaaggggaagtgggaggaggttgaaaataaaataaaagaaagccaaaatacgagtattagtgacaaaagtcctaaggaagagtcaaacggtagccagctgaaggatactgatcctcctgatggatctagtaaagcagagttgagtgacaagaatactccacagccattgaaggccaaatctaaaattgttaagaaatctcgggctggtaaacttaaggctaagatgaacaatggtcctcaacagattcgtgggaaaagaggaattaggaggacttcaaagaaagtggacaatagtgaaagttgtcataatgcagatgagaaacaaattttagacaatagccagttgaaggaaactaatgatggaccacctaaggagaagagtcaggaggctgaaaataaagtgaaaggaagtcaaaacaggagcaccagtggcaaaagtcctagggagatgagccagcaggctcaaaaagataaaactagtcagttggataagactgaacagaaacaaaagagtaaagagaagcataggaagttaagcaagggttctatgattagaaaaaacaaagataagagtagtggcatggaaaggaatcaattaaaaggcaagaagggtgaaaaacttggtggttttatctttctgtgcaatgcaaagacgaagcctgattgtttccgctatcacgtcatgggtgtttcagctggtaaaaaggatgatgttttacaaatcaaacctgggcttaagctttttctttatgattttgatctgaagctattgtatggtatttacaaggcttcatgttctggtggcatgaagcttgaacccaaggcgtttagtggcaaatttcctgctcaggtgcggttcaaaattgcttctgattgtttcccaatacccgaaagcattttcaaaaaagccatcaaggataattataatgaaaagcacaagttcagaacagaacttactgttagacaagttaggaagctcactcaacttttccgcccagtcggaattcattccgccgtgcaccctgtgcattcccaaccaaaagtaattattcaggaaagggagattcgttcagctgtgcaacctgtccactcccaaccaaaagtaataattagagaaagggaatcttcggacagtgttaggggatcatggacccatttgcagagggaaagctataatgtgcgctctattaatagggatcaatttgaccggcgagaggaaattgctgatgatctgtttcgagtggaaattcctcatgatctgtttcgaatggagggctatacaccatctcatctcccaagagatagaagaaatgtggctactacttctcatgttaatcctttattggaatattatgagggagactatcaaccctatcacctggaccgtggctatccaagaaatgtctcggctcatgtcgaaagtcttcgaactgatcctctttatttggatgacagttgggatccttatcatgcctatcaccgtggtgtttcagctagggatgcatattttgcacctttaagtagggaggaaatctctccaaactcatatttggctgggggaagaccttttgtggggacggataacttgccaaggagagaggccgttcaagatagacattacccaatatattctgctcctgatgctttgtctgatcaccatcgaatgcggccatatcatggagacaagtttgaagcttcacgtgggccagtttcatctcgttactcttttgctggcccttcatttcaccgccaataa

SEQ ID NO: 115656 - DNA, 489 bp, Glycine max
  Peptide Sequence Number=SeqID_232434
atggaatcagatgctaagcttcaaagttcaaacgaagcgcacatggcacctagaagcttttttggggtagaggatttccttgacgatgacaatagccgaccttacacataccaaaaagggaagaagtcaaagaatcccaataagcacatatcattcaaacaaagaacaattgcctacatggagccttttacacttgatgtgtttatctcgaaacgttttgtatcagcttcactcactcatagggtaacaagcaaacaggttgcagttgccgggaccaactccaaggacataaaagctgttcttaggtctcgttccgacataccggcatgcatagccattggtaggattttagctgaaagagcaaaagaagctgatgtttacactggttcttatactccaagggatagggacaagtttgaagggaaaatcagagctgtagttcaatcacttattgataatgggattgatatcaaggtttatcttgattga

SEQ ID NO: 115657 - DNA, 204 bp, Glycine max
  Peptide Sequence Number=SeqID_232435
atgtcattgcaaagtgaaaatacgtacaaagttcaaatgaaattagagtcaaagggaggatggtgttgcgagttcatggaagccattttagtgagggtcgtcgattggagaagtggtgtcaccgatgatgaaggttgggcaaagtgtggtctttgtcgagctaataggaagcgccgcaaacactgttcacttgttggaacttaa

SEQ ID NO: 115658 - DNA, 678 bp, Glycine max
  Peptide Sequence Number=SeqID_232436
atggaggagcaattcatacttagagttccacctaatgtggcagagcggatagagcgtcttctgaatgaaaacaatgcttcttcatctgaagacaagtcactagatttgtcatttagagaggatggaagaagtggtacgtttatgattgggaatgaacaattcccagcttctctattggatcttccttgcgttgttgaatcctataagacttatgatgataactctttgattaagactgccgatattggtcagatgattatggtgagggaatctggtgatgctgctccagatgtaattgagtacagacatggcctcactccacccatgagagatgctcgcaagcgtagatttcgcagggagcctgatcttaatcctgagcttgtctcccgtgttgagaaagatcttctcaaaatcatggctggaggaacagcggacaatcttgatatccttacatctttttgcccacctgatagtggaaacaagcttaactttggttatttccttgaccgaaattcacatgtggaaacagctgagcaagaagaaggggatgagaatgcccgaggtgctaataaaaaatctgcacctaagcctgcaccaaaacatgatattccagagaatcttactaatgcaggagaagctgacaggagtgattctgaggaatctgatgactcagtctga

SEQ ID NO: 115659 - DNA, 411 bp, Glycine max
  Peptide Sequence Number=SeqID_232437
atggatttttctgagtaccttgcactggtgggtcagatttgtgttgtgctgggacagtgtgtagcaaactacatcgactggttctacatgatttatcatcccttgattagaccgacacagcccaaggatccaactagacatcaacctgtcgtgcaagatgacacatatgttgaaccagatattcctcagtactcggtggcagctgcagctgtggaggaagcacctgcagatgcaccttctcatgtagagcagcctcaacatgcagtggatgtttgccaagcaatagctgaaaggttagaatggttgttgaatctgaagatagtgatagaagttatagaagcatacagtgtcatggaaggctgcctaaggatcgctagaggtgtcactacgaaacgcaatgtatatgtgtga

SEQ ID NO: 115660 - DNA, 1623 bp, Glycine max
  Peptide Sequence Number=SeqID_232438
atgcgaagagacagaaagaagggcagtaagaatcctccaggggagtcttctaatcctcaatcatcagaaaaagatgatcacaataaggatacaaatcttgctgaaggatctagtaaaccagagcagagtaacaagaatactccacaatcattgaaggccaaatctaaaattgctaagaaatccaagggtggtaagttcaagaccataatgaataaaggttctcaacagattgggggagggagaagacttagaaagaacaacaaagtagtgggcaatagtgatgaactgcctaaagagaagagtgagaaggatgggaggaataaagagaaggaaagtcaaaataggagcactgatgacaaaagtcctattgacaatagccatcaggctgaaaaaaataagatcattaaggtggataagagtgaacagaagcagaagagtaaagagaaacatacagagtcagacaagggtgctgggagcagaataaacagaactaagcatagtagagtggaaaatactaactccagtgagaaaaggagagaaaaacctagtggtttcatctttatgtgcagtgcgaagacaaaacctgactgtttccgctatcgcgtcatgggtgtttcagctactaaaaaagacattgttttaagtatcaagccgggaactaagctttttctttatgattttgatctgaggctgttgtatgggatttacagagcttcatcttctggtggtatgaaacttgaaccccgagcttttggtggtaactttcctgctcaggtgcggttcaatgttgcttctgattgtttcccgctaccagagagcattttcaaaaaggcaataaaggaaaattacaatgagaagaacaagttcaaaacagaacttactgctcgacaagttaagaagctcactgaacttttccggcctgtggatgttcgttcaggcttgcagcctgttcgttcccctccaaaagcaataattcctgatagggttgctcctgatggtgttaggggatcatggtcctatttgcacagggaaagggatccccaaatcgaacggcaagaagaaattccccgtgatttatttcttactgagaagagttaccgagcttatggtctccaaggagataaaaggaatgcgataccagcccctcaagttaatcctacactcgatccttatgagagggattatgaaagagatcaccttcatcatgtggaccctctctaccgcacaaacgtcccttcatacagagaaagtcttcatgccgatcctcatcatttcaatgagagtgaacaccagacctatttgcgtggcggaatttctgcacatgcagacgatccttatcaccagtatccctatggtgcttcaccaagggatccatatttgccacctatgagtagacaggaaatctcttcaagcacttatttggctgggggaagatccttgactgcaagtgataacttacaaaggagggaggctgttcaggataggctttactcaacatattctgcggctgatgctttgtctgaatacaatcggatgcagcactaccaagagagtttgaaagctacagctgtgccagtttcatcccgttactcttttgccggtccttcatattcacttcgctaa

SEQ ID NO: 115661 - DNA, 348 bp, Glycine max
  Peptide Sequence Number=SeqID_232439
atggcgaaggctaaggcatcaacggggatcgtggggttcccatcaagagcttcaccaaaaacaggctcaacatgtgctaagaggaggaggactgtgaaaacatccaaaaacgcaacagctttgaagagcttaggaagattactcttcgatggtgttttgttcttggttgactcagagctcccgaatcgcacgacgaaattgagttttgcaaaaggggtttcgttggctaggagtagaaggttcacgaacaatagattgtcaatgggcataacttgtcaaccacaatatttacacaagcataatgatagtttaagcaaaagactaattacaaccataataaggacataa

SEQ ID NO: 115662 - DNA, 513 bp, Glycine max
  Peptide Sequence Number=SeqID_232440
atgattcttcctcctccatccctccgtgtcgttttaccaccccgttgtcgtcatcagattgcattgtcgccgttaaggtcgtctccaccaccgctgttccttttttgccgtcaagcatgtgcacgtaggcaacgggaagctgcccctagttttgaggatgttcagcacatggatcacgcagctgatgaggtccacgaacagcctaaagaagcaactgttgatgatgaagttgttgatgtcgagggttttccaagcggactacacgacacatcagttctgaatggctatgctaatcatgttgcagtcattgtatggaatagagagggacttatatcggtttttgcggagagatggcataatgaaattagcagtttccatcttcctgtagtagaggtgactatcaccctcaatgatgtggcctttttgcttcatctgcccatcacaggcgcattccatagctttgagactgttcatgttgaggaagtggtgttgctattagtcgaattacttgag

SEQ ID NO: 115663 - DNA, 345 bp, Glycine max
  Peptide Sequence Number=SeqID_232441
atgaagattggatgtggtgttggcgacgttggtagtggttgtggtgacgatgacaaaggtaatcttattggtagtggtggtggtgacaatgacggtgatggtaacaatattaatggtgatgttgatatcgatgacaatgatgatgacgatgatgatggtgttggtagcggcaccaattgtggtggcagtgatgaaggtggtggtggtagcggtgatggtgatggtggccgttgtgttgtggtagctagtaatgacaaaggtggtgggagtggtaatgacaatggtgatggtgatggtggcaatggtagtgatggtgacagcaaagagtatcattgtcaaatgtga

SEQ ID NO: 115664 - DNA, 348 bp, Glycine max
  Peptide Sequence Number=SeqID_232442
atggagagaagttctaatgattcccttggtgagttctacattatgtttcaactaaatagagatccactttctgattcatcttttgacaatcgaggctcaaaaccttctatgtcttctagtgaagcaattcaaaatttcaggactgcaaccaaggtgagtgagatgctgggaaatgtcaatacaagtagtgctctttcagcttttgaaaagatggaagagaaaggtagcaagtgccacgatcacttttgtgtggatgaagaagaggttggagactacattacaaggccacttttgcatgtcatgctgcacacgttgtcaggaattagattcagattgcatttgttttaa

SEQ ID NO: 115665 - DNA, 4395 bp, Glycine max
  Peptide Sequence Number=SeqID_232443
atggctgtgatgctgtgtggaggagcttcatcttctgcttttggccgcggatggacttatgatgtgttcttgagtttcagaggtgaggatacaaggagaaccttcacaggctctctatatcatggtttgcaccaaaggggtatcaatgttttcatagatgatgagaagcttaggagaggggaagagatatcccctgctcttattggagccattgaagagtctaggattgctatcattgtgttctctcaaaactatgcatcttccacatggtgtcttgatgagcttgcaaagatccttgagtgttacaaaacaagagggcaacttgtttggccggttttcttccatgttgacccttcggcggtgcgccatcagagaggaagttttgcgacagcaatggctaagcatgaagacagattcaagggtgatgtgcaaaagttgcaaaagtggaagatggccttgtttgaggcagccaatttgtcaggttggaccttaaaaaatgggtatgaatttaagctcatccaagagatcattgaggaggcctctagaaaattaaatcacaccattttgcatattgctgagtacccagttggaatagagaatcgcatatcagaattgaaattacttttgcatatcgaacccggtgaagatattcgtgtcattggaatatatggacttggaggcataggtaaaaccacaattgcaagggctttatacaacttgattgctggccagtttgaagctacaagtttccttactgatataagagaaagttcaaatcaaagacaaggtttagtgcaacttcaagaaacacttctttttgatacagttggggacaagaacatcaagctaggaagtatttataaaggaatccctatcataaagaaaaggctatgttgtaaaaaagtacttttgattcttgatgatgttgacaagttggagcagcttcaagcattagcaggcggacgcgattggtttggttttggaagtgtgatcattataacaacaagagataagcacttgctagctgctcagcaggttgacaaaacatatgaagtaaagaaattaaaccatgatgaagcttttgatctcttcacttggagtgccttcaaaaggaaggcacctgatgcaggctatttcgacatttctaaccgtgtggtgctctatgctgaggggcttccactggctttgaaagtaatgggttctaatttgtttggtaaaacagtggaagaatggaaatctgcactgggaaaatatgaaaagattcccaacaaagaggttcagaatgtacttagagtaacttttgataatctagaagagaatgagaaggaaattttccttgatatagcatgtttcttcaagggggagacaatggaatatatagaaaagactctgcaagcatgtggattgtatccaaagtttggtattagtgtacttgttgatagatctcttgttagtattgataaatatgacagattgagaatgcatgatctgatacaagacatgggtagggaaattgttagagaagtttcaccattagagcctggaaagcggagtagactatggtatcatgaagatgttttcgaagtactctctgaaaatacggggacttacagaattcaaggcatgatggtggacctccctgatcaatatacggtacacttgaaagatgaatccttcaaaaagatgagaaaccttaaaattcttatagttcgaagtggacacttttttggaagcccccaacatcttccaaacaatttaaggttgcttgattggatggaatatccttcatcatctctaccatctagctttcaacctaagaaacttgttgtactcaacttgtcacacagtcgttttacaatgcaagagccattcaagtatttggattctttgacttcaatggatttgactcactgtgaattgttgacaaaactacctgacattactggagtcccaaatttaacagaactacatcttgactattgtacaaatttagaagaggttcatgactctgttggattccttgagaaacttgttgagttgagggcttatggatgcaccaagcttaaagtttttccaagtgccctcaggttggcatcattgagaagtcttatcctcaattggtgctcaagccttcaaaatttccctgctattttggggaaaatggataacctcaaatccgtttctatagatagcactggtataagagaattgcctccttccattggaaaccttgttggacttcaagaattaagcatgacatcttgcttaagcctcaaggagctacctgacaactttgatatgttgcaaaatcttataaaccttgatattgaaggttgtccgcaacttcgaagttttttgacaaagttgagagacatgggacaatctactcttacctttggtaacattcagtcactgaatctagaaaactgtggccttatagatgaagatcttcccataattttccattgcttcccaaaagtatcatcattagtcctttcaaaaaatgattttgtagctcttccaatctgcatacaagaatttccttgcttggaattacttcacttggacaactgcaaaaaactccaagaaattccaggatttcctcctaacatacagtacgttaatgcaagaaattgtacatcattgactgcagagtcatcaaacttattattgagccaggaaacttttgaggaatgtgaaatgcaagttatggtgcctggaacaagggttccagaatggtttgatcatatcaccaaaggagaatatatgacattttgggtacgtgaaaagtttccagcaactatcttatgctttgctctcgcggtagagagtgaaatgaaggagagtttcgattgtgaaattcgcttctatataaatggtgatgaagtttatgaattggaaatgccaagaaacttttcagatatggtgacagatcatgtgtggctctatgacttgagaactcatccatccattcagtggcgcagtcttgatttatatctaatggatgactggaatcaggttgagatttcatgcgagaaaatacttggagcatcaaatgtgactgtgagttggtgtggagttcatgttattaagcaagaaactaacatgaaggatatactatttgcagatcctgatccagatttagattcaagcttacactctgagaagattgatatagatttggatacagatggtgaagaaagtacaaagtcaattgaagattcccaatattgcaacttagtagatgataactgctacattaactttgagacaccggatagacaaatggaggagtggtggaatataagtaaagaggcagaaaataatagagtcgtatgccacactgaaatggatcagaaccaagataagaatttattgcctgaaaagacattgtatagtgttactgaagattcattgttttcattgtatcttgaagacattggtagtgtcaaagcttccggatcaaattcaagcatactagttgttgatcatccagtgaaaaatcaaccacaatctcaagtcacaggttttatacagacaccaaatgttcaggaaccaaggactacagtatccatggatcacaaagttactagaggggagtcacctcaaaagaccaactccaccatggagctgccaacaaccattgactctctgaaaaagcaaaccaatttgactataaatgatgcagacatggaagcattctatgctgttctggatgctgagacctctgactccagagtggtttctaaattggcccacaaaattccaagcgaagagaccaagaaagcattgaagacatttcaagactttgtgaccaaagacttttctgttttgttaggccctagtgagtacagtaccatgaaagataccttggactaccttaccaatttaccagcagaagatggaatatcagtggaaataagatcgttggtaatacaagtttcaagacagttcactcattggagtaaggattacacatatgaaagcaagaaactagagtctaccacagccaagttgttgaaagctgatgaactagaagaaggtcttgaagctaataagactcacttcaaggaagtcatgtgcttggaaaatgagttgtgcagtgagttggcctatttggagcaaagaaagaaggagctagaagaacaaataaatgctgtcaaatctaacatctctgcttcacaagcagctagaaacatggctagtcaaagaaagagagaaatctttggggaagcaaagattctgaaagctcaaagagatgggttaagagaacaaatgccacacttgagagatgagcaggaattggcaaagaaaattaaggcaaatatcagagaagaatggtcaaagcttggagaaaagtttaacaacatcttaaggcatgaagggtttgattaa

SEQ ID NO: 115666 - DNA, 297 bp, Glycine max
  Peptide Sequence Number=SeqID_232444
atggatagtaaccataatcctaaccctaggtcaaagacactttacactagtgcgtcaagaaatccaatgcttgaaaccctaaccctagtaagggaatccaatgctttacaccatgcattagagatacttttgctttatgctaatgcgtcaagaaatccaatgcttcaaaccctaaccctaaccctaaccctaggtcaaggaatccaatgctttatagcagtgcgtcaaagacacttttactttttggaagtgcatcagagacacttttgctttttgccaggaaatccaatgctttaa

SEQ ID NO: 115667 - DNA, 909 bp, Glycine max
  Peptide Sequence Number=SeqID_232445
gtgagcatgaacaagatccccataatggtgaagcacttggtgaaagagggcatgccccaaagtttggggacatcaacatccttgaattccaccgtggcagaattctcagctgatcctggctttgctgagaaggctacaaagctttcttgctttggaaataggagtttcaatggcatgaccacccaattgtgcgtcaacattgctgaattggctcagagatcttatccattggtggaaaatgggaagaagcagctccttacagtctcaagtagtccatcactcaaagtgtttggatctcaaatgggtactcaggagaacaacaattctccattgcaagacctaatggaagtggccaattctcaagagatgtccgcaatctatgaacaaacaccaaatggagacactggggagaagccttccgcttatgctactgaagctagcgaagactccaatgaaaagcgcagcaagcctaacaaaggtgaggggaatgaaaatggccaagtgaaggcagaggaagagtccaaaggatcaacaagaggtcaagccactaatagtcatagtcttgcaaaaagaggaaagtcaacaattccacaacaagttacaacattccaaattcagtatacccttaatactaacttcttcaacaccaaagaacaaaaggcagagaacaccaaggagcataaacgcctgtcctcaacctggactaatggatttgcttattgcaataccatgtcaatggtttcagggaaactccgtggcttgcacagtggcgcgacaagacgagacgccggatgcgcgataatggactacgcccttcgtccgaggtcacgacaaggtcacaacatattgaaatttcagacaaacagggaagtgggagctcgagctagggcgaggttggagtgttcatga

SEQ ID NO: 115668 - DNA, 402 bp, Glycine max
  Peptide Sequence Number=SeqID_232446
atgaggtcctttaatggtgattttccaccatggagatgcagcggaagacaaaggagaagaggtgagaggaggcgccatccactagggaataagccatggaagaaggagcttcaccaccaagatgagccttggataagaagcttggaaggatgcttcaatggagaaaaagaaagagggagagaaagagagaggggggagcacgaaattgaaggaataaaagagggagagaagtggaactttgaagtgttgtttccaaagaagaggagcaactatagattccatgatttaggttttggtactaacatcaagacgaagttaaagatggatataggagaaccagagaaaccattgattttgtcagtgggatcttggtcgttcaatgtgcgttgctccaatcgatga

SEQ ID NO: 115669 - DNA, 330 bp, Glycine max
  Peptide Sequence Number=SeqID_232447
atggttccaccatttactgagattgttgcaagctatgcaacaatttcttcttgttatggttgcgaagaaggaaacactaccaatgccaccgcaaggaagtcaaacagtaaagtgtttcgtaaaattgcattgtcctttttggagttccagatcatgtatcgatgggtttcaatattgcaagcccgtggttcagcatatgtaaggacaaagcctacgttcaatcaccactacaactttcaaacggaggaaacaaatggtcatcgcataattaattggctcagtgagatttcgcacgaaaaatggactcttgcatgggatggtggccgatga

SEQ ID NO: 115670 - DNA, 348 bp, Glycine max
  Peptide Sequence Number=SeqID_232448
atgacttcatcatcagtcaatgcaattgtgtattacaatgacactatcacaacaactaaacatggttcaatgtttgtaagcagttcaccaatgatagttcaacttgataatataatgttacttgatgcctttaaacaagctattggaaacaagattagtctaccaaatggtaaagtggtcaaggatattatagattttcgattacctgtatcatctgttggtgattatggccaatatagggcatgcacactacacaatgatgaggatgcgctcagcgtgatgcacaagctcagtgagcaacccacgcttagcgccaggaagataattctggaaagtgaaggtgcttag

SEQ ID NO: 115671 - DNA, 171 bp, Glycine max
  Peptide Sequence Number=SeqID_232449
atgaggcgtacaatgatcacattattgaagaagaggtacaagaagttgagccttacacaaatgttggtaagagtaagacgtccacaaccactcaaaaatgaggaaaaaggaaagcttcagctgaaggtagtagttattttgctccaaggactacaccaagctcctagccag

SEQ ID NO: 115672 - DNA, 357 bp, Glycine max
  Peptide Sequence Number=SeqID_232450
atgaagaagaagaagaagaagagcttttggccaaggagcataatactaagagaaggcatgatgacctcaattgcacaaaggttgaaagacctaagtgagactgatgaagacaatgaaagttttgtggtgaccaaggctaacccaaagtttggtgacaaagaatgggcaattatcttcattggaaagaaggacgatccagcctcatccttattagatagtgagtccaccgatgacactcctatctcacccctccccatgtttagaaggacaactccaagggaaccattaactgatgctcaaagatttcctctggccttcattaacggtaatcctacgcctgcgaccccctactcttaa

SEQ ID NO: 115673 - DNA, 240 bp, Glycine max
  Peptide Sequence Number=SeqID_232451
atgggtttgaagatggaaagatttaacaacatcacagtcagtcttgagatggcagtagtggtggagaggatggagttggtggaggaatcggagccatggttggcgatgaacgagtgctgcaacaactccaagcataaacacttgatcttgttgaatgttttgcaaaaggacaacactgaggttagagaattaagttgtgattgtattctgcatagagagcatgaattgcttattctctag

SEQ ID NO: 115674 - DNA, 546 bp, Glycine max
  Peptide Sequence Number=SeqID_232452
atgcctacaaggaagatgaacatggggcttgtgaacttcccctgcaattggagccctttgtttcatggaaaacatatgatacgtactccgaacgctcatgatgctaggacttcctggagtcaaattatgtggatagactctctaaaagcctccacttttggctatgatggaagtaacaatgttatgcaccataaccttgatgcctccgtccaagctgaatcatctactaaaggtatggatgacactattgtgtgtggggtcatcattgatcttacaagcattggtgtcatggacaagactagtgaagcatccaatgcagctatggttgatgaagttgaaccatatattcaggatcctacgtccaagcagtctacaacttcaaaagaggccacttcacgagataagggcaaccgtgaggttgttattgtttattcaacaagttctggtcccactcctctcaactatgcacaaccccccaccaccgtcactcgtgatcaagtgcaagacatgattggccaagccatagaatcttttgttgaatgctaa

SEQ ID NO: 115675 - DNA, 127 bp, Glycine max
  Peptide Sequence Number=SeqID_232453
atgggttatttctgccaccacctccggatccagcccgcgcgcgccgcggtactggctgtcgccgggattgtcgcgcaccagcgcaccgcgcgcgccgctgtcactgccgccgccgccaggcagaccg

SEQ ID NO: 115676 - DNA, 585 bp, Glycine max
  Peptide Sequence Number=SeqID_232454
atgggttggatcggtgagactgttgattccatcaaatctcttcagatccgccaggtcctcacccaggctgtgagcctaggcatgattgttacgtctgcactgataatatggaaggcattgatgtgcgttactggcagtgaatctcccgttgttgttgttctttctggaagcatggaacccggattcaagcggggagacatcttgttcttgcacatgagtaaagatcctattcgggcaggggagattgttgtgtttaatgttgatggacgtgagattccaattgttcatcgtgtaattaaggtacatgaaagggaagatactggggaggttgatgttctcacaaaaggagacaacaattatggggatgacaggctactgtatgctcatggtcaactttggctgcaaaggcaccacattatgggtagagccgtcgggttcttaccatacgtaggctgggtgaccatcattatgactgaaaagcctattatcaagattgtttacggtttgaaacttaataattctgttgtcatgtctgatctattgcacaaagcaatctatgaagatgaccattttaaagatgcatga

SEQ ID NO: 115677 - DNA, 145 bp, Glycine max
  Peptide Sequence Number=SeqID_232455
gcaggcacgaccacccctgtcacatcgtcctgtccagacaagccacgtgtcgcgttctggtggaacgcgctcctcagagtgtattccaatgaatgatccaatgggtgaacgaagaagtaaggaggggcatgtgttggccaattaa

SEQ ID NO: 115678 - DNA, 306 bp, Glycine max
  Peptide Sequence Number=SeqID_232456
atgcaggctgtgaaggaaaagctaaaagatttaaatgctgcgcgtaaggccaaggctgaagcaagggccgaagaaaaggctgagaaagagatcgctgatgccagaaagaatgttgctcacgaggttaggttggcaaaagaagctgaagcagaaatggatatacacgtggaaaaagcaggaaaaatagctgagaaagaaatatcaaagcatgcatctaagaaccctaatgttggttatagcaacatgaatactacagatcatgctatgttggaagcagcaaatggacccgcctctacaattaactga

SEQ ID NO: 115679 - DNA, 342 bp, Glycine max
  Peptide Sequence Number=SeqID_232457
atgatgcaagttcctcaagtgactcaagagaggaggaaaaagcaaatctatgtgtccttgttgacattgatgaagactaaaaacaatcatcttcaatgtaaaattgattatcttgagaagatactttcaaagttcacaagtggaagagcaaacatagatgccttgttgagttctcaaaagtgtgtcatagaattatatggtgttccaagtgggatgcacaggcacatgaacgaagacaagtcaaagtttttctatctgatggaaaaacaaggagggtttgttccctatggtgataacaacaaagggaagattctaggcattggtaatgggggtaattcataa

SEQ ID NO: 115680 - DNA, 1191 bp, Glycine max
  Peptide Sequence Number=SeqID_232458
atggaattgcctccgcagtcgggttcaataggggcagaagcactaaaacatatagctcctggatcatcaatttctgttgcatatcactcatcttttggaccatatgaagacctcctctttctagagcttgatgagaaacttctcccagatgttctgaatgaaagggtggtcttgagaggacagcctgacgaagatgcagttctttgtactcaatccaagacatacgctatgaagtttgttggaacttccaattctgttctgcttgtaccacctgcaaatcattcagaatattatgaaaatcaactaaagaatgatagtaatagtgatgaagagaaagttgttgcacctgtactcaaagttgtatctggtaatatggagcttattgagacagcccccagacttgataagcttaaatcacttctgtcagaaaaaccttacaaattggaggaggatgacatgggaaatttagaagagaatcaggaatctagaataggattatataactggaatgatctagtagacaatattcaagctagtgatgaggaattattgtccggactgcaggctctttcggcactggagatttatgggtattggagattagttgacgggagttacatggacatgattctgggaatgattttgaaaaatgcagtgttgaatgactggtcacttaatgctttaaatgaagatgaagttgtgagtacactggaatcagatggatttcctggggtgcttgctaggcattgtttgaatgtatatggtaacagagtaaatgagtgcatgcctagctttgtctggaagttggatgagaagcgagtatgcatacattttgcaagagacatcctaaaagggggtaagaggaagttagagagtttcatggatgaatggaggcagaagattccagacggaatgcagcccacttttgatcttgtggaaggagaggtattaacagagaaaattggagttgaaacatgggtccacgccttcagtgtcgcttctttgccttccactccagctgagcgtttctctattcttttcagagagaggccaaaatgggaatggaaagatcttcaaccctatatcagagatctgaagttaccgggtctttcttcagaaggtttgctactcaaatacactcgaaggacacaaccatcagctgacgcagaaccagttttcagtgcaagatag

SEQ ID NO: 115681 - DNA, 354 bp, Glycine max
  Peptide Sequence Number=SeqID_232459
atggacgaatccactcgatccaaaaccagttctgatcgattggaagatgccatttccaaattagcctcccatcaaatcaccctcggtgaatcccttaatgctatgaccctcaaattggatgaactcattcaaaaactgctcacgtcagaatccccttgtcattctccatcttcttcttctgccaagccacctgttgcttcaccttcctcatttcatcgcatcaaactggaagtccctcattttgatggtgttgaccctcttggttggatcttcaagttcaaccaattctttgaataccactcgatgcctgagcatgaacgtctgaccatttcttccttctatacggaaggatga

SEQ ID NO: 115682 - DNA, 1401 bp, Glycine max
  Peptide Sequence Number=SeqID_232460
atgcctatgagagttcgtgggatgggtctgagttggatgttgctgcatgctgttgtagagttaaaacgtggtgtgcagttggtgaagcagagccaggatgaggtggttgacgaggttacctggaagatatctcctgtcaatgagaggctccaggcggtttcgaaatacacgccggaagtgattaaagccttggccgcctcttccaaaatcaacttgtcgccaattcgcagcagcggcaacaaggagacttgtcttgataaggttattacttcgccgactcccaaggtgccattgagcttcaaaaggataagctcggcccgcgatgtgagtggacagagccccttcagaactccaccatcgtatcgccctgacaaggtgcagcgtgtcaaggatattgaacgcatcagaccatgcgacaatcttttattaaggcagaacaaaaaggcattgcttgaactgttagatcaagttgaggatgccattgctgttgatgatgttacagtttgtaataacaacacttattcctttaaagttccgcaagatctaattgctaatgagcttcctgtcaaagtcaatcctacagtagaaaggactaaatcagatatacctaaagaggttgttgatgtcttcagttctaattatttggttttggaggtatctgaacttaggtctgctgattcatctgatgccccatgctcatcatacaaggtgcttcgtttgctaaatgaacaaaccggagaagagagggctgtaaaccttcataatgagtggtttgatagtgtaattgcacctggagatactgtgcacataatcggtcaattcgacctggggggaaattgtgatattgatcacaataaaaactttttgattgtacacccagatattctagtgtctggaacacgggttgctgccagtttaagttgcccaaggagaactgtcttagacgagaggttaaaaaacaatgattactcaattatagcattaactggaacgctgctgcaccaaatttttcaggctgggcttacgaaagaaaatcctacagtaaatttcatggaagattatgcagaagtggtattacagagaaacattgaaagtttgtatgcatgtggagtaaatgaaaatgatgttcgcaaaaccttgagagatgctattcctagaatattgagttggatcaagcagttcaaaaatacgaaggtaattgatattgaagagatggcttgggctccaaaatatggtttgaaaggaatgattgatgcttcagtcagagtgaaaattcaatcacaaaaagatgatccggaggaaaagatcatgccattagagttcaaaactggaaaagcaccatacagccaggcaagttctggtcctcatttaaattcaatcataaagaatgagataagatag

SEQ ID NO: 115683 - DNA, 1494 bp, Glycine max
  Peptide Sequence Number=SeqID_232461
cgtttacgaattcctgggagttcttccactgcacatgatctcagtcagcaggtttggagaattgataaggatgaatatgtgacttcatttgctattatgaggtttaatcttgtacagctttttctacaaaatgatcaaagtgctcatctgcggaggatgattgttgatcttgaggctcctagatttgacagtggatctttagttagtcaggatccagcgatatcctatgtttggtcagagaagagtttgaatgatgaccaacgtggagcaattctcaagatacttacagcaaaagattatgcacttatattagggatgcctggaacagggaaaacatccacattggtccatgctgtgaaagccttgttgattagagggacatccattttgctaactgcgtatacaaattctgctgtcgataatttactcatcaaattaaaagcacaggggattgattttgtacgaattggaagacatgaagtagtgaatgaggaggttagagaacactgcctctcagcaatgaatgtacaaggtgttgaagatatcaaaataaggttggaacaagtcaaagttgttgcagttacttgtctcggcatttctagtcccttgcttgccaacacgaggtttgatgtatgcattatggatgaagctggacagacaactctaccagtgtccttgggtcctctaatatttgcttcgacgtttgtacttgttggggatcattatcaactaccaccacttgttcagagtgcagaggcccgagagaatggcatgggcataagtttgttctgtaggctctcagaagcacatccagaggctatttcagctttgcagagtcaggacattatggacctttccaatgccttgatatatggtgacagattgaggtgtggttcatttgaggtagctaactcaaaacttgagttttcaggcttaaactgtgatttgccttggctagaagatgttttgaatcctcgaagacctgttatatttattgacactgacaagttgcctgctttagaggcaagagatcagaagattgtaaataaccctattgaagctcagataattgctgaggttgcaaaggaattggtaaagaatggaatcggaagtgaacacattggcattattactccctataattcacaggcaaacctcatccggaatgctgcttccatgacttccttggagatacataccatagacaaataccagggtagagataaagactgtatattagtatcttttgtaaggtctaccgaaaacccgacaagctgtgctgcttctctgcttggagactggcacaggataaatgtggctcttactcgcgctaagaaaaagttgatcatggttggatctcggagaactcttcttagggttcctctattgaaacttctcattaagaaggttgaggaacaatctggaattttaactgtgactaagaaggatatctatcgaaaaagtgagctcaagagatgttctcaaatgagatga

SEQ ID NO: 115684 - DNA, 957 bp, Glycine max
  Peptide Sequence Number=SeqID_232462
atggggtctatgagtaactcaaatccaaatccatggactccaaaggattgttctgaaggaatttgtagcatctattgtcctcagtggtgttacatagtgtactctcctcctactccaattctactaggtgatggtgatgatgacccttctggatttgaattctctcctctcatagttgctgcgattggaatcttggctagtactttcatcttggtcacttactataccattatctcaaggttatgcaggcaaagacacaacacaaatgatccaacagaagacgatggaaacagcgaattggcgcgaatttcttcgtctgccaattctggtttggatgaggctctcatcaaatccatcagggtttgcaagtacaacaagggtggtgggttggtggaaggtcacgattgttcggtttgtttgatcgagttccaagagaatgaaaacttgagattgttgccaaaatgcaaccatgcttttcatctcccttgcattgatacttggctcaagtctcatgctacttgccctttgtgtcgttcttctgtcaccgcttgtccaaatccgaatccaaattcttccatggaacccccaccaagagtcattgttaatgccttgggacaccaacttaggagtaaccatgttgttgttgttgagagttctgaggaacaacagaaagatggggaagctaatatttggggaacagatctgcttcaacaagtacacagagatccatgttcacaaggcatatactatacatatataattatcttagtggttgtcactgtcgccgtcaccccaaccaccacaactgtcacaacaaccaatgttgtcaccaaaacccttggtgctcctccttcccgcatttatactatcatccctaaaaccttcaccattgttttagtggcctccaacccttcggccaccaacaccatgtctctcccctccactgccatacactag

SEQ ID NO: 115685 - DNA, 177 bp, Glycine max
  Peptide Sequence Number=SeqID_232463
atggatgggtttggtggaaatagggaggggagagacatggtgttggcagacattgtggtggtgcctattgcaaaggcgacaacgactgtggtggcaatgattgtagcattagccactgtggcggcaatagttgtagtgttgaaacccaatgttgaggttcttaagagggaggagtga

SEQ ID NO: 115686 - DNA, 246 bp, Glycine max
  Peptide Sequence Number=SeqID_232464
atggagaaagacgcatggcacgtaggaccatggaatggaggcttcaatcccttctccttctctctaacgtctaggaactctaatagagcaaccggaggaagagctctagagagcactagaaatgccacaattgataacggagaatgctttagtgactacatcgagtgttgttatggtgtgattccaaaaattattcaagtgttggagtttgagaatattgttagatttgaggtacatgtgtattaa

SEQ ID NO: 115687 - DNA, 816 bp, Glycine max
  Peptide Sequence Number=SeqID_232465
atggagaagatcaacatgaagaaggtgagatgccaagccaaggtggtgggaacattggtgacggtggctggggccatgttgatgaccttgtacaaaggtcctatggtttggaccaaagatgcacctcataatgggcaaatcaataatgcaacaaataccacaacatattcagacaaggattggttcataggctctatcctcctaatcattgccactcttgcctgggcatccctctttgttttacaagtgagaccacttaaagccaaagccattgaaacctacaaaaatcaccagctaagcctcacatcacttatctgcttcataggcactcttcaagctattgcagttacttttgttatggaacacaagccatccgtgtggacaattggctgggatatgaacttacttgccgctgcctatgctgggattgttacatcaagcataacatactatgtccaaggattggtaattaagaagaaagggcctgttttcgcaactgcatttagccctctgatgatgatcattgtagccatcatgggctcctttatcctttcagagcagctttttcttggaggtgttcttggtgctatcttgatcgttataggcttatactcagttctttggggaaagcacaaagaacaagtggtgaagaacgaggtagaggatatacccttgcctgtaaagggtgctcaacttgatggaaacccagaaacacttattgattccactgatcagaaatctgattccaacaagatctcttcacatataattaatgtgtctatccctgagcttcccatgaaatctaataacagttaa

SEQ ID NO: 115688 - DNA, 135 bp, Glycine max
  Peptide Sequence Number=SeqID_232466
atgaaattgcaattagaagcagagaatcaaaaagtgcattgcgtgaacagtaacaataagctcgagaaacaatctaaagcatttgatactataggacttgcaaaggacaaattcagtcacggttactgtgaataa

SEQ ID NO: 115689 - DNA, 744 bp, Glycine max
  Peptide Sequence Number=SeqID_232467
gtttattcggagattagcattgtaggaagaaacccatcaaaatatgagcatgaagatgtttataggatgcctttgttattggctacaatttatgaatctgcacgccttctgcccactggtccaatgctgcagaggtgttctttgaaacatgacttgtgctttgcaactggtttaaccatacctgctggagctgtactggttgtacctgtcgaattggtacacaaggatgactctagttgggggagtgatgcaagtgattttaatccttaccattttttgtcaacgggtacaaaaggatcagaattgaggggtttattgtctcttaataaccatagggtccgaggcttaaccaaaaatcacaaaagatctgtaaagaaagttgtgaaaggttctactgaagacctttctattacaggagtcagttcatgtgtactaaatgatccaaatgaaaatgcagcatttcttccttttggatctggtacacgtgcttgcattggacagaaattcatcatccaacttgttgcctcagtgttggcatcattgctaaaaaaatatgagaaaatgaaacatataaaaaggaatggagatgaggaaatggacaaggaaagtaactgtatgaatgcaaagtggtcggtgttacggcttaactcgggatcagatgaggactcaaacacaaccttgaagaataatcttcatcagcatcatcctaactcacagatattatttgtgaaaagggaccagtga

SEQ ID NO: 115690 - DNA, 300 bp, Glycine max
  Peptide Sequence Number=SeqID_232468
atgttgggtgcaccagcaataatgctgggtgcacctagcaacacccaagtctcaatcttcgtctcctttcttccccgtagcgtcgcacagactcatcaaactcgttgtgactacagctgcacagattttcctcttctctatgcctttgcgagaacgtgcgtttggtttcaattcaatggtgggagtgttttaaaggatcttggacttctcagcacacgaaggctcactcagcgagcatgtctcgctgagcgagaggttttttatccgctaatcgagttggttgcctcgctaagcagatga

SEQ ID NO: 115691 - DNA, 231 bp, Glycine max
  Peptide Sequence Number=SeqID_232469
atggatactccctctggaatcaaggactcaattcctgcttggattaaatttgctgtacaggctcccggtgaaattccatacagcggaatatactatgatcccctagaagagaactcatgcgttgcccccctaatagaggacctgaaggttcgatgcgaacgacgacggaaaaatctcctcggtgtaagcagcaattttggggggtcatacatgcatatatcacatgattga

SEQ ID NO: 115692 - DNA, 363 bp, Glycine max
  Peptide Sequence Number=SeqID_232470
atgtatgaggcaaaaggagtaaagtctagttcaaaaggtacaagcaacgctcttgaggttcttactcaatgtaaagaagaaagtaaagggttggccacatttgaaggagaaaagggaagggaaataaatgggaaaattggcaatgatgttgttggaagaaagagtgataagaaggccaagcctgactcaacaacaagggcaacaattaaggaagtggttacttcagcttctcaagctatgactagtctagcaaagaagtttaatgaagaagataaacaaaggatagcatacatgggtacatcagttcttgtggtggcactaggagtttatgctacctacaagcttcattcacgtgtaccatag

SEQ ID NO: 115693 - DNA, 1692 bp, Glycine max
  Peptide Sequence Number=SeqID_232471
atgggtttgtgtgctatttgttctaatgtgggtggagtaaatattatagcaattggatgcaatgatggaagttgtgttatttgggattttgaaacccgaggcattgctaaaattctgcgtgatgatgaatgttcttctcccataaccagcatttgctggtcaaagtatggtcatcgaattcttgtatctgctgctgataaatcattgatattgtgggatgttatgagtggtaagaaaataacccggatagttctgcaacaaacccctctacaagctcgtcttcatccaggatcctcgaccccatctctctgcttagcatgtcctctttcatgtgctccaatgattgttgacctgaatacaggagacacaactttacttatagtttctgtctcagagacatgcaatggaccaacccctcctccacgtaataaatgttctgatggaattacctccttcacaccaactgctgcttgttttaataagtatgggactctggtttatgtgggaaactcaaaaggggaaattcttgtcattgattacaaaaatggtgacgtgcgtgctgtagttccaatctctggtggttctgttgtaaagaacattgtgttcagcaggaatgggcagtatctgctcacgaattcaaatgatcgaataatacgaatctatgaaaaccttctgcctctgaaagatgaagtcagagccctggatgacctgagtgggaaccacaacgatctaaataatattgagaatttgaaggctgttggatcaaaatgtttaactttattccgggaatttcaagattccatcacaaaggtacactggaaagcaccttgtttcagtggtgatggtgagtgggtagttggtggttctgccagcaaaggtgagcacaagatttacatatgggatagagctggacatcttgtgaaaatccttgaaggacctaaggaagctctgatagatttagcatggcatcctgtgcatcctattgttgtatctgtttcgctgaatggtttagtttatatatgggcaaaagattatactgagaactggagtgcatttgctcctgatttcaaggagcttgaggaaaatgaggaatatgtagagcgtgaagatgaatttgatctgattcctgagactgagaaggttaaaggacctgatgttgatgaagatgaggaagttgatattgtaaccgtggagaaagatgccactttcagtgattctgatatgtctcaagaagagttatgttacttgccatcaacccctagtcatgatgttcctgagcagcaagagaagtgtgtggaaagttcttcgaagttgttggacagcaataacactggatcccctctttcagaagaagctggaccaaatggtcatatgatgaatcatgcatcaagtcctcttgaagatgatgctgggcgcatgaaaagaaagcggaaaccttcagagaaggtgttggaattacaagccgaaaaagttaagaaaccctcaaaatctagcaaatcggaaaaacccaagagcagatctttggccgatgaagataatggtgctgctggtcgctttgatgacgccgagagtgtgagagtggggttttttaaatgcagaaaaatgctcctggaaataggagtgatgcaggatgcatcatttggccagaacacaaaaatgttgggtcttgcaaatctattagagataaagtga

SEQ ID NO: 115694 - DNA, 432 bp, Glycine max
  Peptide Sequence Number=SeqID_232472
atgggtgtgaaaatgcaagaaggtatcagttgcttgaaatcattacaaaagctttactttttggatgctgatcatggtggattagaccttctggaagagctcaaaaggttgaaaaagttaaggaagttagggataaggcgtatgcagacagaatatgcaaccttgaatctctcaatattaaaatctgtctctatagacaaaggagctttggttggtcttgaacacttcagatttaaggataacccccaaatgaaggttgtacctcaggatatcaaagacttggaaaaccttcaatttcttggctttgctgatatgccaactgaattagtagagagcattgatccagcaaaaggaggaaaacaatattcgactatccaccatattccacttgtacttattcgtcagcatgtgggaccaggatttaatgactga

SEQ ID NO: 115695 - DNA, 1641 bp, Glycine max
  Peptide Sequence Number=SeqID_232473
atggggcgcaaagagaagcagaacacgaaggcaatagaggaggaacgcgaccaagacaattttaatggcgcttcaacgccgccactcgttttcagcagcgacgacgacgaagccaaccaagatctcagcctcaagatcatcaaaaaggccatgcgaatgcgcaccgccaagcacgccccaaacgacgacgtttcgtctccgttttcgcagaaacctgatctcgcattgcccccaagcggcggtgtttcggatgggcccagcgcaatcgctgattcagaagtgatggaaaagaagaaaacggcgaagttgaaggtggaggctggggatcaaagtgttgttatagcggaggagcaagagatggaggagacaatcaatgctacagagaatcatgtggaaggaagaccagagataggtgacaatatggttctgcgaaagctgcttcggggtccgaggtattttgatccaccagataatagttggggagcatgttttaattgcggtgaggaaggtcatgctgctgtgaactgttcagcggtgaagcggaagaaaccgtgctatgtttgtggttgtttgggacacaatgcaagacaatgcagtaaggtgcaagattgctttatctgcaagaaaggtggtcaccgtgctaaagactgtccggagaagcacacaagtacttctaaaagcattgctatttgcttaaagtgtggaaattcggggcatgatatcttttcctgcaggaatgattattcacaggatgatctcaaggaaattcaatgttatgtctgcaagagacttggccatctatgctgtgtcaatactgatgatgcaacagcaggagaaatttcttgttacaaatgtggtcagctgggtcatatgggtttggcagctatggctcttggttttaagctctatagcatatataaatttgagaatcaattgcttcaggcatgtttaaggttgcaggatgagattgcaagtggagccacacctagttcatgcttcaaatgtggtgaagaaggacattttgcccgggagtgcacaagttctataaattcagggaaggggaattgggaatcatcacgcacaaaagataaaagatctcaaaaagaaaatcgttacatgggaaatagatctgcacctaatgatattagtggggctcgtagaaagaaacggtctcctacagaagaaagaggcttttcaactcccaagaaatcaaagagtagaggtggttggatggcggagtatcctaccaaagaaagaggctttacaactccaaagaaatccaagagtagaggtggctgcacaacggagcatccttcagaacaacaagactatgcaactcccaagaaatccaagagtagaggtggatggacatccgagcatcctgaagaattctttcctcccttgtcctcaaggagcaagggttacaggtctccagggacaccatcttctagaaacgatagaattcattcatttggcggtggaagtcatactccaagttacaaatcttccaaggtatggaatggtcatacgggaacctcaatgtctcaagggtcagccaggtcaaatcatcatagatattcagcatcaaggtttggcaactctagtagtgatgggcatggtagaaattacaactggtggtag

SEQ ID NO: 115696 - DNA, 300 bp, Glycine max
  Peptide Sequence Number=SeqID_232474
atgagaggcaccgtgcatgagcctcaagcgaacctagggacagatcaaaagttcttacccgagaatcctcaaggtttcgcacttgcacatatgagaagaaaactcattcgaccaggagctcgtggaaaatgcccaaaagaaaattgtgatggtagggtacatctgatgttagtcgctcatgcagactccttaggattctttttgaatccaagggtggcctttgttgtacaaattcttttgggatcagcccatgtcatcaagtttcagcgggatcgacagatccttggcattactctgtaa

SEQ ID NO: 115697 - DNA, 168 bp, Glycine max
  Peptide Sequence Number=SeqID_232475
atgttaggagatttgaagttcttagaggtgtgcctaaaagcaagagacttactatggtacttggatagtgactgctctaggcacatgacaggtgacaagtccagacttactgactttgtgtcaaaggaagaagatttgtcacttttggagacaaaaataagggaataa

SEQ ID NO: 115698 - DNA, 429 bp, Glycine max
  Peptide Sequence Number=SeqID_232476
atgactcgtgttttgaattgtgttatcgttggtgtgaatgcagtgtcttgtcattgcgtggcgttggacgttgaagggcgttgttatacatggggacgtaatgagaaagggcaactgggtcatggagatacgattcagcgtgataggccaactgtggtgtctgaactttccaaatacaaaattgtcaaagctggatcagggaggagccatacagttgttgttacggatgatggaaattccctagcatttggatggaacaaacatggacaactaggttctggttctgtgagaaatggcttttttggatattttatgagtggaatagattcaatgatggaatggagtaaagcttgtagttatttgggtcttcaacgatggaatggagtaaagcttgtagttgtttgggtattcaaccatggaatggagtaa

SEQ ID NO: 115699 - DNA, 450 bp, Glycine max
  Peptide Sequence Number=SeqID_232477
atgaccttgttggaaaggaccagattcatgctatccaatttaggattgaatatgagtttatggattgaggcaaacacaacatactatctcatgaaccactcaccatccattgccatagatttcaatactcttattgaagtatggtctaacaaacctgctaaatactcaatgttaaaggtgtttggatgtccgacatactatcacataagtaaaggtaagctagagcccagagccaagaaggttgtcttcataggcaatagagatggagttaaaggatttagaatttggtctccatcagaaataaagttcattctgagtagagatgtcatctttgatgaactctctatgttgcattctaaatttgaagaagattcgggcaaggctaaggatgtcactaagcaggtggagtttgagagacccacaattagaatttttagtgatcagaagtag

SEQ ID NO: 115700 - DNA, 357 bp, Glycine max
  Peptide Sequence Number=SeqID_232478
atgattggtggaataccaacgcttcaccacgagggcattatttgtttcttgccagtcacgcgtttcgcatggaccgaaggatcttattttgccttcgccatcgttgtagccgccggtttggacgaagagggggcggaaggtgttgcatgcaatgtcgtattcgaggagtgtgcggtgcagtccgttatgttgagaaccttgtcggaggggtcgtggcggcacgtgccgttggggagggttaggttggagaagacgaagtcggtgcggtcgttgttgaggagctgcatgtgcatggcgacttaccgatgcttttgtggaggagctgccactggccgttggaattggaagcttcggtaa

SEQ ID NO: 115701 - DNA, 1290 bp, Glycine max
  Peptide Sequence Number=SeqID_232479
atggaaggcacaaagcagcagatcaatataaatctgctcagggacagcatatactccctgctaagaaagtggttgatgcaacatcagccttccatgaagcagattatggcaattatggctgaaagagatgcagccattcaagaaagaaatctggccatttccgagaaaaaagcagcatatgctgagcgcgatatggcattcatgcagcgagatgctgcaattgctgaacgtaataatgcaattttggaacgagataatgcaattgcaactcttcagtatcgcgaaacctctttaagtagtggcagtatgccatcatgccctccaggatgccaaatttcacgtggtgtgaagcatatacatcatccccagcaacaggtacaccatatacctaacatgggtgatgcctcttacagcacacgggaaatgcacacaaccgatgccctccctgcagcccccatcccttctgaggccgggaaaccgaggcgggccaagcgaccaaaggaaccaaagtcagcttcacctaataagaagacttccaaaccagcaaaaaaagtcaagaaggagagcgaagacttgaacaaggttatgtttggcaagtcacatgagtggaagagtggtcaggaaatggtcaatggaggtgatgatcttaacaagcagttaactgtgtcaaaggctgattggaaaggacaggacttggggttaaaccaagtggcgtatgacgagtcaaccatgccagctcctgtgtgctcttgtactggtgtcctgaggcagtgttacaaatggggtaatgggggttggcagtctgcctgttgcacaactactctgtcaatgtatccacttcctgcagtgcccaacaagagacatgcccgggtaggtggtcggaagatgagtgggagtgctttcaacaagctgcttagtcgccttgcagcagaaggtcatgatctgtcaaaccctgttgacctcaaggaccattgggcaaaacatggaacgaaccgttacatcacaataaagatgcataagcctggtgttaaagtcatcctcgttcgtcatttgtacgcacttaattttcttagatggtctgatggcgccaatggcatactcgtgtcctcagtcatcctggaacctctctgcggaggtggcgaatatgagccctatgaacctattccttggtttattagcaaatccgtgctactccctctcctgtctctgcttcttattaacaaaggaggtgtaagatacgctgtggggagaaagggtatgttcaagaggaatttttcaagactagattaa

SEQ ID NO: 115702 - DNA, 213 bp, Glycine max
  Peptide Sequence Number=SeqID_232480
atgatgaaaatgttccacgcgctgaatgccgcgcgtatggaagaaccacataattttattttcacacgtgcaggaggaacagacagacagacagacagagttaagactagagcgttttctttctttgtcattgcaaatgacgagagagagacaatggacattcttcaatcatacacgcatgtctcttcttccttcctttcctttctcacttaa

SEQ ID NO: 115703 - DNA, 135 bp, Glycine max
  Peptide Sequence Number=SeqID_232481
atggctcgtcggacctccgcctcgaatgcctgcattgaaggtcttgttgttgttattcttttggctgccgatagcaacttccaccttgaaccaactggtatggggatttgtggagagggaacgaaagaaacttaa

SEQ ID NO: 115704 - DNA, 171 bp, Glycine max
  Peptide Sequence Number=SeqID_232482
atggaaaaatgtcccaatcaagaaacggttggtaatgcggcaatgctttcagcggtgggcaccttccactctgaggcactgcaacaccaaagtgatggaggattaaacattgcacacaaaatcaagaatagtggtgcatcaagacaagtgaatgaggaatccgttttttaa

SEQ ID NO: 115705 - DNA, 147 bp, Glycine max
  Peptide Sequence Number=SeqID_232483
atggctacttctacccacgtgaccttgtgggctttcagtctacggcccatattcatctccggcgtcctctccgtcttacccgacagaaaagaaaatcctccactctcaaaaattccgagaccgaccctctccgcaaagagcacgtga

SEQ ID NO: 115706 - DNA, 336 bp, Glycine max
  Peptide Sequence Number=SeqID_232484
atgggtaaacccccaaaaggctacatttttaacttcactgtcattttatatcttggtgaaaaatggactaacagtactacgactcagtcactcggcgtatttagtgcggtaaacgatgggtcgttttcaattttcctttcaatgacagtccacgggagagaagagaaaagggagtatataatgaggccgtctagggtgccaaagaaagttgtgaaaaaagcaacatctgattcttatccgtcagatatagtgccaaagaaagttgtgaaaaaagcaacatctgattcttatccgtcagatataaaaattaaaatatttaatggttgggatgtgtaa

SEQ ID NO: 115707 - DNA, 2655 bp, Glycine max
  Peptide Sequence Number=SeqID_232485
atggtgaagacgagagatacagcagcgtcaatgacggacgtcatagaggagcagggaaacatggctctgtcaaatgcccaggaagagagaatcttcgtttccataagagtaaggcctttgaacgagatagaaaaggccaggcatgatgtttccgattgggaatgcatttctggcaacaccatcagatacaagaacaacggccatgcggaaccgcgaccactctcaatggatacctatgcctttgatagggtatttggggagaagtgcaatacaaagcaggtttatgaacaagggattaaggaagttgctctttcagtagttaggggtatcaactctagcatttttgcatacgggcaaacaagcagtggaaagacacacaccatgtctggcattactgaatatgctttaagggacatatatgaatacatagagaagcataaggacagagaatttgttgtaaaattctctgccatggagatctataatgaagctgtcagagaccttctcaatgcaggtgctacttcactaagaattctagatgatccagagaaagggactgttgttgagaaactcacagaagaaacactgacagagaagagacagttgcagcaactcctttcaatatgtgcagctgaaaggacaacagaagagacggccatgaatgaaactagctccagatctcaccaaattcttagattgacagttgaaagtaatcctcgtgattatgcagacaccgcaagatccggagctctatttgccagtgtgaattttgttgatctagcaggaagtgagcgtgcttctcaagcaatgtcagcaggcacaagattgagagaaggtagccacataaatcgcagtttactgagccttggaactgtaattcggaaactaagcaagggaagaaatgaacacataccttacagggactcaaagcttactcgcattctgcagaactctttaggtggtaatgccagaacagcgatcatttgtaccattagtcctgcaaggagccagagtgagcaatcaagaaatactctgctttttgctagttgcgcaaaacaggtgactactaatgctcaggtcaatctagtgatgtcagacaaggttttggtaaagcaactacaaaatgaattggctagattggagaatgagttgaggagtttcaccccaaataccatgttacttaaggagagagaacttcggattcaacagatggaaaaagagataaaagaattgactcggcaacgtgatctctttcaatctcgtgctgaaaatatggtccagtctgttgggaaagataggcttttaagaggagcagacaaagattccgcctcagaatctacaggtgttgctaacgatcttcttcgcaggacagacagcgcatctgagagtctggacagaacaacatccagtttactgcacactgcgaattctgaagaggactttctcttggatggcaattctcccacgtttgctggtcctgacccatgtcatggttgggaggagatgaccacaagcagagaatctgaagataactacaaggaagttccatgtattgaaataaaagaagtggagacagaacacaaaacagatgttaataatacgccccccattcctgtttctgaagaaaatggaggaaatacacccatgatacaagttgtgaatgtaaatgccaaatcatcctcaggaaatgagcctatagagttgactcctgttgccatagataatactcaaggtgctctgcagggaaaaactgaggagagccttcaaaataccaaagaccttgctgtggacatcactaagaaatccaatgggtcctctgaatccgaatcacgtatttcgaatgccatgtctcctcctcaaatagataaggaaacttcaacccatcctcagatcagtagtaacttggagcagaatgagtcacctcggtttaataagctggaccaggaatccgcctcacctcctcggtgtgatgtgcaagagcttaaaactacgttacctcctcaacttgataagccggattctactagtttggtttgctttgaggacaagctacctgaatcgaagttacaagccgcaaaaagaaactcttccagaaaatattctccaattcactatagggatgcttcagttgaagatgtagaatccctttgggattctgatgcggaggatactgccagcgtccttaattttgttggaagaatgaataaaaaggctaagcaaaaggcattcaacaaggacatggatgatattatggtacgtgcaaggacatctggaatcaataaacgtgtgaacaaagtaataggtgtcaattttgagaggcagcagagagatacaatccaactttgggatgcattattcacacttttttcattgaacagcttgatgtcactgaatcgtgagaggaaaatgctaagcaagcaagtgcataagaagtttacgaggaaggaaagagaggaactttacgtgaagtggggtattgatttgaggtcaaagcacagaagtgtgcagttggcgtggcgcttatggacgaatacagaagacttgaaccacgtaagggaaagtgcagcacttgttgcgaagctggttggttttataaactcgggtgatgccccaaagaaaatatttgggtttggcttcttagcccgtcgtaagtaa

SEQ ID NO: 115708 - DNA, 273 bp, Glycine max
  Peptide Sequence Number=SeqID_232486
atggggtccacatggatctcggaacatggtgaaactcctgaggtggggtcgcaccagggaggcgagatcatagcaggaagcgttgccgaaaaggacgtcatcggtaaaaggcacgccagaaaaaagggtgttaggccagaaacgtcactgggaagtcgccaaaacactgctggtggctggccaaaaaatgatgtagagttcgttgcaaaagtgcgacgagtagaagggctcaccggaagaaggatggcgagcgaaatggctcaccagggatag

SEQ ID NO: 115709 - DNA, 465 bp, Glycine max
  Peptide Sequence Number=SeqID_232487
atggcaatatatgcaatatgtacatcgtcaacattgataccaccatcctcaacaccgacgcatgatcaagttaaagttaacggaggtgatgaatatcatgcagacaattatggtatttggaacccttctcctggtaactggggaagaggcaggggcgctcccatattcctcatcaacgagagaaagagaaatcatcatgagtcatggtacgtaatacaacacactttaattttgagcatgaatgacactactcctactgccgattctccaagttgtggccatgggcagaaaactagaagccaagatgatgtctgtgaaattatggagagctcagcaaggtttgaacaaccttttggaggaggcgacccttatcggttacgacaagaaaatgacagttctttatgcacaattcaaggcagggctatgatgctcgccaccatgtggctctgtgtctctagggcttga

SEQ ID NO: 115710 - DNA, 1024 bp, Glycine max
  Peptide Sequence Number=SeqID_232488
tgagtatcagaatcaattcaattttgagctagtcatgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtttggcaccatgcgtaagtcttttacggccgtgcgatatgatgccaaaaaattggatgtacagatgcattatcttaccatgtggatgcggtatcttatcatggggactaagtggtgtttgactggtcttaaaaaaaggatagagataaaggaggtatttctgttgtccattttcgatggggagattcgtgggtcggaggctgccggtggtttaaggatgtcatga

SEQ ID NO: 115711 - DNA, 153 bp, Glycine max
  Peptide Sequence Number=SeqID_232489
atggagataagagaaaaaaatgaatataaaatatttgagaatgtccttttactctctcaaggattagcaggaatccaacctgttgatgtgacacaacttatagaaggccattcttcctacttgcggatgacaaaaaatcctggagcagcttga

SEQ ID NO: 115712 - DNA, 105 bp, Glycine max
  Peptide Sequence Number=SeqID_232490
atgtcgtggaactttgcggattacctaacgatggatgttaagtacctcggggcggtcaagcaaaggttgcaggccatcaaaaaatggtccctggacgaaattagg

SEQ ID NO: 115713 - DNA, 405 bp, Glycine max
  Peptide Sequence Number=SeqID_232491
atgaagactggcttgagaagaagttctcgggtactctgtctaatccttgcaattgttgggcttattagatgtgacaatgaggtcataaatggcaacgcttcttctagtcctagtcaagccagcaatgccacatttctaacttttcctagtcaagtaataaatgaagtagtaaaagaaaaacacaacagctcctacaacaataataataaagtccacgtcaagagtactagttggtattatggaggaagtggaggcggaggaggtggaggtggaagtggtggagggtggaaatgtggtaaaaggaagggaggtggaagaggagcacatcattatcaatataaaccatataataagaaagggatgttagatgagaaagaatatagggtgggggagtatgcagaatga

SEQ ID NO: 115714 - DNA, 315 bp, Glycine max
  Peptide Sequence Number=SeqID_232492
atgtctcaatataaggtgataacaaatcagattgacacccagaggaaaaagtttaataacgagaaagaagtgcacaacaggctcctgcatgacttgatttacttgacagcttctctccagccgaatccctggcatgatgcaaaagcagaagatccacgttttgcattgatagataatggaggggagtatgagtctgtgatcggattctcaaatttaggtccacgcatgttcgcattgagcatacaaccaagccatcctagtgcccatagcggaggagcaggctctgatcttaccacttaccctttacttttctag

SEQ ID NO: 115715 - DNA, 213 bp, Glycine max
  Peptide Sequence Number=SeqID_232493
atgacaataatgctagtagtgacaacaatgacaagatgtgaaaacaatgatgttaatgaaaatagtaacaatgatgatgcgaagtggtggtgggatgtggtggtggttactacgatagagatgacgatgataatagagataatgaagggatggataaacgggcccaggtccatgaactgccccgcagggtccacaatcctcacgggtaactaa

SEQ ID NO: 115716 - DNA, 3237 bp, Glycine max
  Peptide Sequence Number=SeqID_232494
atggatcgacgctggccttggaagaaaaaatcatctgaaaagtccgtgattgagaaagcaactactgcattggattcctccgatgcttctaacaaccaggataacaagaagaaaccaaactatgttcaaatttctgtggaatcctattcacatctgtctggtttggaagatcaagtgaagacatatgaggaaaaagttcagacactggaagatgagataaaggaaatgaatgaaaagctgtccgcagcaaactctgagatcaataccaaggaaagcatggtaaagcaacatgctaaagtggctgaagaagctgtatcaggctgggaaaaggctgaagctgaagctttggcattgaagaaccatctagaatctgtcacccttttaaaactcactgctgaggatcgcgcaacgcatttagatggtgctcttaaagagtgtatgcgacaaataagaaaccttaaggaagaacatgagcagaaaatacaggaagttgctctctcaaaaaccaagcaattagacaagattaagggggagctggaggcaaagatagtgaacttcgaacaggaacttcttagatctgctgctgaaaatggggccctgtcaaggtcattgcaggaatgctcaaacatgctaatcaaattaagtgaagaaaaggctcatgccgaggctgaaattgagcttcttaagggaaacatagaagcatgtgaaaaggaaattaattcacttaaatatgaacttcatgttgtttccaaagagcttgaaattcgcaatgaagaaaaaaacatgagtatgaggtctgcagaagctgctaacaagcagcatatggagggtgtgaaaaaaattgccaagttagaggccgagtgccaaagattacgtggtcttgtgaggaaaaagttacctggtcctgctgcacttgcacagatgaagctagaagttgaaagccttggccgagattttggagaaagtcgattaaggaagtctcctgtgaagcctgctacccctaatttgtctccattacctgatttctccttggagaatgtacagaaattccagaaggacaatgaatttcttacagagcgtttattggcaatggaagaagaaacaaagatgctgaaagaagctttggctaagcgtaacagtgagttgcaggcctcaaggagtatgtgtgctaaaacactgagcaaacttcaaagtttggaagcacaatctcagacaagtaaccagctgaaattatctccaaaatccatcgtccagttaactcatgaaagcatttataatcaaaatgcaagcagtgcaccaagcttggtctccatgtctgaagatggaaatgacgatgcagcaagttgtgctgaatcttggtcgacagcaatagtctctgggctatcccaatttcctagagaaaagtgcaatgaggaatcaaacaaatctgaagtcactaacaagttggaactaatggatgactttctggaggtggagaagttggctcgtttgtcaaatgattccaatgtagatgccactgtttcaaacaataagacaacagacattgtgaccggtgatgtatcagaagtctgtactggcaaagaaggtctgtctgaaaaaaatggcaattcagatccgctgccaaatcaagtgtcttctgatcctttgatgtcagcacctgattttcaatctgatcttagtggcttattattaacagaacttagatcaagaatattactggtttttgagtccttagctaaggatgctgacatagggaagattgtggaggatattaaacatgtgcttgaagattcgcatgacactaccatccaccactctgtggatgcccatccttctgacgctacatgtgataggaaggataatcctgaagatgctggcttaaaccttgaaaaggaagtcatttcatcccagcaacccaaaggatatgtgcagataacttcagatttggaagctgcaatttctcagattcatgactttgtattgttccttggcaaggaagcaatgacattccatgacgatgtatcttctgatggaaatgaaatgaggcaaaagattgaggagttctccatcacctttaataaagtattatgcaacaatgcaagtttgctacagtttgttcttgacctgtcctatgttctagataaagcaagtgagttcagatttaatgtccttggctacaggggcacagaagctgaaagtagcagtccagattgcatagataagattgctttgcctgaaaataagttagtacatgacaattcatctggagaaagatatcaaaatggttgttcccatattatcaatccatgttctaatcccgaggttcccgatgatggaaatttggtctcaggctataaagcagatgctgcatcacagaaactgtcaatagaggagtttgaagaattgaaactagagaaagagaaagtagtgattgatttgtcaaattgtacagaaaatcttgaaatgacaaagtctcaattgctagacacggagcaacttctggctgaagttaaatcacaattggcttctgctctaaaatcaaaaagcttggctgagacacagctaaagtgtgtggcagaatcatacaactcacttgaaacacgtgcccaggtcttggaaactgagctgaaccatctgcaaatcaagatagaatctctggagaatgaacttcaagatgaaaagagggctcatgaagttgctatggccaggagcaaggagctagaagagcagttacaaaggattgagtgctcggcagctgatgatgaccacaagacttcgcatgagagagatttgacagctgctgctgaaaagctagccgagtgtcaagaaaccatacttcttctgggcaagcagttaaattctctacgtccacaaactgagccaaatgactcattgtacagtaagataaatccaaaagatgaaggattcacagaagatgaacatactactaatcaaaattttcaagaattaggtcagttggagatggacagttctacttctgcttttgtgcaaagattgagttcggagtcccccttgcatttttccaacagtttatttagcccttcggacagcgagtccaccattccagccagatccccagttcagcattctaaatcaaaaccaaaacaccgacctaccaagtcagcctcttgttcagtttcttctgccactacacctgagaaacatgcacggggatttagtagattcttttcacctaaaggaaaatccggtcattga

SEQ ID NO: 115717 - DNA, 207 bp, Glycine max
  Peptide Sequence Number=SeqID_232495
atggaaccgcacggaacagaacctcaccgacaatttaaagaaagagaaaaagttctgcatgaccaagtagctagcagtttcactgaaacggtttcaagtccgaagccagaggttgaaggagacacaaaacaaaagccatatttgcttataaattttagtttgagacgcaagcaagcagcatctgagctggaaaaggaaagtgagtga

SEQ ID NO: 115718 - DNA, 939 bp, Glycine max
  Peptide Sequence Number=SeqID_232496
atgtgtagagcaaaattagagggaggccgatttaaccagatatcagaatcagaaaacaacggtttgattgcttggtttgtggaatctaaggtcaaggaggctgtatgggaatatggggaaaataagtcgccgggtctggacgggtacaatttccattttattaaagctttttggtctctattgaagaacgatgtgatgaagttcattggagattttcatactaatggagtgttcccaagagagcgaattcttcatttatttcgctcattccgaaagttcatgacccacaaggattggaacaatataggcctatctcgctggttggatgcattcaatggtagcccgacgaaggaattttcggtgtctgaaggtttgcgccaaggagaccctcttgcttcattcctctttaatatttttgcagagggactcactgggttgatgagggaagctttgaggaaaaatatgttggctagccttctagtatgggagaatgaagtacctgtcaatcttctccagtatgcagacaacacaatctttattggagaagcatctcttcagaacgtcatcaccatcaagagcttgcggacttgctttgaattggtttctggcattcaagttaatttcaacaaaagtggctttggtactattggggtggacaaagtggtgacggagaggtatgccaatctcttaaactgtagagttatgcatgtcccatttgtttatttaggcattccgataggtgctaatcctaggatcgctgacacatggtctcctgttatattcaaactcgctaagaagttgggggcggggggggaagcacaaattattgtctttttgcagggagggtgggagctcatggaggaaaaggaggatctgtggtgtgatattttagaatctaagtacagggatggagaggtttgggacaggttgctggcatag

SEQ ID NO: 115719 - DNA, 1302 bp, Glycine max
  Peptide Sequence Number=SeqID_232497
atgggttccgtgtctctgaaaataggcgacggaaccgccagattcagaagagcaacagtgtgttcctccgcagttaacattctcatgatattctccgtcatcaccaccaacctcttcgccctctacgccttctcttcttccccaaaagaccctcactcccaccttcaccttcttgacaaaaacttctccctcatctctgagcaggtcaccctcattctccgagagatcgatatgtctcagaagaaacttgcccaaatagaaaaagaccttctcggctacgaaagcctcgacctttctcgacccaacattgcaaacgagctcaaactcttcctccaccaccaccagctccctctaggcaaagactccaaatccggaatcaccgaaatggtctcatccgtcggccattcctgcgaaaaatcctcggacttgttgtctcagtacatgagttacaaggcttttggaccctgccccaatgattggagcgtggcacagaaactcattttaaaagggtgtgagcctttaccaagaagaaggtgctttgctaaaacaatttctaaggtgggtcttcttcacccttttcccacctcgctttggaaagctccagtcaacaacactgttaactggagtggtttaggttgcaagaattttgagtgtttgaagggtaagaagttgagtagagattgcattggttgctttgatttggttaatgggtatgagaatcaaaggtttgtgaagtctaggagtaagaatgattttctaattgatgatgttttggcattgggaagtggtggaattcggattggacttgatgttggaggcgggtctgggtcctttgctgctgttatggccgagaggaatgttactgtggttactagcactttgaatgttgatgctcccttcagtgaattcattgctgcaagaggacttttccctcttttcttgagcttggatcataggttcccgttttatgacaatgcgtttgatttggttcgggcttcgagtggattggatggtggagggagggaagagaagttggagtttttgatgtttgatatcgatcgtgttttgcgggctggtggtttgttttggctggataacttctattgtgttgatgaagagaagaagagggcgttgactaggttgattgaacgatttgggtacaaaaagttgaagtgggttgtgggagagaaggctgatattcttggatcagggtctagagcttcaaacaacatgatggcaagatgtgagtataatgctattgcttctgctggatctgcttcacttcacacacaatttgtgtga

SEQ ID NO: 115720 - DNA, 513 bp, Glycine max
  Peptide Sequence Number=SeqID_232498
atggaaagcacgatcatggaagctaacagtatcaaagatttactattcagctctctcactcatctaccaaatgacctcaagtgcaaattttcaatgattctatggtccatttggaaaaacagaaatgagaaggtttggaacaatcttgatatttctccagcaacatcaatatctctatccgaccagttttattcagaatggtctcatgctagaagaaagagcaataacattccctccctccccgctcaacaagttcacggaacatgggagccccctccactgggatatatcacctgcaatgtagctatctttcaagacataaatgcttttggtgcagacttgtgtattcgcggtcatgatatgatggaaactttattcgaccaaaaacatgcatctttaatggcaaaccaactctttatcaagcaaaaggatgggcactattcaaagcaattcaatggatatcccaacttgatttctacaacgccatttttgagtcggattgcaaatttgtag

SEQ ID NO: 115721 - DNA, 186 bp, Glycine max
  Peptide Sequence Number=SeqID_232499
atggcgagaggaccgtggttggagaagccgtactcttcctccgcctcaaccagtagcctcttgaacacgggatggttcagacggtattctgtgggccgacgtacgggccttgctacgccaccgccgcagcatttggcggagcctgactatgtggcggattctgctgcattttccaagtgccgctga

SEQ ID NO: 115722 - DNA, 1242 bp, Glycine max
  Peptide Sequence Number=SeqID_232500
atgggtgcttgttggagcagtaggattaaggccgtgagtccttccaatacagggttcacttctagaagtgttagcagagatggccatgacatccagtcaagtagcaggaactcatcagcttccatacccatgacccctcggagcgagggagagatcttacaattttccaatttaaaaagctacagctacaatgagctaaaaatggccacaaaaaatttctgcccagatagtgtcctaggagagggtggatttggttcagttttcaagggctggattgatgaacattcgcttgctgttaccagacccggaacaggcatggttattgccgtgaagaaacttaaccaagacagtttccagggtcacaaggaatggttggctgaaatcaactatcttggccaactgcaaaatcctaatcttgtgaagttgataggctactgcttagaggatcagcaccggcttctagtttatgagtatatgcccaaaggcagtgtggagaatcatctgttcagaagaggatctcattttcagcagctttcttggactttgagattgaaaatatcccttggggctgcaaggggtcttgcttttctccatagcacagaaactaaagtcatataccgtgactttaagacttccaatatccttcttgatactaactataatgccaaactttctgattttgggctggccagagatggaccaactggtgataaaagccatgtttctactagggtcatgggaacccatggatatgcagcaccagagtatctagcaacaggtcacctcactgccaagagtgatgtctatagttttggagtagttcttttggaaatgttatcaggaagacgagccatagacaagaaccgaccatctggagagcaatgcctagttgaatgggcaaagccttacctttctaacaaacgcagagtttttcgtgtgatggatagtcgtcttgaaggacagtattcccttacccaagctcaaagggcagccacccttgcttttcaatgtctttctgtagagcccaaatacaggccaaatatggatgaggtggtgaaagcattggagcagctacgcgaatcaaatgataaggtgaaaaatggtgatcataaaaagtgtagagttagtggctctggccttggccaccccaatggactccctgcgtctaccagcaaaggaagtatagatgctgctaaaaagtttaattatcctaggccctctgcttctctcctttattcttaa

SEQ ID NO: 115723 - DNA, 305 bp, Glycine max
  Peptide Sequence Number=SeqID_232501
atgatggaagatgcatcaaaattcactcatatctctcccaagaaaaacggatatgtgacttatggcgacaacaataaaggtagaattcttggagttggaaaagtaggtacaaactcttcttcctccattgagaatgttctacttgttgaagggtctttccgaccggatgacagcactgttactgtgggtccttcacaagatatccctctcgatgttggagcccaagtcaaaggtgaacccgaagaaagaggtgacacgagggagatcgtgtcgaattgtccatggttccagaaagggaagaagga

SEQ ID NO: 115724 - DNA, 333 bp, Glycine max
  Peptide Sequence Number=SeqID_232502
atgtcaccccctcctacactagcgtcttgttggattcccatcgctccttcacctctggccactcctccaccaccatcttttctcatccctcaacaacaccatttttcgttcctcccctgtgcttgccaaacagtcatcatcttagtctcttactccttggtcatcgccaccgttgttatgatctttcctgcaactgtgagggaaatctttgatgagactaccatggttgtggttggtgttgttgtttgcaaaattgccatgggtgtagggtgtttgatcatatgcccaacaagaatatggattcttgttaatgatgtacaactaagcaaataa

SEQ ID NO: 115725 - DNA, 192 bp, Glycine max
  Peptide Sequence Number=SeqID_232503
atgccgagtacctcgaggcatctatggcatttaaggagtggaggactcacccctacaacaaataactttcaggaagagccacaacatgatttggaattcttgttgactccagtgggtacaatgggcggggcaacattcgttaatatagcgtggagcaagtgcacccaatggaggttacagaggaccaagtag

SEQ ID NO: 115726 - DNA, 3198 bp, Glycine max
  Peptide Sequence Number=SeqID_232504
ctgttggaatcaacaccaaagaacaaacctatccatttcaagtgtgatccttctaaatccgattctgcttggaaatggttggaaaggtggatgtcagtatcatcaaaagatattgcagagtgcaaagaaattagttctctgatagagcaatcaagggaaagcaaagatagcactcccatgtttcaattcgaaatgggtattccatctgaaccttttccccaagcagttgactcgaagctcactgttgaagattcacttctgccatctgaggatgaagaaaagttgattacttgtgatgctgatgactttgagtttcaagcaagctactccacatcatctattgtaaaagatgacttggtacaggttcctcctgaagaaaaaattgcatatgatgccaaagttgcctcagacgatgctgattccttccaaaacgaaaaatcagcatcagatgcaagtgccccatcagagcttaattctattcataaggggcctgaaattgccccaccatcagagcttaattctgttcataaggggcctgaaattgccccaccatcagagcataattctcttcagaaggggactgacattgccccaccatcagagcataattctcttcagaaggggactgacattgccccaccatcagagcataattctcttcagaaggggactgacattgccccaccatcagagcataattctcttcagaaggggactgacattgccccaccattagagcataactctcttcataagggacctgaaactgccccaccatcagagcttaactcttttaatcagaagcctgaaattgatggtgagcagggcaaacaatccatgaaaagatttgcctcagaccaactagaggctgaaggaaagaaacctgtaaatggttcaagaaaggtcagtaatcctgcatttattgctgcacagtcaaaattcgaagagctgagctcaatagaaaattcaggtaggacaagcagtttgtcctaccaagattcagctgttgaatcacaaggagacacctcttctgttggcaatgatactgcatatagatcaaaagagtttgcatttgaaaatcctgctgcttatctttctaggtttgctggttctgaatgtggcactgaactctctatttcttccactcttgattcacctgacatatcagagcctggcgctatggaaaatgaacgagatgccaaagatttaatggaagggattggtaatcttgagaacactataaaccatgatgatgaggccaatgacaatgtttcacgtgtcatcccagcttctaacctagctacttctgttttggataagtcagagattgttgatgacattagtgccaatttgggtcactcagtggtagctgtggactctgaagagcctgctattaagactgagaaaaatgcacctgacctgcagagagagctgccagagtctgttctgcaagatttaagatcatctccagaagcttcacctagaagccatttaactgtccctgaatcacaaggaacgccttcaagtgaagtgtctgtgaaacctaaagatagcactatcaacaagactagatctggcaataaacgtcggagcctatcattgagtaacaaatcacctacaaatccaaatcatgattcaggctcgaaagacagtagggagcaactgcctaaagatcagcagaatggaaagaggcgcaattcctttggctcagtaaagcctgataacattgatcaagaatctagagataatagtactaacaacaattctctaccccatttcatgcaagctacagaatctgctagggccaaggttaatgcaaataactctccaagatcaagtccagatgtacatgaaggagatatcgaagttaagaagagacattccttacctggtgccactggtaggcaagtttctccacgcatccaacgatcaacatctaaggcacagcagagtgcaaaaggaaacaatgtacatcctcctcaagaggaatctccttcacaggttgggttaaattctcaagataacctccaagcaaaaacatcattgtcgttgcgtccaggtggagcaggttctgatgacattctgcctcctggatttgagggaactcatgcttcaagtcagtttgagattaagccatcccagataccagttattaagtggattactcctcaaaagattgttctaaatgtcacatggcgggtagtgtctggggaagaaagcaaagaagcagaggatcaatgtcagagggagatgagagtactggaagctatttatcctcgcatatcttccattcctctaaacccttctgtttcaatggatgttgaagagttccattgcattgatggtcaaactactttgataccaataacgccagttgaagatgaagatgcagcagcagaaacattatcgtattccttggaaccatttcatgtttcccaatctcttcaattagcttctggtgttctgaaggattcaaactctgctacaagtatgcagttagcttgtggtcttgcatctgatgtagctgttgctgcatctgttgctttaactaaccttgtgaagagcaatgaacatggaaattttgttgaccatgaattacttaataatattctcaacaatccagaagtgattgagaagttggttggagattatggagctattaataattcacaatatgtacataatgcggggtcatccttggcggctttttcaaatcctcctattcctattcaaggacaaaccactacaccttcatcggttgttttttcaactacttcttcctatactccccctattggaggtcaggcggaacctgttactacccaatggcctcctaggcctgcagtgagttcagctattgtttcttctcccattgaggtccctcctgcaagagatgtaaactactataagagcttaattcaacaacatggaggacataaagaaacacttccatactccagtaaacgtcagattcctcaggcagcaacaaactatgagacaacctcctacaatcatagaggtaaagtgtcaaaaccaaagataatgaagccttgtatctttttcaacagttctagaggatgtcggaatggagctaactgtgcctaccagcatgatgcatcatttcagccacggggtaatactgtgtcagggatacaaagttcaaagaggatgaaaatggatcatgagattagcaattaa

SEQ ID NO: 115727 - DNA, 1215 bp, Glycine max
  Peptide Sequence Number=SeqID_232505
atggcttcgtctacacgtggggttttggtggttatggaaggacatagggagcagaaggatgagtgggtcccacgacgtgttgaagtttttcaaaatagaaatgttttgccacccgatgcaatcatatcagcaggttctgtgaattcttcatgtactgcaggtggagggcagttgtatatgtggggcaaattaaagaacactggtgatgactggatgtatccaaagcctctaatggatttaagtggttggaatctactatgcatggattcaggcaatatgcaccattttgttggggctgattcctcttgcataagttggggacatgctcagaatggagagctgggatatggacctactggacagaagtcttcagctgtacccaagaaggtggatttacttgagggtatgcatgtaataagtgttgcttgtggtatgggtcattccatggttattgttgatagagcaaatgttgctgatcgacttgaccagcttgatatatatgatgggaaagctgttggtgaaggtaatgaggccgtaaacacaactccagtgcctaagcaggctgctaaaaagggtgcaaaaggagctgacaattcaaagaagaggaaacaatcaaaagattcatctgactcagatgaggatgctgaagaaagtgaggaggatagtgaggatcaaattaatggtgaggctgaggcgaaaaggccacgtggttctggtaaaggccgaggtaagacacccaaaaagtcaggtgctaagggaaaagggtcggtctctggccgtggtcggggtgggactgcagctaataaaaacagttctaaatcccctcaggttcaattgctatacaagataaaaattgaaagctatgttttgaaaggcccgggtatgatttctgttgacaacaaaggactttatttgatcctttggtccattctgacaacagtgtctgaaagtcacatgctaaaacaagatcatttttggtcaaagctcacaattttggagtatgattctgaagtcaagcatgagcatgagaggagggatccaaattccaaaagcatgcagtggataagctttaaacgagatgaggccatgcacatgcaacagcagcagcaacacaaaccttttatgattcactcacttggcacggttgatgcctgcttggacgaaatattttacgaaacaacaacgttgtggctgtctttgttggatcccatgtga

SEQ ID NO: 115728 - DNA, 239 bp, Glycine max
  Peptide Sequence Number=SeqID_232506
tgacccatcaacccagtgccccaactgactcagaccggtttggttccgataacacggattctagtgaaagtgagcagaatgaaattgagtcatcacctgttcgctgtcttgtgtctgaagtaaaacatactgcttgtggtggtgacttcactgtgtggttatcttccattgaaggagcttctatactgactgctgggcttccacagtatgggcagcttgggcatggaacagataatgag

SEQ ID NO: 115729 - DNA, 294 bp, Glycine max
  Peptide Sequence Number=SeqID_232507
atggtggaagcctctggtaatcgattaccagcctgtgtaatcgattacacagaggaatgggtcactgtggttatgagacaaatgatcgtgatggcggcgcagctaatccgtgatcgagtagagatggagtgcctagagggagcttgggagaccctcgaaggcaacacgaggtgccgatttcggggcaccattggattcacggctacttctttggtgcatccagatgaacctgcacggacgcttcagcgcatggtggagtggacagctccttggattagttttgtgtatttttga

SEQ ID NO: 115730 - DNA, 204 bp, Glycine max
  Peptide Sequence Number=SeqID_232508
atgacgggagacaaatcaaaattcacacatatctctcccaagaaaagcggacatgtaacttatggtgacaacaacaaaggtagaattcttggagttggaaaaataggtacaaattcttcaacctccattgaaaatgttctacttgttgaaggtcttaaacatagtctgcttagtgtgagtcaattatgtgacaaaggctatctg

SEQ ID NO: 115731 - DNA, 339 bp, Glycine max
  Peptide Sequence Number=SeqID_232509
atggcatctaagaaaaggagggctccttctacaccttcccaagtcagatttgatctgtctcagttcacatctcaagaagcttgtgagaggtatacaaatattgtggtgcctaggaaactactaccagagaggaatgtgatagtttattacactgagttcgacaagttcaaggaggaacttgagagaagagactacgatgaggagttgactgattttaatgacagcagcatagacattggcattgtgaaggaattttacaccaacctctacgacctcgaggataaatcacctaagcaggtttgcactcctgaggccttatcctcaggagttggctgctaa

SEQ ID NO: 115732 - DNA, 464 bp, Glycine max
  Peptide Sequence Number=SeqID_232510
cacaatggaacttgaaggcagttggaaggggagccttgactacatacaaagacataccaaacttagcaactgcttttgaggaaggacctcaagtcaaagcaatggataccctctggcttggtaacaatgttgttgttcgaccagaacatcccacagttctgaagacaaagatgaagggccaaaagaggaggtttgagcagacaacgatggtgactaacaatggactggccgatgaagtgactggaggtggtccggcgacgttccgacggctggaaggcaacgcgtggctttcacgcaccgagactggcgcgaacttgcggcggcacgtggaggcgcatggctgggattctggccaagcgacttgtaaggacggtgatggctggcggccggcggtggccaaagatggcggcgacgtcggagacaatcagaacgggatcgtacccactctgataccgtcgtgttga

SEQ ID NO: 115733 - DNA, 837 bp, Glycine max
  Peptide Sequence Number=SeqID_232511
atgctgggcagttttgaagtgaccgcgtcgtctgacggtatcattcgccttccggcggacaatctgctgctcaacaccacgccgcagcagatcgccgccgggttggccgagcggcatcaaagcctgtcggtggtcacctcggtcaatgcctatctgatcaataccggcgacaagctggtgatgatcgacagcggcgccggccaactgctgggcgacggcctgggcaagatggtggataatgtgcgcgaggcgggctatcagcctgagcaggtggatgagatctacctgactcatatgcacccggatcacctcggcggcctgacgcacgacggcaaggcggtattccccaatgcggtggtgcgcgccgccagccaggatgcggacttttggctgagcgccgaccggttgaaacaggccaaggcgcagaacaaaggcaatttagaaaaggccatggcggcgatcaagccttaccaggcggcggggcactttaagccgttcaacggcgacggcgagctttcgccgggcatcgccgcctttgccgctcacggccatacgccaggccacagtgtctatcaggtgaccagccagggcaaaaagctgctgttgctgggggatctgatccacgtggcggcggtgcagatgccgcatccgaaggtggctatcagctttgacagcgacgccaaggcggcggtcgctcaacggctgcgggtgttcagcgacagcgcgcggcagaacgagctggtgggcggcgcacacctgtcgttcccgggattgggctacctgaaccgccagggagaagggtacagctgggtgccgctgaattacggcgcgttgtaa

SEQ ID NO: 115734 - DNA, 183 bp, Glycine max
  Peptide Sequence Number=SeqID_232512
atggataccttagagccctacactggggcaatgaaaggcaccatgcataaacctcaagtgaacctaggggaagataagaaattctcacccaataggttccctgctacaaggggggacaaaccctgggatttcaatgcattcattaaacggctccattgccgtcaccccaaaattgtcaagtga

SEQ ID NO: 115735 - DNA, 561 bp, Glycine max
  Peptide Sequence Number=SeqID_232513
atgcaatctcaaggacttgcactgcctcccgagcctctggttagtccttccgatcctcaagtgagcacaaaggggagttgtgttaatccctcaagaaacgatcctgagacagcagatcctgcccgcctggttgccctagggagagtttatgagggatccactgttgttcataacactcctttgtttcctggccaagtaaaggtgggtgtggaggaggttacagatgcagatgctccagttcctgtacccactgatgaggtttccttagtggggcaggcacttcacaccttccttgcttggccgacacatctggtcaagtctttatcacagcaggtagctgtctctccggcaaaaccacctccaaagcccgatccggaggtcgatgatccgctttatctgatgacattaaccatcccagagcttttcttgaggccttatcaggttacatgggatggcaccgtgttcggggtctttaatccagatttcccgctctacataaagcacgaagacctctccgaaatcgcacacggtggtcaatgtctcagcatatcagtgttatag

SEQ ID NO: 115736 - DNA, 200 bp, Glycine max
  Peptide Sequence Number=SeqID_232514
aatgtttatacggataaccactcgggtatttccgcccgtcagcatgactcaaaagtcagtatgacagatcttgtaagtgtggaagatgatgtaaatctcctcgtgtcaacgggcttgtcggtcgcgattgacgaagggtgcagaatgaccacattggccgctgcttgtcatcgggcccgccgcctctggatgacaaaagg

SEQ ID NO: 115737 - DNA, 426 bp, Glycine max
  Peptide Sequence Number=SeqID_232515
atggccaccaaggagaagaacccggagttcatggcacctgagctgtatgatgaaaattacaatgaattagctgacatatattcatttggtatgtgcatactggagttggtgacttctgaatatccttatagtgaatgtagaaactcagctcagatatacaagaaagtttcatctgatattgttcttcccaaatttggagcctttgaaagtcgttgtatgctatcagaaggtcgtgcaagtgcacataaaggagacatttcaatgggtcttggtgacaccagacgagcgagaaatatccatttcatattctatcttgagagtgatggtgctgtctcgatatcaagtgaaacggttgagcaacttgaacttgctggccataatgttaaattcatagctgagttaatagatttgttattgatctcttga

SEQ ID NO: 115738 - DNA, 282 bp, Glycine max
  Peptide Sequence Number=SeqID_232516
atgccattatttgttgaaagtttgacacctaacgaactgtcgtctattattattgattttgattctgaagggcatttggagccccctgatcctgatgtccttgacattgatccaacttgtcgctacatcaagattgacgaggtgttaaagtcaccggctgacttagagagacggtactcagaagtgcatctcctgagttcattaaagcacaataacgcagtcaggttctacaattcctggattttgatgacaagcgcaagacgagttgtttacttcgggtag

SEQ ID NO: 115739 - DNA, 126 bp, Glycine max
  Peptide Sequence Number=SeqID_232517
atgaggtgggaaaaggttgctgctgcggttcccgggagatccaaggctgcttgcatgaaaagattcgccgaattgaagaaagggtttcggactgcaaaagctgcagccgagctttcagcttggtga

SEQ ID NO: 115740 - DNA, 146 bp, Glycine max
  Peptide Sequence Number=SeqID_232518
ggatagggatagggatagttgctccaatctgttaccccatacgcattccgcaacttttgaagccccatattgtaatttccaaacttgaattaggggaatgtttcatgaggactaacgtagggttaggttacatgtatctgaattga

SEQ ID NO: 115741 - DNA, 360 bp, Glycine max
  Peptide Sequence Number=SeqID_232519
atgactgagacgcttgaagccggtggattctttcccattagaaagtctcaagatgctgctgttggtgtgcttgtacatatgctgaaaaaagcaccacctctacgtcaagatttctccacctcacaacacctgtcacaaggttcacaccctgaaacccggaaccataacactcgagggcccaatcagatccttgagccatcaaggcctgtgagcataatgtcttctgggatcatagccactaggaaaacaacagctgatgcattggaagagttccatggttacaaagaaatgaaaaacttgctgcttacgcgaggtagtctgagctggctggctggcatggtacagccttatattgtgtaa

SEQ ID NO: 115742 - DNA, 1499 bp, Glycine max
  Peptide Sequence Number=SeqID_232520
atggcatcgtctcatggtaatgcacactcggatgccgcgaagatggaacaaataatcaccgagttcttcgcgaagagccttcacataatacttgaatcaagggcactctatgtgtcctcccgtaattcctatggtgatcaagctgtttcgtcaccgtgttcgtcgtcttcgtcttcatcaaatgtgcgaccgagggataagtggttcaatttggcgctccgggagtgccccgcggcgttggagaacattgacctctggcgccagaacaatctagagtgcatagtgattgatgtgattttggtgcagaggcctctggtgagtgtgagtttttctcccaaaagggttattcctaggagttcttcactgaaggaaagatgcccttttggctggaacactgatcaggaagaattgggggttgtgggaaggagtgaaaagattgtggagaggtgggttgtgcagtatgagagtaggaagacaagggattctaattctggcagtaggaggtcaagcaatgtttctttgcataacttgtataagaaatcaactttgcttctgaggtctttgtatgtcactgttagacttttacctgcatataaacttttcagagagcttaattcgtctggacagattagggacttcacccttgctcaccgtgtgtcttcttttgttgagcccttcacccggaaagaagaggctgaaatgacgaaattcgggttcacccctgtggatacttcttctggtaggctgtgtcttagtgtgatgtattgttccttagcctcagatgtgagttctgaaccttcaactccaatgtccccacaagttataactgactatgttgggagtccattggctgatccattaaggaggtttccttctcatctcgtggcaggattgccatcacatggctctccatcatcgttgccatcttcaaggcagcgtagttggagtttcgatcattatagagcctcacctccttcttatttaccttcgcctactcattcagaatcactctcatcagtgtataatgcaagtttgcctcctcatccaactgagatgtctatgattcagaagaagaatacaaactttgaggattatcatcactttgcatcaccttcaatctctaattctgggccatttccatgcaaaccacttttacgatctgaaagtgctccagtcagcatacctattgctgaaattgctaattcccctggatactccaatagtcataatgtgcctccatctcctcccctaagaggttcaaggggcactgctaagattgatagaaacacaatgcaaacaggagcaacagctgagaagttgttttctcttggaaaagatgagtctcgaaaatattctggagtcaagatatctgctaacagctcgccccagatttcaatttccagaagctccagtaggtcttatcagaatgattttgatgatactgattttacttgtccatttgatgtggatgatgatgatatgacagatccaggaagcag

SEQ ID NO: 115743 - DNA, 624 bp, Glycine max
  Peptide Sequence Number=SeqID_232521
atgaaccgtatctacagacgtgtgtggaatcgagcccgccaatgctgggttgtttccagcgaactggcgtcgagcgcaggtaagccgcggtcaacggctgcgggcgcagtgttgcttgggcttgttcttgcggttccctcagcagaagctggcgacatcattgcggctgatgagtgcgatgaatccatctggcaggcgctgtgcttgaactcggaggtgcgcgcaggatcttcttccgcatactcgctgttctcagctacgccacgtgcgggcatcaatgcgctggaacttggctatcaagcgaaagccaatggctatggcagttcggccgtgggtccggaggcgagatccgagaacttctactccgctgcgttcggctggagggcgcttgccggtgaacactacagcgtcgctgtgggtgccaacgctcaggcagggggggggtcggccatagcgatgggtaacgattcaaacgcatccgcctcgagcgcagttgcgattggccgacaggccaactccagtgggaagtcgtctgtcgcgcttggagcttcgcccattgcatcagcagatatcgctcccgccctggggtatctgagccagtcaacggcaaattacgagtctgcg

SEQ ID NO: 115744 - DNA, 696 bp, Glycine max
  Peptide Sequence Number=SeqID_232522
atgtatgcctcaagttcctttacttcacaactagtccatgaccttctcgtggacacaaactcaagaaagctactccttcaagatccacttcttcaccaatcaatgaactcggccaactccccagattccatgagttacaacacaacagactcatacttcacaggtcgtgatttcgatgcaaatgttgtcatgatactctcagtgctgttatgtgctgttatttgctcactcgggttgaactccatcataaagtgtgtcttgaggtgttcaaacatagtcatcaataataatgacccttcttcttcttcaagtagtgcgagctacaacccttcaccaagattggccaacagaggaatcaagaagaaagccctcaagacttttcctactgtgagctactcaacagagatgaaactccccggtttggacacagagtgtgtgatatgcctctcggagtttgccaatggtgataaggttcgcattttgccaaagtgcaaccatggtttccacgtttgctgcattgacaagtggctaagttcacactcatcatgccccaagtgcagacagtgcctcattgagacttgcaagaaaattgttggatcccaaatacaaccagtggcaccagtgccagaaacaattataaggattcaaccactagaacctgaaggtttggagcgtaactatagggaagtatgctag

SEQ ID NO: 115745 - DNA, 870 bp, Glycine max
  Peptide Sequence Number=SeqID_232523
atggataacattttaggaagacacatcttacctgagaggaaggtggaaatataccacactgagctggacaagtttaaggctgaattggagaggcgtaacttccataaacgcctcaccaatttagttgacaacaacatagacttagctttagtgaaggagttttatgctaacctttacaggtctgaagaccctccaccaaagcatgccaaggtcagaggccacctggtgaagattgatgcagacaacctcaacacattcttggagacacctgtgatattagttgagggtgagactttaccagcatattctagatattgtaggttgctcacaaattataaagagattgaggctgccttatgtataccaggccgagggtttgttttgaactctgagggccatcctgggaagattctcaggaacgatttgatgactcttgctcaggtgtggagtgttctttcatattccaacctggctcctacttcacacacctcagacctgatagtagatagagctaggatgatctttggcctagtctctcagatggacatgaatgtgggagcccttatctctggccagatcacatctatagcccaatctaactcttctagacttgggttccctgctctgatcaccgtcctgtgtaaggacagaggggttacttctgacagcttggttttcgagcgcctgagcccggtcatcaacttggcctatatcaagaaaaacaattggaatcctgatgatctaacagtttctatcagaggggctaggcaggcaaggatgaggccagctgagcctccttccacatctacaactcctattccagcacgtacctcagtagctcattttgttctagcttatgcagatttttag

SEQ ID NO: 115746 - DNA, 915 bp, Glycine max
  Peptide Sequence Number=SeqID_232524
atgatcgatgaattccaggataccgatccgcagcaataccgcattttccaaaaactttacgtcggccggcccgattgcggcctgctgttgatcggcgatcccaagcaggcgatttacgccttccgcggtgccgacatctttacctacatgcgggcgcgctcagaggtgagcgcccactatacgctggagaccaactggcgctcgtcgccgtcgatggtcgccagcgtcaatcacctgttttctcaggtagaaaagcctttcctgttcggccaaatcccctttatcgaggtcagcgcggcggaaaagaaccaagggttggcgtttgacctgcacggcaagccgcaaccggcgatgcagttctggctgcagcagggggaaggcgccggtgtaagtgattaccaacagttgatggcgcgcctgtgcgccacgcaaattcgcgactggctcagcgccgggcagcagggccaggcgtggctgcagggcggcaaggagccaaggccggtgcaagcctccgatatcacggtgctggtgcgcagccgcaatgaggcggcgctggtgcgcgatgcgctgagcgcgctgtccattccgtcggtctacctgtctaaccgcgacagcgtgttcgacaccccggaggccaaagacctgctgtggttgctgcaggcggtgttggcgccggagcaggagcgcacgctgcgcagcgccatggccaccgggctgatggggctggacgcgccgacgctggacggcctgagccgcgatgagcgtgcctgggacgagctggttaacgaattcgatgattaccgcacgctctggctgcgccgcggcgtgctgccgatgctgagcgaggtgatgaaagcgcgccagctggcggagaacctgctggccagcgccggtggcgagcgtcgtttgaccgac

SEQ ID NO: 115747 - DNA, 288 bp, Glycine max
  Peptide Sequence Number=SeqID_232525
atggggagctcgaaagacctatctgtcctcctcactcaagctgccattccttctccctttcttcctcatcgctcaggctcgaaagacctgtatgtcctcctcactcaagcggccattgaggttttagacattgttttggttcttggttggtgggttcgtgagttcatgagttggtgggtttgcgagttcctaagttggtgggttcgtgagttcgtgagttggtgggttcgcgggtttatgagttcattatttcgtaggttgctctctttggcacttttgattctgtaa

SEQ ID NO: 115748 - DNA, 171 bp, Glycine max
  Peptide Sequence Number=SeqID_232526
atgactcaaagtttgaacaaaggattttctatgggaattccagatggagcttcctcagaagttttatgtttggctcttgatgtctttgaaggttacttcctcattgacatcttttgtcttaaatggactggccatgacaagtttatccctgttgtctttgacctttggtag

SEQ ID NO: 115749 - DNA, 642 bp, Glycine max
  Peptide Sequence Number=SeqID_232527
atgggcgtgacgaaggaacaagttgaattatccttgaaggccaaactgaacccttctcaccttgaaaagaaaacaagaaggaaattgaaggtggagcttggagttgatgacaacggaataacaagtggagatgtagcagctctattgggaggaagagagttagcatgggaatgctcaaactcaaactcaaactcaaagaaccccatttgcactatgcaaattatgatgattgtggatgagaaagaaacccttgcatcccaaggcaagtacaaaagcatcccacaaacccactgcatactgacttatcccattgtgctgcatacttggcaagatggcacagggcatatccaaatctgtaacatgtaccagatagtattgcgaattcttaagccaccagaattgatctctttggctgtctggtttcttttgactgggttttactgctttgctccttttaatgagcttaagtattttttgttccaagttatttccttatcttctttctttggtgtatctgcggcaacaagtttgataccttgtgcgaaatattcaaaccctcaccacttggccaaccttagtgggttggttatttccatatctgactgcaaccattttgtagatatcaaagagttgctgacataa

SEQ ID NO: 115750 - DNA, 666 bp, Glycine max
  Peptide Sequence Number=SeqID_232528
atggtcactaagctagttcagccaccaatgacagattcccatgtgagtcctcttatttgtagaaccatgaatgccatgaaactccaaaattttgttccatctagaaatcattcaagaataaacacttcaagatttggtgagagaccattatggtttagacccattacaatcattaaagttgcagaacacaatcctggctcaggcttagctgagcttgaaacacttgctcagaagaaaagagagctttgccaggcggtggaagagtggcaaaaaaacatgtttcaaggaatcaacaggggaatttttggaatcccagctaccaagaaatctgaaattgaaagattggtgaagcagatagaatctctgaatccaactccatgcccaactctagaactggagaaggtggctgggtgctggaggcttgtttacagtacgatctcaattttgggatcaaagaggaccaaattaggcctcagagacttcatctcattggatgatttttttcagacgattgacatatccaagagcaaagcagttaatgtgataaagttcagtgcaatgggattgagtttgttgtctggacagcttaatattgaagcctctttcaggattgcttcctcaacagttaaaactccacttcttgtttggtcgcttatttctctgtaa

SEQ ID NO: 115751 - DNA, 624 bp, Glycine max
  Peptide Sequence Number=SeqID_232529
atgatgatgacctcaaaccatattccctacactggagcagccatcattcacagtgttgataacgaatatgatgatggcctcccaatgaatatgaagtacgaccttactggggtatgcaatggtttgatctgtttgagagcggagactcttaaagatggattttacttaacctgggtccggttttggaaccctgatacgaggttaatatccaaaaaatcaccatgtatacagtttcaaattcagaccccaagacgtggttgtaagatgatgggcttcggttcaagagacacttacaaagtggttacagtggttgtggattgggaatcaatgaaaacgaattctaaagtttggagttgtagagttttgaacgccgttgctgaatgtgttacatataaccatcatcctgatttcttccgttcattctgtcttggggtggtcttcccattgagcatgtctgaaaatggcgatcttgtgtttctgggaagtaaatgtaaaccaggtcctttaatttttacgtatcaccagagagataacatcgtagagcatagtaagatttaccaccaaagagtttggttggattccactgattatgttcaaagtttggttttgccttatcgtaactga

SEQ ID NO: 115752 - DNA, 1068 bp, Glycine max
  Peptide Sequence Number=SeqID_232530
atgagtttcacatttaagaatgaagataaaaggggttccacagaaaatgagaaaaacaaagttgaggagtctgtgaaagaagaagtgttagaggtcaagaaacctgcggaagatactaaaagcaatgagccaacagttaaacaagaatctctaaagccagaggagaagctgtccgaggagagtaaaaacaatgaatcatcaaaacaagaatacgagactttgaaggcagaaactcatgtcaatgaaccatctaaggaaacagtgaaacgagagtcagaagctgagaaaccttcagaggaaactcatatcagtgaaccagttaaggaaacagagaaactagagtcagagactgagaaaccttcagtggaaactcatatcagtgaagcagctaaggaaactgtgaaactagaatcaaaagctgagaaaccttcagaggaaactcatatcaatgaaccagacaagaaaacagtgatagttgagtcagaagctaagaaaccttctgaggaaactcatatcaatgaaccagttaaggaaacagtgatagtagaagctgagaaaccttctgaggaaactcatatcaatgaaccagctaaggaaataatgatagtagagtcagaagctgagaacccttcaaaggaaactcttgtcaatgaaccagctaaggaaacagtgaaactagagtcagatgctgagaagccttcagaggaaaacaatcaaagcagcgagtcactgaaagaagaatttgtagaggccatggaggcaccttcagaggaaacacaaagcattgaacccatcaaactcaaagaagagcctattgaaccatcagaagaaggtaagccaagtggggaatcagagaagaatgcttcagaaactaagactctcattgtagagagcataaactctgaggtggctcctgtgcctgaggagagagtaattgaagaaattccaactgctgccaagtcttttgagaaggtaacaaaggaagctgcatcaagcacagaagagaaaagccataatggggtggagaatgcacctaaggctgttgatgctggcgctgagattcactaa

SEQ ID NO: 115753 - DNA, 450 bp, Glycine max
  Peptide Sequence Number=SeqID_232531
atgaaaaagtccatgttgtacgtagacacgatagaagatttgaaagtaaagagtgcccgcggagttgctaagttggttggtgtagtggcatgcttcactggatcagcaatccttgctttctttaaaggtcctcatttggaacttttaagccattatcaccttttagggtaccataaaaaccaacaacatctgggtcgtgttgcatctgggtcatggataaagggttgcttcctcttgctcctctccaacaccttttggggaatgtggcttgtgctacagacttatgtcataaaagagtatccttcaaagctgctcctcacgactcttcagtgtttcttaagctcgattcagtctttgagcattgccttggccgtagaaagagatattgaccaatggaagttggggtggaacgtcagactcctcgccgtagcgtattgtgtaatcctctaa

SEQ ID NO: 115754 - DNA, 172 bp, Glycine max
  Peptide Sequence Number=SeqID_232532
atggctcttttaggcgatgacaaaaagtttggttcccaacaaaacactcactatcctaagaaaaaatggcctaaaattattacacacaaatggaagtttggtaacctattggaggctcccaacacacttccaatgaaaggcctttttgttacaaaacttgaaagcaatgaag

SEQ ID NO: 115755 - DNA, 366 bp, Glycine max
  Peptide Sequence Number=SeqID_232533
atgggtgtccctttcaagcttcgtggcaagccagtggttgggggacaaggttggacggtgaagttgatttgtgtgattcataatcatgaattggtcaagtcattagttggacatccatatgtcgggcgattgagtaaagctgaaaagacacttattgctgatatgatgaagtcaatggtcaaaccaaaaaacattctgctgactctgaaggagcacaatgccaatagttacaatacctacaaaacaaataggtacagactctcactgcttgattttgttgggataacaccaactgggatgacattctttgccagttttgcatatttggagggtgaacgtctaaataatgtggtttgggctttataa

SEQ ID NO: 115756 - DNA, 999 bp, Glycine max
  Peptide Sequence Number=SeqID_232534
atgatgggagtatatcctcattgcatactgtctggcaccagtattgactttgaactcatcaaagagctagtggagttcagtggtatgaaggatgatcaaatcacagattgcgtagttgtatcagatttccattctctgacaaagctcgaggtcgaacagtatgctagacaatttttacaagaccatcaagtcgatcaattggatgctgttgtatcaagaatttcagactttgaattatgtcatggaagaccatgttttatatcgtatattctgggcacatatatgaaatcaaatgatattgacgctgcgattggcaaatttatcactgggatatctaatgttgatgaccagattttcccgcttagattcttgaaaaatgaccttgatggaggcattcgttcatttgacataactggaaatgacgctgctactgcaatacgttacggtttgggatttgttcagactgtcgatggaactatatcttccattgaaattcaagagttggctgtaatcgagtgtctttgctactttttgccctttgcacacactgtcaaaagtttataccaaagaattggcttgtatcctaaccctaaccctcaaacggttggctatttggtggaatacttggttgcgtttgctttagtagccaactattctggttctgatgctgccaatagtatcaaggcatcccgagattctgcatccagctatttactatttggtgattcagatcaagtatactttcccaatcatatgtgtggaccagatatcatctacaagtgtgccaatacaaagactgtatacattgtccaaatcaaacttgtcaagaaaatgtcaaaacaacaagctgcaaacgcttacaatactacagttcctgaacgcttttattgcaaacgtaatggcggtggagtgttgaaagggtttgaagaaaaacgaactcaccttcttagcactttgtcgaaactacacaaatcaggctactcattgcaacagactctg

SEQ ID NO: 115757 - DNA, 595 bp, Glycine max
  Peptide Sequence Number=SeqID_232535
gatcccacttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaaggaaaccaccggagccgtagcgaaagcgagtctttcacagggcaattgtcactgcttatggacccgaacatgggtgatctatcccatgaccaggatgaagcttgggtgaaactaagtggaggtcccgaaccgactgatgttgaagaatcagcggatgagttgtggttaggggtgaaatga

SEQ ID NO: 115758 - DNA, 432 bp, Glycine max
  Peptide Sequence Number=SeqID_232536
atgtctagtaggtgtgcagcatgcaagaatcaaacaagaaaatgctcttcagattgcattttctttccatattttcctgccaatgatcctcagagatttgcttgtgttcacagaatctatggtggcagcaatgttggaaaaatgcttcagcaaattccaccatacttacgtgaacaagctgcaaatactttgtattttgaagcacaacgtaggattcaggaccctgtttatggatgtactgggattatctctaaattatatgaacaaatcaacaacactgaaattgcacttgcgcatatccaaactcaaattgcttgtctcaagcttcaagtcccacaggaaaaagctgagtcaaacttcaatgtcttgcgagcacaaagcagcggcacaacagagtttcaatggcaaagtcaagtttgttggtttaattaa

SEQ ID NO: 115759 - DNA, 273 bp, Glycine max
  Peptide Sequence Number=SeqID_232537
atgaccaaccatgaggccaaggtgtcctcccctctaccaccaaacattgacctcttaaccaccataatgtcgtttcaatcagaccaacccagtcgcgatagtggtgcaaccgtcagaatcggtttgggccttgacaggctccccatcaattcggaggattctaccagagaaattactgttattgaaagcgaacccaaaatcggcatcagaagaggaaacattgtgagagtaatcggaggaggaagaatccatcaccgttctcgagtcgaatag

SEQ ID NO: 115760 - DNA, 363 bp, Glycine max
  Peptide Sequence Number=SeqID_232538
atggtggcgatgatagggaggcgcaggagatgcgaagggaaagattatttgggatcaaacgcaaaagtttggtatatatcaaggattaaaagcaaaagccagtgttggttctatcggcatgtttcgattaaggccacgctttttgagtgggagagaaatattgaactggtgtttagttcttataacttcttggaggaggatgagattaaactagcaatttataaatccattgattatgctagtatttggtgggatcaatttgtaagtagtatgcgtagatgtgaagaaaagtctactgatacatgggatgagatgaaggttgtcatgagaaagaggttcataccaaattaccaaagggattag

SEQ ID NO: 115761 - DNA, 231 bp, Glycine max
  Peptide Sequence Number=SeqID_232539
atgcagtatctaggaagtgatcctaggtcgtctcccaaatttaatattaataacaaaaccttaaagagagctatgcttaatcctcaagagaaaacaacactagagattcagccttccattaacaacaaaaatgaaactgaaactgaaatcaaaagcagaaaaagaaactggaatttgaagcagaaaacaaaactggaattctacgtaaacagtaccatgcgtgaacagtaa

SEQ ID NO: 115762 - DNA, 231 bp, Glycine max
  Peptide Sequence Number=SeqID_232540
atgggtgctagaaaaaaaaaggtagtaccttcatcgacgattgtgggggtggctattgttgttgaacaacaaatggtggaactaatgcataccccaagccttagcacgcttgcttggcctgggcaaccaataaaaaagaggttgcaaaaggttattggtgaatttaagggtgtcaaagaattcaaatcctccgcagttgcctttcaaagtgcatggatctttacccattaa

SEQ ID NO: 115763 - DNA, 462 bp, Glycine max
  Peptide Sequence Number=SeqID_232541
atgcaatactatgacaatacgctagaagcggtgatcctgcccatgcaactctgcttcctcaaaggaaatagtccattacatcaaccatatcatcatccttcttactccatcctcgtctccggggacccccgcgggtcctacccccgtctcaaagtcaggctcatctccgggccatgcaaccgtggcaccaaacaactcgggggtaggccacgggaaaggactgaggtcccggctctactggtgcagggtttaccggtagaagctctcattcagctgcacctgacccctgtgattagccgcctactagctagtcacatgttgcacatacgtgtgcatctggagctctatcctccgcaggtggtgatggcgcatgtgtggctagttgctactggtcctcctcctgctgctgttgtgcttaaccttgctgatgtgcctgcctgggcatgcaatatttctctatga

SEQ ID NO: 115764 - DNA, 291 bp, Glycine max
  Peptide Sequence Number=SeqID_232542
atggagcggacaggaaagggggtgtttaaagaagagagagagagtcaaagggaagtgaagtgtgctgtgctccgagaagggatggtgggcgttggattggagtgggggaagatggagggttgggatggaaagggctgtcacacggagggttccatcggtcggattgattgcatcatccgtaagttgggggagtccaacattgtacaacgacaagcagctgccacctccaacctcaagtggggtaaagtcactgccttttcagcgctaccccattttatatttccaaaataa

SEQ ID NO: 115765 - DNA, 219 bp, Glycine max
  Peptide Sequence Number=SeqID_232543
atggagaaaattatgcgagcgacgtggggcagcctatgtctgtacgtcgtgatcttgtcgggagcgtcaggcggcccctacccgatagtaactaacattacgatcgaacctgattcacctacttcctggacttatcatttcgaacaacaagtcgtggagtccgcggctgcgggactcgccgatccctttcaatcaaatggccttggggcacaaacatag

SEQ ID NO: 115766 - DNA, 427 bp, Glycine max
  Peptide Sequence Number=SeqID_232544
gtttgatgcagatttgcttactaaaggagtggtaagtgagggtgaaggtgagagtgagaagtggagattgaggaatgagaagattgataaattcaaggactcaccgcttgggaggattccagaggagtgggaagtggtaaggttaggagaaacaggcagaattgtatcaggtgctactccagatacttctaagcctcaattttggaatgttttaaaagctcttgaaaatattggtgaagctgttaagcagattccggatgataaaagagagctttatccaatagaatggaagaaaatcgctggtttaagggatattcttattcatgagtattttggaatagatgctgaaataatctgggaggttatcaaaaagaagctgccggaacttgaaaaggcagtaaaattccttcttgaaaaggagagttaa

SEQ ID NO: 115767 - DNA, 424 bp, Glycine max
  Peptide Sequence Number=SeqID_232545
atgggtttaggccaaaatggtgatggcatggccagcttggtgaggtttgttgaaaaccgtggaagggtccctatctgccacattagcaaaaactttgttagcgcggggtggatgcatgagaatcaagttggtatgctggatgaagaaaccgaccaagagcaaccaaaatgggtcgctagtatcgtgccaatcccgaaaaaggatgtgaaggtgcgaatgtgcgtggactatcaggatcaaaaccgagccagtccaaaggataaatttcctttgccacacatcgatgttcttgtagataacacaaccagttttttccctattctctttcatggatggattttcggattacaatcagataaagatggcaccggaagatatggaaaagacaaccttcatcactctatggggaaccttttgcttcaag

SEQ ID NO: 115768 - DNA, 303 bp, Glycine max
  Peptide Sequence Number=SeqID_232546
atgtcgcaacctacacttcggcgggggcgcgaaaaggccgacatcatgggccaaggcattctcctcagagggagaaaacgagcagagtcgccaccagcgtttattcgaggaaaacgtcggaaaaaccaaaaaaacaaagaggtgtcgcaacctacccttcggcaagagggtggcgcgagacccatgggtgcgtcttccataggaggaaaatgcgcggagtcgccaccaacgtttattcaaggaaaacgtcagaaaaactggaatgtgtggtctacaaactttacgaaggacggcagcctttaa

SEQ ID NO: 115769 - DNA, 147 bp, Glycine max
  Peptide Sequence Number=SeqID_232547
atggggtctcggtggcgcaaatttgaagggttggattctgaatcaagggaggaatggacaatcttctcgtttttgattcaggcggctggtgaacaaagaagctcactcccccctttttcaacttatataggatatataggaagctaa

SEQ ID NO: 115770 - DNA, 960 bp, Glycine max
  Peptide Sequence Number=SeqID_232548
atgaagtacctgttggtgacgggtggagttgtgagtggacttgggaaaggagtcactgcaagcagtattggagtactccttcaggcttgtggctttcgggttacttctatcaagattgatccctatctgaacactgatgcagggacaatgtctccttttgagcatggggaagtgtttgttttagatgatggcggtgaggttgaccttgatcttggaaactatgaacgtttcttggacctcaaattaactcgtgacaataatatcacaactgggaaaatatatcagtctgtaattgaaaaggagagaagaggagattatcttggcaagactgtgcaggttgttccacacattactgatgccatccaagaatggatagagcgtgtggcacagataccagttgatggaaaagaaggcccagctgatgtttgtgttattgagttgggtggaactattggagatatcgagtctatgccttttattgaagcacttggccagttttcataccgtgttggccctggtaacttctgtttagttcatgtcagcttggtgcctgttatcaatgttgttggtgagcagaaaacaaagccaacccaacacagtgtccgccaacttagagggttagggttgaccccaaatcttcttgcttgtcgcagttcaaaggaacttgatgacaacattaaggaaaaactttctcaattttgtcatgttccgtcatcaagcatactaactctctatgatgttccaaatatttggcacattcctttgctattaagtgaccaaaaggcgcatgatgcaatcctgaaaacattaaacctgcgaggtgttgctacagagcctaattttaaggagtggattacaacaacaaaagtatatgacaaatttcatgaaatggttagaattgcaatggtgggaaaatatactaacctctcagatgcatatctttctgtactgaaggcatga

SEQ ID NO: 115771 - DNA, 339 bp, Glycine max
  Peptide Sequence Number=SeqID_232549
atgacgaacgaagaacatcgaatgaagaacgatatagaagttgattacagtcgtgattcggtagcgcctccaaaaaagggcacttggggacttgcagctcgcccaggcgagctgttgcttcactttgaagtaaactgcctcacccaagcgagctgcagctcgcctaggctagctagttccttcacccttaagcaatttgggagcccaggcgagctagaggctagcctgggcgagttagaggctagcttaggcgagccagggtctagaaaactccctgaaatgacccttttgcccctccctttcggtatcttttgcactcttgatcaaaacattcaatga

SEQ ID NO: 115772 - DNA, 3078 bp, Glycine max
  Peptide Sequence Number=SeqID_232550
atggacgcggatctgaaatcggcgaaggcggcgtaccggaatgccaaggcggagggaaaccaccgggaggaggcgcggtgggccaacgtcatcggcgacatactcaaaaaccgaggagagtacgtccaagccctcaaatggctccgaaccgattacgacgtttcgctcaaacatttacccgaaaaacatttgctcccaacttgtcaatccctcggcgaaatgtatctccgcctcgaacacttctccgatgccctaatttatcagaaaaagcacttagagcttgcgagagacgctgacgacgtcgttgagcagcagcgggcgagcacgcaactcggtcgcacttaccacgagctcttctcgcgatcggagcacgaccacaactcgattcgcaatgcgaagaagtacttcaagtccgcgatggatctcgcggtgaagctcaaggagaatcctcccaacagcaagtcctcttttctcaaggagtacatcgacgcgcacaacaacataggcatgctggagatggatctcgacaacttgcatgaggcgcggaagattttaactagaggattggagatttgtgaggaagaggaggtcgctgaattcgatgatggccgcagtagactccaccacaaccttgggaatgtgtatatggaacttagggattgggataaagctaggaaacacattaagacggatattgtgatttgtaacagaattggacatgttcaaggggaagccaaggggtatattaatcttggtgaagtgcattacaggactcagaagtatgaagatgcaagtgcttattacttgaaggcgcttggtttggcaaagagcttggaggatgaggatgctttggtaaggcaaatcgagcagaatattaaaattgtgagagaagctgttaaggtaatggctgatataaagaaaaatgagcagagccttaagaagctcaaaagagatatagccactgccagagggacaccaaatgagcgcaaattcttgctgcagcagaatgcagttcttgagcgcctggttgagaaagcaaggatgatctctgcgtgggagaagagactttttgaagctaagcattgtgaatttgcaaaggagaagaagagaatagcaagtgaactctgtgataggcagagactggctgattcatatctggatgttgcagaatcataccagaaactcagaaaattcaacaaagcaatcaagtggtacaaaaagagttgggaaatgtacaaaaatattggtaacttagaggggcaagcaatggtgaaaattaatattggtaatgtttacgattctactgaaaattggagaaaagcattggatgcatttcaagagagctacagtatcgcagttgaagcagaccttcctgatgtgcaactctctgccttggaaaatatgcattatagcaacatgataagatttgatgatgaggatgaaaccaggaggttgaagcttctaatcgataaactgaagaaatcagaagaaaaagaggcagaagctaaaagtatgccggaggatttttgctctgaaactgataccgaagcagatgattatctgtcaaacagtgggtctgatgatttatgctttccaaagacaacttctcgatcaaaaactctaactactggagaagaaatgaaaaatgacatgcctctcatgtcagtctatcagtccataaaaggctcatccaaaaagaaagcaggccacaaagaaagtcttaccaactctaccaagcaagatgagcagtcacccagtagtctgaaaaatcaaaccagtgatcatcagacggttgttagtcgtaaacgtgtccgtgtaattctttctgatgatgacgatgatgatgaggaagtggagtgttcaagcagaaagaatcatcattgcccagtagaggacttgcccacttatgatgccattaagactaaagccagtccttgtaaaattcagtttatctcagagaatggatccaagtgtacaataaatgttgaagaaagcagttgttcttacaaatgttcaagtccacatacagccacaaaaactggcagacactccaggtctttgagcaatgatatagttgctgaacctgattttcgtattggctctaaatgtggtactgatgtctctggcaaacaaaacgatatttcccagcccatgttgcatcattcccaaaatgacctccagcaatatattacatgccggattgggaatgatctaatacatgtagaaacaaccttgtgtgccactggtgatcagttgaacattgactctttgaaggctgcagttgcatgcttatattatctacaatttccaactgaaaagagatcagagggtttgttgcccattattgagcatataaaatgtgctggaagagatttaaaatccctggaaactgttgaacacctgaaggaagttctgggaaatagcatggttgaagcttctgttgatggatggattcacaagtgcctgataaaaatgtatgtagacggctgcaaggagttgtctgaggtaccaaacatcaaggtactgaagaagctttacaatttagaggtttcagatgatgaaattgctgtgtctgactgtgacctgcaagatttgtctattacaccattgataaatgcactgcattcccaaaagtcatttgcaatgcttgatctctctcacaatttgttagattgtgcagtatttgccttgtcatcaaattgtctagtagttgccttttcttttggaaatggaacaatcgaaaaacttcaaaaggtgttcacagcatcaggacaatcttatggtgggttaactctggatttgcattgcaatcgatttggcccaacagcattgtttcagatttgtgaatgttcactgctatttgctcgactagaagtgcttaacatttctggaaaccgtcttactgatgcatgtggatcttatctttcaacaatcttaaaaaactgtacagaatggtgtggtggattttttgccaaccgccatagagaatttgtgaagggagacctgccatgtcagtgccataggcctcaatggcatgtttatatggccgaattttggccttgtgccatctgtcgttga

SEQ ID NO: 115773 - DNA, 351 bp, Glycine max
  Peptide Sequence Number=SeqID_232551
atgacaactagtaagaacttgactattcatggggcttttggcagtggtcctagtatgtccatcccccacatggagaaaggccaaggggagcttaagctatggagattgttagaaggagtgcatggaatgtttgcaaaactcttggcatcgtctggatctcctagtgaagtcgagggtgttggccctgagtgttggccaatagtattcagcacataccactttggttgcaagggagggtcccttggtatggaagccgcagatcccttcatcaagttctcgaacttggagtgtctcctagatgacagtcttgagattcccgatctttttggtattggccagcttgtaaagtag

SEQ ID NO: 115774 - DNA, 1791 bp, Glycine max
  Peptide Sequence Number=SeqID_232552
atgtctttcatctctgactttgccataagtatgggaggtagtgactacgggggttcaattcagcaacccttggtgaagcgagaggttattcccatcggtggctcctctttggaaaggacatgccaagaagcttatgataatgagtcttcttcctctgagaggttggtggactcgcatcgagttggcagaggttcttctcaccttcgtaggagggcacgaccttctattgcctctctggatggggaaccttttctagtcaccacgatccttcccccttctacttctgggggagcgagaaggagtcgtggcgaggatcctttgtccccttccaccgttgctggctatgagtgggtaacgaacgatgtgttgaaatatcggtcttccattacctctgtggcgagcgtcgctgctttggagcgtcaactgaggttggccaacccagaaaactcctgtaagatggctgtccaggcttgcgagagtgatgattttacctttttgagggctgtgtcgggttgcccacccttcttttttatgtaccactatctctatgatgttgtgggtctggtggtttcatcttctcctcctactatggttgttgcctcgatccctttggccagtcttgttgtggctcctcctcccaccattgttgtgccctggttgagtgctagtgtgacaaccataagtgctctaggaatgtcccctccttcttcttttgcttcaccaatcacgtttacacttctcgtgatactaatccaatgtggagcatgggatataggagggactagagaactccaattggctttgtgtcttcttttgacaagaatcttattcggtcagttgggctttaaaatgccattgactctgcaaagggccactactcggactgtttggagagtggagcatcccaaggttgctaatgccactattgcctttgttgaggccgtcaagtctaaccatcagttgtcgtcgaaggttggtgatgttcttgccaagctactggagaagaatgaatatgctggcaaggtggagagctctatagtggagaaggacgagcttgctaaggtggttgctaacctccaggctcagttgagggagttggagtccaagttggaggagtttgagcacagagtgtcaaaggaaagaaaggccaataaagagcttgaagaggaactgctggttgtccgacaagtcaagttcttcaccaaggatcttgacttgggtcttgttgacccattgaaggacatgaaggatggtgaactgcttgacgaagaagagataactgttgtagaggaggatgcgggcaaggagcaaggcgatagggccaatagcttctcccttgaggcttgcgagacttggaaccagagaggctcaccaagggcgaaccttaggtttgacaagcctttggagaagggagactcacaagtggcggaccttgggttcgacgagtctttggagaagcgagactcaccagggaaaaaccttgagtttaatgagcctttggagaagcgagacttaccaagggcggaccttgggtttaagaagcctttggagaagcaagactcaccaagggtggaccttgggtttgatgagcatttggagatgcgagactcaccaagggtggaccttgggtttgacgagcctttggagaaggtggaccttcgatttgacaagcctttagagattcttggaggctcaccaagggtggaccttgggtttgacaagccttttgagatgcgacccagaacacgttcgtccagggttttgttgaggcttaccaagggcggaccttag

SEQ ID NO: 115775 - DNA, 228 bp, Glycine max
  Peptide Sequence Number=SeqID_232553
atgagggtagaactggagacaaaggatgaagtccaagagatgccaaaatcaaagaagaggccactaaactctgagcatcaaggagatacaatacaaaggttcatcctcaagccttttagcctgccttttgtcccaatagaggaaaatcaaggttttggcttgagaggttttaacgaggcaaaactggtgaatgaagggaattcatactcagttgactacattgaataa

SEQ ID NO: 115776 - DNA, 933 bp, Glycine max
  Peptide Sequence Number=SeqID_232554
atgattggaccagatacacagataaatgtcctggggagaaacattttaccagagaggaaagtagagatatatcactctgagctagatgagtttaaggctgaattggagaggcgtaatttccataaacgcctcactaatttagtcgatgagagcatagacctagctttgatagatgctgacagtttcaacacattcttggagacacctgtggtattagctgagggggagaccttacccacttactccagatactgcaggttgcttatagactacagagagatagaggctgccttatgcatacctggccgagggttcatcttgaactctgagggccatcctgggaagattctcaggaaggatctgactacactagctcaggtgtggagtgtcctctcatactctaacttggcccccacatcagacacttctgacttgacagtggatagagctaggctgatctttggcctagtctctcgcatagatatgaacataggagcgctgatctctggccagataacctctatagcccagtctaacacttctagactttggttccttgctctaatcatcgcattatgtagagccagaggggttgtctctgatagcctcacttttgagcgcctgagcccagtcattaacttggcctacatcaggaagaactgttggaaccccgaggatctaacagtttttatccgaggggctaggagggcgagggcaaggctagttgagcttccttctacttctgcagcttctactccagcatccacttcagcagccccttctgtcccagctcagacagattctcaacgctttgaagccatgcttcagagcattcatcaggaacaaatcattctattacagagtttacaggtggtggcgcctctaggatctattccttcagtggagcagttcactgagatggtagcctggtga

SEQ ID NO: 115777 - DNA, 600 bp, Glycine max
  Peptide Sequence Number=SeqID_232555
atgaggaggatcttcataggacttcatccagctgatgtttgtcgccagtttcatcatccaccacccttttcttctctgccttctcactgggatccttggggtgttccaaatgattacagatgtaaggtgattgagaatgatgcaccagttcccaagcatggacttgaggaagctttatcatcagaaatgtggctatccaagaaatgtgggtatgtcttcacttggaggctcctcaaggacaggctccccactaagggtaatctcttaagaagaaatgtggctatccaagaggctgtttgtcctctttgtggtcaagctgtaggacctcttccagcttccccaacaagccattttgcccaattttgtgatgggtttggtgcagacataaatgatagcagctggtgtgggtggtgggttgctctaactagtgctatatggcagcataggaacctcctgatctttcaaggaaatccttttgattcctctaaagtcatggaagaggctatgtttctagtttggtcttggctaaaacctagagacaaaggcttcaacactagttttaaccactggtcttccaacatatcggactcctttggttaa

SEQ ID NO: 115778 - DNA, 177 bp, Glycine max
  Peptide Sequence Number=SeqID_232556
atgggtttaacaacaacaaacgtgagaaggcagagaagaaaagggtggtggatgatgaaactggcgacaaacatcagctggatgaagtcctatgaagatcctcctcattctcaaagaggggaacgagcaacaattttaagagcgccaagagcggatacgcaagaagcttgcacttga

SEQ ID NO: 115779 - DNA, 432 bp, Glycine max
  Peptide Sequence Number=SeqID_232557
atgaagccgaggcgctaccgaatcgtgaccgagatcatttactacgtcattttcttgttctatgttcttcgtgcgaccgtttcctattttactccttgtcagaatgttgcggttttcgatcctcctactgatgatatgaggtgtcacatgaagcaacttcacttgacaactatggtagaaaaccaaatcattaacaagattttggtggatggagggactgtattcagcatcttaccaagatctatgctgcaaaggaaacaactaaaggttggtgagctggcagaagaagtgactcaatttatgtccagacgagaaaaatactttgtagaggttgaagctcaagaggaaagccctgtaaaagagcatgagtcaagagaaaaagatgaggaacaagcactgtggaagcaaagcttcatgatgaatcaacaatga

SEQ ID NO: 115780 - DNA, 411 bp, Glycine max
  Peptide Sequence Number=SeqID_232558
atgacatcattattctccaaggaacaaaacaacgtttcccctctcctcgatggcatcgatggtttctccctcctcaactccaccaaagaaatcatcaccgaccaaaaagtcatcctcatcatatttagaggaagagtgttggggctaagggtttgtgggaggtggtggagggtttttggaaactggtggtggtgggagatctttttcttcttcctcttagtaggaagcaatttcttcttcttcctattcttcgaaggaaacttctttgtcttccttttctttgtgcttttgggaggatggttgttgttgttgtggctcttcttcctcgaaatcgaaaaaggaagcggtgggtggctcgtcgagaggagaaggacgcagcttttgcttctatgccaagttggtgagtggtag

SEQ ID NO: 115781 - DNA, 423 bp, Glycine max
  Peptide Sequence Number=SeqID_232559
atgtcgcttgagagtattaaagccgagccagggctggcgtcgcgggtgattgcctttaacggccgttacgcgtcgttgccgcaaacggcgaccacgcaaaccaccgtgcatctgatccacggcggcgaggatcgggtgatcgatctggcgtgggcggtttccgcgcaggagcggctgcaggaactggggggagatgtcacgctggatatcgttgaagatctcggacatgccattgatgaccggagcatgcagtttgcccttgaccgtctgcgttataccgtaccgaagcactattttgatgaagcgctaagcggcgggttttcccggatgcggcgcgttgcgccttctccgggctaccaaatcgcacagcgctgtagccccggtaagcggcagcgccaccggggggtccagcgtggtgaataa

SEQ ID NO: 115782 - DNA, 1129 bp, Glycine max
  Peptide Sequence Number=SeqID_232560
atggatatagttgaacaagaaaatcagagtctcagggaggaggttgccactttacgagagggaatggataggttgacgaccatgatgagtgcactcctgtcagcccagaactctcaagctgccgccgctactgtagagcagcccttggtgagcacaaccccgctatctacggtgacttctccacccctctttttgcctccaggttgtacatggggaatgccacctccagtctgtggaagcccccagcccgctgtatctgaaattccaccgccttttgctcagcagtcagcaccagttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatcccacacaagttcaaggtgccagacttcgataagtataaagggaactcttgtccccgcagtcacttggtgatgtacgcgcggaaaatgtccatgtatactgacaatcataagctgcttattcatttctttcaggacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccaacgttggagggaagtggctgcccagattgtcccgccgttggaagaaagggaaatgaccaaaatatttctgaagaccctgagccagttttattacgagaaaatggttgcaagtgcaccaacagacttcaccgaaatggtcaacatgggggtgcgattagaggaaggtgtccgagagggacgtttgactggggaaagtgcccctgctgcaagcaatgccaagaagtttggaggccactttgcgaagaagaaagatcaagaggtggggatggtagctcatg

SEQ ID NO: 115783 - DNA, 869 bp, Glycine max
  Peptide Sequence Number=SeqID_232561
agaccttggatatcagaaacacgttggttcatgagttaccaagtgaaataaacatgctcaaaaagttaagatatcttcttgctttccatcgaaactatgaagcagattattctcttttgggatctacaactgatcatgggggcatagatctcatccaagagatgagatttttaaggcagttaaggaagttaggcttaaggtgtgttcgaagggaatatgggaatgcaatatgtgcttcagtggaagaaatgaaacaacttgaatcacttaatatcactgcaatagctcaagatgaaatcattgacttgaactctatatcatccctaccccaacttcgacgacttcatttgaaagcaagactggagaagatgcctaattggatttcaacacttgagtttcttgttaaaataaggctggctttatccaatttgaaagatgatccgttgagatcgctagaaaagttgccaagtttgttgaaggttagtatttgggacaatgcctatgatggtcaaattttgcattttcgaagtggagggtttcgcaaattgaaggaattgtatctagctcgcttggatagagtaaattctgtcctaatagataaaggaagtttgctttctcttgaaaattttataatttgcaaaatcccccatctcaagaagctaccctctggcatcgaagccttggataaccttaaagttattgacttccgtgatatgccaactgagcttgttgagagcattgatccaaaaaaaggtcaagattatgagattatcaatcaagtgcccctagtaatcattcgtcattggattggcccaaaactcagtgattttgaagtccgcgctattcactcgtcctcccagaaatcataa

SEQ ID NO: 115784 - DNA, 2683 bp, Glycine max
  Peptide Sequence Number=SeqID_232562
atggcagaaattgccgtagcatttgccttggggcaagtgttccaaatcctaaatgatgagacaaacctgttaggaggcatccacaaagatttttcaaacatcagagatgaactagaaagcattcaagctttcctcaaagatgcagatagaaaggctgcagatgaagcaaacaccaaccatggaataagaacatgggtgaagcaagtgagagaagcatcatttcgtatagaagatatcattgatgaatacctcagggtgattcatgtggttccccaccttggatgtgaggcttcaatttgcaagattacaagcctgataaaaacatcaatttctcgccatcagatagctactaagattcaggacattaagttgtcaatttctgtaatcaaggaaagaagtgaaaggtataagtttcaaccttcacaagaaccaccatcaagcagcagcaccagaatgggttccctttttattgaagaaactgaaattgtaggatttaaattgccaagagatgaattggttggttggctgttgaagggcacagaagagcgaacagtgatttcagtggtagggatgggaggacttggaaaaaccactcttgccaagcatgtttttgatagtgaaaaagtaaaaggtcactttgattatcgtgcttgcatcacagtttctcaatcatacagtgtcagagggttattcatagaaatgataaagcaattttgtagggaggcaaaagaccctcttccagaaatgttacacgaaatggacgagaagtcactaatttctgaagcgaggcaatacttgcagcacaaaaggtatttgatattctttgatgatgtatggcatgaagatttttgtgaccaagttgaatttgccatgcctaataacaatagaagtagcaggatcataatcaccactagaatgatgcatgttgctgagtttttcaagaaatcctttcctgttcatattctcagcctacaactgttgcctccagacaaagcatgggaactcttttgcaagaaggcattcagatttgagctacacgggcaatgtcctgcactgcttgaaggtatgtcaaatgaaattgttagaaaatgcaaggggctgcctttggcgattgtagccattggtggtctactttcaacaaaatcaaaaactgtctttgaatggcaaaaggtgaatcaaaatctaaacctcgagttgcagcgtaatgcccacctcactagtataacaaagattttatctctcagttatgatgacctgccttactatttgaaaccatgcattttgtattttggaatatatccacaggactactccattaatcataacaggttaacacgacaatggatagctgaagggtttgttcagtctgatggaagaagaacttcagagcaaattgcagatgagtacttatccgagttaatttatagaagcctggttcaagtctcaacagttggctttgaagggaaagttaaaagttgtcaagtccatgatatattacatgaaatgatagtaagaaaattgaaggacttgtgtttttgccattttgtgcatggaggtgatgagtcagccacaagtggaacaactagacgcttatctgtagacattagttccaacaatgtgttgaagagcactaactacacacacattcgtgctattcatgtttttgggaaaggaggactgcttgagcttttcacgggtctcttatcttcaaagtcaagggttttgaaagtactcgaccttcatggtacatccttaaattatatttcaggtaatttagggaatctttttcacttaaggtacctaaatctaaggggtacgaaagtacaggttcttcctaaatctcttggtaagttgcagaacttagagaccttggacataagagacacattggttcatgagttaccaagtgaaataaacatgctcaaaaagttaaggcatcttcttgctttccatcgaaactatgaagcacgttattctctcttgggatttacaactggtgtgctaatggaaaagggtattaaaaacttgacttccctattaaaactttgctatgtggaggtagatcatggtgggatagatctcatccaagagatgaaattcttatggcaattaagcaagttaggcttaaggcgtgttcggagggaatatgggaatgcaatatgtgcttccgtggtagagatgaaacaccttgaatcacttgatatcactgcaataggtgaggatgaaatcattgacttgaaccctatatcatccctaccccaacttcaacgccttaaattgaaaacaagactggagaagatgcctaattggatttcaaaacttgagtttcttgttgagataaggctgggtttatccaatttgaaagatgatcttttaagatcggtagaaaacttgccaaatttgttgaagcttggtatttgggacaatgcctatggtggtgaaattttgcattttcaaagtggagggtttccaaaattgaaggaactgtatctagctcgcttgaatagagtaaattctgtattaatagataaaggaagtttgctttctcttgaatattttataattgccaaaatcccccatctcaagaagctatcctcaggcatcaaagccttggataaccttaaagttattgacttccgtgatatgtcaactgagcttgttgagagcattgatccaaaaaaag

SEQ ID NO: 115785 - DNA, 258 bp, Glycine max
  Peptide Sequence Number=SeqID_232563
atgtggcatgtggagttcacagggaaccaagatacgacaatcaccaccacactcgaccacaacattcagtcgcaagacatgacccagaccctctacgctggcgagcacctgcgttgcttgatggacgatgatggcggctcccgtggctggctggtgcagttctacgtgtacccctatgcctgcatccaatcgacgctctgcgagcttggacagtgcttctcgaaaaagatgatcatcagcgtgagggaagagtcgtga

SEQ ID NO: 115786 - DNA, 1697 bp, Glycine max
  Peptide Sequence Number=SeqID_232564
atggcagaaactgcagtatcttttgccttggaaagagtgttccaaatcctaacggaagaaacaaacctgctaagaggcacccacaaagattttttaggcatcagagatgaactagagagcattcaagctttcctcaaagatgcagatagaagggctgcagatgaagccaacaccaaggctggaatcagaacatgggtgaagcaggtcagagaagcatcatttcgaatagaagatgtcattgatgaatacctcagggtgattcatggggtccaacatcttggatgtggggcttcaatttgcaagattacgagcctcatcagcacagtgacttctcgtcatcagatagcaactgagattcaggacatcaaagtgtcactttctctaatcaaggaaagaagtgaaagatataagtttcaagtttcacaagaacaacaatcaagcagcaacactgaagcgatagaaggcagtagatggcatgattctagaatgagatcccttttcattgaagaaactgaaattgtaggatttgaattccctaaagatgaattggttggttggttgttgaagggcacaaaagagcccacggtgatttcagtagtagggatgggaggacttggaaaaaccacacttgccaagcacgttttttgcagtgaaaaggtaaaaaggcactttgattgtcgggcttgcatcacagtttctcaatcatacactgtgaaagggttattcatagacatgataaaacaattttgtaaggagaccaaaaaccctcttccagaaatgttacacgaaatggacgagaagtcactaatttctgaagtgaggcaatacttgcagcataaaaagtacttgatattctttgatgatgtatggcatgaagatttttgtgaccaagttgaactggccatgcttaataacaatgaaagtagcaggatcataatcaccactagaatgatgcatgttgctgagtttttcaagaaatcctttcctgttcatattctcagcctacaactgttgcctccagacaaagcatgggaactcttttgcaagaaggcattcagatttgagctacacgggcaatgtcctgcactgcttgaaggtatgtcagatgaaattgttagaaaatgcaaggggctgcctttggcgattgtagccattggtggtctactttcaacaaaatcaaaaactgtctttgaatggcaaaaggactactccattaatcataacaggttaacacgacaatggatagctgaagggtttgttcagtctgatggaagaagaacttcagagcaaattgcagatgagtacttatccgagttaatttatagaagcctggttcaagtctcaacagttggctttgaagggaaagttaaaagttgtcgagtccatgatttattacacgaagtgatagtaagaaaaatgaaggacttaagtttttgccattttgtgaatgaaggtgatgatgaatcagccacaattggagcaactagacgcctatctatagacactagttccaacaatgtgttaaagagcactaacagcacacatattcgtgctatccattgttttggaaaaggagaacagctcgagccttttatgggtcaactattttcgaagtctagggttatgaaagtactcaaccttgaaggtacattgttaacttatgttcccagtaatctagggaatcttttccacttaag

SEQ ID NO: 115787 - DNA, 255 bp, Glycine max
  Peptide Sequence Number=SeqID_232565
atggaggaggtgcaagagcagatgaaggccgacatggaggccatgaaagaacaaatgaccacaatgatggaagccatgatgagtatgacaaaaatgatggaggtcaacacggctacagttgttgccgcaagtacttccactgaggtggacccaactcatctatctggcatcaatcaagcaattcatccattctcagatatggtaggccagggaggcgaagcattgggaagtacgggtggcccctattttgtgtag

SEQ ID NO: 115788 - DNA, 564 bp, Glycine max
  Peptide Sequence Number=SeqID_232566
atggagctacatcatttacccagataccatccacacctgaacaaatataaagaaaaaattcttagagaagttcttccctgcatccagaacaacatccatttggaaagaaatttgtggcataaggcagcaacctggagagacattatatgggtactaggagagattcaacaagttgtgtgcttcctgtcctcaccatcaaataaaagtatgattaatgcagccagtggaggcgctttaatggacaggactcctatagctgccagacaattgatttccaacatggcagcaaataatcaacaatttgggactagagttgctacaccacctagagcagttgcaagtgaagtttttgtttctatggtggttgataatcaaagactggagaataaacttatacagttaacatcccttgtgaggcagatgcatgtttcacacttcaagaaacaaaacaagctgctattatttcttccatgcaacctgggtagttattcaaacctcaacaacaacaatacaatccttactccaacacctacaatcctggttggaaagatcatccaaacttga

SEQ ID NO: 115789 - DNA, 420 bp, Glycine max
  Peptide Sequence Number=SeqID_232567
atgcgtgccaaagctagagtaatgagtgaaatagaggaggtgcaagagcagatgaagaccgacatggaggccatgaaagagcaaatggccataatgatgagtatgagaagaatgatggaggttaatgcgactacatttgttgccataagtaccgtcacagaagtggacctgactcacccatctggactcaaccaaataaatcatccaacctcaaatatgaacaagcattccttcccaccatatggcttgcctcccaactatacaccacccaacgttttacacactctcgatgggaatgtcgacaactccgcacctatacccattgagagccaaaaaccccaatctgatcatgcacaatctctcaacccatggggaagacacatgaagcaccccgagacctcacaatctagccgactttga

SEQ ID NO: 115790 - DNA, 378 bp, Glycine max
  Peptide Sequence Number=SeqID_232568
atgaggcttcattgttatcaagcgagtcagagacccaacatgactatagatcgacctccactccttatggctcacatagtcccgggtacagggcctaatatctcaacgtgtgtgcggggtattggtgtcattggagtcgccaactgtcgcaacctatccttcggcgggtgggcgaggcgggataaaaaagtgtgtcttctcatgaagaaaatgcgtggagtcgccaccaacgtttatttgaggaaaaacgttagaaaaaccaaaaagaggtctatggaacttgagaaaaagggttcgggagttgtttacgtacgagaaagggtgttgtccttgctcctacgtatcctcaagtgcgatgaggaattcagacctacatag

SEQ ID NO: 115791 - DNA, 2832 bp, Glycine max
  Peptide Sequence Number=SeqID_232569
atggcagaaacagcagtatcttttgccttaggagaagtttacgaaatcctaaaggacgaagcaaagctgctaagaggcatccacaaagacttttcagacatcaaagatgaactagaaagcattcaagccttcctcaaagatgcagatagaagggctgcagatgaagcaaacaccaatgatggaataagaacttgggtgaagcaggtcagagaagcatcatttcgtatagaagatgtaattgatgaatacctcagggtgattcatgtggtccaacatcttggatgtggggcttcaatttgcaagattacacacctgatcagcacattgatttctcgtcatcagatagcaacagagattcaggacattaaattgtcactttctgtaattaaggaaagaagtgaaaggtataagtttcaagtttcacaagaacaaccatcaagcagcagcactggagggatagaaggtagtagatggcatgatcctagaatgagttcccttttcatcgaggaaactgaaattgtaggatttgaattgccaagagatgaattggttgcttggttgttgaagggcacagaagagcgcacagtaatttctgtggtagggatgggaggacttggaaaaaccactctttgcaagcacgtctttgatagtgaaaatgtaaaaagtcactttgattgtcgtgcttgcatcacagtttctcaatcatacactgtcagagggttattcatagacatgataaagcaattctgtagggagacaaaagaccctcttccacaaatgttacatgaaatggatgagaagtcattaatttctgaattgaggcaatacttggagcataaaaggtatttgatattctttgatgatgtatggcatgaagatttttgtgaccaagttgaattttccatgcctaataacaataaaagaagcaggatcataatcaccactagactgatgcacgttgctgagtttttcaagaaatcctttcctgttcatgttcacagcctacaactgttgcctccagacaaagcatgggaactcttttgcaagaaggcatttagatttgagctaggtgggaaatgtccagcagagcttcaaggtatgtcaaacaaaattgttagaaaatgtaaggggctacctttggcgattgtggccattggtggtctattgtcaacaaaatctaaaactgtgtttgaatggcaaaaggtgatccaaaatctaaacctggagttgcagcgtaacccccatctaactagtttaactaagattttgtctcttagttatgataacctgccttaccatttgaaaccatgccttttgtatttgggtatatatccagaggactactccattaatcacacaagtttaactcgacaatggatagctgaaggatttgttaaatctgatgggagaagaactatagagcaggttgcagatgagtacttatctgagttaatctatagaagtctgattcaagtctcgagcataggctttgaagggaaagttaaaaattgtcaagtccatgatttattacatgaagtgatcgtaagaaaaatggaggacttgagtttttgccattttttgtatgaaggtgatgatgaatcagccacacttggaacaattagacgcctatctatagacactagttccaacaaagtgttgaagagcactaacaacgcacacattcgtgctattcatgcttttaaaaaaggaggactgcttgacatttttatgggtctcttatcttcgaagtctaggcctttgaaagtactcgaccttgaaggtacattgttaagttatgttcctagtaatttagggaatctttttcacttaaggtacctaaatctaaggaatactaaagtacaggttcttcctaaatctgttgggaagttaaagaacctagagaccctggatataagagatacgttggttcatgagtttccaagtgaaataaacaagctcaaacagttacgacatcttcttgctttccatcgaaactatgaagctgagtattctctgttgggatttacaactggagttgtaatgaaaaagggtattaaaaacttgacttccctacaaaatctttgctatgtggaggttgaacatgcaggaattgatctcatccaagagatgagattcttaaggcagttaaggaagttaggcttaaggtgtgttcgaagggaatatgggaatgcaatatgtgcttcagtggaagagatgaaacaacttgaatcacttaatatcactgcaatagctcaagatgaaatcattgacttgaactctatatcatccctaccccaacttcgacgacttcatttgaaagcaagactggagaagatgcctaattggatttcaacacttgagtttcttgttaaaataaggctggctttatccaatttgaaagatgatccgttgagatcgctagaaaagttgccaagtttgttgaaggttagtatttgggacaatgcctatgatggtcaaattttgcattttcgaagtggaggttttccaaaattgaaggaattgtatcttgctcggttgaatagagtaaattctatcctcatagacaaaggagctttgctttctcttgaaaattttaaacttaacaaaatgccccatctcaaggaggtaccctctggcatcaaagccttggataacctcaaagctcttgatttccttgacatgccaactgaatttgttgagagcattgatccacaaaatggacaaaattattggatcatcaatcatgttccccttgtattcattcgccactggattggcccaaaactcaatgattttgaagtccgcaccattcgcttgttctacagggagtga

SEQ ID NO: 115792 - DNA, 252 bp, Glycine max
  Peptide Sequence Number=SeqID_232570
atgctgcaactgcccaaaagtgaccattttcctataaataggcgtcctaagggggttttaaggggttccaaggggtcagaagtggagagaattgacagaagagagaaggaagaagaagaaagaagaggaaacgaagccgaggtgctaccaaatcgtgactgtgatcgtccccacatcatttcttgttcggtgttcttcgcaccagtcgaactacgtaggtctgaattcctcatcgcacctgaggatacgtag

SEQ ID NO: 115793 - DNA, 201 bp, Glycine max
  Peptide Sequence Number=SeqID_232571
atgagctcgcccaagcgagctggtttcttcaccatgaagatatttggtggaccaggcaaacgagaggctggcctgggcgagctaggggaagtaaagataaggacactaatttcatttgggcgactttgctattcgactgggcaactgacaaaaaccaaggaagtgaaactgaaaaaacaagaggatattgaagtcttataa

SEQ ID NO: 115794 - DNA, 423 bp, Glycine max
  Peptide Sequence Number=SeqID_232572
atggctgcaagccatttcaacagagaaaataagaagtgtcttgagcacttgaagcatgctaaacaaatctctgatcctccagatcacaaggattggaaggccttaatgccagtaattgttgatccccctttgaaagtctccaatgctacttggctctctgaagaaggggatgaaagaattggtcccaatgcgacctttcttcttctctcttgtgctacctgctatattgtattaaatgatatcatcagttcatatcatccagactctttgaaatctgcttgtgctaggaaaattgagccttgtttttcagtgcaatcgagaggctgcacttgtggaggtgcatattcattggatttcgattcagagtgtgttaaaaactcaacaccttatggaggtttaaaatcatcaaaatctgtttcatag

SEQ ID NO: 115795 - DNA, 183 bp, Glycine max
  Peptide Sequence Number=SeqID_232573
atgagaagagtgaagagtgaagagtttgataaattttacaataaagagtgcaggaaaatatcgactatttgcacttacaaaatggacaccaacaacatgaggcctatttcagatgcaaccaacattgaggccaatggatggaaatctaaagacaatcgtaacatgatggcaaaaagaatgtaa

SEQ ID NO: 115796 - DNA, 809 bp, Glycine max
  Peptide Sequence Number=SeqID_232574
atggttatgcctttcgtcgtgcctgtcaccatgtgtttgctgttttatgtgtcaatgccaagaataggtagcaagaaaaagatatctgaaaagaatgatgtatctgatgaaaacaataatttgcaggctcggataaagaagataatgcaagcagatgaggatgtcggaaagatagcagacattgtcagcagagttcctgactatgggcatggccatggccatggccattcagaggctggagctgatgatcgtgcacttccaaagagaaggaaagctgttggtgacgacggcaatgacagtgatgaagaggctaagaggagtaagatgcgtgagctgggccacactggcactcctggtaggggaagaggccgaggtagaggaagaggccgtggccgaggggctcgaactattgaaagagatatctgtcatcagcaggttgaatccgagccttgcacctctattctgcaaagtagcaatgatattcctaacactagtgtgccaatagataatggtccacaatccaaggagttaccaaaggagaactttgtgatttctgaggaaagtactcaatctttccgcaacattgatctgaatgctaacttaaatgaaaacgaagacaaaaatgctggcacagctgttccggcttcattgcctgagcccacttccatggacactgccatggagattaaacatgaagaaattccaggctggtccctatctgatgtggacaagatgggcattgacactatgcagcttgcaaacctaggtagtcgactagaagaggacgaagaagattatgacgaggaagg

SEQ ID NO: 115797 - DNA, 912 bp, Glycine max
  Peptide Sequence Number=SeqID_232575
atggcatcatcacactttttggaaggttgtccctccgaaggctctagcatctctgccacctccgaaggcatttcccataaaccaagtgctgaagaagagaagaatcatgatgaggtgacaactatgaaggagaaggatgtcaaatctgaacaagatcaggcttccaattccaattcccacatggtgttggattttgttaagctatccaaggattattcaattcgagggtcgaaagtggaattggattttttcaatccaatgagcttggggggttcatcttcttctaggactaacaacaatgaaggaagagatgagaacaacaatgaagagaaatcatctgaggctaagactttttcttgcaatttttgcaagaaagagttttcttcatcacaagctttgggaggacaccaaaatgctcacaagcaagagcgtgctcttgccaagcgtcgccaagggattgatgctggtgcttttggcaaccctcattttctttattacccttatcatcccacacactccttttatggatcatataatagggcacttggggttagaatggagtctatgatccacaagccttcgtatccttcaccctcactaggttttaggtttggtcaagggtggtcaagatcacaagagatgctaaacccttctcttgatagattgaggatggagactttgcatgcaaatagtggaactaggatcctagggagtgataatactaatttgaggacacaagatgatcgtggtactattgggcacaacattccattccttggagaatcttctacaaatgttgttacgaaatcaaactcagccccattgagtaacttgggtggtgatcatcccaagcaagaagcaccctctagtcctgattcttctgatgagattgatttgtcacttaagctttaa

SEQ ID NO: 115798 - DNA, 450 bp, Glycine max
  Peptide Sequence Number=SeqID_232576
atgaggctcttttcaaacattttccagcatggggcagttttggacgtgttatgcatgcatgcagcatccaaaccgccagaatcattggcgagtttggtgtcggtgagcaaatcgctattcacactagcgatacgtgcatgctgcgtgaaggaaccaccagcactactcgcaatatcagtatccatgggaatcgccagtcaaactggcgagttccaagttgctgaaaagcaggcttttttcaggcgtgtacaggcttttttcatgtgctttttcagggagggtagctttttcaaattaagggaagttgcaactgtcattgacgagttaagggcaagttgcaactcccactggcgagttagggcagaaggaatagccattccagatgatgatttagggcctttatatacgcgaaaattctttcagtgttgttgtgtgttcacaagttcgtag

SEQ ID NO: 115799 - DNA, 147 bp, Glycine max
  Peptide Sequence Number=SeqID_232577
atgggtatgcaagatgtcaggcctatggagaggggatgtgccttatggcaccaatggcctcaaagttggtcaatgtggtcaattatagagatgcctaaggttaaggataacatggtggatgcttcttgcaaggagcttggagcatga

SEQ ID NO: 115800 - DNA, 171 bp, Glycine max
  Peptide Sequence Number=SeqID_232578
atgaggaggatcaagggtgaaaacactcacattgagagtctcgaatctgagctctggggcactaggcttagtgggccttggccttcctcaggccttggatccctttttggatcctattatcttattctcatcaattcctattataaggtcctaaaggatttctatccttag

SEQ ID NO: 115801 - DNA, 273 bp, Glycine max
  Peptide Sequence Number=SeqID_232579
atggacaagcagaaagggggctgttttgcacataaattatatgcaagccccaagcaaaccgccagtcaaactggtgagttcgctggcagtgaagaagtcgccatccccattgacgatttcgccatgcatgggggaactgccagtcaaactggcgagttcgtggcaggagagacagctagttgcagggcctatgtgcaggagtgcaggcttgacgtagcagggcaggaatcgccattggtgcaggcaagatgcaggaagaactcgccagtttga

SEQ ID NO: 115802 - DNA, 207 bp, Glycine max
  Peptide Sequence Number=SeqID_232580
atggtgatggtaatgcttgtttctgagtgtatgtgcgttcttgcattcactctcgtgcattcacttattcacgataggttaatcttctataaatgcttgtttctatgtttggttttgatggtgatggtaagcgagaagctagggctcgctcttggttttgatggtgatggactttgtgctggtgggagaattatgccacagccttag

SEQ ID NO: 115803 - DNA, 243 bp, Glycine max
  Peptide Sequence Number=SeqID_232581
atggagagccaattaagtattgaggctcctatggttgaggggcttcaaaacttgaaagtgggggatatttttgattccgtgaatgggtgcttgaatgatggacttattcggcatttattattccacaaattgtcttccaacgagagaaccaacttgagggatcgtggggttgatagctcaatgaaactgttttccatgcttgccaagatatccttgggtgttggtggagagggtccatcttag

SEQ ID NO: 115804 - DNA, 153 bp, Glycine max
  Peptide Sequence Number=SeqID_232582
atggttgaccctgttattttggagagagatgacaacttccttttctttagagctaatgagaatgaagctttggtgattagaagaattctagatgagtatgcttctgcctcaggctatccctacataatggatgagcctctttcaaatacctaa

SEQ ID NO: 115805 - DNA, 1239 bp, Glycine max
  Peptide Sequence Number=SeqID_232583
atggcgaaatgtgaacatcataagcgggcattggaaaacacttttgcactcttccaagtgaacaaaagtgaaataacccctgattttgagcaaagagtcgataatattgaaaagtatatatactctattacgaaacctaaatatgtttcttcacaattgcaaatttctcaagtggaagcaacatctacaaacataccaacatcacaagtaatgggtccacatgattctcatatgacacagccaaattctcatcaagtggcaaaccaatctagtgctgcagatccacaagaagagtctgttaaacaacaaggttatggaaatgttgtacaacaacaaacaagtggtgaaataacaccacctgtcatcagcacctctgggattttagcttcacccttgcttgaaaactgcaatgaagagaacgaaaattgtcaaggccatattgtcatttcggatgatgcaagccctgcaatgcaacactcgattaatgtgatgaactttgtatcggctgaagcattggtggattcttgtgaagacattggaatggtattccatttgaatgatggcaagtcaacattggaaccactaaatggaccaccacttagtgcaattggctctgacttggagggagttaatgtgacagattcacaagcaagatatttgactcgtcgtaaatttgctcctagagaaagaaatatgaaccatttcattaattcaatgcctgcaagtgaaatttttttgcagttaactagttcagagaaacttttctcaaattcaagcactagtcaggaaaataatgctctttcagaagaaataaaggagataaatatgcgactgatagacactgaggtagttgctgataaagggaaaattgtcaccactgcagctgaaggatatattgcccatggtgaaggattaactgtaaaattattgttcaattcaccaataattcaaccgctttggttgcatattcctgcaagttatccacattgctcggttgccattatagatgaaatgccattggaagccaggaaggacctagatgaagatctatcaatgaaagctaagttgaagttgacactttgtctccaaaggctaagtcaacctttgtcactaaaggatattgcagtgtcatgggatcgttgtgttagagaagcaatatgtgagtatgcgcaactctttggtggaggaaccttcacctcaaaatatggaggatgggagatatgtcctaatgatatataa

SEQ ID NO: 115806 - DNA, 136 bp, Glycine max
  Peptide Sequence Number=SeqID_232584
cgaaaatacataatatatgtgcgagagccaaagggcaagaagatgaagacaatctctggacattgtgttttggtaaaagacatatcagtttcgaaagcagctaaaattctcacaaagtttgtctctgctgacgatg

SEQ ID NO: 115807 - DNA, 243 bp, Glycine max
  Peptide Sequence Number=SeqID_232585
atgtcaattaggacttgtaggaaagcttggtcagagcaaatgaggaaacaaagctgtcaaattgtgcagcaaattctgccaattatgcagaaaaaaaatggttgtgcagtgctagtttctgctgtcacgggaaagagtggtacctggagatatgtcgcgcgggtcaggagaccttggggacgtcaggtggggtgctattgcccaaaaccaagcttggccaatcccgacccaactcgggcatag

SEQ ID NO: 115808 - DNA, 342 bp, Glycine max
  Peptide Sequence Number=SeqID_232586
gtgatggagggtgtgaaggagataacaagaaatggtgccaaatttatggatggaaaagaaaaggaattcgatgctataatcttggcaacaggatacaagagcaacgtgcctacttggctcaagggatgtgatttttttacgaaagatggaatgccgaaaacgccctttcctcatgggtggaaaggagagcagggaatgtatacggtggggttcacaagaagaggtcttcacggaacgtcgtgtgatgcaatcaagatcgctgaagacatagctgaacagtggagaaccgtagaggacaagagtcactgcgattcacatatcatcctactcaataattcatag

SEQ ID NO: 115809 - DNA, 339 bp, Glycine max
  Peptide Sequence Number=SeqID_232587
atgtccatttatctcattgaacttaatgtcactcagttagaatcagaaagggaatacatgtcttatgttcgttatgcgagtgttgtaggtagtctcatgtatgcaatggttcgcacaagattagaactagcacaaacagtcagtgaggtgagtaggtatatgggttgttttgttacgatggcactaagcacatacttcaactttgacactctacaaagtcccaacttagaaacaaacactttcgatgaatccatgctagaagaagtagcagcaccaaacctccaacacctttttccctattcagatgaaagcttgttcctttcaaacacgtttttttag

SEQ ID NO: 115810 - DNA, 328 bp, Glycine max
  Peptide Sequence Number=SeqID_232588
gaagcattgatgacagtggcatcgagcatccgacgtctggctgatgccatggagcaaagcaaatgctcatttgatgcaagtgagctattacatgctgtgatggagatagatgggttggaagagggtaaacagatgtatgcattcgaatatttaaatgctgatcctgtcaaagccagagccttcctcacctacaatgctaggatgagaaagacatatctgtttagacagttctggtggtggaggataattgaatgtatagactctagactgataggagatagccatatgccggagacattagaaacatcgtctcttccaagtaaccatg

SEQ ID NO: 115811 - DNA, 648 bp, Glycine max
  Peptide Sequence Number=SeqID_232589
atggaattgcaatattggaaactagatgtgcttggcatggtagttaaggtcgccaagatacccaatcaaggtgcaccttttgagggaaccattatcgacgactggaagtttgattactcaagctttgatgcccgtcatatggtcagcaatgatcaggcggatatgactggcagactgcttgtcgggtcattgacatttaattgtcacatcatgcactatatcattgttagaattttgatgcctcgttcttctaatctagctcaagcctctgaggaggacttgattttgatgtgggctttcttgaccgatcgtcaaatcgactgggcccatttgattcgttaccatatgcataaggcattgcggtctacggtcacctcttttagctaccacaaggagttggatggatcttgggtgaagaaagatgcaccaccacaggttgcagatgagcatacaccttatcctctaagacatgattcttctgtgcttctgaatgaccttctcatggagttacgaggatttcgagcacatgttgatgaccgcttggatggtattgacacacgctttgacgcgatggacctccgcatcgaccagctttcaaatgacatgaacttcattcaccgttcttttgatccgcctgcagacccttag

SEQ ID NO: 115812 - DNA, 615 bp, Glycine max
  Peptide Sequence Number=SeqID_232590
atgtatgatgggattgttagaaccttaatcgaggttctaatcactgtgggtgccatggattcaaaatgcttttctttctggattgaaggtggagttatgcaaatcaaaaggaaagggaagtttgtggtaatgcaaaggaccaagcaaggaagtctatacatccttcaagggtcccctgtgacaggcactatctcaactgtttcacaagttgggagttatgcgttcaatggctcgtccaatgaaaattatctatggcatctgtgtctaggtcacatgagtgaaaaaggattggaagttctaaggttgaataggagtttatgggctaaggctgttagtacaacatgttatctcgtaaatcattccctgtccactgccaaacatttcaaaacctctattaagatattaacatactatcacgtaagtgaaggtaagatagagtccagagctaagaagggtgtctttatgggctatggaaatggagtcaaaggatttagaatttggtctttgttaaaaagaaaggtcattctaagtagagatgtcatctttgatgaattctctatgctgaattctaaatctaaagaagattcaggcaaggctaaagatgtcactatgtag

SEQ ID NO: 115813 - DNA, 219 bp, Glycine max
  Peptide Sequence Number=SeqID_232591
atgcagagaagaaagcaataccaacaaaatcggattgatgaagattggatcccaatcgccaatcagatcacggaatccgaatgccgcagcagcgcgtcattggagtgcagagagggttttctcgggaaaaatgatgagaaaattctgagttttcactttctcgaagaccaaatgcggaaaagaaaaggttctggccgtttcagtcaagggatcaggtga

SEQ ID NO: 115814 - DNA, 114 bp, Glycine max
  Peptide Sequence Number=SeqID_232592
atggagaaagctcgaaaaaccctagtttttaagagatcaaaaggtccgggggttggttacgcaaagggaagttatgcaaagataagtctaaacgcgccggatcccttaaaatga

SEQ ID NO: 115815 - DNA, 474 bp, Glycine max
  Peptide Sequence Number=SeqID_232593
atggcaaaaacatcctcgtctaatgaagttaggacactagttttagtcggacgtactggcaatggcaagagtgcagtaggaaatagtgttcttggaaggagagccttcaaatcgaagtcaagctcctctggtgtaacacgtgtttgtgaattgcaaagaactattataaaggatggaccaattgttaatgttattgacaccccaggactatttgatggaactcattctgcaggaaaggaaatagtcaaatgtattgatatggccaaggatggaattcatgctattcttatggtattctctgttaaaactcgtttttctgaagaagaacaagctacatttcttgccttgcaagcattgtttggccacaaaattgttgactatatgatcgtggttttcaccggaggagatgagctagaagaaaatgaggagacacttgatgattatttaggtcatgagtgtccacaacctcttaag

SEQ ID NO: 115816 - DNA, 1167 bp, Glycine max
  Peptide Sequence Number=SeqID_232594
atgggggagccatgccaacaatattggttttcggatatggaaatacgagattttgatttctttaaccaaagccagaaccacaagattggatcactcgatcgtgatgaggatcggatctttcgagagatcatgatgcatcaaccagttttctcttctgacagcgatactcactctcccaaaattctaagcaaatcaatccacggtggtgatagtggttataatacttacacagcccttgccaacaacaagagtagcaatagcaacctagtgatgaagagcaacagctccaacttcatcttctcatcacaacatgcaccaccagagaaaccttccacagccacagtcgcttccccaaccgcatacattctttcattcggcgactccaccctagtggcagctacacgccaaaactacggtggaaaacagccctaccacgaggaagtggtagtagggagtggtggcgtatgtcttccctcaaaaggggtctcagaaaaacatgatgttgaacctactacggccaaccaaacaacaaagagaagtagaagctctgcggagacactagaccatataatgacagagagaaaaagaagacgggaactgactgagagattcattgcactttcagccaccatacctggcttaaagaagattgacaaggccactatactcagtgaagcaatcactcatgtgaaaagacttaaagaacgtgtaagggagctcgaagaacagtgtaagaggacaaaggtagagtcagtgtcattcgttcatcagagaccccacattacaactgataaaggcaccacctctggtgcaatgaactctgatgaatggtgtagaaccaatgaagcactccctacggtggaagcaagagtgtttaaaaaagatgtactcctccggattcactgcaagatacaaagtggcattttgatcaaaattttggatcatcttaatagtcttgatctctccacaatcagcaacagtgtaatgccttttggaagttcaactcttgatatcagcattattgctcagatgggggacaaattcaaagtaacaatgaacgatctagtgaaaaatctgagactggctctcttgcagtcatctgaaatgatagctcagttttcacttttcagcattagagcatctagctccaactttcaagatagctag

SEQ ID NO: 115817 - DNA, 372 bp, Glycine max
  Peptide Sequence Number=SeqID_232595
atgcgggataaccaacaaaaagcacttgactccttaaaaggatattcaaaagaagaaatgtttgagattaaaatgcaaatgcaacaaaaatatgacgacgagctaaaacgaatgattaatatggttgaatcaaagttgaaggaagaaactgcaaatcttttgaaaaaattggaagaagaaagagttgctagacttaaggctgaggaaaactataggtcatttcaaaatgcatcaaatgatgaaattcgaagacttaaagaagatctagaaaaggcaaatagaagaagagatcctgggcttccttttccatttaacctattgattcctttccggggtaggagaccaattccacctccttgtcccattctttga

SEQ ID NO: 115818 - DNA, 523 bp, Glycine max
  Peptide Sequence Number=SeqID_232596
atgggtgaagtagaggaggtgcaagagcaaatgaaggccgacacggaggccttgaaagagaaaatggccacaatgatggaggccatgatgaccataaaggagataatggaggtcagtgcagcctaccaaacccgtgctagagctagagtaatgggtgaagtagaggaggtgcaaaagcagatgaaggccgacacggagaccttgaaagagaaaatggccacaatgatggaagccatgatgagcataaaggagataatggaggtcagtgcggcctaccaaacccgtgctagagctagagtaatgggtgaagtagaggaggtgcaagagcagatgaaggccgacatggaggccatgaaagtgaaaatggccacaatgatggaggccatgatgagcatgaagaaaataatggaagccaatgcggttccagttgctgctactagggctgttgctaaggtgaacccgatgcccccatctgatctcatgaatcatcctacctcagatatggtggacaaagatttgggaa

SEQ ID NO: 115819 - DNA, 720 bp, Glycine max
  Peptide Sequence Number=SeqID_232597
atgactgatgtagaaaccttggttctgctctttgaagaaagcaatgatgttgaatatgggaacttctacatcagtggtgatgtagggactgctgtagtaagttgcgctttctacattgttttccataaagcaatgatgttgaatatgggaacttctacatcagtggtgaccaacgatgttgaatatgagaacttctacatcagtggtgatataggcaccgatgatttaccaggcttcatggaatcccttgtgaagcaaatgtctgtaaatcttaaacgcattcacagcttagggataaaaaaggtagcagttgggttattacagccaattgggtgtttgcctgtgttaaatgtgatatctttccgtacgaactgcattggccttttgaacgtgatctccaaagatcacaacaaaatgttgctcaaagctgtgcaagaactcaacaaggaagcagcagacaaatcagttttcataacactggacctctacaactccttcctctctgcaattgaaactatgcagaaaaagcgtgcagaaaagtctacactgatgaatccgttgcaaccatgctgtgagggaaacaatttggaagattcatgtggaagtgtggatgacgaaggatcaaagaaatacagtttatgtgagaacccaaaactttctttcttttgggacacacttcacccttctcaaaatggttggtttgcagtctacacccaatag

SEQ ID NO: 115820 - DNA, 797 bp, Glycine max
  Peptide Sequence Number=SeqID_232598
gtgatccacctaaacagaagagaagtcaaggaaatgagaaaaagacagaagacgacaatattactcaagggccatcaaaacgaagaaaacaatttagggttggagatgatggtaaaatattatttgatgaagaagagctcaaaatgatcctagattttaagagaggtgaggactatattgaggttctttgtggcgctacaaacaaaaaatatggagattatgttgggaggctaaaaattaataacgaaggtcaatatttcatcacttgtgagtgttgccctgagtgtcccttggtgagtgtcactctagaagcatttgagaaacatgctttaagggaagggagcggaaggtggaagagaaacatctgggttcattgtgaagacgaagacaaagttccactctggaaaacacctctgataaagtattacttacaccaggcaaatgtgactaaccggaaagactctgcaatgaggaaacaaaactttcacagggatgagttcctgcgttgcacgagatgcgggaaggagcgcaggttccatctccagagcagaccagacattaggaactaccatgatgctttaaacaacaaatgctggatttgttctctttggccttatcaaaaaataacatgcgatgatgatgaagagagatcaagtctgaaagcaagcaggggctgttctcgttcttcaacttgccaaggctgctcaacttgttactgtgaagggtgcatcaagtaccgctttgaggattgcaattgccaagaatgcagagactttatgctatatgctaaaccttaa

SEQ ID NO: 115821 - DNA, 370 bp, Glycine max
  Peptide Sequence Number=SeqID_232599
tgcatttaagactttggaaaccaagagtgaggggaaatttggtcacagtacaccgcggtggattgaagtgaagagtcacgttcaaagcggaacctatgagtgtggctattttgtcatgcattggatgtggaacataatcgtcgggcagttgaagactaattggacgctgtggttcaatgatggcacgccgctagacatcaacatcatgacaacattacgaaaaaaatgggcagaatattttgtaaaacttagaagcatccaatgtgaggatgatgttgctgcagatggaaacaaggaaaatcctactaatgaagctgaacaaaaagagcctgagaataaggaatattctggagtattgttgaatcaatga

SEQ ID NO: 115822 - DNA, 171 bp, Glycine max
  Peptide Sequence Number=SeqID_232600
atgggaggtgataacgacaagcgcagagagacacttgacaaggaagataaattaaaaaagggcatgggggacttcttggacgaaatgttaacaatgatgagtcagaccaaatcaaatggaaaatcgaatgagaaaagagatctcaattggttgtgcttgtgcgtgagctga

SEQ ID NO: 115823 - DNA, 99 bp, Glycine max
  Peptide Sequence Number=SeqID_232601
atgaaagtaggtgcatctcataggatgtcgttcatcaagggaaagataggaaatggctccgaagaaactctccacgaagaggtctgtgggatcctctag

SEQ ID NO: 115824 - DNA, 636 bp, Glycine max
  Peptide Sequence Number=SeqID_232602
atgaacggcgaactcttcttacacgcgcccaccaccaccaccactaactttttgcttccaaaaaaatcccaaacggcgtcgtcggagacactggacccatcacagaagctacgacgctacgaaacggcgctggaaggaatcgccgcggtcgtgggagaacacgtcctcttcggaaccacgttgtcgcatgtttctgagactccgaagaagacaaatggcgtgtcgtcatcgttgagcaagagctacagaggagtaaggaagcgaccgtgggggaggtggtcggcggagatacgcgaccgcatcgggcggtgccgccactggctggggactttcgacacggcggaggaggcggcgcgtgcgtacgacgcggcggcgaggcgcatgagaggcgcgaaggcgaggaccaacttcaagataccctcggtgttgccactttctccggaaggggttcatggtagtgccgtgaagccgaaaaccgcgcgaagcaacgctaggaagtgttcttccgtggaacaattgttcagtggggtgcctcaacttcgaaaagatgatggtatcggcgagaatgggaatgtggaggtcgatttgaagctgggtgtgaactttggtgttacgagctctagaatggtgctttag

SEQ ID NO: 115825 - DNA, 333 bp, Glycine max
  Peptide Sequence Number=SeqID_232603
atggggtttcagccattgaattggtactgccggccagcagagaacagcatttgggcaaaagcagtggatagtgcttttgggtcctatacaccttgtgcaatcaacactcttgttatctccatttccaatttggttcttgtgggtttgtgcttgtatcggatatggcttatcacttgcaatgctaaagctcagaggttttgtttgagttcgaattgctatagctatcttatgggaatgttggctgcttattgtgctgttcaacctattttgagattgttaactggaaattcagctttcaacctgaatggcgaaaccgaatttgctccagttgag

SEQ ID NO: 115826 - DNA, 2814 bp, Glycine max
  Peptide Sequence Number=SeqID_232604
atgtcggagcacaatgttcaaaactttagtcaacaaatggaaggagtgccaccagttgtgttaggggatgaaggcttgcctcgtctttatgaagattcaaaaatttctgagaaccagcttcccagacaacatggcattgtcaagagagctgtggctcttggacgttaccttctaaacccgctggctatggtggcaacattatgtggagtgaaaaatgagattgtgtcatggaagttgaacaccctggagaaattcctaacaagtgatgagaagttagagataattgaatgggtcatgacagatgttacaaaccaagtaggcatagacataaatttggccatccgacatgactggctgctagctcctttgcagtttgtttctggtcttggacccaagaaagctggcgtgttgcatagagaattacttgggggtactgatgtgagaaatagaagggatttggctaaatttgggctggataaagagaaggttttctgcaatgctgttggctttttaaaggtttcttgcgatgaagaaaactttgttgacaatggtagcaatactcttgatcatacaagaattcatccagagtcgtataatctttctgaggaattagcattagctgtttacaagaaacatgttcctgatccagaagctaatttttctggagtgaatgcaattgaatacattcaaaatgatccaaacctgcttgagaattttgatttaaatgaatatgctgatagattggaaatagaaaaaggtgaatacaaaaggattactcttattgacataaagatggaattacttcatggatttaaggatcctaggattccctatacggaactgactcaagaggaggaattctatatgataactggagaaactggggatgcacttgttgaaggaaaaagagttcaggcaacagttcgtaacgtgatgtctaaacaggcattttgtgtgcttgactccggaatgactggagtactttttaaggaggacttttcagatgaaactgagaatatctctttaacagacaaattgcaccaaggtgccgtgcttacatgcaagatcaaactaattgataagaacaaatgttgggtcaatctgacttgtaaattgagcgagctgaagaatgatggtgagcaaggtttccatgacatggatccttattatcatgaaggaaacatcatttcaattagtcaggtggagagagcagacaaaatggagcttggaactaaaaatttcaagcccaggatgatttctcaccccaattttcaaaatataactgcagatcaagcaaaacagttccttgcagatcaggaagttggggaatatatttttcacccaagttcaaggggtcttagttttttgatcctgtctattaaaatttttaatggagtttatgtacacaaagacattgtggaaggtggcaagagtcaaaacttgcctgaacttggagagacattaaaaataggagaggaaacatttaaggacataaatcaggttattgaacactatgtcaatccattggtagttcatctgaaagatatgattaatttccgaaaatttaagaagggcacaaaagctgaggttgatgaactcttaaaacttgagaaggatgaatatccaaataggatagcatatggctttggcatttcatatgagcatcctggcactttcatcttgtcttacattagaagtagaaatccacatcatgagtttgttgctatccagcgaaagggattcaagtttaggaagcaaatattcaaaaatattgagcagctggtggcatattttcaaaatcatatcaatgataatgttgcacctgcaaaatcctgcatagcagttggatcatttagggagtccttgtctggaggatggagaagcaacaatgtagatcagcacactgaatcaatagcctattcctctgaaaagaatagtgatcttggattatttgttcgaattcaagcttacaatgacagtggaaatggtagtaatgctggtcgtggccgtggccgtggaggccgtggacaaggccgcgaccgtggaggctgtggacgtggccgtgatagtggaggttgtggacgtggatttggccatagatctggctctcgtgattattttaatggtgatgacaatgatggaagtagttttccaagttcaaattggggctctggttctagagattcccctgatgattcctttggtgcaggtaagagttgggaagtgaggggttctggagaaggcaatggcgggagacaaggtaggggaaggggaagaggaagaggaagtagaggaagccaaggtgatggccaaggacgtgttccttggggtggaaatagccacgagagaggtggttatagtgatggcaatagtgatagtggttggggacaaggtcaggatcagggaagaggaagcgatggtaatggccaaggacgtggtcgatggggtggaaacaactcaaatgaagaaaggaacaaggacgaagagagcagaggaaatggcagttggggattcggtaatgctgggtcaggaaatgagaactcaggatgggggaagaatgcaactccctctggtgatggcagtggatggggagggacagggggtagtagttgggaaaaaactgaatttgatgataaccttgatctcgggagagtgcagtcttcttctcccatttctctcgtcagtgccacattttgttcggttcattggcaaaggttaggttcggtgaaggtgaaggtacccgtgttcagtgttgcggtggtcgtcggcggcatacgaggtaccgtagatcgcgcggatcaagttgatccgtaa

SEQ ID NO: 115827 - DNA, 1189 bp, Glycine max
  Peptide Sequence Number=SeqID_232605
atggcagccgacaggttggcgggtatgatttacaggagcatacaagttgtagtcttttctaacaaactcaacttgcttatgccttttgggcctcttgcaattcttgtacagaagttgactggtcatcttggttgggtctttggtctgagtttgttggggataatgcctctggcagagcgattaggttatgctaccgaggcagcaactgggagttcaatgaacctggctagaacactgggtccagcaattgctgcacacaactacaagggcatgtggatctatctcacagctccaatacttggatctctatgtggggcaggtgcctacactgtgctcaagctgcctgatcacatcaggaagagtgatagcaacactgcaagagatttagtgcaacatgcatcaggagttggtaagagttctgctaacagaagtgcacaacaaaaggcaaaccaccttgctctaggaaagtatttggagaccgacctagcctgtgaagcagagccaatccagcgcccagctctacctcaagctgaaaaaaagcggaagcttgattcctggagtagagatctaaacaaacgtgaggccctaactgatcaagagaagaagaaacttgaagaggacaacaagaaggttggagcagagtttctgggcacgttccttctcatatttgcggcaataagcgctgcaattgaaaaagaaaagtcacaaggacaagaaactatgatgggatgtgcagaaatgactggagttgtgcctttgtatattggtgcacaagttttggcatcagtgagtgctgcatttgctctgaagttaatttttcatccattcatgagcggtggagtgacggtcccttcagtgggatatgggcaagctttcgttgcagagttcagtgtcagctttactcttatgttcgttgtcactgcagtggccaacggcacaagagctgtgcgattgttcgcgggaatcgtggtgggagccactgtcatgatcaacatacacatggcgggggcagcaactgggagttcaatgaacccggctagaacactgggtccagcaattgctgcacacaactacaagggcatatggatctatctcacagctccaatacttggatctctatgtggggcagcttcagaaggtgatgatatgattaaccatatccccggcaattcttcatcacatgctgcac

SEQ ID NO: 115828 - DNA, 462 bp, Glycine max
  Peptide Sequence Number=SeqID_232606
atgcaagctgagctacctgaccatggtgaatatgaacctctttgtggagatgatcaagtttgccctgagaggcatgccaacatattctctagaatatgtttcggatggataacgccactcatgaaacaaggctacagaaaaccaataactgaaaaggatgtttggaagctagatgaatgggatcgaacagagacattaactgaaaagttccaaaagtgttggatgttagaatttcaaagctctaacccatggcttttaagagcattgaacagtagtctggggaaaaggttttggatgggaggcatctttaagattggtaatgatctttctcagtttgtgggacctattttgctgaatcatctcttagattcaatgcaaagaggagacccatcttggattggttacatctatgccttctcaatatttgttggagtggtatggctactgtctcttataatttaa

SEQ ID NO: 115829 - DNA, 225 bp, Glycine max
  Peptide Sequence Number=SeqID_232607
atggatggttggcgaggggttctcctgggcatgctgctgctggagatttttggggctattattgctcttgaaatgactaaggagaagggttggaaccgcacctggcttgagtgtgattttactttggtgattcatgctttcaaaaaaccttctattgttccttggcaggactacaactttttggttggactccatactttcctttgtcaaagaggagttccttag

SEQ ID NO: 115830 - DNA, 375 bp, Glycine max
  Peptide Sequence Number=SeqID_232608
gtggctgctatatttagaaaatctttaaggctaactaatgatggtcgaaagaacttcccatctgggaggcttatgaatatgataacatcagatgccaatgcattacagcaaatatgtcaacaacttcatggactatggtcagcaccattccgtatcactgtagctattgttctcctataccagcaactaggtgttgcttcacttattggatcattaatgctagttctcattatcccactgcaggcaagttttgtcacttcttttatacctcagatatgtgtattatggtttttgctgtctgaaagacaaatattaggaaaaaaccctgagaatccttgtctagcagcacttgatatctttctattctttgtatag

SEQ ID NO: 115831 - DNA, 819 bp, Glycine max
  Peptide Sequence Number=SeqID_232609
atgactaaacatgttcttagaatgcttcttaacagttttatactgaacagcatccctgttcttgtgacggtgacctcatttggaatgttcactttactgggtggagaattgacacctgccagggcatttacctcattatctctgttttcagttttgcgctttcctttaaatatgctaccaaacttactaagtcaggtagcaaatgcaaatgtctcattgcaacgtttggaggaactgttcttagctgaggagcgaaatttaaaacaaaatccacctattgaaccaggacttccagccatctcaattgagaatggatacttttcatgggatcgtaaggaagagaaaccgacattatcagatatcaatgtggaaataccagttggcagcttagttgcaatcattggcggtactggagaaggcaaaacatcacttatttcagcgatgattggagagttacctcctttagccaatggaaatgctacaatcagaggcactgttgcttatgttcctcagatttcatggatttacaatgccacagttcgtgaaaacatattatttggatcaaaatttgaatatgaacaatatcggaaggtcattgatatgactgctctacagcatgatctcaacttactacctggacgtgattttacagagatcggagaaagaggagtcaatattagtggtggtcaaaagcaaagagtttccatagctagggctgtatactcaaattcggatatatatatatttgatgatcctttgagtgctcttgatgctcatattgctcaagaggtatcttccttatttcttatcaagctctag

SEQ ID NO: 115832 - DNA, 1701 bp, Glycine max
  Peptide Sequence Number=SeqID_232610
gttttcaggaactgtataaaggaagggctacgagggaaaaccagggttcttgtcaccaaccaactacattttctccctcaggtggataaaatcattctggttagtgaaggaatgattaaggagcagggaacctttgaggagttatcaaaaagtgggcctctatttcagaaactaatggaaaatgcagggaaaatggaacaagcagataataatgaagatagagaaagtcatggcacagataacgatttacccatgaataatgaagcaattgaggaattaccaagtgatgcaagctatgagaaaaaaggaaaattacgaaaatcagtacttattaagaaagaagagcgggagacaggcgtggttagttggaaagttgtaatgcggtacaaatctgcactgggaggactgtgggtagtttccatactattttcttgctatacattaacagaagttcttcgaatttcaagtagcacatggttaagtgtgtggacatctcaagattccactgcagattatgatccaacgtattttcttttgatctatgcacttttctcatttggacagagagttatatttatcagcttttgggaaaacgaaatgaatatttcctttgctgcattcagtcttcgtgctgccaaaaatttgcacgatgcaatgctagataaaatcctccgggctcctatggtattcttccaaactaatccggttggccgcataattaataggtttgcaaaagatacgggagatatagataccaatgtttttaatttggtgaacatgtttttggggcaagtctggcaactactttcgacatttgttcttataggcaccgtgagcaccatatccctgtgggctataatgccacttctgatcttcttttatgcagcttatctatattaccagagcacagctcgagaggtaaagcgcatggattccattacaagatctcctgtttatgcacattttggtgaatcactgaacggtttgtcaagcattcgtgcatataaagcatatgacagaatggcacacattaatggaaaattcatggataaaaacatcagattcactcttgtgaatatcagctcaaatcgttggctaaccataaggctagaaacattaggaggcctgatgatttggttgatagcaacatctgctgtcttgcagaatgcaagagctgcaaaccaggcaatgtttgcatctacaatgggtttacttctcagttatactttgaacataacaaatctcttgagtggtgtcctcagacaagcaagtagagctgaaaacagtttaaattctgttgagcgtgtcgacacatacataaatttagaaactgaggctcccggtgtaattgagacacatcgtccaccaccaggatggccaacatcaggatcaattgagtttgaggatgttgttctgagataccggccagaacttcctccagtgttgcatggattgtcctttacagtacctccaactgagaagatagggatagttggaagaactggtgcaggaaaatctagcatgcttaacgcactattccggattgtggagctacaaaaaggaaaaatcattattgatggttgtgatatttctacattcggattagaagatgttcgaaaagttcttactatcataccacaatctccagttcttttctctggtattttccatgaacagaattcttgttctgtgctaaattag

SEQ ID NO: 115833 - DNA, 339 bp, Glycine max
  Peptide Sequence Number=SeqID_232611
atgactctctctctctctctctctctctctctctctctctctctttctctctctccctgtatctgcattgtggcacatatttatttaatatggcaagaccctgcagaaactgaggagatatggaatttctggaatcctatcctatggacttttgaacactgcatactgtctcacaacgtttctttttgtgtgagatctagtttgtataagaaattgttttacattgctccagcacctgcaaagatgggctatggtgcagctgtaaaaagatttctcaaagtgatggccatggtgtgggctggtagtcaaatcactaaacttgtaagagcaggagggtga

SEQ ID NO: 115834 - DNA, 183 bp, Glycine max
  Peptide Sequence Number=SeqID_232612
atggccaatgggtatttgctaatagcaaggggcgtttgcccatggttaagggagtatccaaccgtggccgaggagtgtctgattttcatcatatggaaaggcctatgcggtcatgtgaatgtgacctctgctatacccattgataacgatgtcattgcgaaagggcaaacaacggatgcctag

SEQ ID NO: 115835 - DNA, 177 bp, Glycine max
  Peptide Sequence Number=SeqID_232613
atgcctcctcctcctcctcctgttaacacaagtggtggcaagaggaagaatccgagtacctctaatctggaagatgtgagggagaagaagtggaaggctactactttgcctcaagtttctgcttggtcccatgtcgataaatacttggctttcctttcgatgaaggatggcatgtag

SEQ ID NO: 115836 - DNA, 1068 bp, Glycine max
  Peptide Sequence Number=SeqID_232614
atgtctcatctacgcacacaagttaaacaagaaaaacaactcatgaacatccaggaagcacatgaaacgattgcacaacctgtgtgctctgtgtgcaacaacacaagaccaaaatttgaatgcaacaaaaagagagacttcacctatgctgagctgtatgcatccacacaaggcttttccccaaagaattttctgtctgaaggggggtttggttctgtctacaaagggacgttgtatggacagaaggttgctgttaagctacttaaacttatgtgtgcaaaccacaaaggagagaaggaattcaagtctgaagttgatgcactcagcaaagcaaggcatgagaatgtggtcaaactgttaggatcatgcaccgaagggaatcatagacttcttgtctatgaatatgtctgcaatggttcattggaccaacacttatcacaacattctcgtaaacctcttagctggaaggacagggtgaaagtagctattggagccgccgaaggattgctatacctgcatgagaacaacatcatacatagagacatgacaccaaacaacattcttcttacacatgattatgatgtattgctaggggattttggtttggctagaaccgtactcgaagattcctcatactccactgactgtgttgggaatctgacttatatggcaccagaatatgcagaatttggtaaagtgtcaactaagacagatgtgtattcctttggggtggttctgctacagctaataactggaatgaggaccacagacaaacgagttggagataaaggtctagtgggatgggctagaccactactaaaagactggaaatgccaatcacttattgatggaaggatgataaactctcatgactgccatcaactctattggatgagccgtcttgttggaaattgtctccagagagatcctcaaaagagattgaatatgaatacagtggtcagagctttaaatcagataggccaaggttgtagctgcattgtgcggatagaccatacgcttgccgagtcaagccattctattccaaaagatgatatacggagctcttaa

SEQ ID NO: 115837 - DNA, 1521 bp, Glycine max
  Peptide Sequence Number=SeqID_232615
atgatacatcacgcagtgtctaggtcttcatcaagtgatctgttgacaccaactgtagtttcaagtcagtggagtacagaagtctccacttctagttttggaagcttgcggcatggctgtcaataccaagagggaaagttttattcaaatatagaacaagaaacaacatggaaccgatcactatttcacatttcggagaatgaagaaacaagtcaaatagaagtaaatcaaaaggagcagaacagcagaaataacgaagcatctcatatggaggaagaattcacaaatccattttgttccgtgtgcaataatagacggccaaaaattggattgaagagagatttcagttatgcggagcttcatactgcgacacaaggattttctcctaagaactttctgtcagaaggtggatttggatctgtctacaaagggctgctgaatggaatgaagattgctgttaagcaacataaatatgcaagcttccaaggagagaaggaatttaagtctgaagtgaatgtgcttagcaaagcaagacatgagaatgtggttgtgctgctaggttcatgctcagaaaaaaacgataggcttcttgtgtatgaatatgtctgcaatggctctcttgaccaacatatatcagaacactctcgatcacctcttagttgggaagataggatcaacgtagctattggagctgccaaaggcttactatacttgcacaagaacaacataatacacagagatgtgagaccaaacaatatccttattacacacgattatcaaccattgctgggagactttggattagcaagaaatcaaaatcaagactcgatacactcaacggaagttgttggaactttggggtacttggcacccgaatatgcagaacttggcaaagtgtctgccaaaacagatgtatattcttttggggtggttctactgcaactaataacaggaatgagaactacagataaaagactcggaggaagaagtcttgtgggatgggcaaggccacttttaagagaaaggaactatccagatttaattgatgaaaggatcatcaactcttatgatgtccatcaactattttggatggttcgaatagcagaaaaatgtctaagcagggagcctcaaaggagactaaatatggtgaaggttgttgatgctctaactgacatagtggaaggcagaacatgtgacatcagattaagggattactcccctgcaaggtcagattcaaccaatggtgtatcagactctgatgaatctaaagatgaaatgcaggaacccttcaggtttgaagaggagttactaagtcacagttcagaatccatagaaaataacaacataagtcagatgatgcagatgattgtaagacagccaccatcccctccaattcagagcatcttttcatgtatctcaagctcatataagtttcattatgagtcaactagtgatggtgaagcacagaatgaaggggaaatagaaatatcaaattcgaatggagggttactatattcttag

SEQ ID NO: 115838 - DNA, 417 bp, Glycine max
  Peptide Sequence Number=SeqID_232616
atgatgacaacagaagctgagactgagagggtagtggtgatccaggatgcatcaagagatgttaattcaaatgcaatcctaagggccctggaatggttttctgttaaagctggagatcagcttataattgttgctatccttgattggattagcagtcctatgggttacatggtcagagttgattccagttcaatgatttcaacaaacaagaaaataattgaaaaaaggcttaccaaaataaaggaagaatatcttaggaaccagaacatcgaggagatctccaactactgtaaattgaatgagattggattccaattagaagtacttgtaggctctactgcagaggttgcttctaatgctgctaaggaatttcaggcgacaaggttgatactagttaggtccgtttctaacttctaa

SEQ ID NO: 115839 - DNA, 816 bp, Glycine max
  Peptide Sequence Number=SeqID_232617
atggttggcgcaataacaagtgggcctattaccgattttattggacgaaaagggttcatgatcactgctgctgtgtcagtgtcattcacaattggaaatgcaaagagaggacgtcaaaaagattttgtggcagcgctgcagatacttcgtggcaaagatgccgatatatctgaggaggcagaggaaattcagattggaataggccttatggtctgccagcagtttgggggaatcaatggaatttgcttttataccagcagtatttttgaactagcaggattttctcctaccatcgggactataacatatgcttgccttcagattgtgactacaggtcttggagcagccttaatagataaagctggcaggaagcccctacttctaatatccggatcaggattggtagtaggatgtatgtttgcagcagttgcattctatctcaaggttcacgaggtgggtgttgcggcagttccagcacttgccgtaatgggcatactgatatttcctgttaatattaaagggctggcaggaagtgtggccacattagtgaactggtttggtgcatgtttatgttcctatactttcaacttcttcatgagctggagctcctatgggaataatagtagaagattgaagttcggtaatgtgcaaccagtaaattcatttgtgtatggtttgcagaaaccaaggggaaaagcttggaacaattacaagcagacattaactcataggaagcaggagttttgtaatctgcagaacagtgtaaggtggaaaaagaaaaagaaaaaaccgacagcactcacagcagtttcgtga

SEQ ID NO: 115840 - DNA, 1356 bp, Glycine max
  Peptide Sequence Number=SeqID_232618
atggcaatcaaagaagatgtggaggatcgcacacagaaaggaatcagagagccacttgttgtgggggaacagaatcaccatgcaaacaaagggcatccatggatggtttacttcagtacatttattgcagtgtgtggctcttatgaatttggggcctgtgctggatattcatctcccacccaagatgctatcaggaaggatctcagtctgtctttggcagagtactccttgtttggatccatcttgacttttggtgcaatggttggtgcaataacaagtggacctcttgctgattttattggacgtaaaggggcaatgagagtgtcaagtgctttctgtgtcgcagggtggcttgttatttatttttctgagggtccagtgcctttggacattgggaggttagcaacaggatatggaatgggagttttttcatatgtggttcctgtctttgtagcagaaattgcaccaaaagaactccgaggggcactgactaccttaaatcagttcatgatagttactgctgtgtctgtgtcattcataattggaaatgtactttcatggagggctttagctataattggtctcgttcccactgctgtgttgcttttgggtctgtttttcattccggagtctcctagatggctggcaaagagaggacataaaaaagattttgtggcagcactgcaaatacttcgtggcaaagatgctgatatatctgaggaggcagaggaaattcagattggaataggccttatggtctgccagcagtttgggggaatcaatggaatttgcttttatgccagcagtatttttgaacaagcaggattttctccgaccattgggactataacatatgcttgccttcagattgtgatcacaggtcttggagcagccttcatagataaagctggcaggaagcccttacttctggcaagtccaaagcacaaaacattatctggatctggattagtcgcaggatgtatatttgcagcagttgcattctatctcaaggttcacgaggtgggtgttgaggcagtcccagcgcttgccgtaacaggcatactggtctacataggatcattttcaataggaatgggagcaattccatgggttgtgatgtctgagatatttcctgtcaatgttaaagggctagcaggaagtgtggccacattaactaactggtttggtgcatggttatgttcctatactttcaacttcctcatgagctggagctcctatggtaccttcatcctttatgctgcaattaatgcactggctatattatttataattgttgcggtgccagaaaccaagggtaaaagcttggaacaattacaagcagacattaactcatag

SEQ ID NO: 115841 - DNA, 1731 bp, Glycine max
  Peptide Sequence Number=SeqID_232619
atgatgacagacgaggaattgttgcagaaacttgaagacttaaccaaaaacgcccaacaccaccacttggagactctccgctcgatccttcttcacaatggaatcgtgcactatcttcaatccttcaagaagggttctcttcttcatcttgatccatcaactttcgcacgtgtcgtgcccttgtccacgtatgaggactacgttgactacattaaccagatggcagaagggaaagatgacccttttctctccgttgaccctctccgctgcttcttttacagctcgggaacaagttcaagcaccatgaaaccgaaattgatcccttactttgattcaagcctttccaaagctgcctcctttattggtcaccgaggcagtgttgctgttcgtcaaaggctatttcctccaaggccagaagtgaacaagatcctatggtttctctatgctgacaacattactaccactaaatgtggcttgaaagtcatggctgcatctacataccctttgcaaagtggtaatgctacccctcaacaacttgctgccttttccagtcccctagaagtgattcttgccactaatgttgagaatcaaatgtactgccaccttctatgtggccttaggaatcttgaccttatagatggaattgcaaccccttatgctataggcttgattaaagcatttggttttttggagtccaagtgggagcagctatgtgatgatcttgaccatggatttccatgtaatgaaatttctgagggggcaatgagggaagctgtgaccaacacacttggtggacctcagccagaattggcaaatagaataaggttaatctgtgaaggtaataactggggcggaattgtgtatagattgtggccaaacattcgttatattaggtgtgttaccactggaagcatgaagcagtactaccaaaagctcaagtattatgcaggagaggtacctattttaggaggagattattttgcttcagagtgctgtgttggtctaaatttagacataatgcaaccccctgagacaacacggtttgtgatgcttccaacttttgcctactttgagtttcttccatttaacataaatgaggacaatgatgctagcaaggaagctgtggactatagcagtgtagaggttggcaagatgtatgaagtggttgttactacttacagaggatattaccgataccgtttgggcgatatagtgagagttgttggtttctataattcatctccactagtagagtatgtgatgagagcacctaaaactcctgctgagattgtgactgagaaggacttgatttcagcagttgaaaattttcaacttgcacttagaggtgctatgagaattgagattgttgagtttgcaagtttcttggaccaggagtcaatgccgaagcagttgaaggtatttgtggaagtccaagaggaatctgattttctggaggataagctagaggaatcagttagagttttgagaagttgtatctcctctcttgagagtgggttgggagctatatacaaggtgcagaaggataaaggtcaactaaggagcttacggatattcatcataaggcctggagcttttgatcagttatcagaattagccattaaaaatggaacatcagctagtcaatataaaccacccaagatcataaggaatcatgaagttgtcaaactcttggaaaaattagcctttgtggcagtatcattcgatggctaa

SEQ ID NO: 115842 - DNA, 1041 bp, Glycine max
  Peptide Sequence Number=SeqID_232620
atgcaacccaatgtgatgaacaccaatatatgttccaatcatgaagaatgtgaaggacgttcttcacagataaagctgactaagggtttcacagcaaaggagtccgtgaaggggcacatggcaaaaatctgcaagctgactgattttgtgaatgagattcatgctgctggccagaacggggagctctcaggtgaaacttttatactattcaacaaacagatgaagggaaacaagagagagctgattcagttgggtgttccgatatttggacagataaaggacgataccaaaaacaacatagagccgattccagcacttcttcatgatgtcattgatcaccttattcaatggaaattaattccagagtacaaaaggccaaatggttgtataatcaacttttttgaagaggaggaattttctcagccattcctgaaaccaccacatttggaccaacctctatccacccttcttctctctgaatcaactatggcttttgggcgtatccttacgagtgaaaatgatgggaactacaaggggccactcatgctctcattgaaggaggggtctcttttagtgatgagaggaaacagtgctgacatggcaaggtacgtaatgtgtccatcccctaacagaagggtgagcatcaccttctttagagtgagaccagactccaatcattgccaatcaccaactcctaccatgacaactgcgatgactctttggcacccaagcatttctagcccttttactttgccaaagggacctctaaatggctatgaggctatggatatgatgccccaatggggattacttagtgctccaatggtcatgctaactcctatgcgccctatggcagtaaatactcgcaaacttcctcgaggtggtactggggttttcttgccttggaagggagcatccagaaaacatacaaggcatcttccaccgcgcgctcaaaaaggacgccttatggaattaccctccccagttgaatcacacatgggagagtccacttctgaacccagcattgctgttgaaggatag

SEQ ID NO: 115843 - DNA, 1111 bp, Glycine max
  Peptide Sequence Number=SeqID_232621
atgaagtattttatcatagaaaatctcacttgtcgatcaccggtcctaattcttttgattatttggaacaatggtaggctcatgggagagggtaccacagcacaagcgagagttgaaaactccatcatgcttaaattcctcaacaagaaccttcgccgcctcagctcccacctccgctggccaccacgacatcgttccaagcccactcccaaacctcctcctcctcctcccaaaccaatacgaatcgcaacgttcaacgccgcattcttctccatggcaccggtgcttcccgaagcagacggaaaaacaaccaccgccaccaccaccacttcagacgacaacaacaacataggacgaccacgaagcattctgaaacagtccaagtctccgctgctggggaagtcgtcgaagctgagagtgtccatcaacttacccgacaacgagatttcgctgcgccaaacgagcttctcggagcatgagagatcgaaattaggctccttcgccgagggaagaatcgaagaaggaggaaaagagaggcagagaagaacggtggttgaagttctgagagagctaaacgccgacgttttggggttgcaagacgtgaaagcggaggaagagaacgggatgaagcctttgtcggatttggcgagtgctctgggaatgaactacgtcttcgctgaaagctgggctcctcaatacggcaacgccgttttgtctaagtggcccattaaacgctggaagctacagaaaatctttgatcaccacgattacaggaatgttctgaaggccactatcgatgtaccccaagaaggtgaactccacttttactgcacccaccttgattatcttgatgagaattggagaatgaagcagataaatgcaataattcaatctaatgatgagccacacattttagctggaggccttaattcgcttgatgaaacagattattcccaagacagatggacagatattgtaaagtactatgaagagatgggaaagccaacaccgaaggttgaagttatgaaacatctcaagagcagacactacacggatgctaaggatttttcaggggaatgtgagtctgttgtcatgattgccaaaggacaaa

SEQ ID NO: 115844 - DNA, 1281 bp, Glycine max
  Peptide Sequence Number=SeqID_232622
atggagcaggcaccaaaatgccaaacagatagttcaacatggcaatgctactgggttgacttccccggcaatgcatttcatcaaaagcggcacctatccgattcccccaccagcgacggcggcgcgtgggaattcagcggcctatggaaaaccctaagcgcgaaatcggaatccatcatcgatacctaccgtcgcgacctgcaggaattcggcaccggtttgaagaaggagattgaggtcgctcacggttccctcgagacggtgggccacgtcatcgaccagttcggaaacacagtcgtcaaaggcacctctcacatcaaatcatatctcgattccgataataataacagaaacaacaaccccggcggcaacgaagaaaaaaagagtttcaattcgaagcgctattataataggtttgacgcacaggttcgtgcaattcagggtgacgttagcacctacaccgaagtgcctgaggattcggatgagtatactgattggaaatcagggttttcgttggaagggaagagtgatgaaattgaggattttttaaaagagagtgaggcgatggagagtgttttcaagagggttgttcccagtgttgttgaccgtgacacgttttggtgtaggtattattatagagtttataggctcaagaaagctgaggatgtgagggcgagactcgtgaggagaatgtcgagggaagaggaggagttgagttgggatgttgaagatgatgatgatgatggtgatggggatgagaataaggggaaagagggagattctgagttgcatggtgatggaacaaagaaattgaatgtggaagagatgcataagtctggtgaggaggggtctaaggaagaaaagagaggtgatttattgcaaagcaagggagatgagtgtgtcgaagaatcaaaggttgacaagaacaaagaggttgttgagaagatgggtgatggaagtagtaagaaaactatcaatgaagatgatgagaggaaagattctggtgtggattctggtaagaaagtgataatggaaagtaaagttgatgatggaaaagattcgttggttgcaaataagcactcggggaacaagaaagaggaggaggatcttgagtgggatgaaattgagaatcttagtagaattgatgaagagaaggaagttcggacgggtagccctaccaaagttgatttgcggaagcgcctcagtgctgctcaagagcaagacgaagaagacgacttgagttgggacattgaagatgatgatgaacatgctaaggcatga

SEQ ID NO: 115845 - DNA, 179 bp, Glycine max
  Peptide Sequence Number=SeqID_232623
atgtctggtcatgtggagtaacgttatatgtgatgctagtgggagcatatccttttgaagatcctaatgaaccaaaggactttcgcaagacaattcagtattccattccggacggtgttcaaatatctccagagtgtggccaccttatctcaaggatctttgtttttgacccagcagag

SEQ ID NO: 115846 - DNA, 1011 bp, Glycine max
  Peptide Sequence Number=SeqID_232624
atgtcttcattcttgtctaactctgccatcgacatgagtggtagtgattctgggatctcgattgagcaatccatgatggaccgagaggtcatttctattggcggttccttgttggaggatactccttgtggtgccttcaatagcgagttttcctttttggagagggtgagggcgtcgcgccatattggtaggggcacttctcgccctcgcgggagggtgcgaccttccactacttccgatgagtctgtctcggttaatgtgatcctcctaccttttgcttttcggggtttgaggagaggtagtggtggtggagatgccagggcatctccccgtttgcaatgtagccatagcactaggtcgtcgtcatccacacctgtcgtcgttgggtgtgagtggacttgcgggagtgatgacttcactttcttgagagcggcgtcgattagtttgcccttcttctttatgtataggtatctatttgagggacaaggagctctgcttctattggtaatcttaccataccaagtcaagtcgtttgatgaggatctgttgacccttgtggagaaggtcgacaaagctattttggagttgttgtcggcttcactggacgagtgggccattttgttttttccctcaacgagctccccttcaatgccttggatggtcggacctgggagtgagactgtgccaccgtctgcttctactcttattcttggagaaagaggtcaacctgctagtgaggttggccttgttgttatttttgctgaggtcatacctagcgctcattcctctgttttggcaaagaggaagcttgatgatggtactgggtcgtctaactgtaaaaagtcaaagacctctaggaagctagataatggtgctgaagaaagtgcaacaactgctttagccagtactgttgtgatgccgttgttcattattgtagcacatttgttgagtgtcagtgtggcaaccactagtactcgtgtggtgcccctccttcttttacaacttcaataa

SEQ ID NO: 115847 - DNA, 537 bp, Glycine max
  Peptide Sequence Number=SeqID_232625
atggcggctgtcccagcatcgcggaccgatccaccaccggcaatggtggcgccgccgccgttgttggtctccgactccttcgccaaggatgccattctcgcctggttccgcggcgagttcgccgccgccaacgccatcatcgactctctctgcggccacctcgcgcacctcgccgctgcatcctccgactacgacgccaccttcaccgccatccaccgccgccgcctcaactggatccccgtcatccagatgcagaagtatcactccatcgccgacgtcactctcgagctccgcagagttgccgagaagaaaacggagaccgaagccgcgaagaaaagcgagagcagcttcgacgaggaagggaaattggagaagcaagcggtggagaatggcggaaacgacggtggtgacgacgatgccgcgccagtgtatgattcgccggacagtgaaattactgattcaggaaaaaaagttattttcgttccctgctgtgtggcgaagaaaaataaccaaaggatatttgcctatttggcatga

SEQ ID NO: 115848 - DNA, 288 bp, Glycine max
  Peptide Sequence Number=SeqID_232626
atggatacaactgaaattgtatcattttatcagaattcaccatacgagctttatctgttgtttgagcagttctgtgaccacttccatgcaacatcaaggaattcaatgtatatgaatttcatatcttctcattcaaataatatccacgcactggaacagctccggagcattaaagataaggcaagcagctctgcacagtttgtgaagaatatttttgaatcaagattcattgctgacaaagccattgcagaaattgaggcaaagtgtggccaaaaaattgaagaatga

SEQ ID NO: 115849 - DNA, 255 bp, Glycine max
  Peptide Sequence Number=SeqID_232627
atggtgcaggggttcagtcgcacgaccgcgcgaagggtgctgatggtggtgtgcaccggcgacgaggtaggtgggaggtcgcgtggagctgatctggtggcagcgtgtggtgcgatgacgatggtggtcgaggatctgatttgtgagaagattgcacgccgtgttggttcaggggtcgttcgcaataacagtcttttgatcatcattcaggtccaaacattactcaatatactcacaagcaattgggaccgctaa

SEQ ID NO: 115850 - DNA, 315 bp, Glycine max
  Peptide Sequence Number=SeqID_232628
atgaaaaagctaggcagtagaagttttgatttccgtgtaactgaagaaagtttgatggatcgcttgggtataaatatacatgaagcatgccttaagattgacaaagaatgcagggtctttacaattcatggttcttccgatgaaattattcctgttgaagatgcatttgagtttgccaagatcatacaaaaccataagttacatgtcattggaggagctaatcatatgttcagtaatcatcaaggagagttgtcctcagttgttgtgaactttatagaagaaaccttgcaccaggtcaagggtactgctagctag

SEQ ID NO: 115851 - DNA, 606 bp, Glycine max
  Peptide Sequence Number=SeqID_232629
atggctctgcctccacaaaacccacctgttcagcgacacagagtcataatacccaacaagcacggtgaaaagcttgtgggcacattgcatgaatctggaaccagggacattgtaatcttgtgccatggttttcgatgcacaaaggataccaatctcatattgaaccttgctgttgcattggaaaatgcaaaaattagttctttccgttttgacttttctggaaatggggaaagtgaaggtttgtttcagtttggtaactattggaccgaggttgatgatttacatgctgtagctcaacatttccatgaatctaaccgtgtaatcagtgcaattgttggtcatagtaaaggaggtggcgtagtgcttctatatgcttcaaaatatagtgacattaaaacagttgtcaacctctctgggcgttatgatatgaaggcaggcattgaagaacaccttggaaaagattatttggaaagaatcaggagggatggtttcattgatgtgaagaagaggaggtcaggaaaagatttcagaattggtttagggagggtccaggttcctcaaactgccagggtatctcatactcattctttcattcttgattcttga

SEQ ID NO: 115852 - DNA, 237 bp, Glycine max
  Peptide Sequence Number=SeqID_232630
atgggtagaagtagaggaaaaggtaaaaagttaactattagcaatgaggaggatgccataagtgaagaagaagaaaaggttcctaagcaaaaaagaagagggaggccacataaactgtataaggaagactttgatgaagaagaaattgaggaaatattagaagaggatgctactagtggtgacaacgttatgaatgtagtgtctagcaaagagatgaatggatgcggttttcattga

SEQ ID NO: 115853 - DNA, 313 bp, Glycine max
  Peptide Sequence Number=SeqID_232631
atggcttttgaaaatggttccaaaaaggagcttgagaaagttggtctaaaaatctcgaagagctttcctcttactaggactactctggcatctatggagtctttgtccctgccagtggttcaagaaattgttctttctgctgatatgcaatgtgagaagtgccagaagagacttgaaaaaacatggcaactgcagcatcaagaagacctaggtggtgccaccacgctcctcctcctcccacccccaggatccttcactacccccgtcggagaccctcttcccggagggaccttaaatccaatactactaacag

SEQ ID NO: 115854 - DNA, 441 bp, Glycine max
  Peptide Sequence Number=SeqID_232632
atggggaatacaacaagctcatcaaattcaaaggttcatggccaggtaacaagggttgcatcaactgaacctagctatgacccaatgatgggtatgcccgttgctaaattcagagatgaatacataggcaaatccaaggcagagactcgaggcactttgaagggacaacatggtactggggtgtactcaggtaacaccgcacttgacaacgatgaaactttcaacagtttcattcgacatgccaagtataaaattaaaaccgtttcccacatcgatggggagcagagcaacgttgcatcttcatcactgccagatgatgaggctaatgcaaaggatagccgccaaaacgaccagttttcaacttttattcagagtgctaagaagaagttgagagctacatcaagcatgagaaagaatggttccttcttcaagagaggctaa

SEQ ID NO: 115855 - DNA, 459 bp, Glycine max
  Peptide Sequence Number=SeqID_232633
atggggaataagaactcatcaaattcaaaggttcatcatggccagataattacaagggttgcttcaactgaatctggctatgacccaggaatggggaggcccgttgctaagttcagagatgaatatatagccaaacccatgatggcaaagaccccaagcacttcgaagggacaacatggtacttgggtgtactcaaataacaccccacttgataacgatgaaactttcaccactttcattcaacatgccaagtccaagtataaaactactagaactgggtcccacatcagtagggagaagagcttcgttgcatctgcttcaacaccagatgatgaggctacggctagccctagggataaccaaaacgaccagttttcaaattttattctgaacgctaagaagaagttgagaactgcaccaagcatgagaaaaaatggttccttcaagatcagtggctaa

SEQ ID NO: 115856 - DNA, 279 bp, Glycine max
  Peptide Sequence Number=SeqID_232634
atgatgtatccacaaaatcggaagctagctcagccacctgaagagacatacactgtcacatgtttgcaggcgtacacaaatgctcataggataaatttgtatcttcaaatgactgataagctgtgggaacttgctttgcctaacattggttcgattcacaagcgtgctaatctgtccaagaaattatctgttctttctccggaggagttaagagattttgtttcctgtaagatagtacaagaatcaagtggagaaattcagtatggtggtgaacgctag

SEQ ID NO: 115857 - DNA, 213 bp, Glycine max
  Peptide Sequence Number=SeqID_232635
atgtggggcacaatcgccaacttcaaagagaacttgaacaagattgctctcgacgttcactacgccgcttacgacgacgatgatgaagacgacgtcgtttcccctgccgccgtctccgatcgccgcaattctcacagctccgcgcattccatatcgcttcctaggtcgccgcctgccaccaacggaacatccgatcacccctacgctcctgag

SEQ ID NO: 115858 - DNA, 1720 bp, Glycine max
  Peptide Sequence Number=SeqID_232636
atgactcccgaatccttcctctttctcaacattgtcaccattcccatgtacttcaccaccatcgtggcgaagcagccttggagtggctatcgtatgggtaagattctccaagaaaccgcgaagccgtcggcgaattccacatcggcgtacccctctgcggcgcccggcaccacgtcgtcgatgtcggtgacggagacggtgagggggtcgcaccagttcaagattacggggtactcgctctcgaaggggatcgggattgggaagtacatggcctccgacgtgttttccgtcggagggtacaattgggcgatttatttctaccctgatgggaagagcgtggaggacaatgcgacctacgtgtcgctcttcatcgcgctggccagcgaaggcaccgacgttagggcacttttcgagttgacccttctggatcagagtgggaaggagaggcacaaggtgcatagccatttcgagaggactcttgagagcgggccttacaccttgaagtaccgtggtagtatgtggggttacaagcggtttttcaagagaacagctctagagacatcagactaccttaaagatgattgtctgtctgtgaattgtagtgttggtgttgtgaggtcacgcacggaaggtccgaaaatctataccatagcaataccgccttctagcattggtcagaaatttggacatctgctggaaagtggtaaaggcagtgatgtaaattttgaagttaatgatgatatttttgctgcacataaattggtactagcagctcgttcacctgttttcagagcacagctttttggtcctatgaaagatcagaatacccagtgtattaaagttgaagacatggaagctccagttttcaaggcattgcttcattttatatactgggactcgctaccagacatgcaagagcttactgggttggactcaaaatgggcatcaaccttaatggctcagcatcttctagcagcagctgatcgtcatggcttagagaggcttaggctgatgtgtgaagcgagtctctgtgaagatgttgctattaatactgtggctacaactctagccttggcagagcagcaccattgtttccagcttaaagctgtctgtctcaagtttattgctacctctcaaaatcttagagctgtgatgcaaactgacggatttgagtacttgaaggaaagctgcccatctgttctgactgagctattggagtacgttgccagatttactgagcattcagacatcatgtgcaatcataggaatgatgccctacttgatggcagtgatataaatgggaggcggttgttcttctcgtacttcaaggatttggtggggagggaagtaatcgtggagctgaagaacgatttggccatcaaagggacgttgcattctgttgatcagtacctcaacatcaagctcgaaaacactagcgtcgtcaatcaagaaaagtaccctcacatggatttgactgaggctgctaatgctcatctttcctatttcttttatgttgagtatggagagattgaaatggttaaacttatatctcgtagattgttggaaattgggaagtatgacgggattctggagttcatatatttgctttctgtaaggaactgcttcatcagaggttcggtagtgagatatgtgcaattgcctccagaaggtgtggacattgaattattgcacgatgccacaagaagagaagctcggggcg

SEQ ID NO: 115859 - DNA, 348 bp, Glycine max
  Peptide Sequence Number=SeqID_232637
atggcgcttcccgcgcaaaccagtgaggttgatgcatgggaagcggtcctccgtcaaacgaaggtggccgtggataccaacgccgatcctaacgcgtgggccttgggagtgacgtcgacgcttcgctcctccgccgtcaccctcccttctgtcgaactcgcttaccgcttggtctctttcttcttttgggacaaccactgcgccaccgcgtggaagcttctgcacaccgccatgtccctcaacttgctcccttcctccctcctcatggctcttctctccgccacatgtagaatgggtgaaattcgtactgtgacgtcgcggttttgctcaattcggctccatacttaa

SEQ ID NO: 115860 - DNA, 249 bp, Glycine max
  Peptide Sequence Number=SeqID_232638
accgagtttcccagttcttactggttcagtgttgggttgattacatggcaccggtatttgtgtattgctcctggatctagaccttcccctgttgctgttgctgctgcaagtcacaaattaatcacatgtatttcatgcttcgatgagcgttcacttgcttatcatgctgttggatatgaaagaggatctcacattccagcagtagccattacatcatcaggcactgcagtttccaaccttcttcctgct

SEQ ID NO: 115861 - DNA, 438 bp, Glycine max
  Peptide Sequence Number=SeqID_232639
gttgttcaaggagaacaagggagggcacatcccttgtggatctttgcttgtaaaggactttacaaggttgaaaagaaagctcaaggaccacaggtcgcttggggactgaatgtaggctcgggttgttgccgaaccagccacttgatccaacataagccagcactcgaacccatttctgattttgtagaacttaaagagattaatgaggaggctgaagatgataaggaggaagagacactaataaaagaagaagaaaaagaaaaagaaaaaaagctgaaaaatgaaaaacaaaaagagaaagttgttgttgatgagatgaggagaggcaagagtgaggcaaacattgaaaagaagaaggatactacttcaaatgaaggcaaggaagtaccttatcctttagtaccttcccggaaagagaaagaaagacatttggcctga

SEQ ID NO: 115862 - DNA, 411 bp, Glycine max
  Peptide Sequence Number=SeqID_232640
atggccgctaggcattttctgcttcaccgccttcggttgcgtagcttccaagggttcaccgtcgcggcgcccaagggccaccgtctctggtgcagtgccacgtcagcaccggaggaagcagcttccaacgcggaggtggatgaccccgagtggaggaagaaagaagagaagatcgtgagggacgttgagccaatcgtttcgttaaccatgcaaattctctactcatcaaggtacatgaatggggagatactgactatggaggatgaaagagccgtggtagagaacattctcatttaccatccggattatgaagataagataggaagtgggctgaactccattatggtcttaagtgaaattttagatacaaatgaaggaaattactcaaataatttagataaaaaagtatag

SEQ ID NO: 115863 - DNA, 990 bp, Glycine max
  Peptide Sequence Number=SeqID_232641
atgaccctactccttgggctcacagatacaagggcagtagaaatggttaaggaagaaaatcagttcgggacaacgccgttttactcactgaagaaatggaatccaaatatcagaacgggcaatagactaatctgggcctggtgctggggcattccaatagcagcttgggatatcgcaaacatccgcaagatagtttctgcgataggcgacctggtggacatcgacgatgatgcggaggaacgccgaaggttggaccgaacgagggtgcttattaggaccccatggaggcccacaatccagcacctggtaaatcttcccatcggcggtgaaatgcaccaggttcatattgtcgaaaagacgtcaaaggacatcagaagatgcacctgtgacggccgtagttgcctcggctcatcggaggagatctcctcctttgacgacgacgatgactggctaatctgggggcccgccaatggcttggatatcgacaacgcgtcggcatggatcaacggcgacccttctgtcgggggaaagaccttgggaaacgcacctttaaccggcgtaatagtacccaacggtacgaacactgccgtcggacctgtgggtattaaccctggtacaaggaaatcccccaaaatcaatctttcggaagtgtcaggcgtggaagctcaaaaagggacaatgttagaggcatgccccgtcctggtgacagggggtagttgcaacaaagaggaaagaatcagagctgggagggagccacgtgatcagaatatggaggagcagcccatgacaggtgatcttcacccttctggcaacgttgactctacgcggtgccaacaccaaaatcgcgacgacgaaagcaatggctcacagctggcagttcttaatgacccaagtggcactcgtagagatttccaaagttcaacaagttgtaacgcaccccatcaccaaaagctacaccctgcctctgttccagcccaattgaaaagttaa

SEQ ID NO: 115864 - DNA, 1533 bp, Glycine max
  Peptide Sequence Number=SeqID_232642
atgagtcaaatgacaaatgaggtcgacaacaatgtgcattatgatgatcagactgggtcacagttaaatgatgatggtaatggagtaggtgttgttctgaagaaagggccatggacagctgctgaagatgctcttctggtgaactatgtccagaagcatggagaggggaactggaatgctgttcagaattactcaggcctgtctcgttgcggaaaaagctgtagactgcgatgggccaatcacctaaggccaaatttaaagaaaggagcatttaccgcagaagaggagcggatgattgctgaactccacgccaaaatgggaaacaaatgggcacgcatggcagcgcacttgcctggtcgtacagataatgaaataaaaaattactggaacacccggatgaagaggcggcgacgggctggcttgccactttatcctcctgaagtacttttgcaagcatttcaagagagaaagcatggccaaggtactggtgaaattagcgatggtgatggagggcatcgtgatttcttgaagaaaaacaattacgagatacatgatgcaatatttgacagtctgaaggaaaatcaaggaatcttaccttttttgcctgaccttcctgctatttctgctaatagctttcttccaaatggtcttggttctcctccatattgtaatttattgccatcaacattgccaaaccatgatcatcttcaagagtcaacaatgtcttttattggttccagtgaattgaacagcaatcgattttatccatttgaccatattaaggataatacttctgataagatttcagaatcatttggattgtattctccccttgatcgtggtgtctcacatggttcaatttgttacagccattcactatcgaatggcaattcctctacttctaagccgacttctgaggctgtgaagtcagagctcccttcactccaaattccagaaaccgaattcggtagttggggtacctctcccccacctccattgaacgagtctcttgatgttttcattcattctcctcaaccacctaatgcactagactcgggttcttcttcaccacttaatagtggcttgcttgatgcattactttatcaagcaaacactcttggttgttcaaagaataattcttctgacaagagttcaaattcttcaattgcaactcctggcgacagagctgagtgttctgctttgaacatgtacgagacagaatgggaggattatgctgaccctttatctccctttggagcaacttcaatcctgaatgagcatcctgttgttagcaccaatggaaactcatgggatgaatgggaactttttcagacctttagtggcaacaatgagagattgcagtcaattgaccaagtttggacccctaagagtgaaaatcaatccatgtctctgttgaatttcactctgccagatgtcttgataacttcagattggcacgagctgtattctgaccacgacagcacgaaccaagccatcatgactgaagctagtgatgatatcagtggacagtaa

SEQ ID NO: 115865 - DNA, 339 bp, Glycine max
  Peptide Sequence Number=SeqID_232643
atgggtgatgccagttctgcagttgcttattttgaagaaagtgttcaatttttgtcaaagttgccaaaagatgatttggagattacccatacactttctgtttcacttaacaaaattggagatcttaaatattatgatgaagaccttcaagctgcaagatcttactattttaaatctttgaatgttcggcgcgatgttgtcaaacacaattcaaatgttccatcccagcaaattatggcgattcaaactaatctagaacagacagattgtattgaaggaagagaatgggaggaaagaattagagggaaagagacgcgcatgtgctcgcacactgagtag

SEQ ID NO: 115866 - DNA, 204 bp, Glycine max
  Peptide Sequence Number=SeqID_232644
atgacgaattttatgggaaccactaaaaaagtgatccattttgcaacattatttttagccctaaggggtgccgtggtcgtcaatggaggagaagccaaaggaaataagaagaaaaacctaatcgtcgtcgtcgaaaaccatctccaacaacagcaaacaatggccgaaggaattggtggagggggagttgctaggtgggactag

SEQ ID NO: 115867 - DNA, 822 bp, Glycine max
  Peptide Sequence Number=SeqID_232645
atgtcgaaaagcaaagcgaaaaagaaaaatagtgatagcgatgaagacgacgacgttttctactaccgctatagcagcgtcaaccctacccaaactcaaactcaaacccaaaccctacaacacaatccaaatcccaaatccaacaacaacaagggatcttcgtcttcttccttggctccgtcgaaatcaacgttgtacgtttcgaacatcgactactccctcacgaactccgacctccacacgctcttctccaccttcggccgcgtcgcgcgcgtcaccgtcctcaaggaccgccacacgcgcctcagccgcggcgtggccttcgtccagttcgtgtcgcgccacgacgcgcacgatgcggccgcgcagatggacgggaaggtgctcaacggccgcaccctcgccgcctccatcgccgccgacaacggccgcgcccccgagttcatccgcaagcgcgtctaccgcgacaccgatcgctgcttcgagtgcggagagcaagggcacctctcgtacgactgcccgcgtaatcagctcggcccccgccaacgccccgagcctaaacgcccccgccgtgggccccacccccacccccaccgccatcgccataacgacaatgacgatgccggaggcgacgatgacgattatgacggcggggctgagcggtttgaggatgataattgggcttctgttgtggatgacggtgctggtgagaggctcttggcgggaaaccaacatgatggtgatggtgttgtggctggaaagagtaagaagaaaaagaacaagggtgggtacttcagtgacgagagtgatgatgatgaatag

SEQ ID NO: 115868 - DNA, 393 bp, Glycine max
  Peptide Sequence Number=SeqID_232646
atggcttggcctaatttgtttgaagcttttagaaaagtataccaacatcgggacgatcttacaagctacagtgtaacaatcaatacattatatgggagttctcggaaacacaatgaagtaagagtcatccggggcatgagagatggtgtgaatccaaataacaaaatctatgtctatgatggtctttataaaatccaagattcatggatagaaaaagcaaaaggtggtggtggtggtgtatttaagtataagttggtgagaatggctggtcaatctagtgcctttgctgtttggaaatcaattcagaagtggaaatctggcaccccttcaaggacctttccaatggagatgagggtattcctgtatcacttgtcagtgaggtcgataatgtga

SEQ ID NO: 115869 - DNA, 309 bp, Glycine max
  Peptide Sequence Number=SeqID_232647
atggcaacaaaatgcccaaggaaaagttcagaggaagacagggaaatcaaatcgtgtcaaaactcatacagaagtcttcagattggactggatacgctcagttgcaccatgaagaggccaaaaaatgctataagcaaacatgaaaaagtttgcaacatagatacaccaatcataaatcatataaaagctagtcatccttatcctctgcaaaacaatacatgcatgctaacatgcggtggtttccaatccatccaatctagaaatccaggacaagttgaaacaattctgagcacttgtgcagtaggctag

SEQ ID NO: 115870 - DNA, 324 bp, Glycine max
  Peptide Sequence Number=SeqID_232648
atggatccgggcattgctgtatcctacttgcttgctgaagagttggattttattcttgcgataaacagtataattgaatattgtgctgtagcacccactatcttagctggtcaaattgatcctctactctttgaagctctgtatgcatcacagcatgcaatctttctctttgcaaggatcccacaaatatggcaaaacttttctaacaaaagtacaggtgaactcagcttcataacttcttttatgaattttggaggttcaatggttagagtattcaccaccatccaagaaagtgcaccaaaaagtggtaggcttgcttcttaa

SEQ ID NO: 115871 - DNA, 532 bp, Glycine max
  Peptide Sequence Number=SeqID_232649
atgatgcagagtgatagtagcagtagaagaagcgtaaagagaggagacatagtgtgggtcagagtccacttccctcacaaatggcaccccgcactcgttctctcttcccgcgacaacctcggcgtccaagtcaccttctccttctccccaaacgacgccgtttcagtttcacccgccacaacctacttcgtcgagtccgaggttgtccccttcgaggaagctttcccttccctcatcacccgccgcaacgttgacgcgccgccgcttcactccgcgctccgcctgttgggccagagggtcctttccgggctgcggtgccactgcctaacgggccgggcccaggcccaacaacaatcggcccgcgagttcgacccggttggggtcttgggttttgttttggacgccgcggtttcgccgtgggtggaatccccgcgtttcgcacacgccgttagagttgttgctcaggttcacgcttttcgaaggtattcttctatgcagcacaagaaaatttacaaacagaataaagaaacag

SEQ ID NO: 115872 - DNA, 786 bp, Glycine max
  Peptide Sequence Number=SeqID_232650
atgttgtctgttccagtggtgttgctacccggtgatgataatgtgaagctgcttctaatttcatctttgagtcagacggtgcacaaagttactcaagaatctgttgccttggaacccaaggaaaaatgtcagatcatatccaaaaatggggagaaaaacaaagctattggtgctataaaaagattgaactcaacagttccagtttgggaaggaaattctgcacacttgtttaagaataaacatctgattatttcacagaatcttgtgcactctcctgctttagatccactttacatggtgcgagaaagcctaaaatctgcaaggctgagccttctgggattcaaaaatagatcagaccagggcatagttgatatctgctttgaagacttttctactatgagtagaactcacatctcagttccttccaattttataattcatttgagaaactacattgataaaagaaaagacaatgtactggggctttgctggagattgcctgacaaagaaaccaccgttatatatcttaacagggggaaaagaaggcgactagataataaaccagcttcatgtaatgattttcctcaaattagtgaagttcaagaaagtgaaagggatggagatatctcaaaacataccactcctaggatctcagacattaagatgcttgaaccagaaggaagtatccagaaaggccatgaggcctcaacatgcgtttgtgaaactaatatgaacttcactgaggaggttcagaaagtggattcaaaaagaacacgtccattctga

SEQ ID NO: 115873 - DNA, 159 bp, Glycine max
  Peptide Sequence Number=SeqID_232651
atgttgtctggcttcacactgtatgcagcgatatatattgcttccattctaaacaatgtgattattgaacaacaacaaaggggaatagctaatggcatttctatgactgctatgtcagcattcaaagttattggtccagctgcaggtggtgcaatgtga

SEQ ID NO: 115874 - DNA, 534 bp, Glycine max
  Peptide Sequence Number=SeqID_232652
atggatgttgactctagtttctcacaaattgctcatcttgtctttgatgggaagagttatgacctttggaaggtgaaactgaagtcctacatggagtcttttgatttgtgggatgctatggaagagaattatgaacatcacaagaagattaaaaccaagaaggtgaaggtaaagacatgcctatttgctagtgtttctcaaacgatcttcacgaagatcatgaatgtcaattcacccaaagaaatttgggattatttaaagaaagaatatgaaggatatgaacacgttcgtggcatgcaagtgctaaacctgatgagggaatttgaggtgcaagagatgaaagaattcaagacaattaaagggtactcggatagattgtttgacatcgctaataagaaaagattgatgtgggaagaatcaatagttgaaggagctttaccagccaagcaccagaatgcgaccaaatacaagaaaaacaagaactttgatgggacaggatcaagttcaacatcaaccaatgcaaaaggaaattag

SEQ ID NO: 115875 - DNA, 252 bp, Glycine max
  Peptide Sequence Number=SeqID_232653
atggatctggaatgttttaataatgccctagtagctaaatggatgtggaaagagggggaggacttattgagcaatccgacaacttcagcgtggtggaaagaggtacataatgtgtgttccaaaagtggccaacaacattggttttggaagtcttcaaggtggaaaattggcaatggaggttttgaaatggagaagaactctctttgtttgggaagagggattaaaaagaaatcttatgtagtctatgagtga

SEQ ID NO: 115876 - DNA, 119 bp, Glycine max
  Peptide Sequence Number=SeqID_232654
atgaggatgaaactcaggtgtttgggccttgaaccaactgggggattacaagaagctgtggttcaaggaacacaggccaaaaactgcgccataataaacccgaaacccttcgagcaaag

SEQ ID NO: 115877 - DNA, 914 bp, Glycine max
  Peptide Sequence Number=SeqID_232655
ggtctgcattcatgcttggtagatgtttgacatctatgttgtggggaatgatagctgatcgctatggtagaaaacctgttgtgattataagtgttatttctgttgtcattttcaacatactattcggccttagtacaagtttttggatggctgttattacaagactttttcttggatgtttaaatggtgtgatgggcacaatcaaggctttttcttctgaaatatttcgagaagaatatcaacctctgggactctcaaccgtctctgctgcttggggagtaggtttagcacttggcccagcattgggaggttatttggctcagccagtagaaaaatacccatatttattttcaaagggttccttttgggataggtttccctacttcttgccctgcttggttatatcaacttttgcattttccgttgcaattgcttgcatttggcttccggagacaaatcataaccacaatcctgaagctttagaaatcagaagtagggcccccgacaaagacaaggtggtccaaaacaatgaaagtgtcttccgaaattggcctttaatgtcatctatcattgtttattgtgttttttcacttcatgacaatgcttattctgaggttttctcattatgggctgtcagtcctcgatggttgggaggtttaaactttacaaccaacagtgttggtaatgttttagtagtttcagcaaaaagaaaagatatatcaaaaaagggatacaaagtaaaatcacatcaccttccacacccgactactggagatcatctattcccatccaatgacagaaaaattttctgtgtattaaatgcttcccaaacttcctcacaatccttccactcacagcccatcaaaatttgctccttgattattaactgccttaaaatctccacccaccattaa

SEQ ID NO: 115878 - DNA, 462 bp, Glycine max
  Peptide Sequence Number=SeqID_232656
atgacatactttattcttgttgttatgtccaattgtccatttgatggtattttagatgttagtaatgtttacaaggttgtgaagggaaagaatggaagcatgccacttgcattggcaatgctttacccatttgttgtacttgtgggaggagtgcttgtgtgggattatttgtcaccatcagacatcatggggaaatatccacatttagttgttataggaacaggacttactttcggatatcttgtggggaggatgattttggcacacttatgtgatgaacctaagggtctgaaaactgggatgtgcatgatgcttgatttggttgttgtccctcattataaaacctatgaaaacacaatgatgacacgggccaaaagttctctacactcagtgaacttcactttcatttatgtttactgtagctttcaaatatcacaaatattaggagtctcaagcccttaa

SEQ ID NO: 115879 - DNA, 312 bp, Glycine max
  Peptide Sequence Number=SeqID_232657
atgacagaagagactaatattggagaaccacttttaaagaaacagtactatgagaactgccctggttgcaaggttgatagagccaaggagctggaaaaggatgtctccattcgaaatctcgtccatatatggattgtggtgttgtgcggtgctcttcctgtttcttctctctatcctttcctttatttcatggatgcagaaatagcatatcacttcaaatgtcaatccaggcttataagggaaaaatatagtttcaatcctgatactttggctcaaacatgtttaatatttctaaatccatgtgtttcttga

SEQ ID NO: 115880 - DNA, 346 bp, Glycine max
  Peptide Sequence Number=SeqID_232658
ttatttcaccaatacacttatactgcctgttataaatgggcctacagagggtcttatgataatatacatctgtcactttttcactgctatcgtgggtgctgagtggtgggttcagcaatttggaaagtctttgccattcttaaattggcttccttatcttggggcaacatatcctattttcaatctaactcttgattctgcatgttcactggatacccaatggcaagatgcccttgtcagttcagatgcttgtttgttatatgagctagggattttggttgtctactctaataacataaacaagcagggtgggttccatttgcttgtccagtatgatcttagctaa

SEQ ID NO: 115881 - DNA, 330 bp, Glycine max
  Peptide Sequence Number=SeqID_232659
atgtttccaggaatgttcatgcgcaagccagacaaagctgcagcactgaagcagctgaaatctcacgtggtcatgttccaggcatgggttgttgttattcaggtcaccccttacgttcttcactttctcagcaccgagaaagaggaacttaagcttgagctttaccttctcactcttcctcggcagagccaaagcaacaagagacatactgtgcaagcaagtgcatcacaccctgcaaatacagttgaaaacatcttcattaataacaaacaggaaaatcaccatgatcaaagagctcccccaatgggcttgaggaatttgttcgtctag

SEQ ID NO: 115882 - DNA, 129 bp, Glycine max
  Peptide Sequence Number=SeqID_232660
atggagactaacttagtcacacctgctggttctctgatgcctttggctggtcaatcttatggggatagttggtcttcactctggcttcctattgatcttatcctggaagatgctttggatggagcacaa

SEQ ID NO: 115883 - DNA, 233 bp, Glycine max
  Peptide Sequence Number=SeqID_232661
ggttgttccaagcagacaactctaccctactgcttacagactttatatggaactcctcaagcaacttgatgatatgcttgcacgtgatttcagttctctatattatgaaaagttggaatgtgaactgtatcattgcacttgttcaatttgaactgaacaaatcccgcatgatacaaccgaagcctaatctagctagtgatgttgcattgagtctttgcctgtgtttggtttga

SEQ ID NO: 115884 - DNA, 363 bp, Glycine max
  Peptide Sequence Number=SeqID_232662
atggggaagtttccttgtgtatttctaaatactaatgattacatttcataccaatgggtccttaggattatgaaatcaattgatgaagttcttcagctttctcaagtatacagtcaaaagttacttgcagcatcattagatgatgaagggttattagatcacactgctgagaataagcctagatggctaagcaggtcacatgatatgaatattgatggacctgacagctttactgaaaagaaaactgagcaagcagaggggtttcagaagaaaaatacagcaatagctattgagatcattgcagaatttttgcaacagaaaatgacttcaaggatcctttccttagttcattggaacatgtaa

SEQ ID NO: 115885 - DNA, 483 bp, Glycine max
  Peptide Sequence Number=SeqID_232663
atggtgaagactttacatgtagttaatggcactatgtggcacaatacatttttgggtttatgggttgcagcactgcgtctggttcaaagggttggaattattctaacagaaaaggagagggatttaaaagaaggtcctatacctcgccttgatacctgcatgtgtatgttactgagcattacaaccctcgtggtaactaatattatagaagaagaggaaggtcaacttattgaagaacctgaacatagccctacaaatcaagggaaaaataaactggctctggggaagtgtcatggggaattgattaccagcttacagctattgggtgattatgagtccttactgacaccacctcaacttgttcttgtggaagccaatcaagctgctgccaaagctattgtgttcttatcaggaaaccctgttggtagtggatgcttcaaatatatgagcacgaatgacatgccgatgaaatgttgtgagtaa

SEQ ID NO: 115886 - DNA, 579 bp, Glycine max
  Peptide Sequence Number=SeqID_232664
atggaaacccaagttttaggcatcaaaactatacaatccttctctgagcagctatcagagttggatcagattatcaggaagatgattttggagagtttgggtgttgaaaagtacttggaggagcacatgaactcaaccaattatcttctcggggttatgaaatacaaaggccctcaaaccagtgacacaaaggttggcctcacaacacactcagacaagaacatagtgaccatattgtaccaaaatgaagttgagggtttagaggtgatgaccaaagatggaaaatggattagctacaggccttcccctgatagtttcgttgtcatgattgcatgctcaaacagaaggctgcattcaccctttcaccgagtgatgatgagtgggaatgaggcaagatactctgcagggctgttctctatccccaaaggagggaacattataaaagccccagaggagcttgtggatgaggaacaccctctactctttaagccttttgatcatgttgagtttctcaagtattattacactgaaaaaggtcagagagatcaatttgcactgcgcacttattgtggtgtttga

SEQ ID NO: 115887 - DNA, 1022 bp, Glycine max
  Peptide Sequence Number=SeqID_232665
atggctttgcgaagttctaaaggaactttttcaaaaatttctattaattgtgtttgcgtaaagggcagaaaagtggaatcgaaagggctccactctgttcctgtttcaggagctctggtgattcttcaatctgggattccattgcctgataagaggactctggaattgatacttgacaagcttcagaagtatgtttcgtttcctgttttaaagttcttctttgggaaagacgcttatggtgtgtttgcagaccctgttgatccagaagagcttcctgattatcacgatgtgatcaagcatcccatggactttgccactgtgaggaagaagttgggaaatgaatcttcttatactaccttagaacaatttgagcaagggcaaaaaaccagagcttctgtagctggtgttacatcaataaacttggctgaatacgttcctgcagctgtagataaagagactgaaattgtgttgtctcttagtttactgaaactggaggcccttcaagaatatttggatgcagtgcatagatcaactatagccaagaaggcaagctccaaagatgaaggaagtgatggtaggagctccaacagaagtgaagattttgaaaataggtatacatcggacgtggattcactggataatgatgctgcaattaagtcagaggtgaatgaggaggattcttgtgtgagacattcattgagttatgagactctggcctttggaaactatgcaggaggatcaccatattcaggttcaactattaatggtaaacatgagtgctggatctactatagtagccaaaagtctgattatgggggtgcacatgttgagaattataatacatgtgatcaggttgagcatcagaattcaaaacaccgaatcctttcttggaggaaaaggaaacttcactttagatcttccaagatactagggaaagcatcgggtggaggagttataccagttagtgcagttcttgcagacaaagatgtgatgctttgtatacaaccgggacagcatggaag

SEQ ID NO: 115888 - DNA, 522 bp, Glycine max
  Peptide Sequence Number=SeqID_232666
atgataagggaagctgaacatagccctacaaatcaagggaaaaataaactagctctgcggaagtgtcgtgcggaattgattaccagcttacagctattgggtgattatgagtccttactaacaccacctcaacttgttcttgtggaagccaatcaagctgctgccaaagctattatgttcttatcaggaaaccctgttggtagtggatgcttcaaatatatgagcacgaatgacatgcagatgaaatgttctggaaacttgcgacatctaattgttgaggcttgtattgcaaaaaaattgcttgatacatcagcttatttatggcctggctatgtgaatacatgcagcaatcaaattccttgtagcatttctaatcatgtgtctggctggtcatcgttgatggagggatcacagctaactcctgcattggttaatgtcttagttgcgactccagcttccaggtattgcaccgtgttcttttgtaattcaaaaggacagctcaacacgaccttctgttactag

SEQ ID NO: 115889 - DNA, 2274 bp, Glycine max
  Peptide Sequence Number=SeqID_232667
atggattttgatggaagcttggcagagattgagaaaatatatgaaattgcaatcaatggttcagatgaagaaaagatatctgctgctaccattctatgtggggcatctctggagcataccgttctttttataacaaaattgctttcacctatagatcctcctaattactctggggctgaaagccatttgaccagccaagctccatttttaaacgttcttcttattggaatctcatctatggactgtgttcatatattctccctacatggtttggttccattacttgcaccaggactaatgctaatatgtgaggtttttggatcatgtgttcctgattcctcgtggacacttgcaagtggagaaaaactcactcattgggaagtattctgtaatgcgtttactcttttgctgaggttctggcggtttgatcatctacctattgaacaagtgaggagcgatgcaacaactccaccatttggatcactacctagtcctgaatgccttttattagttcgaaactgtaaattggcatcatttggaagaacagaaaaggatcaacagaggctcaaaagatggccaaagattttatgtttttccgtagaacctgtattcatggattcctttccaaaattaaacttttggtatcggaaacatcaagaatgcattgcttcattccgctctggtcttgtgcctggaaggcctgttaatcaaattgttgatgctctactcagcatgatgtttaagaaggtaagtaacggtgtcaaaccttcgacacctactacttcaggaagcagcaattcatctgggaatgcattggatgatgctttaatgaaactaaaagtgcctgcctgggatatcctcgaagctattccctttgtgctggattctgctctgacatcttgtgcttatgggaaaacctctacccgtgaactggctacaggtctcaaagatctagccgattttcttccagcttctttggttaccattgcaagctacttttcagctgaagttacacggggcatatggaagccatcttttatgaatggaactgactggcctagccctgctgcaaatctagcacatattgagcaacaaataaagaaaatcttagcagccacaggtgtcaatgtcccaagccttgatatagatggggattctccagctacacttccttttcctttggcagcttttgtaagcctcacattaacatataaactcgacaaggccactgagccattccttgcactgattgcccctgctatgaatgccgttgcttctggttgtccctggccctccttgcccattgtgacctctctgtggatccagaaggtgaagcgttggagtaactactttgtgctctctgcttccagcactgttttccaccacaacaaggatgctatagctcaactactaaaaagttgcttcacatccacccttgggttaggctatggcagcatttataataatggcggtgtcagtgccctccttggtgatggttctgtttcccgaatatccaatgggatctctccagtggctccaggaattctttacataagagtgtaccggtctattggagatatcaccttattgattaaagaaattgtgcctattttaatgctttcagttacagacattgcaagtagtgatttgatgcccaagggggttgtaaggaaaccaaagaaaaccaagtttggggtaaaatatggccaagtttctcttgccagatccatggcacgtgtcaagcatgccgctctactcggggcttcattggtttggatatcaggtggacaaaagttgattcaatatttgatgagggagactctgccttcctggtttttatcagctaccatgttcgagcaagatggtggagaatctggagttatggttgctaagctcaaaggttatgcactggcattttttgtttttcttagtgcagcatttgcctggggtattgacaattcgtattcaccaaaacaacgggcagaggttgtcggcttgcatttgaaatttcttgcaagcaccctgaacaggaacggagcaatgttttctcgttgtactacttggaaagcctatgtgtcagggttagtgagcttgatggtgggtcaagctccatcatgggttcgggaagtcgatgctgatttgttgaagagactgagctggggattaagtcagatggatgaacacaagttggctcttcgccttttggaaattggaggaataggtgtcatgggtgcagcagctgaaatgataattggatttgaacatagatcttaa

SEQ ID NO: 115890 - DNA, 1503 bp, Glycine max
  Peptide Sequence Number=SeqID_232668
atggagaaactggtggtttataggttgaatgtgaagcgctttacgcagcacgagtccagccaacttccgagtggtttagctgggacctttactggtttggctaagaaggttcagcattttaaagatctaggagtgaatgccattcttctggagccggttttcacatttgacgagaaaaagggaccatattttcctagccactttttttctctgatgcacatttatgggccatctggtggtcctgtatctgctattgcctctatgaaagagatggttaaaactatgcatgccaatgggatagaagttcttgtggaagttgttttctccaataccgctgagattggtgctctacagggaattgacgactcaacctactattatgcaaatggagttggtggtttgaaggggcagagtgctctgaactgtaactatcctatagtgcaaagtttgattctggatagtcttcggcattgggtgactgagtttcacattgatggcttctctttcttaaatgcttcacaccttctgagaggatttcatggggagtacttgactagacctccattagttgaagctatagcttttgacccagtactctccaagactaaaatcattgcagattgttgggatccccatggcatggtagcaaaggaaattcgctttcctcattggatgagatgggctgaaataaatacaaatttttgtaacgatgtgaggaactttttaaggggtgaaaatcttcttagcaaccttgcaacaagactttgcgggagtggggacatattttctggtggaagaggtcccgcattctcttttaattacattgccagaaattttggagtttctcttgtggacttggttagcttcagcagtacagatgaattaagttggaattgtggagaagaaggacctacaaacaacactgctattcttgaaagacgactcaagcaaatccgtaatttcctcttcatcttgtttgtgtcattaggagtacctgttctgaacatgggagatgaatgtggccagtcttctggtggttttactgcatatgatggtataaagcctttcagttggagttctttgaaaacaggcttcgaagaaaacattgaatggtatggaagtgatggggccccaccaagatgggaagacctatcctgcaagttcctagccatggctttgaaggccgaagaaaaggagtttctagagagctctgtatcttctgatatatccggcgatctatttattgctttcaatgcagctggtcatccagaaactgcagttttacccttgcctccagaaggaatgttatggtaccgtttagttgacacggctcttccatttcctggctttttctcggccagtggtgaagttgttcctgagcagacagcagcgatgcgttcacctcccccgcaaagtccattcttaacagattttcatcaggttcagggggcgctcgaaatggtctttttgatgcttacaccaccagtcaagattgtagactaa

SEQ ID NO: 115891 - DNA, 1020 bp, Glycine max
  Peptide Sequence Number=SeqID_232669
atgacaagtctcgcgccacgcttctcattctcagtgattcctgggagtcaccacagcaaacccaaattctcttgttttcacgaaccctttatccaaaggaagcacctttggcccaaacttggattgcaaaaccccatttcccccttttctcggaaccccacttcttcaaaattgtgtgccacgtcacgcttgtccattgaggaaacggagcagcaacttggaaccttgagccgacccgaatacctaaaaggttcatcggcgtatttgtttaggactgaaactggtggcgggttggtgaaagtttatgtcacaaagagaaaagataggtattttgtttacactgagatttcatcgttggatataagtggtagtgttggtgaaacgcttttgttgtgttggggtgtgtatagaagtgattcatcgtgttttgtggatctggatacgataggtttgagagaaaatgcggcgacggggatgaatgttagtcccttggtgcaaaattctgatggaaactttgcagttgaattggaatttgatgcaaagcatgttcctttgtacttgtcgtttttcttgatgtcgtctttggatgcagggatggagattagaagccataggggaacgaatttttgcgtgccggttgggttgcttccggggtacccgggtcctttggggctcttttgttctcctgatgggtctgtgaattttgctattttctcgagacgtgctgagagtgtggttttatgcttgtatgatgagaatgacatggagaagcctgctttggagcttgatttggatccttatgtgaataggacaggtgatatctggcatgtcgcgtttgagagtgccaagggtttcatgagctatggttatagctgcagagggggtgttcttaagaggaacaaggatgatggttttgctgagcacgttgttttggatccgtatgctaagattgttgggaattcttatcctgatggtgttggatttgtgaagaatcttggatgggttggggaaggaacctga

SEQ ID NO: 115892 - DNA, 222 bp, Glycine max
  Peptide Sequence Number=SeqID_232670
atggcggttagcgacacgggaggggaggggacacgtggcgtgagggcgagtgtggtggtttgggtgtcccgcgaatctcgaggcgcaggagaagagagagagcgtggtgccgctttgcgagggagggacacgtggcgactttttgaggggtttgagaaggcgacacgtggaaggtggcgtttttatggtgatggtgactttacgagggttctgggagggtga

SEQ ID NO: 115893 - DNA, 1053 bp, Glycine max
  Peptide Sequence Number=SeqID_232671
atggttgaagtcgaagagatagagctggatttggcgttgtccatagggggcagtttcgggaaatacacggtggagaagcccgcaccggattccgaagcgcgtgtttcaaattcggatagtcgcgatggaatgcgcgtggtgatggagccgcgcgagaagcgcgagattcaggcgtttcggagaatggaggcgaggaagaagagggagcgcttgagggaaccgtccgagcccgaatcgcaattacgggattttaagagggagaaaacggaatgcggtaacggcgttagtggctcgtggacagcggcgacgacgacgccgtatcgcatgcaccagttcgcgacggtgcagtacttgccgttgaataacggctttccgttaccgtgctgggtcggaggggaaaagaatgtgggtggagtagacggcgttgacggcattaacggtggaggagataggaaagccaagtctaatgggtcttccaggtgtagttcttctgtggtttcggattatcaaagctcttctcgtgaagaaggaggtagcacagacagtcacagccattcagttcattccttggcagaaccggcccaattgaacacttccaaggaaataagcatcggaacgtcccaacctgaagaaagtgcttccgcttcatctcaccctataagacccaaacaaggcaacaccaccatccaagagataaaaaagcacattgcaaaggaaacgcgaccaaaaccaaaccccaattcacccgagccaattgaaaacaaacctttgtctaacgaaaacttaaccaaagttgaaataatgggaaagcctccaaagcctctctctcacacctcttattcgctccctccaatgccctatgtgtctacaaaaggggacaatgggagaacggttaatgggtttctctacagatacacaaaatctgaggtcagcattatttgtgtttgccatggaagcacattttcacctgcagagtttgtgcagcatgcagggggcacagacaccacgcaccctctaaggcaaatcacagttattccttctgtctttgggtga

SEQ ID NO: 115894 - DNA, 696 bp, Glycine max
  Peptide Sequence Number=SeqID_232672
atgggaggagcgggtttgggtcttggtagagttgcgatggtgctagcaaaggaggatggcagtggtgagaaggagggtgaccatgaagaagctaccgatagaggtgatgacagcttgcttgtgacccagtgcgttggacttggagttgaacccgttcagaacttccgattcaaatgtgtagcaatcctttcacacaagggtgattgttatttcgtggaaggtgttgtgggagaccagggtgatgttcatcatggcatctttagatggtcaagcaagtctgttagaggcttcatagctgaaagggctagattcaaagccattgcccttactgttgataccctaagactgggacgcaaagaagctgatatcaagaacaggcataactctccacttaaaccttaccttggaaagatggacaaagctgatgactctggacttgcttcatatgttgtcggtcaaattgattgtactcttagatggaaggatgtgaagtggcttcaaacaatcaccaaactgccaattctggtgaagggcgtgctgactgctgaggacacaaggatagctgtacaaagtggtgcaactggaattatagtgtccaatcacggagctagacatttgtttatgtgttgggataatagtattgcctattggagaaaatttgtggctgaatattactctcctcgtgcaaagaaatga

SEQ ID NO: 115895 - DNA, 1887 bp, Glycine max
  Peptide Sequence Number=SeqID_232673
atggcgactattggggatatttgtgtttcggcatccatcaatctgttgtctgcattggcgttcctgtttgcatttggaatattgcgacttcagccctttaacgatagggtctacttcccaaaatggtatctgaaggggataagaggcagtccaacaggatccaatagggtaaagaaatttgttaatttggactttgggacctacatcaggtttctgaattggatgcctgcagcattgcatatgccagaacctgagcttattgatcatgcaggacttgactcagctgtgtacattcggatttatcttcttggggtcaaaatatttgctccaattaccttacttgcttttatggttttggttcctgttaactggttcgggaaaacattgcaagcacggggacctaaggatttgacatttagcagtattgacaagatttcaatatcaaacatcccatttggatcagataggttttgggtgcatattgtaatgtcatatgtattctcatcttggacatgctatagtctttataaggaatacaaggttatagcagaaatgagattgcgatttttggcagctgaacgtcgtcgtccagaccaattcactgtcctggtaaggaatgttcccccagatcccgatgaatcagttgtatataatgcgaacaagcttgcatgcatagctgcagagaagaagaaattaataaactggcatgtttactaccaaaacaaatacgaaagaaatccttccaagaggccaactactcggacaggtttcctgggtttcttggggaataaagttgatgctattgatcattatactgcaataattgataatttgagcaaacaagaagccgaagaaagagaaagtatcataaacaatccgaatgctgttattcctgcagcttttgtttcattcaaaacacgatgggcagcagctgtgtgtgctcaaactcaacaaactagtaatcctactatttggctcacagaatgggctcctgagcctcgggatgtcttttgggaaaatcttgccattccatattttgacctcaacatgcgaagattgctcatggcagttgctttatttttcctaacttttttctttatgataccaatagcactggtccaatctctggccaacattgaggcaattgagaaggtccttcctttcttgaagccaataattgaaaagccatctatcaagtctgttattcaaggctttctgccagggctagcattaaagatatttcttataatgcttccaaaaattcttatgacgatgtccaaaatggaaggtattacttcgctttcaggtttggaccggaggttcacaaaaactgttggcagtacaatccccatgaaagccacattcttcatcacatacataatgatcgacggttgggctggaatagctgcagagatcctcaggttagctccgttaattacgttccacgtgaaaaacacattcttggtgaagacagaacaagacagacagaatgctatggatcctggtagcttggaatttgccacatctgaacctcgcatccagttatatttcatgttggggcatgtgtatgctccagtcacaccttttcttctccccttcattgtagtattctttgcttttgcctacatgatctttaggcaccagattatcaatgtgtataaccagcaatatgagagtggaggatcgttttggccagatatccacggtcgagtaatttcgggcttgattatatctcaaattcttctgatgggtttgttaagtacaagaggtacagataagtcgacgctagtgcttattgcgcaacccatcttgacattatggttccacagatactgcaaaggtcgttttgaatctgcatttgtaaaatttccactagaggttggttaa

SEQ ID NO: 115896 - DNA, 351 bp, Glycine max
  Peptide Sequence Number=SeqID_232674
atgtatttcattttgtttaactttctggttgctaagtacccaatgaaatcttatcatgggagttctgtgcaagatgccatgaagaacttcttcctcaaagacaacgatgtagacattcctaataacatctctgaagcatgtgatggtaagactgatgatgctgattatgtggagccatcatttgctgttgggaaatctcctaaaaatgtgaatgttgcttctaatgacttgtggctttggtctaatgtatcttcatcaccttgtagacaggtctacttagtgcttacattattaaaaagctgtacattggcaggaagggcagtgagactgagaaggagcaaggttctgtaa

SEQ ID NO: 115897 - DNA, 2385 bp, Glycine max
  Peptide Sequence Number=SeqID_232675
atggaagattggagagtggaaggtaaaagaataaaagctttctgcaatcatgccgatgttgaagcatttactgaagagaagaaacaatctcttgccaaacgttcaggaaggggtggtgaatttgcttgtgcagtaaaggagattattgaatgttatgaaaagttgaggacggagaatcaggatggtgacactagctctggtggtgaagttgctattgcaaatgtgtcgtattcacttgatccatctgccaacacagggttaaaggatcagacggatgctcctttcacaattaattcacaaatgaaatcttcaaattgtgtgattgacagacctgaggatgctgttgcattgaaggatgaatcttataatatagaggcatcactggaggaagctactgataatgctattatgactgcaactgtaaaatcacctttttcaataacccagagaaatgcaccagttcgaaggtctagaactagaagcacattacaggtccaaaactttgttgtaccttgtggtgatggtggaaataatgttggcaatagtgatgacaacatatcagctgatgcaattcaggatacatctataaggagtaaacgtatcaggaaatcacctgaccttttacgttgtgatgatactgattcacctgcatttgccccaaatgttagcatggaggacaatggttctgaaattattacaatcaattctgatgcctttactttaaatgagggaagtacgatagattctaatttaaaatttgaacagtctgagcctattgtttgccctgaaggtgaaggtcttgatctagaaataaaggctgtaatcaacaagaataaaagaaaaccaaaccagaagaaggaaactaatgattctggtgctcagaatgccagccaaagtttgcagaatatgggtggaaattcgaaagaaagatgccctgaccaagatggagatgaacacttgcccctggtgaaacgagccagagttagaatgggtaaatcatccacagaggcagaactcaatagcatttctcaagttcaggttaaaagtggcgaggaagatattactgactcaccacatcagataatcacatgctcaaattgtgaaaatggccttgctgaaggaggcccatcagtgttgaacagtactttggttaatgtttctccttctaacttaatagcctcgtattctgaaaatgggtctcaaatttgtaaaattaaaaaagaccaaatgtttggctgctctgtggatgatgaagctgctttacctccatctaaacgcatccatcgtgctttagaagcaatgtctgccaatgctgccgaagaaggtcaagcttgcatggaatcctcctcctctataatgacatttagtggtagatgctgtatatctgccattaagagatgtccttgtatgactgttaataatcaaggagttaatgagttagaactgcaaagtttctcaactcgttcaaatacaattatttccacagagaatgagttatctacagaagtggataagcatttggtcaagttccaacatgagtctgggaaggatgtcatcccaggtgctagtcagcaaggtggtgaagatattagtgattctgttgtctgtcatcctgccaaaatagattcactaatacagtcacatggaaaaatttctcctaatcttgatgtgaaatgttgccaagttggaaacaataaggattcaccaggtccatcattgttactaaatgatgatgacaatgccagaacttcaaaccattcagatgcatctgatacagtagagcatgttggaataagtctcgatcctgtggcaggcaacagtgaaagtgataaattggtacctaaaaatagtattaatgtgacacagaatgtggtggttgcttgtgaggatatgatgaagcatgcagttggtgacagcagcaaacctaatgacacgcatgaggtcatcaaagaggtaaaatttaaaggacaagaggaggatatgaattctgtttcaatatcaaatgattattccgatgaaaagggtaatttgggcattctgtcaagcccatccttgactgatgtgagagtttgcctcccactaggttcacctccaattacatcagtttgcaatatttctacatctgacagtagtaatatccttcaaaatggaagttgtagccctgatgtacaccaaaagaacactttatctggtcctactgatggatggaaagatgggattgtggaaaatgaacaatcaagatctgagggcaagtcaactgaagcaggagatgctgcattgttgtactttgaagcaacgcttcgaacattgaaaaggacaaaggaaagtattggtcgagcaacacgcatagctattgactgtgcaaagtttggcattgcaactaag

SEQ ID NO: 115898 - DNA, 627 bp, Glycine max
  Peptide Sequence Number=SeqID_232676
atgccgttattcactgttggaggggtgcattcatggtcaagatatgacagagcatgggcttattataccaagagcaacaaggttggtgaccgtgggagtggaaatccctttagcagtggtcatctgagcccagtcaaggagatctttaatgtacttagtttgagaggtgaaaccatcagggagaggctggacttgaatcccgagaaagtacgtgtcaatggacctgatacagcacctgtctacaaattccttaaagcaaataaatcaggatttctgggttctaggataaagtggaatttcaccaagtttttggttgacaaggaagggaatgtcctccggcgttatggttcaaccacctcaccgttttccattgaagtacaatctctctctatttctctccatggagcttatgtgagattatgttcattccatttggattttgacgtctcagccttgaacaatgccaaatcctgtcacttaaggctaagatttcaagataccaatggagcgaggcaatctcacatagcgctccaaggatatgcaacaatttcttgtgtgaatgtgtgtggctattgctatgtaactagaggcttgaatgacatcaagagagcattgggggaggcttga

SEQ ID NO: 115899 - DNA, 1485 bp, Glycine max
  Peptide Sequence Number=SeqID_232677
gtgatggaaattgttgtccacaatctggaaattgagtcaagcctgcatcggagggtggatctgttttttcttgttgactctattgctcaatgttctcgagggttgaaaggagacattggtggagtatatccatcaactattaaagcagtcctgccacgcctcttgtctgctgctgctcctcccggaaatgctgcaaaagaaaatcgtaggcagtgtcttaaggcaagtgtccacgcacgccgttcatcaagaagagagaggccttttgatgaccctgttagagacatggagggtatgcttgatgagtatggaagcaactcaagttttcaactacctggattttgcatgccccgaatgcttgaagatgatggggggagtgattctgatgaaggggagtttgaggctgtcacacctgaacatgattctgaaacatatgaagtgcaagaaacaactcatgcaattgaaaaacacaggcatgtgttggaagatgttgatggtgagcttgaaatggaagatgtggctccgtctgttgatggtgaattgaatttgatttgtaatattgatagaggaaatgccacagagtttgagaagaatcttcctgtgtcctttggcccccctttaccacaggatttgccaccgtcttccccacctccaccatcatcccctccaccaccaccaccagctcctcctcctccatctctacctctacctccacccccacctcctacattgcacttcaagtcagctacctctgatcaatatcatgttgcagttgattcaaaaggttttgaagattcactgactgtggaagccaatgtactccatcctatggcccagcccttagctgcaccaagaaatagtcaatctatcggtgatgcagtgcagtatacagtccctgaatgtagagacatgccaatacaaatgccagagtctacttgctctttcaacactttccctgtacaaccaacagacaattccaggaatactgatggtgctactatgcataataaaggttactcgataccaccacctcaccatgtgccatccaatcagttttcttttgtaaatggggaacatcaaatgaagtcacgaagggaggttccgccacccccttcatattccaatgggcaccactttatgccgagtatgatgagagagtatggctatgacagtcatgagagatcaagaccaccatatgattaccaagagagatggaatgttcctcctccttgttctggtcctcggtatagtgaccgaggtgtgcctgctccttatggttgtcatcctagtgaatcagttggttttccaggtcatggatggagatttcctcccccatcaatgaattacagggactccttgccttttagaccccactttgaagatgcaattccagtagcaaaccgagaagaggtggttgttgtgccctctttctgtacatgcaagaaagaatctttagagaatgcagagcaggaagagtcattgtag

SEQ ID NO: 115900 - DNA, 132 bp, Glycine max
  Peptide Sequence Number=SeqID_232678
atgcggaaattgattaaggaaaggatggaaaataaggtggttaatttcgtgggtcttaataaggttaagtggtggctggacagaaatatagaaatggcaataacggaagctacaaggctccaaatgaggtga

SEQ ID NO: 115901 - DNA, 198 bp, Glycine max
  Peptide Sequence Number=SeqID_232679
atgcaggaagaaatcgtggacaagactgatgtctatatagatgtacatagaagaacacgtgtggctgctgtagcagctgctacatctgtggcactagttccatctggccgaaagtttacaggtcacaagcctgtagagggtgaaagttcgacgaagaatgatttacatttaagaagaatttcatctaaggatcattga

SEQ ID NO: 115902 - DNA, 399 bp, Glycine max
  Peptide Sequence Number=SeqID_232680
atgcaacttctagaaagatgcagtgatattccatctgggatcatgttttgtctcacccttggattaatgtctctaggcctcatcgaccttgaaattcttcagcggttcatccacagagaagaaacaagctgctgctgctattttgcgggttgttcagaaacagcattagttgcttgtgaccttgttactttgcaactcctctgccatggagaatgtcaggtaaggtggtaccagcttgtttcggatgaaccactctgctggagaatctcaaggtcaatgaagctcagagacattaatccaaaggtgagacaagacatgatcccaaatggaatatcatcagcatcgttcacgaagttacctggtcggaactcaatcgtaccaaggttttgggatagatag

SEQ ID NO: 115903 - DNA, 369 bp, Glycine max
  Peptide Sequence Number=SeqID_232681
atgaggccggacaagtacaagccccacaaaattagcaccaacatagagcccatatcttgtgcatatagcttgtgggataacctatccccaagtggcattgttctggatgttttacttggacacaatcatgcactgtttaggcgagcacaactgaaagctcttggttcaatccatagccaagaggctggtaaagggggtgaactcactcatgatgaagcaacaattatcagcggagcactagatctcacagagaagacggcacaggaggctatgacaccaattgaatctacattttccttggatgttgcttccaaattggactgggaagcaattgggaaaattcttgcacgaggtcatagtcgtgtgtaa

SEQ ID NO: 115904 - DNA, 1440 bp, Glycine max
  Peptide Sequence Number=SeqID_232682
atgggtgttaagcgtctcaaagtgatcaaccaaggtctacatgttgacaacaattgtccctggacaaaattaggagaggagtctttgcgcttcatcggacttgatcgtctctggatgacaaaggtgcggataaccatgaggtatctccgcatgctatcgggccctcgagtcacgataacaaaattgtgtgtagggataaccataaggtatctccgcatgctaccggaccctcaagtcctgatagcagaattgtgtgtacggataaccataaggtatctctgtatgctaccagaccctcgagtcacgtatctccgcatgctatcggaccctcgagtcatgatatcagatgggagactttttcacgatctcggccggaagacactaacatctcggggaagggtgcagatgaccacattggtctttgggtgtcaacgggctcgctttcctctagttgacgaaagtctcggccggaagatgctgacatcttcaggaagggtgcagatgaccacattggtctctgcgtgtcaacgggctcgcttgcctctagttgacgaaagggtgcagatgatcccattggtctctacgtgtcaacgggctcacttgcctctagttgatgaaagggcatctccgcgtgtcaccggactcacaggtcacgatagcaaaatgtgtgtggggttgtcgacaaaagcaaggcttttgctcctacgtatcctcaattgcgatgaggaactcatacctacggcgaaaaagtcaccgacacacaagattttggacgaggatggaaattctcatcctgggtcaaggtttatggtgagttgggattttggctcaagaggcggcaagctcgatgacatgcgggggtaccgtatgattatccacacctttcatcatcctgaggcggcaagcccgatgacatgcgggggggcaaacaagcccgttgacgagcagagagacttacatcgtcttctacaccttttgtcatctcgaggtgacgaactcgatcacatgtgggggtaccgtatggttatccgcacctttcatcatcctgaggcggcaagcccgatgacatgcgggggcgacgagcccgatgacatgcaggggtgttgtatgactatccgcacctttcgtcatgctgaggctgcaagcccgatgacatgcgggggggcgaacgagcccgttgacgcgcagagactaacatcgtctcctgcacctttcgccaaccaggggcaaacaagcccgttgacacacagagacttacatcatcttctgcaccttttgtcatcccgaggcggcaagcctgatgacatgcgggggtaccgtatggggtaccgtatggttatccgcatctttcgtcaaccaggagcaaacaagcctgttgacgcgcagaggcttacatcgtcttctgcacattttgtcatcccgaggcggcaagcccgatga

SEQ ID NO: 115905 - DNA, 300 bp, Glycine max
  Peptide Sequence Number=SeqID_232683
atggggctttgggttggcttttatagagggaaagtgatgttctggtttgctatggtaggtgaaaggagtaaatgttggagtaaaggaggttttgatgaggtgaagatgaagaaatgtaacggattacacgcaacaaatgcgctagctaagtattgtaaaagcaagcttcatgatgaatctggattgattcaaagaagttttgatgataacaaaggtgatgacaaaaagctcaaaagtcaagaatacttcatgataacaaagatgatgatctcaagaatcaaagaatgggttcaagattga

SEQ ID NO: 115906 - DNA, 240 bp, Glycine max
  Peptide Sequence Number=SeqID_232684
atggagggaaccttctaccctgagttggtaaaggtcttctatacatgtgccaaagatgacacgaaaggagagcaaccaacaacaaaaaacattgatccgatggatgaagaagaagctcagcaagagctagctcatcaatggaactgttttgagtcccttatgagtggatcatggcaggagagcaaccagcaacaacaaacattgatccgatggatgaagaagaagctcagcaagagctag

SEQ ID NO: 115907 - DNA, 435 bp, Glycine max
  Peptide Sequence Number=SeqID_232685
atggagattttcaacttaatagcattggctctgacattattcctagcaatagtgccaaagatggagagccaaataaagcctattccaaaaacccctcgtccactttgtgcatctcaatttgcactagtgaactacgcttgttcgaggttgccattctcccccggtgtcccaccggattccccgtcccctgacgaagaaaacaacaaccaccacaatcgcagccacagacatggccatagacatggacacagacataggcaccaccaaacccctgatgaagataactgttgccggtgggctaaggaagttgaccaccaatgtgtgtgtgaacttctactgcgcttgccacccttccttattagaccttcgcatcagtacacactcaaggttggagcatcgtgtgatatcacttactcatgcggtgcaccaatatga

SEQ ID NO: 115908 - DNA, 329 bp, Glycine max
  misc_feature (298)..(298): n is a, c, g, or t
  Peptide Sequence Number=SeqID_232686
atggtgtggggtcggaggtggctgggcaggggaaggggaagcaagggtcatgacaacatgacgatccagaatagactccagtttgtcgttaatggcggaatgggattaggtgagggtggcttgattctgggtgagcctcgacaccgcttcctccagtcgttcggtggcggagagttgcatattgtggtcaggcatgggtggcaagtcggaccacttggtagatggtggttacaacttcaaatcctaacaaactacaggcagagtagtggtgagcatggccagccgaaccaagcagcantgaaggcccaatggtccacaaaatcactaag

SEQ ID NO: 115909 - DNA, 435 bp, Glycine max
  Peptide Sequence Number=SeqID_232687
atgttatatggacacgctaagcgcagttgtgtgctaactgccaaaaaaattataaggtactaccttaggcagttaccatttcactcttgtgcattaaggcctcactgcatctgtccttaccttgcttcatctccctgcattcctgcacctttgctcttctttgcattcatcttcacaatccaaatgaacgcgttaagccaagctgtagcgctaagcacgttcatcttctctgttgagttatctgttgaactcgctaagggcggttgtgcgctaagcaagtactgtatggtgttgcaacctacccttcggcgggagggcgacgcaggactcacgggtgcgtcttccaagaaaggaaaatgcgcggagtcgccaccaacgtttattcaagaaaaacgtcagaaaaaccgaaaaaggtgtgtggtctacgaactttaa

SEQ ID NO: 115910 - DNA, 288 bp, Glycine max
  Peptide Sequence Number=SeqID_232688
atggttcgatggccaggaccggagcgcctcacggtggtttccttctacatggaaggaccagtactttgctggtatcaatggatgacccgtaatgggttcctatccacatggcccgctatgctccaggcgttagaatcccgcttcgcaccatcgtactacgacgatccacacagcgctctttttgaactcgaacagcgcagcctcgtcaacaattacttgatggagtttgaacgcctagccaaccgcgtcgtcaaccttgtcctgtataactcatacggatcaacttga

SEQ ID NO: 115911 - DNA, 189 bp, Glycine max
  Peptide Sequence Number=SeqID_232689
atgaggccgaggcgctaccgaattgccatcgtaattgacttctacattgttctttgttcgtcatccggcaaaaaggagccatttcaaagaagtgccaaaggagtcatcgcactaagcgagctcaatgcgcttagcacgcatcaacggctaagcccagctccagcatgcttagtgcgcatcaaaggctaa

SEQ ID NO: 115912 - DNA, 459 bp, Glycine max
  Peptide Sequence Number=SeqID_232690
atgcatgcttgtggcttgatcacccatttatgtgtgctgttcgggactttagcattgggaaatgcactgtttcctcagaacttgatagagcagggactaaataactgcattgctagggatagtgtgcagggtgaattggttccattggatttagaaattgaaaccacctttagaagaaacaatgtagagagaaaaagaaagcttttgcacgacaaaactgtagcatcaatccttgaagaggctcacttctctgagtcatcatcttctaattcacatacatcaagggaatctcaaacagcagaatttgaagccgaagtcatggctgaagagcaacctcgacgagtgaccttggaagattattcaagtacttcggtgccacaatatttctcaagcgttgcgcggccagaggttcaggcacaaaacttaacttacccaccttcgttgatacaactaatatag

SEQ ID NO: 115913 - DNA, 264 bp, Glycine max
  Peptide Sequence Number=SeqID_232691
atgcagccacgcttatctggtgccgctttgatggtggctcgggttatgttatggggcgaatatgagcgcggaatgggtctaggccgaaacagggaaggcacgacaagcttggtggagttcgctgagaatcatggaaggttcgggttggatgaagaaacccctcaagatcgaccggattgggtgcagccatgtcctccgggctttgaattgggtaattggcaaatcgtcgaacgacccaagatttccatgacaaattcaatgtaa

SEQ ID NO: 115914 - DNA, 321 bp, Glycine max
  Peptide Sequence Number=SeqID_232692
atgaagctcgagatgtcgctgaaaataaaagaagaggtgaagaagcaattcaatgttggcttcttggccgttgctcagtactcggaatgggtcaccaatatcgtgccagtccctaaaacggatgggaagataaagatggcactagaggatatggaaaatacaaccttcatcactctgtgggcaactttctgctatacggtgatgtcctttgggctcaagaacactggggcaacataccagcagtgtagaagcaagcttcatgatgatgaatcaagtatgattcaagtagttttgatgatgaaaaaaatcccaaaagaatga

SEQ ID NO: 115915 - DNA, 123 bp, Glycine max
  Peptide Sequence Number=SeqID_232693
atggttttgttggtcaaaggagatactggattattgagatctatgttgttgtacggtaactgttgtggaggcggtagttgtagttatggacatgagggttgtggagacaatggttgtggttga

SEQ ID NO: 115916 - DNA, 558 bp, Glycine max
  Peptide Sequence Number=SeqID_232694
cctctttatatcaactcctccatcctcaccgttgatcagaccggcttcggtgggaccaagataagcactgcggaaccctacactgttttagaaacttctatttacagactatttgttcagcgttttgtgaacgagtcctctgcttttaacttgacggtgacggaagcagttgagccgtttggcgtgtgctaccctgcgggggatctcacggagacacgagttggacccgcggtgcccaccgttgatctggtgatgcacagcgaggacgtgttctggagaatctttggcgggaattcgatggtgagggttgcgaagggaggagtggatgtgtggtgtttgggttttgtggacggtgggacccgcgggagaactcccattgtaatcggagggcatcagttggaggataatttaatgcagtttgatcttgactcaaatagattcggtttcacttcgactctcttgcttcaggatgccaaatgttctaatctcaaggttggcggcgacaaaggacccacgcggcatgagggggaggcgaagggacctcgttgcgcagcatga

SEQ ID NO: 115917 - DNA, 204 bp, Glycine max
  Peptide Sequence Number=SeqID_232695
atgtcgactagtttagccggtccaagtgatagagaagagttacctcctgaacctgctatggacgcccttgacttacctgaggatgatgaagacccactccctgatgttgattctctagaggatattatgtcagcatctgaggcagactctacagaagagaatggtcctggaggaacagtgaatagtgacgactcttcatcatag

SEQ ID NO: 115918 - DNA, 303 bp, Glycine max
  Peptide Sequence Number=SeqID_232696
atggaagaagaattctctcttcaagagaagaatattacaatgaagatcatgtgcagattagaagatgagaccataattcacctcttccgagattgtgctcaagttaggtggatttggcaatctcttggctttgacatcaatcttggtttctacaatcaagatgataataattggttctacactcaattatgtgataacgatggaatccctttggttgtatgtgttggttcatctagcaggcaagaaacacataagtctttgaggatgtggtttggtctcacttgtataccttgtctcaaatga

SEQ ID NO: 115919 - DNA, 273 bp, Glycine max
  Peptide Sequence Number=SeqID_232697
atgtcccattcactttcaagtactaatgtgcaggaacaggaaggaatgcagaacccatttgaattcagtgaagacaagatcctggatgatgtttacagaacccatttcgattgttttgagaagtgcgatgtgacatctctgcaaacggttgcttcaaatgttatcaaccactcgatcgatatctcagagaaggtcattagtaagattcgtcaaatgggtgttgacgtgttcgctaaagacacacctcacttgtctatgtgtatgctaatgtaa

SEQ ID NO: 115920 - DNA, 282 bp, Glycine max
  Peptide Sequence Number=SeqID_232698
atgtcacatttactgattgtaagggttcagagacatgaattatcgaaaagctttgagcctaagcttgactccattctaggaaaatttaaggaatttctggaaaggtgtagcaaggagatagtgagaatagaagactacaccaggcgtgagaaaattgtgattcatactggtaaaaatattgtaaaggttttgaaagcactcataatctccagagagaacagggatttaagacagaatgtgtttaatgtccttactggagaacaggtagccactaggatctag

SEQ ID NO: 115921 - DNA, 618 bp, Glycine max
  Peptide Sequence Number=SeqID_232699
atgtgcgaaaatcagatcgaagaggattgttatctcttcatctatggtggcatggacacaaagtggatccaagaatttgcaactgccatagagacattgaagagggacgttgcgaaactcaagttgaatataaacaccacaatagagtcataccaactaggaaaggatgatcccaaagctattccacacttttggattgccattgatagcttgcttacaaggaggaaacaaatgaagaagggcattgactttgcaacaagtgaagaaataaaaaggttgttgttcctcaaacaagatcctaagggatggaccattcttagtaaagggcacaatgtgaagttacttggtcatggtgaggccatgtgtcgcacggtcaaggactttggcatgtggcatggaaagttgcatgaagaagtgagttttgatgtggctttcagagaatactatgaggaaataatgaaggataataaagactgttccaaaaaatgtttaaatgtaatttctgctggttatgccatggatatattggaacgaatagtgtgccctaaaaaggattgtcggcgtccgatggaggtagcttctgttagttacaagtgttgtcatgaccgtaagaaatag

SEQ ID NO: 115922 - DNA, 294 bp, Glycine max
  Peptide Sequence Number=SeqID_232700
atgattcgtccaacgtgcttctctttctcctcctgtgagatcgaaatcaaaaacccaaacacaccggcattggaggaggaagaaggaatattgaagaaattgaagagtaatcacgctgaggaagatcacgaggaggctagggtttcgctctacacgctgccagtgttgttagcgctgcgtaggagaagacaagatactaggaggaagggagtgagcaaccctgccactaagagtgttgaaggtgagagtgaacctaaagacaaggaagagaagaaaattgattttaatttgtga

SEQ ID NO: 115923 - DNA, 231 bp, Glycine max
  Peptide Sequence Number=SeqID_232701
atggatagtctccaccgccgaagcccagatgtgacagtacatgatttattacaagatttcaaacgaataaattatcataaagcctaccttgcagctctgcttagatccataaatttttctgatcttcaaaagccacaaggagagcttgatggaaaagcatgtgcggatgttgggcagagtaatctcatggctctctatgatactaggttcagccagggattttggctttag

SEQ ID NO: 115924 - DNA, 243 bp, Glycine max
  Peptide Sequence Number=SeqID_232702
atggacaaagatacactaggatatagtggtcagagaggttcgaagaaccaaggagaattggagtggaggacttaccgttgcaaccaccaatttcaaggtgaggtcagggagcattcacagaggatgttcacgtggattagtagataccactacagttatacggtggagggagagggttggaagatttctatacttagtgtcgtgatatttggttgtatcaatccttttggtgatactgtataa

SEQ ID NO: 115925 - DNA, 243 bp, Glycine max
  Peptide Sequence Number=SeqID_232703
atgtctaagtcactttcaaacactaataatgtgcagcaagggaagactaatttgcttcaaaacccatttgaattcagtgacgaacagattctggataatgtttaccgaacccattttcattgtgttgagaagtgcgatgtaacatctcttcacaccgttgcctcgtgcgttatcaaccactccattgaaatcacggacaccgtgattactaagttatttatcaaatactttctaataagttaa

SEQ ID NO: 115926 - DNA, 294 bp, Glycine max
  Peptide Sequence Number=SeqID_232704
atggaacacggacatgcatacattcccatagttaggttcccagacccaaactatgttcggtggcaagcaacgacggctcatggtggccatcagtggttatgggtggtggaggaggaggtcttagggcttggatggacgtttggagagaaaaaaaaagtgaaaatcatgttttttcatgctgaagaacgtatttataatctacagatctcgcttagcgagtgggaatccacttttggtgttaagcgtgacttttcacgcttagcgcaattcctctcgggttgggattttcactaa

SEQ ID NO: 115927 - DNA, 891 bp, Glycine max
  Peptide Sequence Number=SeqID_232705
atggataagtcaattgttttcaatcacaatcatttcaagggtacacccgagaggaatcaccactacacattacttgatggggagatgattattgacacagatccgcatacacataagcaagagagaagatacctcatttatgatttgatggctatcaatcaagtttctttgacagagctgcccttctatgaaaggtggaaattgctggagaaagaagtaattgaacctcgtaacatggaacgcgagggcctctcaaagagtataaatccttattatagatatgacttggaaccatttagtgtgaggaggaagggtttttggttgctatctactgtgtcaaagctccttcataaattcattccacaactatcacattcatcagatggtcttgtattccagggttgggatgatccatatgtccctcgcacacatgaaggtcttctgaagtggaaataccctgagatgaactctgttgatttcctctgtgaggttgtacaagtgggagctggagatcgtcccttgctttttctatttgaacgtggaaggaagaagttaatggaggagaatgttatttttaaagatgcatcggacatttcttcctattcagggaagatcattgaatgctactgggattccgcggagcatcattgggtttgtatgcggatcagaatagacaaagccgctccaaatgatatcaatacctatagaaaggtaatgcgaagcataaaggataacatcacagaagaggtcttattgaatgagatcaatcagatcattcgcctacccttgtatgcagacagaatacaaagggatatcaaggctcaccagcatatgatctcttcgcggcgcaaatatcaagttcacaagatcatattggaaaaagctcaataa

SEQ ID NO: 115928 - DNA, 837 bp, Glycine max
  Peptide Sequence Number=SeqID_232706
atgtgggcttatatggagatggttgtgtgcgttaaatgtctcacttgttcagcatggacaagttattttgtggaagtgttaactatatgctgtaggaactgtgatatacactatgcaggttggttagactgcccaccacatgggcaagaaataggatgtataatcccttcgaaggttccacttggtgattccttcaatgattacattccaagtcaaaaatatgctcccaagcaagcaattcatcaacaaagagtcttaggtagagaacttggtttagtgattgatctgacaaatactactcgctactatcctgtatcagattggacaaaagaagggattggtcatgtcaagataagatgcacaggaagagatgctgtacctgatgatgaatccgtaaaattcttttgtgataagttcatgagcattacttctactcattcttttgctcaatgctcacacttgatagtcaagtattgtcttcttgttagtgttcttagcaatgctggttatatgattgttcactttcttgtgcgcacggaatctctttctgttactgaggcgataaatgaatttgcttgtgcacgtcacccaggaatttacaagcaggactacattgatgccctttacatgttttataatgaaaagaagcctgaagatcttgtttgtcctcaaactcctgaatggaagagaatttctgatcctgattttcatggcacagctgttccagctgtggacaatagtgcacacattcctgaacagtgctgccactgggttgaataccttacttcttggcatgtaatttacttccaacaagtttgtccgagcatgaatctgcca

SEQ ID NO: 115929 - DNA, 483 bp, Glycine max
  Peptide Sequence Number=SeqID_232707
atgctgcagtttacgctctacccgctggtggtggcattggccaacgatctgatcgagccggagcgccgcgtctcgctggccgcctgcctgctgatggcgttcggcgtcggcgccagcatcgggccgctggcggtcggcgcgctgatcgagccgctaggcggcaatatcctgtacgccttcttcgccctgtgcggcgtgctgctggcggccctcagccgcacggcgaaagcggaggagccgcaactggcgcaggacgcgccggtgccgcacattccgctgccggacagcctcgccagctcgccgctgtcgccggcgctcaatccgacctttgatgagcagatcattcacgacaccatgcccccgccggaagcggcgcccgatgtcgacgagccgcagcctgaagaacaggaaacggagcacttgcctcagggcgccgatccgcaagaggacaccggcctgaaaaaggcgcacgccatgctgtaa

SEQ ID NO: 115930 - DNA, 366 bp, Glycine max
  Peptide Sequence Number=SeqID_232708
atgcccatgaacatttgtacaaatttccattgcattgcattgtttcatatgaggtcagcatcaccaaatttcacgacaaaggttgcatgtgtctgcatccctaaaaatcatgttaactacatagattcctacatctcgtggatgaccgagcctctcgatgagtcgatctctttctttctcataaaggtggacccttgggtactagtacctatcacctttagaggaccttatgttctcgccatcagaggactgcacatcctcgtctgcagagggttgcacaccctcgcatttagagggctacacgtcctcattttcagtgtgctccatatccacaccttaagagaatataaggtcctttgcccttag

SEQ ID NO: 115931 - DNA, 739 bp, Glycine max
  Peptide Sequence Number=SeqID_232709
atggaatttcaggagcatcatgtggaagctgaacttgggatgcccgcagcagcagcgagctatgaggagttcggaatgccaccaaatcacggccaagaggagccagtggtggcggcggtgccggtaccaccacccgccaacaccatggcccgcaacagcggcaagggaaagtaccaggagtgcctcaagaaccacgcagttggaatcggcggccacgccctcgacggctgcgccgagttcctgccggcgggcgaggagggaaccctggacgcgctaaagtgcgccgcgtgcaactgccacagaaacttccaccgcaaggagaccccggacggcacctacttgctgcccttccaccaccgccaccagccaccgccgccgccgttcgcgccgtactaccgtgcgccggctggctacctgcacatgacgggaccgcagcacgccacgctggcgcttccctccacgtcaggagggggtgggacccagtcccctagggaggaccagggagacctgtcggacccaccaacgagtggtgccaccactcacggtgggtccagcagcaagaagcgtttcaggacaaaattcacccagcagcagaaggacaagatgctggccttcgcggagaaacttggctggaggattcaaaagcacgacgagggtgtcgtgcaggagttctgctcggaaaccggcgttcagcgtcatgtccttaaggtgtggatgcataaccacaagcacaccttgg

SEQ ID NO: 115932 - DNA, 531 bp, Glycine max
  Peptide Sequence Number=SeqID_232710
atgagctggattcaggctatgggacctctcctagcttctccagtggaccattttcttcagttttgtgatggttttggagcagagaaaaatcatagtacttgttgtggatggtgggttgctttgacaagtactatatggaagcataggaactttctcattttccaggacaaacctttcgagccgcagaaggtcatggaagatgctatgttctcaatttggtcttggttaaaggctagacaaaaaggctacaacatcagttttaaccattggtcttccaacatctcgaaatcctttgaaaggcggataaaggtagagttatgctacaagcctagaacaacagatgaacagaaaggcagtgccatatggaaggtacaattgttgccacggttcagtggctgtaactgtcaagaaaatctgtggcacattctagcattattggagttctatactttcgtcattgtgatgctaattccttacaactacagtactatttctgatgagccatatgacagtgcaacttccacttcctag

SEQ ID NO: 115933 - DNA, 540 bp, Glycine max
  Peptide Sequence Number=SeqID_232711
atgtcgacgacgagttctacgtttgggagaattgtgaaaggttatcaaagatttgttgctttgtattttttgtatcctagcattaatggggatggtgtgttgcttcaattggagaatgacagagatatctcacgcatgtgccgcataggtcttgctcaccttgacaaagatgtttatgtctactttgagcacatagtggatgattacttgaatatagtaggtggtgtgcctgatgaggttatggtgaatcaaactaaggatggagttgaagatattgatgttgaccttaataaggataaggaaattgaaaggattactaaccgaatccggaatcaatttaatgactttgtgattgaagatgcacagaatggtactcttgcacccattaggcctcttgcacctatcaagatgtcattcccaagtggaccttcacccaagatgtcattcccaagtggaccttcaccaaggatgatagaacctagcttcatgagcttcattcccacactagagctgccacgaagggaagacatgaataagtga

SEQ ID NO: 115934 - DNA, 1238 bp, Glycine max
  Peptide Sequence Number=SeqID_232712
atgctgccggacagccgtcgcggctacgcgccggtcgtacgcggcgtcgccaataccaacgcccgcgtcgaagtgcgccagaacggctataccgtctacagcaccgtggtgccgccgggaccgttcgcgctgaccgatatttcgccaagcaccctcagcggcgacttagccgtgacggttatcgaggcggatggctctcgccatagcttcaccctgccttactcctccgtgccgaatatgctgcgcgacgggatctgggagtatcaggtgaccgcaggtaaataccacgacggcaccaataattatcagccgcaatttatccagggcaccgtggcccacggcgccggctccgactatacgccatacggcgggattatcatggccgagcactatcgctccggcgtggtcgggctgggtaaaaacatgggcgaatacggggcagcctccgttgacgcctcatggtctgataccgatctggcttccggcgagaacaaacgcggcgccagcgtgcgcttcctctattccaaatcgctcaacaccctcggtaccgacgtgcagatcgccggctaccgttattcgacgtcgggcttctatgacttctccgacgcggtagctgaacgtaacaactggcagaacggtttctaccacacccagtattacgatcagagcgacgataaaaccggcgcgccggattgggcgacgcaaaatcagcgccgtcgttactacgactcgcagcagtacaacaacaaacgccagcgcgtcgagatgacggtcaaccagcacatcgccggcgcttcgctgtacgcgacctttatccgtcagaactactggaacacctccgcatacgaccgcaccatccagaccggtttcaacaccacctggaatcgcgtcagcgtcggcgtgttttaccagaacagccgcagtaactacggctatagcgacaacagcgttaacctgaacgtctcggtgccaatcaacatctttggcccggaccacgaaagcacggttaactttaacgccaccaacagcaagcagagcggtagcggctacagcgccgggatgagcggcacgctgcttgatgacaaccgtatgaattacttcgtacagagcggccacacccagcacggcggcgataccagcctggtcaacctgggttatctgggcagcatgggtaacgtcgatctgggctacagctacaacaacaactatcagcagacttcgctgacgtctccggcggc

SEQ ID NO: 115935 - DNA, 294 bp, Glycine max
  Peptide Sequence Number=SeqID_232713
atgaaggaaggagagtctctagacgatatgtttggaagaattcaagtcaagataaacctaaaggtgttggacaactttcccaaggtttgggaacccaacacctcaaccatccaagaagccaaagacttaaagaatcttgaatgggacaagttgctaggtattttaggaatccatgaagttcacctccaaaacaaagatcatatgcaaaagaaggattatgctaccctcaagtatggagaaacaatcttcagaagagaagaaacgaagagcttatccaaagctctcaaagtgtag

SEQ ID NO: 115936 - DNA, 444 bp, Glycine max
  Peptide Sequence Number=SeqID_232714
atggggtgctacagaattgaagggagagaccctacactccacagggttggaggaggaaggtatacttggtccccaaaagttaacttcacaaagtgggcaagtcatgaacacttctacaagggtgactggctatattttggttttgacaagcgcatctataatgttttggaggtgaataaaacaaactacgagaattgtattgacacgggcttcatagaaaatatcacaagaggagggagagatgttttccagcttttagaggcaaggcactattatttcatatgtggcagaggcttttgctcacaaggaatgaaactcctaatagatgttaaggaacccacaacaacactgccacctccaatattgcccaacaaggcccttctaaatagattgagtaatacgctcatgcttgtggtcaccattttggcatggatcttcatatag

SEQ ID NO: 115937 - DNA, 318 bp, Glycine max
  Peptide Sequence Number=SeqID_232715
atgaagagggctaaagatgagaaggttgagaaggctaaggtcgataaggctcaggcaacgtccatgatcatggaggtaagagcgacctctagagtcaggtctcagattcaaactgaaactgaggagaacctctccatgaagtcgcgaagtgactccccttcgtcctgccgaatgagtgtgactacaatcaaattcatctgtatgacaaatgtctctacatgcccatctgagttcgagagtccatcataccgatctattgtcagcatctttcatccaggtggtagttatgcttccatgattttctccatgaagaggtaa

SEQ ID NO: 115938 - DNA, 261 bp, Glycine max
  Peptide Sequence Number=SeqID_232716
atgcggcagaaaattattaggcatcatagggacaaactaaaccattccattaatcagtacattgttaagtctttgctttggcagttgctcaatggactaaactatccgcacagtaattggatgatacatcaagatttgaagccatcaaatatattggttatgagtgaaggagaggagcatggagttgttaagatggctgactttggacttgcgaggatatatcaagctcctttgaagccgttatgtgacaatggggtatga

SEQ ID NO: 115939 - DNA, 321 bp, Glycine max
  Peptide Sequence Number=SeqID_232717
atgcttctcgatggaaggatataccgaaatagagatcgtgcttggcataatcgaaggcaagatgggggtgggggagacgtcgtcgtcgtccttggattgcttgaacttttttatggcaatggatttggagggagtgccagcggggatttggttcaggtgagcaagatgaggcctacctcatttttatgtttgattttactctttgtggttgatgagcttttgttaactaatgacgtggttaatggaacaccgaattgttttgaggaatatatcgtgcaagaaataggaaaaagaagagagccaagaattcgtgctttgtaa

SEQ ID NO: 115940 - DNA, 150 bp, Glycine max
  Peptide Sequence Number=SeqID_232718
atggtagtcgatgtcggccaggaagatgaccaatccagtcgatgtcggccaggaaagatgaccgatccaggtctaaaacagaagaatccccggatgacgccgatcgaagatttcctaatagacatcgtccaaatattatcgggggattga

SEQ ID NO: 115941 - DNA, 691 bp, Glycine max
  Peptide Sequence Number=SeqID_232719
atgggaaagcgagcagcagccgtttcggcgacgaggatgtatacgccccccgcagccagcccatccgtcaaattgggaagcccggggatggcaagccggacagtttgtgtgtccgcaggaaaggtgtccattggtttagcgtggcaatcgtactgccgtgctggattccgtaggctttcggcgaatctgccattcacaattccgccagagatttcttgccggatttctttccatgaaaaaccgttttctgcttcttctgaccctgtggtggattgtcgtatccacggcgggttgttctctcctccctgcttcccgcagtgccccaacggctgccgccgctgccgcgcaacgagcggcgtcggcacccaagtctgcgcagcacaacgcggaggacttgtttttgcctgcctcggcgctggaggaacccgtgcctacagcaacgctgccgcgttccccagccttcgatccagaccgcttgctaccccgcttcggcgctgcacggatggatcaggtgctgctgtacacctctgccgccaacgcggtatggatgcgtgccgcagggctcgaccctgcgcaggcgcccaagctttgggaagggttcctgcgcaaatacaagattccgtatcgcaagctctctgtggtctcgcagcttgcccaggcgccggtggggacgctggtgcttccgtcccag

SEQ ID NO: 115942 - DNA, 624 bp, Glycine max
  Peptide Sequence Number=SeqID_232720
ggagtcaaacctcccttgcgttttcaggatcaggccaataccaacaggctcaaggcacgtatcacgctataccacttggccgataaggcaggccctgtgcatctgcaagcaggtcaacccggtttcggtcactttcgacgccatggatgccgggaacccgaccaacaaacttgctacggcatccgtttccttgcagcaggggggcacctacagcttattcctgctgcccggttgactatgcacactttttcctttcgttccatcctccgtactgaccttgctgcgcttgcgttctgtggagttgtcttggtgctgtgcgcactcatgctgcctggtgcgcaggctgcccctgcccacgccagtcccgttgtgataggcaaggacggttggctcttcactccctatgaattcgctaccgaagccgacaaggtcgataccgaagccagcctttccatgctgcagaaagcccatgcgttgtttgcgcagcggggcatcgcgatggtgctggtgctcattccacacaagattcgtgtgtacgcgcaccatctgcccgatgacaaacccttggacgcatacaccgcgcagaaatatgactacgctgtgcagacgctgcgtgcagggggg

SEQ ID NO: 115943 - DNA, 372 bp, Glycine max
  Peptide Sequence Number=SeqID_232721
atgactaagttacatgggcttagcgaatcagccccgcttagccacaagcgactcatcagggagatgaatgttcatccacaaaagatgaactcgcttagcgccgtaggcgagcttagcgaatgcgtagagatgcaaaaagtaagcaagaacgcacagtgcatgaatttgggtgagggagagaatgcaagcaatgctctgagaatcttagcaaagcgaactgcagcactaagcgagcctgagagacctttggtttctcaaagagctgggcttagcgcaaagaaggggagcttagtgaattctgcagatcataaaaacctgcaactctcgctaagcttgactccgggtcagcttagcgaatatgatgcatcttga

SEQ ID NO: 115944 - DNA, 372 bp, Glycine max
  Peptide Sequence Number=SeqID_232722
atggagcaacaacttaaaagaaagcattcttcaaaatcttatcgctttcactcttatccaaggaaggaccaagcccaaggaatttttggggatgaaccttcaaaacccaaggaaaataagggaaagaccatagagaaatcaacccctaagactagttccaaagtgaggactagcaacattaaatgcttcaaatgtcttgggaaagaagactccaagaggattgggctagagctactaaacaaggccctaggtgatgcaatcctactcccaagggcattggatagaagactccaagaagattgggtcagaaatgcaagagaatgccctagggttctcatgagctttagggtagattttgggtccaaaggctaa

SEQ ID NO: 115945 - DNA, 893 bp, Glycine max
  Peptide Sequence Number=SeqID_232723
tccatgggcatgagctttctcaagatgagggaataaagaaagggaaatctctagcccttacgattcaaagaccaaaatgcaactctacatccaaagattcatcctccaaagcctttgccatgaatgatgctttagaagaagaatctgatggtgatgactctaatgaagaagatgatgaactgagtgtgatcacaagaaagatccaaaagatgtggagaaataagaactcctccaggttcaatgaattgtccaaaagatccttccacaagaaagagaaaattccaatcatttgctatgagtgcaagaacccagggcacttgaagttgaaatatcctgaccttgaaaagcaacagataagaagatacgatccctcatttgatgaggacagtgaggaacaagccaaactatgtctaatggctgatgtgtccaccagcaaagtagacctaacactggacacaagttcagatgatgaggactctcaactagatgatactgtcaactctgatggtgaagaggaagtcagggaactacaagatgaaaaggtattcagtggactcaaaactctccttaaggattttcaagacttggaagataggggatgtgaggtcttgaaggaatcacctcttgagattgtaaaactttataaggagatagaaaccttgaaagataaactaggaaaatttgttggttgtcatgaagcctttaacaaaattataaaggtgcaaaggcaccccaaagacaaattcgaccatggtttcaagggaaaaaagattgtatatggtgaagaagtcatcgtttgctatttctatggaaaagtgggtcatgaaagtcataagtgcaaggacctccttaaaaagggaaacccatcaaggggtccatgcagcgcttactag

SEQ ID NO: 115946 - DNA, 1335 bp, Glycine max
  Peptide Sequence Number=SeqID_232724
atgcaagaagagctaaaccaatttcagaagaatgatgtttggaagcttgtagaattcctcaaaggcaaatatgttggagcaaagtgggtgttcaaaaacaagttggaaaaaacaggtaaggttatggggaacaatgctaggcttgttgccaaaggctactcgcaacaggatgcttatgtaggaagagttcaaaatgagtatgatgggagaattgaagttcttccttggactttaaatcaagcaagcggacgaaggaatatgcatacatcaaaccatgtagtgaaaaaacttctgaagaagttcaaggtggacgatgcaaagcatatgaaaacccccatgcatccaaccattgtacttggactggatgatgaatcaacgaagaacccaacccaaaccatccaagttgaactagacttcaagaacaatccaccatctgcttcattcgacgaaggtgaggctctacaaattgccagacctgcaccagtgaccatcattgttgtagaagtttcattgaaagacaaagagcccaatgttcacattgaacatttcttcgacattgagtcattggagaatgatggctacatgatcaatgcacacctcatgttgtgcggcatccaccacttcttcgaggacccaaaggataaaagtattgggaaggacatctaccgtggcgtcattttgatcaatgtctttgaggcttatggagtgataaggaagttattgtatgagactcctgaagaagtacaagacataatctatttttatggcgtattcttgcttaagcaaaaggcctttagtcaagagaacatctccaagatgaggctggctgatgatggctctttccagcagactcctcgggatgattccattttttctgaacttgatttgaagtttggactcaatactagaagtaataagatgatggacacatcatcatccaaggcggcccctgcaccacaccgtccacctcccattctggttgctcccaaggcaataggtgcaatggcctatatattaagaagggcaacacctaagaagcaacaactatcatccactgcagaatgcttactggagctcagtgagattgatgatgaagatggcttgatgatttggaaacatccacagttagtcaacaagacttttgccctgcatccaattccctatgattggggtaagtacttcacttgggatgctgcaataaagacaatcactctgaagctagatgctgagttcgatcaaaatgatgccatgctcttttactttaaagacatagctattgttactgcttgggcaagacatcttgaactcaaagactgttcatcctctcctgattag

SEQ ID NO: 115947 - DNA, 666 bp, Glycine max
  Peptide Sequence Number=SeqID_232725
atgcagccaagaggagtggaacgtttaaaaaaagcaattaatgatttgcaaactgatgagaagatcaatattattatgcgttcttttcagctggaacctaatcttcccagtgataaaaggctgaatgacttggaatttgttaagtttacccaaaaccttagcgatgatcaatatgaaaatatgagaagccgttttaagatttatgctgataatctcaaagaagctggaaaagaagaaaatatagagttcaactttgataaagcgatttatatcaatacgagaaaagctcatcaaataattcaattttctaagaagttcgctaagagcttggaaatggagcagttgctatttaaagctcattttagtgacggattagatataggaagtgatgaagtattattgaactttgcagaacagttaggcttagataggtcggcaacaattcaggctttaaaagagaatagctatgaatatgaaattcaacaggatgtacaggatggattaagtgggggacttagaggcgtgccgttctttaggataaataatcgtaatactttatctggtgcacaatctgttgataattttaaagcttttttgaatgaaaatattgataataattcttcccgtcaaaatatgtcttgtgatatcaatggggattgttattaa

SEQ ID NO: 115948 - DNA, 120 bp, Glycine max
  Peptide Sequence Number=SeqID_232726
gccaaagaagagaaggttcaagtagttgatgactcactcagcgaggcagatccgctcagcgagtggcatccgcttagcgaggcatacagctcgcttagcaggtttggaaaccctaaatga

SEQ ID NO: 115949 - DNA, 780 bp, Glycine max
  Peptide Sequence Number=SeqID_232727
atggcgaggattcctaacaagattaggtctattgatggatcaaaagagacgcttaagcttgctgttagaatcaccgatctttggttcgttgggactcccaacaagtctgagcaagaggaaatgatttttgttgattctgagggtgatcaaattcatgctatttgtaaatcggaccacctcaagtcttggaaagctgatttgaaagagaattgcacttatgttatgcataatttcaaagttgtcaagaatgatggtcaatttagagtgtgcgaacatgagtacaagttattttttattggagtgacggttgttagagaagctgatttgcatgaactgccttttaagttagatttgttgaatttgcaaatgtcgttgctggcaattttgtggctggcctgttggttggtggtctttcggcatgtttcatcaaaaaataccagggttgtttttagaatgaaggatttgagtggtgaaattttatcttgcacactttgggagaattactgcattcagttcctatcctatttgaatgaacgtgggaatgatgggccgatggttattatattgacacatgctagaataaaagatgcgcaggataagtatgatattctatttactaatttgggaagttatccagctttagtgagtaattccttcaaggcgttgaaactattgattaatgatcctatattggaaattcaggaatttaaagagaggcttttagatttaggcgttcaggtgactccagttttactacctggcgatcaagcaagttcataa

SEQ ID NO: 115950 - DNA, 177 bp, Glycine max
  Peptide Sequence Number=SeqID_232728
atgggatccttctcttctttttccctctttctccttttcttcttcttctcttcttcacactcaaagtatgggagcggtgtacgacatcgtgaagagcggcgtcggggttgcgtcgatgggtcacgccggagctggattgattttgtgcttggtatcctgcaccttctttgcagttag

SEQ ID NO: 115951 - DNA, 192 bp, Glycine max
  Peptide Sequence Number=SeqID_232729
atggcaaaaggtgcagaagacgatgtcggtctcttcgcgtcaacgggctcgtttgctccctggttgacgaaaggtgcgggtaaccataagggtcaatttgtcagagattgtggggcggatgacaaaagagaggctcttgctcctacgtatcctcaatttgtgatgaggaactcagacctacgtagttcttga

SEQ ID NO: 115952 - DNA, 787 bp, Glycine max
  Peptide Sequence Number=SeqID_232730
ggtggatccttgggtactagtacctattgcctttagagggatgcatgccctcaccttcagagggctacatgtcctcgccttcagagggttgcacgccctcacctttagagggctacatgccctcgccttaagaaggctgcacgcccttgccttaagagggctgcacgccctcgccttcaaagggctacacaccctcgccttcagaggactacacgtcctcaccttcagaggactacacgccctcgccttcagaggactacacgtccttaccttcagaggactacacgtcctcgcctttagaggagagtacaggtctcttgcctttagaggactacatgtcctcaccatcagaggactacacgtcctcaccttcagaggactacatgtcctcacctttagaggactacacaccctcaccttcagaggacaacacgtcctccccttcagagggctacacgccctcaccttcagaggactacacctcttcgccttcaaaggactacacgccctcgccttcagaggactacacgtcctcaccttcataggactacacgccctcgccttcagggggctacacgtcctcaccttcaaagaactacacaccctcgccttcagcggactacacgccctcaccttccaatcgagtcatttgagacccaaagctgatatgaccggcagattacttgttgggtcattaacctttgattgccgcatcatgcactttattattgttcgtattttacttcccgttcttctaaccttgctcaagcctccgaggaggatttga

SEQ ID NO: 115953 - DNA, 409 bp, Glycine max
  Peptide Sequence Number=SeqID_232731
atggctccgaagaaactctccacgaagaggtgtagaagagacgccacaagagatgggtccagtaccaccccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcagacgttggacaccgctggtgactcccatggccaaatttgaccctgagatagtcctagagttctatgctaatgcttggcccatggaggagggagttcgagacatgcgttcgtgggccagcagtgtgagttcagctaaaggaggaatagggttgacgggttcgacgaggaagccattgcccagctgttatgcacaccggg

SEQ ID NO: 115954 - DNA, 453 bp, Glycine max
  Peptide Sequence Number=SeqID_232732
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacagtccggctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 115955 - DNA, 1563 bp, Glycine max
  Peptide Sequence Number=SeqID_232733
atgactatggtggtcctcacaccccttttggccatagtcggtattattctcctacttaaactcgtctatgacaacctctcatgttactggctcacaccactacgcataaaaaagatgatggatatgcaaggtgtccgtggccctaaaccttgtttcttcacaggcaacatcctagacatggcttcccttgtctccaaagcaacctcccaagacatgaaaaccataagccatgacattgttggccgtcttctcccacattttctactttggtctggccaatttggaaagaggtttctatattggaatggttcagaaccaaggttgtgtctcaccgagactaaattgatcaaagagttcctttcaaaacacagcacggtatctgggaaatcctggcagcaaagacaaggttccaagaatttcattggggaaggattgttgatggcaaatggagaagattggtaccaccaacgtcacatcgttgccccagcattcatgggagacagacttaagagctatgctgggcacatggtggaatgcactaaggagatgctccaatcaatgaaaattgcgttggagagtggccagactgaggtggagattggtcactacatgactaaactcactgcggatattatctctaggactgagtttggtaccagctaccagaaagggaagaaaatattccacctcctcacgctgctgcagactcgttgtgctcaagcaagtcgtcatctttgcatccctggaagcaggttttttccaagcaagtataacagagagataaagtcattgaagatggaggtggagactctgctgatggagatcatacaaagcagaaaagactgtgtggagattggaaggagcaattcttatgggaatgatttgttggggatgctcctgaatgagatgcagaagaagaaaaaagggaatggaaacaacaacagcagcatcaatctgcagctagtgatggatcaatgcaaaacattcttctttgcaggacatgaaaccactgcacttttactcacttggacagttatgttactagccagcaacacatcttggcaagacaaagtcagagctgaggttaaaagtgtctgcaatgggggaattccctctctggatcaactctccaagctcactcttttgcatatggtgatcaacgaatcaatgaggttgtatcccccagcatctgtgctccctagaatggtgttcgaagacatagtgctaggtgacctttatatccctaagggcctatcaatttggatccctgtgctggctattcatcatagtgaaaaactatggggtaaagatgcaaatgagtttaacccagagaggtttacttcaaagtcttttgttcctggccgttttttaccatttgcttctggccctagaaattgtgttggacaagcatttgccttaatggaagctaagattatactagccatgttgatttctcggtttagcttcaccatttctgaaaattaccgtcatgcccctgtggttatcctcacaattaagcccaaatatggggttcaagtttgtttgaagcccttggagccatga

SEQ ID NO: 115956 - DNA, 267 bp, Glycine max
  Peptide Sequence Number=SeqID_232734
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggcccccctccccccccccgtgaaacagttttgttgccaggattttgccaactttggcttgcgccccgttggctaagtctgtgcctcggtggtgggatcatcatgtcataa

SEQ ID NO: 115957 - DNA, 684 bp, Glycine max
  Peptide Sequence Number=SeqID_232735
atggatatgaatcttggatctttcatttctagtcagattacactcatggcccagcatgactcctcgaggctcggctttcctaccctaatcactgctttatgtaaagcctggggagtccactctgtttccttgacctatgagagattaagtcctaccattaatttggcatatattaagaaaaactgttggaacctagataacctctcagttactttcagagggccgcgcaaggccaaggggaaaaggtatgaggctcccccatcttttgaggttccctcatctgtcccatctgcatccatatctgtttttccagtttctatctctgcaggtccattagattttatttttacaccacaaatgttgcactctatgctccagagcatccatagggggcagtccattatcatgcagagccttcagggcttgggcttgccctccattatgagcatggaggagtttgatgctcaggtggcctgcccaggagaccaactctcttcttctggagagggtggagcctctgcagcccaggagcctgtgactgaggagccaccagcaccagcaccaacaacaacagaggaggagactactcctcaagagacccagccatctacactagttgcggagccagagcagcctatccaggattcatcagcagctctagcattggatttgaatgaagactag

SEQ ID NO: 115958 - DNA, 843 bp, Glycine max
  Peptide Sequence Number=SeqID_232736
atggatacaaagtttgcacgaaggactgagcgcattggtagaacaacatgctcttattggagagctggaagatgtaacagaaatccttgcagatttttgcacatagagacaccatctccacctgctgcttgtggttatggcaatactgcatatagctacggaaaaaagccccattcctcctctgagaataccccgaaatatggttcaaagaaagcattgcttagagataatggagatagaggagatgcgacaagggttgctaaggctttcaagaaatcatcaccaaggatatgtaaatactggatcaacaacaattgtgtacatggtgaacaatgcctgtatctgcattcatggttttgtggtgatgggttttccaccgtaaccaaacttcaagaacataagaaggttatcactggcatcgcacttcctgttggatccgacaaactttattctggcagcactgatgggacagttaggatatgggactgtcatactggtcaatgtgctaaagtcatcaaccttggtgctgaggttacctctttgatcagtgaggggttatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagttctaaagccgattctccttttgaactggttgcgtcactcactggccacactaaagcagtggtttgtctggcagttggatgcaagatgctgtactccgggtccatggaccaaagcataaag

SEQ ID NO: 115959 - DNA, 1629 bp, Glycine max
  Peptide Sequence Number=SeqID_232737
atgacttattatgggatatcatcaaacttggtcctgtatctaacaaggaagcttcaccaaggcactgtcactgcttccaacaatgtaaacaattgggttggcactacttatataactcccatattaggtgcctatattgctgatgctcaccttggccgctattggacttttgtcattgcctctcttatctatctattgggtatgtgtctgcttacactatcagtttcccttaaaagcctacagcctcctgagtgccatgaattggatctgacaaaatgcaagaaagcctccacactacagttagcagtgttctatggtgctctatacatcttatcagtgggagctggtggaacaaagcccaacatttcaaccattggtgctgaccaatttgatgattttgaccccaaagaaaaggcatataagctctcattcttcaactggtggttttccagcatcttcattgggacccttttctcattcacagttctagtatacatacaagacaatgttgggtgggctcttggttatggaattccaactatagcgcttgctatagcattcatcacattcttggcaggcacacccctctatagacatagattggcctcagggagttccttcactagaattgccaaggttatagtggctgctttgaggaaaagtactgtagctgttcctattgactctacagaactatatgagcttgatgagcaagagtatacaaataaagggaaattcaggattagttccactccaacattgaggttcctcaacaaggcttgtgccaaaactagttcaagtactagtgaatggatgctatgcacagttactcaagtagaggaaacaaaacaaatcctaaggatgatccccatctgggttgctacatttattcctagtacgatgcttgctcagacaaataccctttttgtaaagcaaggagttactcttgacagacacattggcagattcaacattccccctgcaagtttgattgcgtttacatctttcaccatgcttgtatgcgttatactctatgaccgtgtcttcgtcaagattatgcaaagattgactaagaacccccgagggatcacacttcttcaaagaatgggcataggaatcacgattcacatagtgactatgatagttgcatctatgaccgaaagatatagacttaaagtggccaaagaacatggactagttgaaaacggaggacaagttcctttgagcatactcattttggctcctcaattcatacttatgggattgggtgaagccttcttagaggtttccaaaattgagttcttctatgaccaagcaccagaaagcatgaagagccttggaacttcatattccattactacagtaggccttgggagtttcattagcacttttcttctttccacagtttcacacatcactcagaaacatggccacaaaggatggattttgaacaacctgaatgcttctcattttgattactactatgcatttttcgcagttctaaacttactgaatttgatcttcttcatgattgttacaaagtactttgtttatagagctgaaatttcagattccatagatgtacttgcacaagaactgaaggagaagacagctaatgcgtcaaactaa

SEQ ID NO: 115960 - DNA, 919 bp, Glycine max
  Peptide Sequence Number=SeqID_232738
cgggtttgttcagctgcaggctgaggattatcagctgtcggcgttgggcaacgtggtcgagctgtatgacgtgggacagcgcctgtttaaacgtctgcgtgaggcacccggcgtgacgctgtgctgcccggatcacgttacctcagtaacccgcagcgccgatagcgtgcagacgacgctcagcagcggcgcaacgttacagggcgcgctgctggtggccgctgacggcgcacgctcgccgctggcggcatcctgcggcattcgctggcagcgcgacgactaccagcagctggcggtgattgccaacgtcgcgacgcagttgccgcatcagggccgcgcgtttgagcgcttcacccggcatggcccgctggcgctgctgccaatgtccggcaaccgtctgtcgctggtgtggtgccatccggcggctgccgaagccacggttaagcagtgggacgatgccaccttcctgcatgaattacagcgcgcctttggctggcggctggggcgctttactcacgccggccagcgcgaaatctatccgctggcgctgcagaccgcagagcgtcaggtgacgcaccggctggcgctggtcggcaatgcggcgcagacgctgcatccgatcgccgggcagggctttaacctcggtctgcgcgatgtgatgtcgctggcggaaacccttgcggctgcgcatcgtcaccagcaggatccgggcagccacgcggtgttgcaccattttgctgcgcgccgccagccggatcgcgcggcgaccattggcgtcaccgacggtctggtgcggctgttcgccaaccgttatgccccgctggtggcaggacgaaatcttgggctggtggcaatggaccacctgccatggctgcgaaacccacttgccgtgcgcacgctcggctgggttaagcgttaa

SEQ ID NO: 115961 - DNA, 132 bp, Glycine max
  Peptide Sequence Number=SeqID_232739
atgacgatctcggactcattcaccgtggatcgtcgtgaaatttcagcaccagcaatcagaggaaaaattgaggaatctcaggaacttgctagagatgccactatcactgtcggaagacacgaacatgtgtag

SEQ ID NO: 115962 - DNA, 366 bp, Glycine max
  Peptide Sequence Number=SeqID_232740
atgactaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgttagtgggtcattactaaaatctgctgtaaagcttctatataagctgaatcattttatcaataaagacaagttgagttttattcagaaaattagagtttatctcttttatcttagtgagagtgattctcctaaattcttgagtgattcaagaacaccctggctgtatcaaaggactttcacaacctttgtgtgttgccctcgctggaaagagtga

SEQ ID NO: 115963 - DNA, 690 bp, Glycine max
  Peptide Sequence Number=SeqID_232741
aacgccgtacccactctactcgccgatacctaccattctatccatgaccgtacacaggctggccggggaaccatttcttgttgtgcacctttactctatcaatggtttaccttccacttacgtcaatcccgtgccttgaagatcaatgatgacaagctttcctggcctcgccgaatcatgactcttgacccatccgacattgtttggtaccaagcagctagtgatgttggagagattattgtgagttgtggtgaatatcccaacgtacctcttttggatatgcgtggcggaattagctacaacccactcctcgctcgacgacaatttgggtacccgataaagacaaaaccaaacaaccttgccttgactaatgaattctatcttaaccatggtgatcactcgaacaaaagggaaagattcgcacaagcttggagcgctatccgcagactcaacagaagtcacttgggaaagaaatcagactatgagctagagcaagagaatgagactttgaaagggaagatagcccaacagagccgtgagctttttatccagaaccagaggatgattgagaaggacgacttgcttcgtcggaaagacgttttgctccaccaagatgctagaaggaagaggaagtttatggacttgttctcccgtgcacattcagattccgaggacccatctactccggga

SEQ ID NO: 115964 - DNA, 669 bp, Glycine max
  Peptide Sequence Number=SeqID_232742
atgggagatcgcttggaggacatgattcgtgaccttggacaagagtctttccagcaagcgcatgcccctgtgtatgaaggattgcagagtgattcaaagaagcctttgtatacggggtgtaagaattccttaaccctgttgtctgcggtgttaagtctggttaatgtgaaggctaggtatgggtggagtgacaaaagtttcacctcgttgcttgaggtagtccataatctgcttccaaaggacaacacgttgcctaaaagttactataaggcggaaaatatattgtgtccgatgggtatggagtatcagaagattcatgcttgccccaatgattgcatattgtacagacatgaattccaagaaatgtcgaaatgccctacctgtgggacttcacgttacaaagtgaaggatgaaaaggaaaacagttctgatgaaaactccaacaaaggccccccagcgaaggttttgtggtatctttcaatcattccaaggtttaagcgtcttttttcaaatgaggacgacgcaaaagaccttacatggcatgcaaatggaaggatttctgatggaatagtccgtcatccggctgattgctcgcagtggaagaagattgatgcgaaaatacatgatgttgtctatgatgatatcgggcccaagaaggacattaaatga

SEQ ID NO: 115965 - DNA, 330 bp, Glycine max
  Peptide Sequence Number=SeqID_232743
atggccatcaagaagtcctgtaatatattggtgtggatcattgtgattcacttttttcaggaacttccatttgaggagggggtgtctaagtcccatatcaagtattatggggtgcttggtgaagtacttgttgagtggcttggttctcacccttcacagctagcttttaagggagagttccccaagtgtccccaatgtggccatcaggcgttgactctcaaggatggtgctaattgctatgataggaacttgggtattacgacagggtacctaagtcttactatgagatgctcagtggagtacttaaagtggcttggttccccctcttga

SEQ ID NO: 115966 - DNA, 336 bp, Glycine max
  Peptide Sequence Number=SeqID_232744
atgggttggcctttggtgatgatcctcacattgcggaatttttggacggtgacgggtggtgaggagttgccactcttccagggaggagtcttgatcaaggtaaaggatgtagcagttgcaagggtggtagaaggcaacgagaagggcaatgactttgccaaagataaggtaggcgagacaaggcacaaagtgagaaaggagatcgtagatgacaacgccattgttgtgcacgcgacagagggcatggatctaagacaaagtggtcgcgcgacttgtggtgatggcgatcttggcttgcagtggtttcaaggaagcgatggtggtaagcacaactaa

SEQ ID NO: 115967 - DNA, 855 bp, Glycine max
  Peptide Sequence Number=SeqID_232745
atgttgtgggatcgaaagggagtcttcaaggataagcagaagaggtatggatctcctgcaagacaaaaacactcatcatctcattatggttttctcaagtttaagaatcaggaatctactcgatttcaacgtgttggtcccaaaacaccgggtggtggtggtggtggtggtgctatgcaccagtttccaaaggaacttggccaaggctcttgctctggctatggcataacctttcgatccccaagagaccccagacacaagttctgggaaattactaacgatgcctctctgcgcttgtcttcaaagaggtccattgataatgtgctaagtactccctcacatgcatgttctatgaacaatggggagaagccttactccagagcacaatgccatgataataagaagaagaactatgagagggagagttcttccttgaagaggcgcattgatgatgtgctaagtactccctctcatgcatgttctataaacactaggcagaagcttaactctagtgaacaatgccatgataataataagaagaactatgagagggaggattctttgggatggaaaccacttaataaagggaacaatacttttgaaagagaaaggaagaggccaaggctgaactggggtgaaggactcgctaagtttgagaaaaataaaattgagggtgatggtgtaagtgttgctactgctgctactccagcttctggtgcattcaattccttcacaggtatcttgttagattctatcaactactctttgtcataccctaatttcgtccggggacctttgcttgatgacatgcgacttttgtttggtccttgtaaggtgcttggcacccatcattag

SEQ ID NO: 115968 - DNA, 330 bp, Glycine max
  Peptide Sequence Number=SeqID_232746
atagtaaactggagaactactttaaagtttccagaagaagctaaactttcagcagaggcaaaggatcttatttgtagactcctatgtaatgtggagcagaggcttggaaccaaaggagctgatgaaataaaggctcacccatggttcaaaggtgttgaatgggacaaattataccaaatgaaagctgctttcatacctgaggtcaatgatgaattagatactcaaaattttgagaagtttgaagaggcggacaagcaaactgtaccttcctcaaaggcagggccgtggagaaagttggtctacaagaattgctgtaactgtaccatttaa

SEQ ID NO: 115969 - DNA, 828 bp, Glycine max
  Peptide Sequence Number=SeqID_232747
atggcagcacccacccatattagttatttaactctggttagaatctgccgggagaaggccactggccatgtttatgctatgaagaagcttaagaaatcagagatgctacgaagaggccaggttgaacatgtcaaagctgagagaaatctacttgctgaagttgacagcaattgcattgttaaactttattgttcctttcaagatgaggagtatttatatctcataatggagtatctacctggtggagatatgatgacattgctgatgcggaaggatatactcacagaagatgaggccaggttctatgttggggagactgtcctagccatagagtcaattcataaacataattatattcatagagatatcaagcctgacaacttgctgctagatagaaatggccacatgaaattatcagattttggattatgtaaaccgctagactgcagtaaccttcaagaaaaggacttctctgttggaatgaacagaagtggagccctccaaagtgatgggcgtcctgtggctcctaaacgaacccaacaggaacaactgcagcattggcagaaaaatcgacgaatgcttgcctattctacagttggaacacctgattatattgctccagaagttcttctgaagaaaggatatggcgtggaatgtgattggtggtctctaggagctataatgtatgaaatgcttgtggggtatcctcccttttattcagacgaaccaatgttgacttgtagaaaggacttagagtccattgaattctgcaagactcctgtgcttagaaaaggccatcttgtcatattggattttagaaatagctag

SEQ ID NO: 115970 - DNA, 456 bp, Glycine max
  Peptide Sequence Number=SeqID_232748
atggctgacacgatccatggtgaagaattaattgaaggagaagaaatattggtgaagaagaagatcaagctaccccgccgtggttgccagctgtgtcgtgagagtgagaagcagagggtaacgaggaaggtgaagtggctaccccgccgtggttgccagctgtgtcgtgagagtgagaagcagagggtaacgaggaaggtgaagtggttcgatgaccagaagggagtgggtcgtgtctacgatgtcagcactggaaaatccttttacggccccggcggcccctacgccatgttcgccggcaaagacaccagcagagccctggcgaagatgagcaagaacaacgacgacatctccccctccctcgttgacctctctaacaaggagatcggcgttctcaacgactgggagaacaaattccaagctaagtaccctgtggttgctcgtgttctcaattaa

SEQ ID NO: 115971 - DNA, 2544 bp, Glycine max
  Peptide Sequence Number=SeqID_232749
atgtcatccgattacaaactgccatatgttctgaacatgaagctgagcaagaaaagcaagtatcacttgtctgatggagaggaagatgactttgagggaattgattctcttggaagagatgattttgaggatgagatgcttcctgacgatgttgatgctgagactgatgagaaattaaatttggttcagcggagcatgcagattccgggggaaattagtgcggatgatggggaggaaaatagacataaaagcaagaaggaagtgatggaagaaattatctcaaaaagcaaattttacaaggctcaaaaggcgaaagacaaagaagaaaatgaaaacttggtggaagaattggacaaggatttcacttccttggttcactctgaagccttgttatctttgactgaacccaacaagatgaatgctttgaaggctctggtgaacaaaagtatttcaaatgagcaaagtaataaggactgcatgtttgctactcggacaatgggtaattctgtgcaggaaaaacctgatgattatgacaaacttgtcaaacaaatgggattggaaatgcgtgctcgcccttcagataggacaaagacaccagaagagattgctcaggaggaaaaagaacgtctagaggaattggagtggttgtggattctaatcatggactatttgcatgaggaagagcggcagaagaggatggttgctgctgaagattcaagtgatgaagacagtgaagattcagaaaagccatctgaacagaaaccaagatctatctctggtgatgatcttggtgattccttttctgttaataaacaaattatgaccaagaagggttgggttgatgagattcttaaaagaagagatgagaaagattctgctagtgaagatgatgatggtgaagattctgacaatttgggaagctctggagatgccgatgaaggatcagatgaagatcttgatgaacatgagaaggatctttctttaaaagattgggaacaaagtgatgatgatgatattggtgcagatttagaagatgaagatgatagtgatgaggatatagaaacagcttcagaagaccttgatgaggtaaaaggattggatgctgcagttcatataaaagcaaaaagaaatgcttctgttgaaagtgtaaaaaaagataaggattcttcagatgccaagaagatagatgttggaggaaaacagtcaaaagagttggacattccttatataattcaagctccgaagacttttgaagaattatgttcactggtggataaacattcaaatgacaacattattttgattatcaatcggattcggaaaagtaatccaatcacactcgcagcagaaaatcgaaagaaaatgcaagtattctatggagtattgttgcaatattttgctgttttggcaaataaggaacctcttaatgttgagctactcaatatgctggtgaaaccgttgatagagatgagtatggaaatcccatactttgctgcaatatgtgctcgtcgcagaatagaaactactagaaaacaattcattgagagtatcaaacaatcagaaagtagcagttggccttcttcaaaaacgttgtgcctcttgcgtttgtggtccatgatatttccatgctctgactttaggcatccagttatgactcctgtgatattgttgatgtgtgaatatctgatgcgttgccctatagtatctggtcgggatattgccattggctctttcttatgctctatgcttctctcagtatttagacagtctcggaaattctgtcccgaagcaataatatttcttcgaacttcgctgttggcagctactgaaagtaaacatgtttcagatgaagattcccagttatatcatcttatggaactgaaagctctcaagcctctcctatgcatacacgagatagtgaatgagattagtcctctgaatttcttcaagataatagacatgccagaagactcttctttcttcacttctgttagtttcagggctagtgtattagttgcagtcgttgaaactctacaaggatacgttaacgtctatgaaggcttaagttcatttcctgaaatattcctaccaattttgaaattattaaatgaaatagcagaacagaaaaatatgtcaaatgcattacgagataaaattaaagatgtggctgagctcattaagttgaaagtggacgagcatcacactttgaggcgaccacttcaaatgcggaaacaaaagccagtaccaatcaaattactgaatcccaagtttgaggagaactatgtcaagggcagagactatgatcctgaccgtgaacgagctgaactgagaaaattgaagaaacatttgaagcgtgaagctaaaggggctgcacgagaattgcgtaaagacaactacttcttgctggaggtgaaggaaaaagagaggtctttacaggaaaaagatagagcagagaagtatggaagagctaaagctttccttcaagagcaagaacatgccttcaaatctggacaactaggaaaaggtaggaagaggaggagataa

SEQ ID NO: 115972 - DNA, 303 bp, Glycine max
  Peptide Sequence Number=SeqID_232750
atgggtggaggatggttgttgtatgttgctattgctgttggtgtggcactagcagctattgctgttgtttggttgctttggaagctaatttctggagttgtttggttgctttggaagctgatttctggtgttgttttgtggcttgggaaagtgattaggaagattttctgctgttgttgtaaaagagggaggacaatgaaggctccagggaggaacattcgcatttacagaaatgtctttgaacgtagccctagaaactactttcgtattttgcgcagtgatcagcgtatgctattggtttga

SEQ ID NO: 115973 - DNA, 1563 bp, Glycine max
  Peptide Sequence Number=SeqID_232751
atgacgaggggaagatatgatggatcgccaaagaagcatttagttgcttccgtttgtggtgtggcagtctttcttggtttgctatatgtgttccagcgatccatctttggttctcagaatagtggttcatctgcgcttgaatatggcagcaagtcattgaaaagacttggggcatcatatttgggttcagatgatgatgctgatagcaagcaagatgaatcttcatccagtattgcgcagggagatggtgaggctgatattgtaccaaagagtttccctgtttgtgatgatcgtcattcagaattgattccctgcttagacagacatcttatctatcaaatgagactgaagttggatctttctttgatggaacactatgagagacattgtcctcctgcagaaaggagattcaattgtttgattcctccaccggcaggatacaaggtccctattaagtggccacagagcagagatgaggtgtggaaagcaaatattccacacacacaccttgcacatgagaagtctgaccagaactggatgattgtaaaaggtgaaaagatagtgtttcctggaggagggacacattttcacaaaggagctgacaagtacattgcatcaattgcaaatatgctcaatttttcaaacaacaatcttaataatgaaggaagactgcggacggttcttgatgttggctgtggtgttgcgagttttggagcatatcttctttcatctgatatcattgcaatgtccttggcacccaatgatgtgcatcaaaatcaaattcagtttgctctagaaagaggaattcctgcatatcttggtgtcttgggaactaagagactcccttatcctagcagatcatttgaacttgcacactgttctcgctgccggattgattggcttcagagggatggaatactactccttgagctagatcggttgcttaggccaggaggttactttgcatactcatctccagaagcatatgctcaggatgaagaggatcaaaggatatggagagagatgagcgcccttgtgggacgtatgtgttggagaattgctgcaaagaggaaccaaactgtcatctggcaaaaacctctaacaaatgaatgctatatggagagagaacccggcactcgccctcctctttgccagtctgatgatgacccagatgcaatttggggagtgaatatggaagcttgcataacaccttactctgaccacgacaacagagccaagggtagtggattggctccatggcctgcaagattgaccactcctcctcctagattagcagactttggctattcaaacgaaatgtttgaaaaggatacggaactatggcaaggaagagttgagaattactggaatctgttgggtccaaaaatctcgtcgaacacagtgaggaatgtgctggatatgaaagccaatatgggttcatttgcagctgctcttagaggcaaagatgtttgggtgatgaatgttgtacctcgtgatggacctaacacactaaagcttatatatgacagaggcctcatagggtctatccatgactggtattaa

SEQ ID NO: 115974 - DNA, 3348 bp, Glycine max
  Peptide Sequence Number=SeqID_232752
atggatgcatggggagggaaactttcactgaacatggcattcattactttgaaaaagggcactcagttagtaaagtatagtcgaaaagggaagccaaaactctgtacattcaggatctcatcggatgaaacgaaactgatttggatatctcatggaagggaaaagaatctaaaattgtcttctgtttcacgcatcatcccaggacagagaacagctgtctttagaagatacttgcgccctgaaaaggattatctgtcattttcacttatttataaaaagggggaacggtcacttgatctgatttgcaagaaccaagctgaggtagaggtatggttttcaagccttaaggcattaatttcccctggagagcgtattaggcgtggaacaagtgatttatccaatgatagtgttgacttaattccaaatgatcgtccttatgctggaacactagagtttgcatcaagcattgcccgtggcaggttttcttttgaatcagtgtctcatgaatctacatcatcttggtctagatcagaaacaaatatgccagtaaggacaagttgtggagatggttcgcgtgttagtgtatcaagtgttagtcactcaagtagcgtaggatcaggactagatgacatagaatctctaggtgatgtttatatatggggagaggtttgggcagatggcaattcatttgatggattggggagtcaacttcaagccttttgtaagacagatgtgctgactcctaaaccgttggagtctgatgttgttcttgatgttcatcagattggtcctggtgatcgtcacattgctctagttacaaggcaaggagaggtttttacttggggagaggattctggtggaagacttggtcatggatttgaaaaagatttcggtcgacctcatcttgtggaatccctggcaattaccaatgtgacttttgttgcgtgtggcgagtatcattcttgtgctgtgtccacatctggtgacctattcacctggggtgatggtacacatggtgcaggacttcttggtcatggcactgatgttagctactggataccaaaaagggttagtggccctttagagggacttcaggttgtagctgtagcatgtggaacatggcattcagcattagcaacctccaatggtaagttgtttacctttggtgatggaagatttggtgtattgggccatggaaaccgagcgagtgtggcatatccaaaggaggtacaattattgagtggatacaaggctattaaggttgcatgtggagtgtggcactcagcagccattatagatgttatggatctttctggttcaaaggcttcagccaagaggctcttcacgtggggtgatggtgaccaatatcgtttgggtcatgctaacaaggaaacttaccttgaaccaacttgtgtagctgcagttgctgaatataattttcaccaggttgcatgtgggtacactatgactgttgcactcactgcatctggtcatgtttttagcatgggaggcacaacatatggtcaactaggaaatccaaattctgatggaaaagtgccgattctagtgcgagataagttagtaggagagtttgtggaggaaatatcatgtggtgccaatcatgttgctgtgttgacttcaagaagtgagctatatacttgggggagaggtgccaatggaagactaggacatggagacacagatgataagaaatctccaacattggtggaagccttgaaagacaggcatgttaagaacatctcatgtggctcgacctttacatcttgcatatgcttacataaatgggtttctggagttgaccaatctgtttgctctgattgtcgacaaccatttggtttcacccgaaaaaggcacaattgctatcattgtgggttggtatattgccatccttgtagttcaaaaaaggcatcaaaagcagcactggctccaacacctagcaaaccacatcgtgtgtgtgatgcttgttatgctaagctaaaaggttctgatagtgcttccgattttaatagggaaattagtcgtccttctagttccgtatatggaagggaaagttttcaccggggagaggtaaggtcttcaagagttctcttgcctcctaccacagaaccggtaaaatacctagagattaggactaataagcctggaaatatgcatgacttttcttccatagtccgagctgctcaagttcctaccagtttacaattgaaagatgttgcatttccaatttcgttgagttctgcgcagaatgtttacaaacctgttatacagccaactccaccaacaccggctactccaatacctatgtcaccatatgctagaagaccacccagtccaccgcgttctacctcccctggattttcaagaagccttattgataatttaaggaagaaaaatgatcatttgaatcaacaagtctcaaaatggcaaaacaataatcaaaatttgaagcagaagagtgacatgcaagacatgaagattcgggagcttcagaaaaatattgaagaagccgtgtcacgagttggagaggaatcttctaagcttagaaaagcaaaggaattaattaagtccttgacagataagccttacccttacatatgcaaagaggctgtttccggatttgaacccatgaccaacaagtcaccaagacacaactttaccgctgcaccagggctcgccctctatcctcagatgacaataaagaaaaaaaaggaagtgactgagaagttgccacttgagattccggacaacgagaccttgagaaccatgcatgctcaagctgaagaatttcttcatgaagaaaaagattttgaatcttcttcctccccacagagccttgagtctgagcaacaaagtgcacctgatgtacctgcctcagaaagcgactcttcaaaactccaagagcaaagaatggaaggaaatgatgatgcttttggggttgttccatctatagatggagaaaatattcttgaagaaagcagcaactcatctgtatctggtccagtagtgacttcgccaagctcaggaaatggttcaaaattacgtgacactggtatacctgtgacagaaggagaaaaatcagtcattgaacaatttgagcatggtgtttatgtcacactcgtagtactacctcgtggttacaaagttttcaaacgaattagattcagtaaacggagattcaacgagaagcaagcagaagaatggtggaaccaaaacaaagataaggtgcatagtaaatacaatttaccaatcacaaagaatgcaactactggatcatctatcatacctccacaagctgaagaaaaatgtgaggcattaccttcttcctaa

SEQ ID NO: 115975 - DNA, 1035 bp, Glycine max
  Peptide Sequence Number=SeqID_232753
cagatcgaccgcgatgacgatatcggcacccatggcgcgacaaagcgacaccggcacgggattgaccaccgcgccatccaccagccaatagccgtcggcccacaccggtgccaacaggccaggcatgctgcaggaggcgcgtatcgcctgatgaatatcaccttcggtcagccacagctcacgcccggtgctgagattggtcgtcacggcgccgaacttcagcgcacattcggcgatatcattgatcttcaacaactgtccgacggcgttaaacacccgctcgccgcgcaacaggccgccacggtgccaggaaaaatccatcaggcgaatcacgtcccaatagctgaacgatcgcacccactgctccatcgccggcaaacggtggctggcgaacgccgcccccaccaacgcgccgacggagcaaccggccacgatatcaacctcaatccccagtttctttatcgcattaatcacgccgatgtgcgcccagcctttggccgagcccgcccccagcgccagtccgatcttgatttgccgcatagcgccatcctcgcggtgaaaggagttattttgcccgaatcatgcccatgcggcagcggacaggcgtataacgcgtgctgcgccccttttatcagcggcaatcagccggcgcccacgcccggtcagctgatgcgttcacgcttcaccgcctacgtgagtcataacgtcgactatctgatcgccacctggcaccccggctgcggcgccgaagcgtggcgcaatgcaatcgtcgacagctttaaaaataccgaatggttaggcctgacgatcgtggaagagaaagccggtcatgagccggaagaaggcttcgtcgaattcatcgcccgctttatcgatggcgaaagcggcgaaccgcaggcgatgcatgagcgctcgcgcttccttcgtcgcgatcaacgttggtattatatcgacggcaccaaaccccagcccggcagaaatgcgatgtgtccctgtggctcagggaaaaaatacaagaagtgctgcgggcgctag

SEQ ID NO: 115976 - DNA, 657 bp, Glycine max
  Peptide Sequence Number=SeqID_232754
atgtctcacaagaggctaggaaaaaagcttcaacctgccaagaaggcatggaagagcttctccaacacagtccaacacaaactccacaaactcaacattcccaattccatgaaaaccacccttcaacgcctccttcaatccttttactcccttggcactgtcatacactctagacttcatcgttcattcaccaccataaggccacgtggtggtactgccacttctaattactaccatgttcaatacaagcactgtgcagccatacacatagatgacctatttgacaacaagactaataattctgcagtgtccgtgcatgccaccaacaagacaagtgctcctcatgcaacacaagtgcaaggggaaacaaccaaaggcaaagagatcaaagggaaagagaaagaggagcctggtatttacaagggtaataatttggttggtcagtgtcgcaaccagagtcgcagtggcggcggcgagggtagtagtagtggcttgaacactatagaggatgcatggaaggttgtggttgccaagtctccacaactacatgtggatcaaaaggcagaagaattcataagcaagtttcgtcaagatatgaggcttcagaaagagaggtcaatgcttgaattccaggagatgctagcacgcagtacctga

SEQ ID NO: 115977 - DNA, 285 bp, Glycine max
  Peptide Sequence Number=SeqID_232755
atgcctatatgcgttagaccaatgaaatttgagagaatgaaatcagtgacggaatttgcgcgtcgacggcctaccgcatccgcacggaggcagcgagtacctgtgattgtggcgcacgatgagtcagtgctccctgcgccagatgtagaggctgacgtatttccggatgacccgatggcactgactgatgtagaggacactggggcagacattcctacagactcaggcacccaggctactgaggatgagcctgagggattttcaggtggtccgagcgacccatcc

SEQ ID NO: 115978 - DNA, 252 bp, Glycine max
  Peptide Sequence Number=SeqID_232756
atgaacacaaaggaagggattcctttgtggttcattgcttgtaaaggattttacaaggatagtggaaatctcaagcgggttgcttggggactagatgtaggcactggttgtggttgtaggagagcatcattcatgaaagggaaaatttggttcaaatatatttgccccaaatttgggggagtttattgggtgaaagcttccaacgaaaaagaaaagctaagtgcggaaaggcaagtaatagagctagaataa

SEQ ID NO: 115979 - DNA, 315 bp, Glycine max
  Peptide Sequence Number=SeqID_232757
atgtctttgacgatatttttcataagaagaaggatcttcgaagaaggtgataagaatataaggtatttccatgggacaaccatcattggcggacgtaggaacaaggtggagatgcttcaggatatgctaagaattggtgcccctattgaaaatggagagatctttgaagtcatttgttggatggggggctttaagcccttgaggctagatggatttgaagctatattttatcaaacaccaagtaatatggttaagccttccctttgtaagttgattcatgattttgaggatcatcctgggaggattcgctactga

SEQ ID NO: 115980 - DNA, 537 bp, Glycine max
  Peptide Sequence Number=SeqID_232758
atggtgctaaggttccgttgttgctccaatacggttctattgtggctaggtggcagcagatgcgttgcggaatttcatgtgattgaaattcacactgcaattgcggactattgcggttgcggacaacactcaacagcaatatttcggctgcaatttagaaccatggtccagtcacatatactttgtcaggtctttttctcctttttcctctgctgcatagtagtcactgaagacatagaagaacaaagaattcaagacaattctgcaaggtcttcaagtgaagtaaactcaggatttttctactcaagtgcggaacagagagaagctatggttgcagctgaaagacggcaggttgatgaaaaagtcacaagaatcattgaactgaagaataaggtttgttccggtaatgatagcaattttgttgtcatcaaccaaaaaggaattgatcccccatctctggacctgcttgcaagggaaggagatataattgtaggtttaggaatgggagaatcttgttttggaagagtagaaatgtaa

SEQ ID NO: 115981 - DNA, 378 bp, Glycine max
  Peptide Sequence Number=SeqID_232759
atgacgcacgagagtggaaaaacgatgaaaggtaagtactaccttagagagttcatggagagcgttttctcggagatcggggttgctgagtttgagaatgaggtgttccacaaacaccatcccgttacgatccttgccggtggcagaaggagctccaaacaacatgtcgcttgtcgggtctttttctcctttgttggtggctattttccctctccgaccaccactaacgagaaatccaagagtctaagaattgttgcgcaaagagggttatctgaaattgaaaagggaagcacagaacactttgaggaggcaatggatgggaccgaggaatgttggccattggtgaggcatttgagaaagggaagtcaaggagtgtga

SEQ ID NO: 115982 - DNA, 785 bp, Glycine max
  misc_feature (767)..(767): n is a, c, g, or t
  Peptide Sequence Number=SeqID_232760
tacatgtcctcgccataagaggactgcatgtcttcaccttcgtagggctacacgccctcaccttcaaaggaccacacgtcctcaccttcagagggctacacgccctcgccatcagaggactgcatgtcctcaccttcagagggctacacgccctcgccatcagaggactgcatgtcctcaccttcgtagagctacacgccctcacctttagaggaccacacgtcctcaccttcagagggctacacgccctcgccatcagaggactgcatgtcctcaccttcagagggctacacgccctcgccattagaggactgcatgtcctcaccttcagaaggcaacacgccctcgccatcagaggactgcataccctcaccttcagaggactacatgtcctcaccctcgtagggctacacgccctcacctttagaggactacacatcctcgccttcagaggactgcacgtcctcaccttgagaggactacacgtcctcgccttgagaggactacatgtcctcaccatcagagggctgcacgccctcacctccagaggactacacttcctcgccttgagagagctacccgccctcgccttggggctacacgccctcgcctttagaggaccacacatcctcaccttcagagggctacacgccctcgccatcagaggacagcatgtcctcaccttcttagggctacacgccctcgccatcagagaactgcatgtcctcacctttgagagggctgcacaccctcaccttgagaggacntacacgtcctcgccttga

SEQ ID NO: 115983 - DNA, 372 bp, Glycine max
  Peptide Sequence Number=SeqID_232761
ggagtcatatttgacttcatgcataggttcccacaaatgctaaagaacaacatgttcaatggtgctacccatgaagatcgtatgcagcacctgaggaagttcatcaagttgaccaacatgatgcatcctctaacattgaagattaagacactcatgaaagctcaagctcaagtccccatcactacaccttcattcccaacctgtgataaatgtgggattgaggaagtgaatgttgtgagtatcaagagtggacaacctatgacaaagctaaagaagaagaagaaagctactccaccacaagaaaaagaggctcttactgaagagagccaaaaggcaaaggaaggtgagaaggaggtactagcacctcctcag

SEQ ID NO: 115984 - DNA, 444 bp, Glycine max
  Peptide Sequence Number=SeqID_232762
atgggagcacccgatcccttcactgatggcctgccgctgccgctgccgtgggcgtggcaggaagcgctggccgacgcgcgcattgaacggcagtcgatcggtgtttcgcgtgcggacgttgcccgcgtgcatcgtccagggcaggccgatgccttcctgaagtcggaagtgatcgacgccttcagtgcaggggctgcccgcaccgacggtgatggccactgccgaagaatcgggtcggcgctggctgctgatgagtgcgctgcctggccacgacctggcctcgtcgccggcgctcgcgccccagcacctggtggagctgctggccgatgcgctgcggggcctgcatgccctgccggtggcgagctgtccgttcgaccagcggctggcctcgcgcctgcaggctgcacaggcacgggtcgaggcgggcctggtcgacgccgatga

SEQ ID NO: 115985 - DNA, 204 bp, Glycine max
  Peptide Sequence Number=SeqID_232763
atggaggagaagggatggaaaaggaaacaaaaactaatggaagagaagaaggaattccctaagggagagttctcagactttaggtgtgcgttagagtgctctgagactcggtgtgtcctttctccttggcttgaccctcattttagagttgctagaatggacttgggcctgcgtactcgcgctaagcccgtgttgctcgcttag

SEQ ID NO: 115986 - DNA, 240 bp, Glycine max
  Peptide Sequence Number=SeqID_232764
atgatgatcacaatccgttctagcggtgttgtccatgttcttcaactatcaaaagccatcaagcttcttaaagatatctgcacaaaaatgtgcactacggccgtggtcaaaagtgatgctaaagcattgagccattatggactgactatggccctcttgattgagcatgaccctcatgaattgaccacgaccatggtgacactaacattgccattgtcagattttgacattgttctatag

SEQ ID NO: 115987 - DNA, 342 bp, Glycine max
  Peptide Sequence Number=SeqID_232765
atggagtactcactcccttattaccattctcaggatacgatgttgagcacgtcgccaaatcccttattcttcattgacaccatcgagacacagtgggaacacaatgatacactctatgttaaccatttctatgggttcctctgttttcgttgtgcatcgataaacatactagaatatagacaattgttgcctaagtctcagaagccacccggggtagacttggtggatttcatgttagaggacacgggagaggagttggaagaggacacatatttcgagaaggattcgtcaatggatgagaaggctcccatcacggagttggagtttatgccaaaagtttaa

SEQ ID NO: 115988 - DNA, 575 bp, Glycine max
  Peptide Sequence Number=SeqID_232766
atggtgtgcaccatggaacaatttctggttatgaatgtccttggaaagaagatcaaatatagaatgcttgataataaactacaacttgaatgggccagggtggggtctgttcgtcttgttgatatgcctaatgatcacaatattgttcagttcactgctatggaggattaccagcatgctcttttccaagggccatggataattgctgacaattactttgtggttcagcgaaggagaccattcttctctttggatacgaaagtgattcagaagattgcaatgtggactcatattcataggcttccaattgagttgtacaaggataagttctcgtggatgtatggtcagaagcaaacttcttgcactaagagtttcatagaaggaattgaaaatacaatggcggctacaggtgcagttgttgaagcaacaacaatggaggttgaaggtgggaagacgaaggtgagtgatgttgacattagccctaatggtgttacgaagggtgaatctgtggagagcaaaaatcctaaaaaagggggattgtatggactgtggatgattgttaggagaaataacag

SEQ ID NO: 115989 - DNA, 258 bp, Glycine max
  Peptide Sequence Number=SeqID_232767
atgcaagcaaagcaaggaaatcagtccctcgcccgagaggagctacctttagagttgcataataggtcttgcttccttaaatggagtttgctctcactatgctttcgtgattccggatggctgctagaatcccttgctattgctattgaatccggtgttgatgctcgaaatcgggttagtggcacttcttttttcacgcttgaactacggggcagactagcggaatggaagttacatccatacggggcctgtacgtaa

SEQ ID NO: 115990 - DNA, 444 bp, Glycine max
  Peptide Sequence Number=SeqID_232768
atgattaaaattgtagatgttagaggatactgggatgaaaaaaatgcaaacccaaacactcggcgtcatctcctcacggcttacggctcacggctcacggctcacggcttcattcaacagccacagcttctgtccacttgttgccaacctttagtgaacggaagaggtgctaagaaacaaaggccaatgacagatagtgccttagcatatctcaccacagtcaaggatgcatttaaagatgatagagaaaaatatgataaatttctggaactcgtgaaaaatttcactgctgaaagattcaaccttgttagaggcatagaagaagtgaaggagctgcttaaagggtatagagatctaatcttgggatttaatgttttcttgccaaagggatatgaaatcaaacttccattggaggatgaacaacctccagaaaagaagcttgat

SEQ ID NO: 115991 - DNA, 128 bp, Glycine max
  Peptide Sequence Number=SeqID_232769
tttctcatgagggggaatacttgtacttgagtgcatgtcacttggtttggaactcccttaagactcaggctgatcaccatggggacttacctgtgaacgatagggtgaccttgacacttactgcctag

SEQ ID NO: 115992 - DNA, 526 bp, Glycine max
  Peptide Sequence Number=SeqID_232770
atgggcttagatcccgttactcacaaaccaataaaacccaatacgtttgaacgctatggtggtggccatggccagttcaagaacaccatcaataccaaccacgtggctcaatgggagagtgctcgaatggaagccgaagcaagaggatccgtgttgcaagttggatctcactcctcacatcaacctcagctagtcttaagcaaaatcccaactcaaccttgtccttcatcatcagattcagtatcaaccaaacacaacacagtgtataacatgtatgccctcgtgcttgccacaaatcatgaccctttatggccagtatccccgttgagcatccccggttggaaggttcctgcagtctctaccaatgttggacaattcaccaacacgggaagctcactctcttatgagagtgatgttaacgtcaccgaaactaatagtcaaattcaaaagataccagaaaattacttgtcaaacttacaagatgaagatattatggtggctgtggaagcctttagaacaataagat

SEQ ID NO: 115993 - DNA, 348 bp, Glycine max
  Peptide Sequence Number=SeqID_232771
atgtataggggattcctcttgctccttgtcgacttacacactttattccttcttgcattggtgcataccaacattatcagctgtgggttggtacttggtaatgtctttcatgttgagcttctgggatggcatgtggttgttgatgccccgtggatgtgcattgatcattatatgtaccagtttaaaactttctaccatccattcatcatgctcccagccaaagaccttctttccatgcctcatcaccgtgctgcaccagaccccaagcggatgatcaacctgattattctccaagatcttcagaccatattagatctaaggaaagtgatccttggctctgaggcataa

SEQ ID NO: 115994 - DNA, 105 bp, Glycine max
  Peptide Sequence Number=SeqID_232772
atggttgaacctctcgggggatcatcctatggcatccaagatcgtcctcatgggcctaaccttatccttaccctctcagaggcttccatttgtcgcgctcaataa

SEQ ID NO: 115995 - DNA, 231 bp, Glycine max
  Peptide Sequence Number=SeqID_232773
atggtgtctgaaataggaaaaggctatgtcggggaagaaggttcttcgttgatgttgttggagggagaaattggggttgaagtaggagggtcggagctgggaggggacaaacatggaggagccggaactgtgtatagagatgttcagggaggtgaaggtgtcggtgccaatggtggcgatcatagcaggctccacctgctggaggagccactcaatggttttgtcgtctga

SEQ ID NO: 115996 - DNA, 501 bp, Glycine max
  Peptide Sequence Number=SeqID_232774
atggagtggaaaacacaagggttgagggagaagagaagacagaggggttggagaagaaatggtgtaggtatgaggggtgttttttttatgattgggggatgtttaagggaaggagtaggggctggggaagaattcgatcgaaatacttttatatccgatgagcttacaatgctaactgcatggaaaaatatggatgatagaagcaaggtttcttttatcaacccgaccgagcatatggagcaggggctaacaatattggtttgggtaatgataatgatgaaaatatgggtggtgatgacattgatatgtagctgcaacctaactatctcaattgctaccaattatttcatgactggtgagcacccaggcccacttgggccctctggaatattcctccagaaggcggttgcttctggaggaagcaaccctgctcgcctgggcgagctgagctcgcctgggcgagctgggcggcaaccacctcccctattttgctataaatag

SEQ ID NO: 115997 - DNA, 513 bp, Glycine max
  Peptide Sequence Number=SeqID_232775
atggttcttgctgaatttggagggaccaaggcacaacttgaggtagccaaagccagatatacaacagttgtttcagatttaatagttatgaaagaggagctggaaccattgcacaaagaatatgcttccttagtgactgatagagatgtagctattaagaaaggtgaagaggttgttactgcatcaaaggaagtaaagaagtctgttgaagatttaattgttgaactaattgctacaaaagagtcattggagactacacatgctgcgcatttggaagcagaggaacaaagaataggagcagtcatggcaagagatcaagattctcttaattgggaaaaggaacttaaacaggcagaagaagagctccagagactcaaccagcaaatttcatttgcaaaggaactcaaatctaaattggaaatagcctctactttgctgattgatttaaaagctgaattaactgcttatatggaatcaaagttaaagcaacaaggaggcccaaaagaaccatag

SEQ ID NO: 115998 - DNA, 345 bp, Glycine max
  Peptide Sequence Number=SeqID_232776
atgttatctgttgaagccccattatctcaagcatcatccactccaaatacttctcagaatgttagaaagaaaaatgatccagcttggggacattgtaaacaaattaatgagggtgctacaaaagtgacaatgatgtgtatttattgtgataaacgggttaagggaggtattattaataggtttaaggctcacttggttggaagcccaaatgactgtttcatgcctagaaaaactcctggagctcaacctagcttgaagagtgtcttgcaaaataagcaaattgtagaaaattatgacaaagccattgaagagtgtcttgcaaaagatgttgttcaaacattctaa

SEQ ID NO: 115999 - DNA, 285 bp, Glycine max
  Peptide Sequence Number=SeqID_232777
atggttagcacttggtctggccttaaacacgagacccctcttgaagactcttatcctcattcgacaattatgacagacacaaatactctacaacaactccaaaattgctttgcggagatggagcgacgccctgatgaagagctgaaaaagctaaaggttaaccatgatcagataaaggctcgtgtcaaatgtccccaaggcaacgagcactccgctcacactttgcctaagtgcaccaaagggaatcacacccctgacgcacagtcaacactccagatgacttaa

SEQ ID NO: 116000 - DNA, 222 bp, Glycine max
  Peptide Sequence Number=SeqID_232778
atgaagtgccaaaagtggcagttgagcttagctcatcagtgggctaagcgcagcttcaggcatcaatatcaaggtcgcgctaagcgcaagatcagtgtgctaaggcaacaggtgtcttcagccaggcgcagcgcaagactggcgctaagcccaaacccacttactcacgctaagcacgagggtggcgctaagcacaacatcacgaattcagagcctatttaa

SEQ ID NO: 116001 - DNA, 1020 bp, Glycine max
  Peptide Sequence Number=SeqID_232779
atggcgaccggcaaggaaaagggttccgtcaccgtcgacgacgtggcggccgaggcgggcgtgtccatcaagaccgtctcgcgcgtgttgaacaacgaacccaacaccagcgagaagacccgcgccaaggtcatggcggcgatcgcgctgctgaagtaccagcccaatccctcggcccggcgcctggccagcaagcgctcggacctgatcatgctggtctacgacaatcccagcgacaactacctgatcaacgtccagcaaggcgcgctcgatgcctgcaagcgttatttctacagcctgctgctgcatccctgcgactaccgcgcgcccgacctggccgcgcagatcgaacagtccgcgcgccagcacgcctgcgccggcctggtgctgacgccgccgctgtctgacgtgcgcgccttgatcgacgcgctcgaccagggcgacgtgcccttcgtgcggctggcgcccagttcgccaagcgccagggggctggaggtcagcaccgatgaccgctcggcggcgcgcgacatgacgcggtatctgctggacctgggccaccgccgcatcggcttcgtggccgggcaccccgaccacggcgccgtcggcggccgcctgcaggggtatcgcgacgcgctggccgagcagggtgtggcgtacgacgcgggcctggtcgagcagggcctgcattccttcgactccggcgtgggctgcggcgagcgcctgctcgatcgcgccgaccgtcccagcgcgatcttcgccgccaacgacgacatggcggccggcgtgctgtatgcggcgcatgcgcgcggcatcaaggtgccgggggagctgtcggtggcgggctacgacgacacgccattgtcgcgccagacctggcccaagctgaccaccctgcgccagccgatccgcgacatggcctacgcggcggtggagcaactggcttcgcgcgagccgcaggcgcgggtgcggacgctgggatacgagatcgtggtgcgcgactcgacccgggcgcctgcctga

SEQ ID NO: 116002 - DNA, 300 bp, Glycine max
  Peptide Sequence Number=SeqID_232780
atgagccatgggcgcctatatcaacgaaggataaagaacgcgtttgacaagaaggtacgcccgcacaagttcaacgagggggaccttgtgctgaagaagatgtcccacgctgttaaggataatcgaggcaagggcagaatcatcttaagccatggtcagaagtcgagacgagttgacggcagaaatcaactagggtacttagggacggatgcaaatggaggatatggtcacgaccgaccgatcgttgtcccttcctggcgctgggcaagcagagaacgtcgctgcaagacagcccagtaa

SEQ ID NO: 116003 - DNA, 271 bp, Glycine max
  Peptide Sequence Number=SeqID_232781
cactcaggagcgcatgtcgctcgagcaaacaaaccaatggcttgcacctgaaaatcctgatgagtcattagagacatctaacaacagctttcaaaattgccccattgctcaatggaatgccccagggctcctccatgatatgcacatgttgcgttcgagtcgtattctaagaaaaatggaggttgaggaaccttggttggggttatggctaccattgaattatcaagtggtcttcgtcattggaagtgcggtagacaggctttgtggttga

SEQ ID NO: 116004 - DNA, 402 bp, Glycine max
  Peptide Sequence Number=SeqID_232782
atgtctatttcaccgagtctctctccgagacagtgcccagatcgttacgcctttcgtgcgggtcggaacttacccgacaaggaatttcgctaccttaggaccgttatagttacggccgccgttcaccggggcttcggtcgtcggctcccctgtcatcaggtcaccaacttccttgaccttccggcactgggcaggcgtcagcccccatacatggtcttacgactttgcggagacctgtgtttttggtacccatttgttgaaggtcgttcgagcttttcctgggagtatggcatggattacttcagcgctgtagcgcctggtactcgaactttggctcgaggcattttctctaccccttattaccctgaaaaagcagggcaccttgcgtccttgaaccgataa

SEQ ID NO: 116005 - DNA, 586 bp, Glycine max
  Peptide Sequence Number=SeqID_232783
ggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaagtcggccttag

SEQ ID NO: 116006 - DNA, 210 bp, Glycine max
  Peptide Sequence Number=SeqID_232784
atgactcatgttggttcctacgttgtggttctttcttgttggggctttgcaaaagggcaaaaagggccttccgaatgggccaagagtgtgtcttccaaggaaggaaaacgcgtggagtcgctgtcataccctaatttcgtccggggacctttgcttggtggcatgcaacttgtgtttggtcattttgaggtgcttggcgcccatcattag

SEQ ID NO: 116007 - DNA, 204 bp, Glycine max
  Peptide Sequence Number=SeqID_232785
atgagtggtggtatcgtagcaacgagacgggtcgttacaaggtgcgccacaagtgcaagtgcagccatgatggtaaagatgacggtgaagtgcgtggtggtcatgggaagtttcttccattttcgtatctattatcttttcatcctcggcgacagtgaagtgcatggtcgaggtgaggtgcaaagtagaaatgcaacgtcgtga

SEQ ID NO: 116008 - DNA, 159 bp, Glycine max
  Peptide Sequence Number=SeqID_232786
atgtgcgacataaggacaacatttatgactcccattggcttatcaccctttcagctagtatatgggaaggcatgccacctactagtagagttggagcataaaattaagactcttcccaggaaagctgaagtcaaagtggtcaggaccgttcattattaa

SEQ ID NO: 116009 - DNA, 825 bp, Glycine max
  Peptide Sequence Number=SeqID_232787
atgtacaacggaatagggttacagaccccaagaggttcggaaagcccaacaaagagatccttgagcatgaccgcaagcgtcagattcaactcaagctcaccatccttgaagacaagctcatcgatcagggctacaccgatgcggagattgctgaaaagctcgtggaggctcgccaaaatttggaagccgccactgcctccgaggaaacagatggacctgcgtctgtgtctgcatcagataagaaagggtggtttgattgggaaagaagcatggtggaagagttggaaggtaggtgagccgtgtcacaacaaagagatcaagttgataagtggatatggaagggaagtaacccagggttttttctcagtaagttcagcatatgagcagttgtatgatatctttaaaggaccacaagttcaaggcaacttatctcaggtttggagaatgaagatccctctgaaggttaatttttttgtttggagagcttttctgagaagattacctatgaggcaaaaccccttgttgaggaatattcagttgggtgcatcaaatgttttctgtcctttatgtaattctgaatctgaatctgtgaaccatattctgtttcgtgcacaaaggttctacaaatatggcagtagtgaggccagaatccaatgggtaggcgtgctgacattcatggggttagggaaaatatcaggcatggctcggtcatcaaagttggaaaagccacagggtattgcttttaattattggttagatgctttttgtgagattggtgtatatgctaaagatacgtttctccttccttggggtagtgggttatga

SEQ ID NO: 116010 - DNA, 1389 bp, Glycine max
  Peptide Sequence Number=SeqID_232788
atggaagattcagaagaggatgaacttttgaatcttagcctttcagttgctgctgatagggaaaggaaaaagaagggaaagacaattagggaacataatgtttccatgagtagtaccactactactactaggaactcctatgaaaggaagatctttaggcttctccaaatgagggagcagatgctaagacaagaccatcataggaggaaaggtgttgtggaagatggaaatggcctccctctgatccatttgttactctcaaccgcaactgcagttgatgacaacaacatggactcgtccttagagaatctggctgatttataccaaacagtttccataactggtgactcagttcaacgtgttgtggcctattttgttgatggtttatctgcaaggcttctcacaagaaaatccccattctatgatatgctcatggaggaaccaacaactgaagaagagttcctttcatttacggatctctacagggtttcaccttacttccaatttgctcacttcacagcaaaccaagctattttggaggcctttgagaaagaggaagagaggaacaaccgtgccttgcatgtcattgactttgatgtctcctatggcttccaatggccctctctcattcagtctctttcagagaaggcaacaagtggaaaccgcatatccctcaggataaccggttttgggaagaatctgaaggagcttcaagaaactgagtctaggttggttaatttctcaaagggttttggaagccttgtgtttgaattccaagggctgcttagaggctcaagggtcatcaacctaaggaagaaaaagaacgaaaccgtggctgtcaacttggtttcttatttgaacactttgagttgtttcatgaagatctctgacacattgggatttgttcattcccttaacccttccattgttgtggtggtggagcaagaaggtagcaggagtcctaggagcttcttgtcgaggttcacggactccttgcactactttgcagcgatgtttgattcacttgatgattgtcttccacttgaaagtgctgagaggttgagaattgagaagaagcttttggggaaagagatcaaaagcatgctcaacaatgatgtggatggtggtgtggattgcccaaagtatgagaggatggagacatggaaagctagaatggagaatcatgggtttgttgccacaaaaataagctcaaagtctatgatccaagcaaaactgttgctgaagatgaggacccattattgccctcttcagtttgaggaagaggggggtgggggtttcagggtttctgaaagagatgaaggaagggctatttctttagggtggcaaaataggtttctgcttactgtctcagcatggcaatcagtctga

SEQ ID NO: 116011 - DNA, 195 bp, Glycine max
  Peptide Sequence Number=SeqID_232789
atgggaccggcaaactttaaagcacttcaaagagcccatgattcaccttctataacaccaagacatggagtaaagttgcacgaaattgcaactgtgaatcaacccaaattatcacgaaagcaagctcccataccaagggggagaccaacgatcttgaagaatcctttactgcggttggtttatggcacctgctaa

SEQ ID NO: 116012 - DNA, 723 bp, Glycine max
  Peptide Sequence Number=SeqID_232790
atggcttgccactcattcctcttattagcgacgaccattctcgtcgttgtgtgctctgccgtgagcgattgctcgccatcagatacagcggcgctattggccttctggaaggcattgaacgagctctaccttggcctcttcaactcgtggacaggctccaactgctacctcaactggtacggcatcagctgcgacgccaccattggctacgtcaccgacatcaacctctacggggagtccgaagacccaatcttcgagaaagccaatcgctctggctacatgaccggaaaactctcaccggtgatctgcgacatcaacaccctcaccaccctcgtcgtcgctgattggaaagacattgccggggagatccacgcctgtgtcaccgcgcttccctccctccgcatcctggacctcatcggcaacaagctcttcggcgagatccctgtcaacgtcgacaaactctcacatttgacagtcctagacctcgctgacaacaccctcaacggcaaaattccaacgttcatcacccggttgggctcactgaaacacctcgacctcaacaataatcaactttgcagcgagattccggaagactttgggaatctagccatgctgagccgcatgttgctgaatcgaaaccagctaaccggtatgccgctgagagagagttacggagagtacgtgtgtctgagagagggagagagagctggtgtgcgcggctga

SEQ ID NO: 116013 - DNA, 302 bp, Glycine max
  Peptide Sequence Number=SeqID_232791
atgctgacatctccgagaacggtgcaggtgacgacgatagccactgctcgctatcgcgctttgagttctacggattgcaaatgagactttttcgtagtctcggctggaagacgctgcatctccggaaaggtctcggccgaaagacgctgacatcttcgggaagggtgcaagtgacgacgttagtcactgcttgctatcgtgacgctcatatctccgaaaagggtgcaagtgatgatattagtgtcgcaacctacccttcggcgggagggcgacgcgagactcgcgggatgcgtgttccatga

SEQ ID NO: 116014 - DNA, 501 bp, Glycine max
  Peptide Sequence Number=SeqID_232792
atggaggaaccatcaaagaagcacaaaggttcttcgagtagaagccaagggcactccgaggctcaggatattccaattccttcctccatttcctcctcctcattgttctcatcggaagaaaaatgtatacggtacacaaacctcttctcctctcgttctatcattgaccctaagttcatagatatggatttattttctgatgagagtttcgaatgcattcaagcatttcaaaactcaaatctcattccctttatgtctttgaaattgcctgtgtattctgaattggtaaaagctttttattctaaccttgaaattcaagaaagtgcattagacgatgattggaagtttgatttttctgtacatgatgcccgccggttggtttgcaccaaccaagcggatatgaccggaaggctgcttgccggttcattggctcttgaaagccgcatccttcactatcttattgtttgtattttacttccaagatcttcaaaccttgcacag

SEQ ID NO: 116015 - DNA, 598 bp, Glycine max
  Peptide Sequence Number=SeqID_232793
cgcgcagttgggcaccgtaacccagcttccgggttcatcccgcatcgccagttctgctttaccaaaaaatggcccacttggagctctcgattccatggcgcggctcaacagagcagccgcaccgtcctacctatgtaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 116016 - DNA, 870 bp, Glycine max
  Peptide Sequence Number=SeqID_232794
ggtaaaactaacctgtctcacgacggtctaaacccagctcacgttccctattggtgggtgaacaatcctacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccacgcgac

SEQ ID NO: 116017 - DNA, 513 bp, Glycine max
  Peptide Sequence Number=SeqID_232795
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 116018 - DNA, 812 bp, Glycine max
  Peptide Sequence Number=SeqID_232796
ggtgcccgtccccgcgggggtcacggcagagcatcgcccttaccagaaggaggggccggaatggctcgcgttcctgtggggccatcgtctcggcggcatcctcgccgatgacatgggactcggcaagactctgcagctgctcgcgctcatcgtccacgcccgcgagtcgggggagcggcggcccttcctggcggtcgtgccgacgtctgtcctggccacctggcggagcgaggccgagcgcttcgcgccgtcgctgcgggtcctgctccggggaagcacgcagggaccgtcgctcgcggacagcctcgacgacatcgacctcgtgatcacgacgtacgcggtcgcacggctggatgaggaggcgttcgcgtccgagcaatgggcggggctcatcctggacgaggcgcagttcgtgaagaacccggcgacgaagctgcaccgggccgtggcgtcgttccccgctgacgtcaccttcgcggtcacgggaaccccgatggagaacagcctcggcgagctgtgggcgctgttgaaactcacggctcccggcttgttcgcctcggcgcgcgcgttccgtcagcactacatccaacccatcgagcaggggaaggttcccgagaacgaggagggtggggagtatcggcagcgtcgcctggagcgcctgcgtcgccgcatccgcccgctgctgttgcgacgcaccaaggagctggtggcacccgagctgcccgccaagcaggagcagatcctcgaggtggagctcagctccgcccaccgtgcgctctacgagacggtgctgcagcgtggagcggcagaag

SEQ ID NO: 116019 - DNA, 210 bp, Glycine max
  Peptide Sequence Number=SeqID_232797
atggcttcctatggtggtgagcttcttcttgactcattttctccttgtagtggtgtctccaatcatctctcttccttctccattctacttgcattcatcttcaagaatcaaatgactccattgatgaagaagatccaaggcctacaagctccacataagagctacatcatgtggttctatcatttttcagtcataatcttcttgtgctga

SEQ ID NO: 116020 - DNA, 669 bp, Glycine max
  Peptide Sequence Number=SeqID_232798
atggatttgaatcggtggtgttcttccaccaccaacccctactgtctcctcttccaagcgctctctctcattccaatctggcactacctactcttcgtctccttcgtcttcctctccttcttctaccgttttctggagctccatttcctccaagacctcttctccctcttctccggctcctccgtcaccctaacctaccatcacggttcccaattctacgacgctgtggtttccaaatgcaggattctccacggcacctacctcgccacgccctggctctccagccctcacctccagaccgtctttctcaacttcttcggcagacctcccctcttcaaatacagaagacaactgtttactactcctgatggcggaaccgttgctttggactggctcttgagttctgacgtttcggctggtgctatccatatggaagatgttgtttctacagatgaatccactcctattgttgtagtaattcctggtctaactagtgactcttcatctgcctcctcactgtacaactttattggaatttggaaaaaccacatacttatccccctccctgtgagcaattacttgactgctagacatactattcaagatagattaggagtggatgcatttaggggtaaagttggggtagctcctgttgctaaaagatggtag

SEQ ID NO: 116021 - DNA, 846 bp, Glycine max
  Peptide Sequence Number=SeqID_232799
atggtgcccactgaaacagtttatggactctcacaagttggacaatactttgtccctgacggaactaggggctacttggcttcattcacagcattgtcctgttatccaccactcttacaagtttggtcagtgattttaactcctatatacgtatatcacatagaggacaggctgaacttcaaggaagccgtggttgatgcagacattgacttgttcaagaaaattcttggagtaacaatgtaccagtacatggaaaacgatccaaaaatgaaccaaatctttaacaagtcaatggccaacttgtgtgcaacagagatgagtagaatacttgaaatatacactggatttgagggaatatcaacattggttgacgtaggaggtggcaatggacaaaatctaaaaatgataatctccaaataccctttaattaaaggaattaattttgatcttccccaagtgattgaaaatgcacttccccttccagggattgagcatgttggaggggatatgttcgcaaaagttccacagggtgacaccataatactaaaggctgtatgccacaattggtcagacgaaaaatgcatagaatttctgaggaattgtcacaaagcattgtctccaaatgggaaggtgattgtggtggagttcatattgccagaagaacccgaaccaactgaagaatcccagcttgtttccactcttgacaacctcatgtttatcactgttggtggaagggaaagaactcagaaacaatatgagactttgtgcaagctctctggattttcaaattttcaagttgcttgtcgtgccttctctagtctgggagtgatggaattttacaaatag

SEQ ID NO: 116022 - DNA, 435 bp, Glycine max
  Peptide Sequence Number=SeqID_232800
atggatcaatattgcttaccagcagattcttcgaacgcttactggcttctcctccaagttctctctcttatccctctctggcactaccttctccttgcagccttcattctcttctccattctctacaacttcctcgagctctatttcctccaagacctcttctccggattctcaggctcccctgtgcttctctcctacaacacttcctctagcattctcaacgccgtcgtttccaagtgcaagattcttcacggcagatatttcgccacgccctggctctgcagccctcacctccagactcttttcttgaactacttcgggaggcctcctcctttgaaatacaccaagcaattatttagcactgctgatggcgaaaccattgccttggattggctatccacttctcatggtagtattgagtatttttcattatag

SEQ ID NO: 116023 - DNA, 228 bp, Glycine max
  Peptide Sequence Number=SeqID_232801
atatctgggagagacaaaactacctctaatggttctacagcaattgcccccacattaaattcttctcaaagaccaaggccatatcctgtgcctataaacaattcagaaaattttcagcaccctgctaggctatcaactcctgatcgattttcagattatccagtaaataattctcaaggtatacctatgcacgtcgctctccagatgggttgctgcttacaaacttaa

SEQ ID NO: 116024 - DNA, 231 bp, Glycine max
  Peptide Sequence Number=SeqID_232802
atggaaaaatccgacaagatgaatttcaaagagaagaaagaaaagaaaggatatatcacttgggaagataatgtcataaattattcaagtgattcagagaagaaaatcataagtttgggtatcatgatgaaagactatgaaaatggagaagatcaaagtcgatacattgatagcaatttctccaaacacatggcatgcatcaaagtttattcatatttctccccaagataa

SEQ ID NO: 116025 - DNA, 339 bp, Glycine max
  Peptide Sequence Number=SeqID_232803
atggaccctactctaaattctcacacaggcccagcaagtgcaatcaatgccaatgatagcaacatgcacaaaaaggatgatgcagcaacatttaacctgtctaagaggttgccttgcaagtggttcactggggctggacctcgtattgggagtgtccgtgactatgctggacacttgcagtcgagagcgttggagcaggtcaatttgtttccaaggcccacttctgcacgcttgagcagctatggcccaattccttcacccaggcccagtccaaaagtgaggatgccccccaggcttgcttacataggcttgcccagtccaagaaacccaattccagct

SEQ ID NO: 116026 - DNA, 534 bp, Glycine max
  Peptide Sequence Number=SeqID_232804
gattttgcccggaccgttgccgggagacggggtgcggatcatgcgcaccagcgatcataactgtgacctccctctgccgaagtgtcagctgatgtacaccatcctgacatggatgagtgtccatatgccacctaccaggcaccctttagacccagataagtctaacagggccctggggtttccagcgttgatcacggacgcaccgccgccacctcatcaggctgatcctgctgggtcatttgacacagagcggtatttacggcatttggttcaccagcaggcagccaaccacagggggcacatgcagacccatgagagcctctaccagctcagccttagtctgcagagccagagtttcgctccttttccgtgccctactccagatcagttcagggcagaggtcgcatggcccgaagattggcccgaggcccaggcaggggaggcgcccgcagaggctcccgacgatggagaggaggcccacatggatgaggagatgacggatatgctcgatttcttgggaggaagcggagccac

SEQ ID NO: 116027 - DNA, 855 bp, Glycine max
  Peptide Sequence Number=SeqID_232805
atgctcatcatcgttggattcctggtcgtcatcatcagcgtgatcgggggctatctcggtgcccacggccgcctgggtgccctctggcagccctacgagctggtcatcatcggcggcgccgcgctcggcgccttcctggtcggtaccccggccaagacggtcaagcagaccctgcaggccatggtcggcgtgttcaagggcccgcgctacaagcagcaggactacatcgatgtcctcagcctgctctatgaactgctcaacaaggcccgccgcgaaggcttcatggcgctggaagaccatgtcgagcggccggccgagagcgcgctgttcggcaactaccccaaggtgcaagccgaccaccacctgatcgacttcatcaccgactgcctgcgcctgatgatcggcagcaacatcgagccgcacgagctggagccgctgctggaactggagctggaaaagcaccacgccgaggccatggcgccgtcgcaggtgctgaccaaggtcgccgacggattgcccggtttcggcatcgtggcggcggtgctgggcatcgtcatcaccatgggctcgatcggtggcgacatcgtcgaggtcggtggccacgtcgccggtgcgctggtcggcaccttcctcggcatcctgctgggctatggcttcgtcggcccgatggcagccgcgatggaggcccgcgccgagcaggacagccgcatctacgaatcggtgaagaccgccctgctggcctgcatgcgcggctacaacccgaagatcgcgctggaattcgcccgcaagacgctgccgtcgaacgtgcgcccggccttctccgatttcgagcagcacctgaagacggtcaagtaa

SEQ ID NO: 116028 - DNA, 192 bp, Glycine max
  Peptide Sequence Number=SeqID_232806
atggcagagatttggggtggagtggttgcggaagggtcgcgcacgtggcggagggcatggatctcaagcggagtggtcatcgaaggttccaagaggaggcggcgacgcgacaaggaggaaatgggtggtgagtggtggtggtcgacggtccaccgatggaggcggtgggagagagaggaagaagaagggtaa

SEQ ID NO: 116029 - DNA, 177 bp, Glycine max
  Peptide Sequence Number=SeqID_232807
atgaattgcgttttcgttcatgcgtcctccacccacgagtttggagtcatgcgtagtgattgcttagtgcaattctccattctcaaccctttttcgaagccccatgaattgtgtttttgttcatgcgtcctccaccaaaaaaaaaaaggagtagagacgagagtcgtcatggactaa

SEQ ID NO: 116030 - DNA, 285 bp, Glycine max
  Peptide Sequence Number=SeqID_232808
atgtgcattgtaagcagcgtcatttctgcttatcctattcgagcttccactccaattgttacctctccactttccattcctcgcaatgttatcaacgctcatcaagccattgccaacccctttgtgccagaggttgtgaaagcagtggatgccttgcattcagagttccgggctgtggataatttggttgcgtgcaataccacccgtgtccttaaagctttccagaatgctcgagttggatctcatttgttagagatgtcttttacaccattgggcatatcttga

SEQ ID NO: 116031 - DNA, 114 bp, Glycine max
  Peptide Sequence Number=SeqID_232809
atggtgatgcggttgcgaggttggcggcatcaattgggtggcacctcaatgaaatatatattaagccatatcagttttatagagcaaggaaaacatatgcttttcatcatgtaa

SEQ ID NO: 116032 - DNA, 471 bp, Glycine max
  Peptide Sequence Number=SeqID_232810
atgtcggccgcgtgcaatggcgcggcggcaagcagggacaggcacaacagcatgcgatgcatgggcaggcttccagaaggtggacttccagcctgccccgccctttccgaatgcaccgtgactcacgcctcctttcgcgccgcgataggaaccatgcaccggaatcgccgttcggtcagagcgcgtcgatatcgcccaacgcgcggatcaaccgccgcgcgcgcttgtccggtttgtgctctggcggttggaacccatcgcgtgcggcgatgcgcagcgcacgctgttcggcacgacgggccttggaggcctcgctctcggcatacagctgctgcgccgccggtgcgggcccgcgctggtcgctcaggccgagcacccggatctcgaaatgctcctcgccgcgatccacctgcagctgctcacccacacgcaccgcgcgcgaggatttcggacgctggcccgcgacgctga

SEQ ID NO: 116033 - DNA, 988 bp, Glycine max
  Peptide Sequence Number=SeqID_232811
aaagccggtcgctccggctacatgaccggaaaactctcagaggcgatctgcggcatcgacaccctcaccaccctcgtcgtcgctgattggaaagacattgccggggagatccccacctgcgtcaccgcgcttccctccctccgcatcctcgacctcatagggaacaagctctccggcgagatcccggccgacgtggggaaactctcacgtctaaccgtcctgaacctggccgacaacgccctaagcggcaaaattccagcgtccatcacccagctgggctcactcaaacacctggacctcagcaataatcagctctgcggcgagattccggaagacttcgggaatctgggcatgctgagccgcatgttgctgagccggaaccagctaaccggtaaaataccagtttctgtctccaagatttaccggcttgcggacttagacttatccgcaaaccggttatccggttctgtcccgttcgaactcgggacaatgccggttctatccacactgaatttggatagtaactctttagagggcttaattccttcgagtttgttgagtaatgggggtatgggcattttgaaccttagtcgaaacgggtttgaaggctccatacccgatgtgttcgggtcacactcgtatttcatggctttggatttgtctttcaataatttaaagggtcgggtaccctcttcgttggcttcggctaagtttatcgggcatttggatcttagccataaccatttgtgtggatccattcctctcggagcacccttcgatcacctcgaagcgtcgtcgtttactagcaatgattgcttgcatctgcgtgcacgtgcacgacaagacaagggtttcaaggaaggaattcatgtttgtgtgggaggattggaatacccagatgggggagcaataatgcagctcaactaccacttggggggcacatggtgctgtacctcatcccttcccataagcattaactacgagccag

SEQ ID NO: 116034 - DNA, 375 bp, Glycine max
  Peptide Sequence Number=SeqID_232812
atgttggatggtggtatgcatggcatgctgtggtcagagctatttggattgccagaaatgagagtgcttttcggctattatggtggggttgtggagtttgtgactgtaggagaatggaggggtgatgaaggggggtcatggaaagtttccaagagagtcattgtattgttaaagtgtggagtttttcctagcattgcaatattcagattgataggggatttgattcaaactatttgtgggcaccaggttttgggtttgtttcaattgttgttgaaccgaaaaattgcatcaaacgcaaatagttggcagaaggattcgaaagtgaatcaagaatatgttattgtgtatggggttcaaggctggaaggttttttag

SEQ ID NO: 116035 - DNA, 765 bp, Glycine max
  Peptide Sequence Number=SeqID_232813
atggacatcactgccttcaaatccctcaacattccatttccaacctttccatcaaaattttctccttttcgtccattcagtttctttcacttcaaaccttttcgcactccttcctcacctcgcttcatctcccattgctctctcaatgggtcagcagagataacaagcaaggaaggtactttgcctcgtggcgttggagaggcagtgaatgaagcgtcaagttccaagattcttcaggttgtgctcgtgtcccctcaggacctagccgagttggtgaagagattggaacttgactatgggctatgtctccttccacttcctgtaaggatacatgaagtcggaaccaagggtattgttgttaagtgcatgctagatgagagtggagcttttgttgatagtttacaaaaatattttttctttgctaatgcgttaaacatattggatatgctgtcaatgctagaagagttttcgagagcttctctactggaagtttttccagtagagaagctctcaaaagctcttctacctttgtatccaaacagtgttaatactactgcccaagaccttacaggggatgaagaccatcctgtccatggggttatagggagagagtatgagagtaatgagattccaggaaacactgggtgcattgctagaacttgcgcagcatcagctgttggattacacttagttgggccattaggatttcaggtggatgatactaaactaaagcgtgctgggttggattactggccgtatccatga

SEQ ID NO: 116036 - DNA, 243 bp, Glycine max
  Peptide Sequence Number=SeqID_232814
atgccactgcattgcttacagcaggggcaacgaattgaagttattgaagacttgtgtgtctttgcacctctcacagggaaagtttattgtgaaaggggtaacacagctggaacttggaagcttaagcacaccttgactgagagttatttgtcttcttatccttatttcattgaacattggctgctgaaacttgtggtcctaactgagttggggcattctgacatcagactttattctatttaa

SEQ ID NO: 116037 - DNA, 723 bp, Glycine max
  Peptide Sequence Number=SeqID_232815
atggattcttcgcctacaaaagtgctgcttgattctggtgcgactttaccgatagaggaattcatgagtagttcacttaacaacactcatgatataaggcggaaaaaggagtggtccttcactggcatttttggccactctttttgtgacgagagatcatgtcattgtccaggagggatcaggttcgaatggactggcaaggatcttttggacttatccacaagtgaatatgtacgttcaagacctcatttggtcatccctgaggaagatcatgcagatgctacgatggctggaactctttctccaactaaccaaaaccctgaagatcagccaataactgccactgaccaaacctctggagagctaatagatgctccatttgtcactgcatttgatatggaaattgaacacatttctaatgttgctgtcactccccctcccactgtcccagcacacaatgtggttgaagatgattatatgagcgctgataaaagaaatgacttgactatgaagacattggatttagcagcgtcatctggtgctcacagatcagagaatatgcaaacgccagctgagagaatgcaaacatcagattcagatactcctcaattgatcaattctactgattataaagcgcctattttgataacttttttagtagaaggaatatgtgaggagggagcttcagttcctgacaatggacaacaacacaccagccagtag

SEQ ID NO: 116038 - DNA, 1011 bp, Glycine max
  Peptide Sequence Number=SeqID_232816
atgggtcagcttgcaaagaagctccatccagacacaaacaaagatgatcctaaggctgaaaagaagtttcaagaagtttcaatggcatatgaggttttgaaggatgaggaaaaacgtcaacagtatgatcaggttggccatgatgtgtatgtaaaccaagaaagcaccagtggttttggaggcaacagtggctttaatccatttgagcagatgttccgtgatcatgattttgtcaagaacttttttcatcagaatattggtggagaggatgtcaagactttcattgaactatcttttatggaagctgtccggggatgcaacaaaactattacatttgaaacagaagtgctttgtaacacctgtggtgggagtggtgtgcctcctggtacaagacctgaaacctgtaggcgctgtaaagggtcaggagtgacatttgtacaaactggcatatttaggatggagagtacttgtggtacatgtaagggaactggcaaaattgtatcgaatttctgcaagtcatgcaaaggtacaaaggttatcaaaggaacgaaatctgtcaaattggatattatggctgggattgacaacaatgaaactataaaggtttatagaagtggtggtgcagatcctgatggagataatcctggtgatctttatgttaccatcaaggtcagggaagatcctgtcttccgtagagaaggatctaatattcatgtagatgctgtcttaagtatcactcaggctattttgggcggaaccattcaggtcccaactcttactggagatgttgttcttaagattcgtcctggcacccaacctggtcagaaggtggttctgaaaaagaaagggatcaagactaaaaattcttacacatttggggatcaatatgttcattttaacgtcagcattccaaacaatctgacagagagacagcgggaattgattgaagagtttgccaaggaagagcaaggagattttgataaacagagagttgcatctgcttctggttga

SEQ ID NO: 116039 - DNA, 324 bp, Glycine max
  Peptide Sequence Number=SeqID_232817
atggggtttttgacaagttccgatcagaggctccaacaaacaaagccaatctcctcctctgacccagctgattgtgtgagagctgaacctgtgatctacaagaagctggaggcttcacctgatgacattgcacttttgagagcttatgttggagatagaccaacatggaggaatccccagcatccatggaggatggatcccaggttcaagctcactggggtgccaaccttgatccgttgggagaacaacaccgtcaaaggtcacttggaggatcatgaagctcacattgaaagcaaaattgaagctcttgttgctgacaagtga

SEQ ID NO: 116040 - DNA, 303 bp, Glycine max
  Peptide Sequence Number=SeqID_232818
atggtggaaagggagagatttggtcatatagaggagaggctgagagctattgaaggaggcagagattatgcctttgctgacatggcagaattgtacctaatgcccaatgtcgttatccctctgaagttcaaggtgtcgaattacgataaatacaaggggactacctgccctaagaatcaccttaagatgtacaacaagaaaatgggggcatactcgaaaaatgaaaatttgttgatgcatttcttccaggaaagtcttactggggcaactgtcacttggtatactaatcaggaaccttcctga

SEQ ID NO: 116041 - DNA, 267 bp, Glycine max
  Peptide Sequence Number=SeqID_232819
atgggaggtgcaaatagaaagtttcaaaatctgggcccttctagaggattctgggcaaaatggggttgttctaaggatccctcatccccctggctatccatttcagctgtttttggtgaaaaaaaaaatttatgtgaagaaaatccaagccgtggtgctttcctaatgcttccgagatgtttccgtgagcgaatccgtgaaggtttttcgtcgttctttaccgttcttcatccgttcttcgttcgttcttcgttcttcaacgggtaa

SEQ ID NO: 116042 - DNA, 446 bp, Glycine max
  Peptide Sequence Number=SeqID_232820
tcctgcctgaaatcgctcctctttctcctccccgcctgaaatctgccaaaaaccgctccctcgacacccacattgtcgtcggtcgaagccacagaaccccctacactgccgaaaaacccacattgtcctcgctggaacccacagaatcccctacagtgccggaaaacccatattgtcgttgctggaaccccacagaacccacattgtcctgggtcgaagaaaaccctacatacactgttgctactagggtgctgaaacactcgtcgctgctcaaaggtcaaagctttttccgcgaggctccgctgacgtgcgtgtgttgttgggttctcttgatcaagagaatgaaccatgatttctgtagatggatccacaggggtcttgaaattgcttgcaattgctttaacattttactgtccaacagagggggcttgactgttgttgtttga

SEQ ID NO: 116043 - DNA, 1604 bp, Glycine max
  Peptide Sequence Number=SeqID_232821
aatggccttcggcagcgaatccagtcccaccagcgtcgtcgcaccggtggtcgtcagccccgagaaggatcaaagaaggcgtcggtcagcgacaagttgggccgttcagaaaacaggaacggcaatgcccccacgctgcccagcacggtccagaacagcacgacgatcaggaagccttcgcggggtttcagttcgtgtttctgtttgcggttcggccaccacagcatcagaccgatggtcagcgccacgaagaaggtttggctgaacgcgcgccccgccccatcgcggtaaatcaatgccaccaggccgggaataaacatcgtcccggagaacaggatgaccagcagaccaacgatacgggttatggcgcgaaaatgcatttcagcacgatccttagcaattcaattgggaggaattattgcgaaatggggctcgacctccgtggccggcaacgccagatgcagcacgacggcggcgccgtattcgccctgcaggatccgacctgcggtttgctgcagcaagttctccaccaacgccaactgcgcatagtcgcactgcaagatatattcggcttccggcaccttttgagccaacgccagctgcttcaacgcctgttgaacaccgttgccataggctttcaccaatccgccggtgcccaacttgacgccgccgtagtaacgaacgaccacggcggtcacttccccgatgccgctgcccatgagctgcgcgaggatcggtttgccggcggtacccgacggctctccgtcgtcggagaatcccagctgctgcgagtcatcggggctgccggcgacgaacgcccaacaatggtgccgcgccgccgggtgttgcttccgccggtatcggatacggccgcatcaagccaggttcagatcgcgcgtcatgttctcgatgcgcttttcgtggattacgatgttgtcttcgatgcggatgccgccatacggcttcagcgcatcgatgcgatcccaggcgaagtgctgcttgaactcaccgctgcggcacggcgccaacagagactcgatgaagtacagacccggctcgatggtcaacaccatgcccggctgcaacacgcgggtgcaacgcaggaacggatacttggccggcgccgccagatgggtgccttgctcgtcctgcataaagccggcggcgtcgtgcacctgcaggcccagcgggtggcccagcccgtgcggcaggaacggcgtagtgatgcccgtttcaaccatcgcctcttcgctgaggccgttcaccagcttgtgattcttgagcagcctggcgatgcgctggtgcatctgcacatggtagtcggtatagcgcacgccggttttgatggtgtcgatcagcgccagctgttcaccgttgagatctttcaccagatgggcgaattcgctgccgctttgcgccgcgtaggtgcgggtcagatcggcggcgtagccgttgtattccgcgccggcgtcgatcaggaaactcagggattcggccggcggctgatgatccagcttggtgtagtgcagtaccgaagcgtgttcgttcagcgccacgatgttgtcgtaaggcacgtcggtatcgcggtggcctgtcgccgtgag

SEQ ID NO: 116044 - DNA, 142 bp, Glycine max
  Peptide Sequence Number=SeqID_232822
atggcactcggctggttaaggttaaactgcggatgtaacggcatttgccgggaattgcgagctgctccgcatgcccaacgcgatgaggttggtgcgccggagcgctgtgttaagatgacttctttcgtgctaaggcataagg

SEQ ID NO: 116045 - DNA, 846 bp, Glycine max
  Peptide Sequence Number=SeqID_232823
atgtatctaaccgcaactgcattcctctatcaatcatataaatatgaggaggatgctctaaatgatataaagaataaattaatcccttatctagagtgtaaagagaacttaaaaacgtattttaaaacgtatttaaagactttagtgatagaatcacggatggctaaacggccattccaatatttatctaatatttacctattcttattatcagtatcggatttaatgtctttcgttgatctgtataattgtgttcctgtaactcaggatgctagcgctagcgcatatcaactgatggcttatttcctcctggataagaattttgcgaaactaacaaatctttttgataccggcagcggtgagatatttgacatctattctcacatgagaattgaattaatttcattcatcaaagactctcttagtgaggagaatcctgagctatgcgcaattttggatagggtcctaactaggagtatagttaagcaaatatatatgccaattatatatggtaaaacagctaatagcacaactaaggatcttatagtgagtctttgccaagatctcttgccaaaagaatgtactatactgtcggttctatgcttcaaattttggcaagaaaaatacagttttatgtattcgtttatccagctgatcagcctggtaggtcgggtatgctcttacctagatcgaccagtcttgtacagcacagaatattttagcacatcccaggattataaaaagatggaaaaacactcagttagagtcttcaactcttacttgaaaaaggcccataatgtcacactctcgtttccctcaaaagagcgggataagaggaaaagtggg

SEQ ID NO: 116046 - DNA, 519 bp, Glycine max
  Peptide Sequence Number=SeqID_232824
atgagtatatattggggttaccccactaatcaagacttcgactatgatgcactagcaccgttattgcattttcacctaaacaatgttggtgatccatttacagagagtagctttagtttaaattcatcaaaatttgaagtttgcgtgcttgattggtttgctaacctatgggagatagataagggtgagtattggggatatgtcacaactggtggaactgaaggaaatcttcatggaattttaacagggagggaacagtttccagatggtattctatatacttcacaggattcgcattattcaatatttaaagcagcaagaatgtataggatgcaatgtgtgacagttggcactttggtctctggtgagattgattgtgttgatttaaaggctttacttcttgctcataaggacaagccagccatcatcaatctgaatataggtgagaaattgaaattttcttcttaccgtcttcttcaagaaacaccgtttgagatgtggagcattgttcgggcctga

SEQ ID NO: 116047 - DNA, 246 bp, Glycine max
  Peptide Sequence Number=SeqID_232825
atggcggtcttgccagtgccgggttggccaaccaagtcgactacacaattttcccaaccatgtcgtccgagacgatgcgtgattcctgggaggagtctaggccaaggccgcggatatcagagtgcgtgcctaagcactttatgcgagttagattaccatttacgactcttagagagttttaggtgcgccattatagaaatggcgaagttggtgagagggagaaagaggatttcggagtttatttag

SEQ ID NO: 116048 - DNA, 147 bp, Glycine max
  Peptide Sequence Number=SeqID_232826
atgaaaggaatttcaagtcaaatccaatcacaatctttcattcttattttggtgatgaatgatcatgagctgatgacttcacatggaagtgatcctgtgttactgttccgaaagaacagggttggcaatcacgcaggcacaagttaa

SEQ ID NO: 116049 - DNA, 735 bp, Glycine max
  Peptide Sequence Number=SeqID_232827
atggggcaagagtgtagaccagcctcttcggccctccttcaatatatatgtatgtctaggcctagcatggaaaacaaccttaaccgtgaaacagaagggcatggcttgcctaaaattccatcactagttcaacatatatcatcaaatgatgaaggaaactttgacaatggtgacttgaaaaatctaagctcatctttcaaagagaatgaaacaatcttagcaggaagccaaggtgatgaacatgcagccattaatcatcggaataagcattcggtatctatcaacataccattctcttgtgaagaggttcagctgcataacaccgtaagagttctctatagtggcgaaaatgatttctcttctcaatcaactactacagactccaagccaccattaccatcacaatcaatgccaaatggcagtctgcactcagagccagcaagcggtgtcaattttaacaatcaagaaagcgtcataagcttgaataataagaggattgattttttcaaaacatggtccagtaaactagggggacacatatcagttatgagtggaaaggtacatacagaaagtgcagaagatgataacagcttatgcaacactaataagcctttacctgttgatttgttcttcaaaacattggagggtccacagttacaaactcctaagttagcagtcaagcaattctttggaaagcattggccacgtctccttccactgcatttcttcacataa

SEQ ID NO: 116050 - DNA, 744 bp, Glycine max
  Peptide Sequence Number=SeqID_232828
atggatagcccttttgttcctagctcttggagttcccccatcagttaccaaggacttgcatcaagcagtttgctaaagatatatggacagtggatgtttgggggcaaaagactgctgtcaaaggtggccaatccaacaaatctcttagcaattgttggaaattttgtaggagccttattgggtgcatcaatgggcctaaaagaagggcctcttttcttctttgctcttgggcttgctcactacatggtgttgtttgtaactctctcccagatgcttccaacaaataagaccatcccaaaagacctccatccagtgttctttctttttgtggcaccgcctagtgttgctgctatggcatgggctaagattcagggttcatttcattatgaatcaaggattttctatttcactgccatgttcctatatatttcactggctgtccgggtcaatcttttcagaggattcaaattctcactttcatggtgggcctacacttttccaatgactgctgcagcaattgctaccataacctatacaaatcaagtcacaaatgtactaactcaagctttgagtgtaatattgagtctcattgctacattcacagtaacagcagtgcttgtctcgactatagtgcatgcctttgtcctacgagacctctttcccaatgaccttgccattgccacaagtgagagaaagcaaaaaccacgcaggaaatggctcccatttaagacttgggagccatga

SEQ ID NO: 116051 - DNA, 105 bp, Glycine max
  Peptide Sequence Number=SeqID_232829
atggaatggagagtgaacatagaggcaactcctggttcagattatcctatggaattaaatcggaatggtatgtcatatttgtcaagaagatcggaggataagatg

SEQ ID NO: 116052 - DNA, 672 bp, Glycine max
  Peptide Sequence Number=SeqID_232830
atggaaacttctcagcctctttctatagaaagcttctcatacagttggttagtgaacctaaggccatcagcactagaaagcctagaaagctccctaagaactccccttgatgcatctgatgaaacttcttccttcattgagatggacccaagaatgccaccttctaaaagattctttaagaactcacaggactccaaatttgacttcccaatttcacagtcccctctcactcttgtccatgcagatgagctcttttccaatggctacctcatgcctctctttgttgagtcattgcaaatggaagaatatgagtcctcagactccaacacaagcttagtttcatcatcttcacatgcaccaaagagtgaggctcctacaggcccttctagatgcctttccttaaaaaagtgcagaacattgtcaaggagagtgtttcagaagtatctgaatttcttgaggcccttgtgtagaaagctgagggttcacaagcctagtattgatgctgttgctaagagaggtgaggctgtgaagaataggagatactattcagacactgctacttcaccgcgaattagtgtagccttttctgctgatgattggcgctactcttgtgattctgaaagctcaatatatgaagcagttctccattgcaaaagatccatcggagaatga

SEQ ID NO: 116053 - DNA, 759 bp, Glycine max
  Peptide Sequence Number=SeqID_232831
atggtaatgcttctctggattgcctcattttggtttgtaggaacttggatagttccatttttagcatacacagcagggtttagaaaggaatctcttacatacagagggcaagcattgtacagcctcttgaccgatgttgccgaaggtgtgattgggatagcaattcttcaccattgtcttgcaaagtttcaacctctttcatctgattggttcaaatttgaactcaaggggaagtggccgtttgatgttggtttaggctgcctcatgttcccccttatcaatcagctatcacaaatgaacctaaatttgttgcctgttcttcaatatactccagttgccatctcaagtgtagagcagtccattgttgcacgagaccttgtggcaatggccctctatgcagtgatagtctcagtctgtgccccgatatgggaggagattgtcttccgtggtttccttctcccatctttaaccaagtacatgcctgtatggagtgcaatattagttagctcaatagcttttgcattggcacattttaacatccagagggtgctaccacttgtatttcttggcatggtgatgggcactgtctttagtattgcaagccagttttctgagagacttgatgccttcaagtatagttttgaagctctaagtcctcagttcgaagccagttttctgagagacttgtttgccgtgaccccgtatgtagagcctaacattaaggtgtttgacaatctttcactgaaagtaagagattga

SEQ ID NO: 116054 - DNA, 321 bp, Glycine max
  Peptide Sequence Number=SeqID_232832
atggcgcatgcatggaagggttactacgattctgttcaatggtattttggaaaaggtttagtcttggttgacatctttgaaaggaagactgttaaattggccaggaagggtgaccttggtgaacctagtgttggccttgatcccaacatatacgatgctccatttgatggattggaagactatgacgagaaggaaaacaaatgggggcttaaggggtcagatattagtcaggtccttaatcactcaaggtcagatacaacgaggtcgggatacaaatggattaaaagaaatatggatgttgatggggattcatggttgtga

SEQ ID NO: 116055 - DNA, 888 bp, Glycine max
  Peptide Sequence Number=SeqID_232833
atgtgtagggtttatggtttgtggagtgaaagggtggaagggcctctgtatatggtgtgtgagaggcaaagatgtaattttttgaacaagtttggtgaattgggaaatgggtttcttgctgtgagtgagggtggtttggagttggataaaggtgggatttttagttttttaatgattgggaagggtatatgtgaagctgtggttgctttgcatttggaagggttggttgctggctgtttggggctttcttgtttctcttttgatgagcttggtgggatttgtgttgatttgaatgaggcattgatgctggcaaggaagtttgtgaatgttgtttccgttgaacacgaagaagaagcaatgtgtaaggattgcttggaaaatgaggtttttgcaagccctgaggttttgtatgggttgttgcacaagaggggcactgctccggatagtgggcattcgagatatccaactgggtatggctcggatgtatggtcattggcttgtgtactgctgcggcttcttattggaaatgcgctgccttggaataccttggaaatgaaggaagagaatgacggtgatagctctgctagttatgcatgctgggtggagaaagttagttctgttttggaagacaaactaggctctgaatatctgtcactaaggcagattctttgtaaatgtttggatgtcaatccaggaaaccggccagatgtggtggatgtcacggtaagtagggactacacgggtctttgcttggttctaggggagttgtgtttgttgcctaagcaaagttctaatgaactgattgaacatgagttgtgggagaaagaaattggtggtcaaccaaatgttgttcaagatggcaaaggcaaatttgatgaagaagaataa

SEQ ID NO: 116056 - DNA, 153 bp, Glycine max
  Peptide Sequence Number=SeqID_232834
atgcctataagacacacatccctaaatgtgtatatgcctaatgttggaatttccccgactcatatctatggggtagtgactactttaattggtaccctaaaaggatataaattacattctttaatgtctttccccaaagcgactttagtatag

SEQ ID NO: 116057 - DNA, 2079 bp, Glycine max
  Peptide Sequence Number=SeqID_232835
atggtgagcccaaaaatcttgacgttgtggcaaacaagttgcagtcgtggactgttttttaaaatcactggtgaaaccttgatgcacactgtgcattatggacacactctacaagattatgttattgtgttgttgaggaatggtaggcgcaaagaacaagcaaggaatgatttgaatgtttttctgggagaaaacagctattcatttgtatcctggctctgggatcatctggatatgtatttaaatttgtatgtacaacctgaagcattgcaggatgaagctcctaaaaaaaagcttacagcggaggttcaagctggagatgatgattctcagcatttaaattcacagtcagaaagaggaaaatctagtaagttatctagaagtcggcataacaaagattggaaaggattgatgaaggaagaagctgaaccaccttccattcgaagctctgtggttgacaatgctcatttggagcttgaagctaatcatgggccaaggtccctatctcctaagcctccagttcagaggaaaaggggccgagctgatgaacaacagaggatgaagcgggatgttgtatcacaagtaaatattgctgctccacggaggctgcttcaatttgcagtgcgagatgcagtagcgacttcaaggacagccaattcaggcatgtcagtggagccttccctaaaacgtcttcgttctgtagtttctacatctgctggcgattcatctttgcttgaacgtccaccgaggatgcagcttgcttccagggtggcaaatccaatggctacagtgattaaggctgtcgcagaagctgccgaagatgtgataaaatccaagccctctggaagtgtatttgatagacttggtcgcagtatggatacattagatgataacacgcaacttgaagatagtttccaacatcaggagcaacatcatttattccgttctcaaaaaactgagtacaatgggcagtatgctgcaaatatgactatgatgggacatgaaactggctatccttctgattctaattcagacaatgaagggtttgatgatattaatgtcatggatcgtagggtgtctggagcttctcagatctgcccctctgctggaaacaggggcaatgattcactgatggtgcagtatagtgtagcaaaaaatgtcgatgatagtttgcgccaaaagcgaaatcgcgaacaggagcaactttccacttcatccaacacatctcataagatagtgaatatttctgttaatgtaaatgcatggaagccaccacaacatcaggaaccacgagaggttacagaattagatggtaatagaactttttacaatgaaagagatcccagatctagtacacggccagtgaaggagaatgccaacactctaaaagttagtaatgggaatgcaaaccctgctcttgatgttcagaaagagtttagcaaggctcacttaaccgcttctggttctaatgctgctggccgtccatcagaagatgttgattccagaaccatttttgttagcaatgtaagaactcttactcctctgttcttggtgtgggagggcaggcttcagggattggttcattttgctgccaccaaagatggcctgtctcggcattttaatagatttggggaagttttaaaagtgattatagttactgatgcagcaactgggcagccaaaaggggcagcttatgttgagttcatgcgaaaagaagcagcagataatgcattatctctggataacacttctttcatgtcaagaattctcaaggttattaagaaaagtgctacaactcaagaatcagctccagctatggcatggccacgcattgttaggggttctccattcccttctgctaggttttccagacatccctttccaagaggtattcctggtgcttttagagcccgacccccaattaaactgggtgccaggagcatgcagtggaagcgggatgctcagggatctgacagtagttcatctgtgaatactggcagtgttactgctcctgtagctcgtgggttcacctacatcagaacagaatctaagccagaaggcagcttgagtacgacatag

SEQ ID NO: 116058 - DNA, 207 bp, Glycine max
  Peptide Sequence Number=SeqID_232836
atggcatcggaatgcaaaaaatcctgcaacgcaaatgggggttggtccaattctagaagcgcagtcccagaattcggtctcagttttgccaggaagtatgcacaaaagttcccctctctcagcgaattgaatgacgaatctcgatcttccaaggcccccaaatcccgcaagtccaagctgccccaagcaactaccatccacatgtaa

SEQ ID NO: 116059 - DNA, 2634 bp, Glycine max
  Peptide Sequence Number=SeqID_232837
atgttgttctactctgtcatgtgcagttccaagattcattgcaatgagaaggacatgaacacactcctacgcttcaaaacaggagtcacagatccttcaggtgtgctctcctcatggtttccaaaattagattgttgtcaatggactggagtcaagtgtgataacatcactggaagagttacacatcttaatctcccttgtcacacaactcaacctaaagttgttgctttggatgagaaggatgacaaatcacactgcctaactggtgaattcagcctaactttacttgaacttgaatttttgtggtacttggattttagcaacaatgacttcaagtctatccaatacaattcaatgggtagtcaaaaatgtgatcagttgtcaagaggtaaccttcctcatctttgtcggaactccaccaacctccgtttacttgatttgtcattgaattatgatcttcttgtcgataatctccattggatttcccgtctttcctcattgcaatatcttagccttgaaggtgtccatcttcacaaggaaattgattggcttcaatcagtcaccatgctcccttcacttatagagtttcacttgcagaggtgtcaacttgaaaacatctatccatttcttcagtatgctaattttacctcacttcaagctctaaatctgtctggcaatgattttgaatctgagttgcctagttggttattcaatcttagttgtgacatctcttatattgaccttagccaaaataagatacatagccaactacctaaaacattgccaaatcttagaagagttaagttcttgattttatctcaaaattatctcaaaggacccattccaaattggttaggacaacttgaacaactacaagaacttgatctttctgataattttttttctggtccaatccctgcaagtttgggaaatttatcttctttgacagatttggcactcgattcaaatgagttgaatggaaatcttccagacaatctcgggaatctcttcaacttggaaacactttcaattttaaaaaattccttgactggaattgtgtctgaaagaaatttactttctttttcaaaattgagatggtttgccatgagttcccctggcctgatctttgattttgatcctgaatggatccctccttttcaacttcaacatcttacattgggctatgtgagagacaaacttcctgcatggctattcacacagagttctctagaatatctaatcattgaagattcaactgcttcatttgaacctcttgacaagttttggaactttgctactcaacttaaatttttctttctggtaaacaacactatcaacggggacatatcaaatgtgttgctgagttcggaacgtgtttggttagtttccaataatttaagaggtgggatgcctcgtatatcaccagatgtggttgttttaactttatataataattcattgtctggatccatttctcctctcttgtgtgacaataggatagataaaagcaatttagtgcatttggacatgggttataaccatttaacgggagaactcacagattgttggaatgattggaaatcgctggttcatattgatttaagttacaacaacctaacaggaaagattcctcactcaatgggctccttgtctaatcttcgttttctgtatctggaaagcaacaagttctttggagaggtatcttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaggcaatagattatcaggaccaatacctaattgcttacataacttcacagccatgctttttagtaatgcttcaacccttaaagtcggctatatagttcacttaccaggttttccagtaatcatgacagctagtattacgatacttataaaagggaacgagttagaatattttaatttaatgaatgtgattgatctctcaaataacatcttgtctggaagtgtgcctttagagatatatatgctcactggactacagtccttgaatttgtcccataatcaattactgggaacaataccacaagagattggcaacttggaagcattagagtccattgatctctcaagaaatcaattctcgggagaaattccagagtccatggctgtcttgcattatctttcggtcttgaatctgtcattcaacaattttgtggggaaaatcccaacagggacccaacttggttccacaaaccttagctatatcggcaatcctctcctctgtggagctccacttacaaagatatgcccacaagatgaaaagtccaacaacacaaaacatgcaggagaagaagatgatgatgataaatctgaactatactcctggttctatatgggcctgggaattggatttgccgtgggatttttgggagttttgggcgccattttcttcaaccagagatgcaggcatgcttattttcgatttctgcaccgaatgtatgactttgtgatccaaaagatgaactccatctattga

SEQ ID NO: 116060 - DNA, 2655 bp, Glycine max
  Peptide Sequence Number=SeqID_232838
atggaagacttagttgaatacaagaatataaatacttgcagtggattctatctatatcttcccatcatcaacacatcttcttgcgttatcatgggtgcctctccactgggtattaaaccccttttactttccttattattatgtgcattcatgtgtagcagtttgaagattcattgcaacgagaaggacatgaacaaactcctacgcttcaaaaaaggagtcagagatccttcaggcatgctctcctcatggctcccaaaattagattgttgtcgatggacaggagtcaagtgtgataatatcactggcagagttacacagcttagtctcccatgtcacacaactcaacctgaagttgttgcttatcaagagaaagacgacaaatcacactgcctaacaggtaaccttccccatctgtgtggaaactccaccaacctccattatcttgatttgtcacataattatgatctgcttgtctataatctccattgggtttcccgtctttcctcattgaaatatcttaaccttggaggtgttcaccttcccaaggaaattgattggcttcaatcagtcaccatgctcccttctcttttagagttaaccttggagaattgtcaacttgaaaacatctatccatttcttcagtatgctaattttacttcactccaagttttaaatctagctggaaatgattttgtatctgagttgcctagttggttattcaatcttagttgtgacatctctcacattgaccttagccaaaatcgcataaatagccaactccctgaaagatttccaaattttagaagtattcaaacgttgtttttatctgataattatctcaaaggacctattccaaattggcttggacaacttgaagaactaaaagaacttgatctttctcataattctttttctggtccaatcccagaaggcttgggaaatctatcatccttgattaatctgatacttgagtcaaatgagttgaatggcaatcttccagacaatctcgggcatctcttcaacttggaaacacttgcagtttcaaaaaattccttgactggaattgtgtctgaaagaaatttacgttcattaacaaatttgaagagcttttccttgggttcacctgctctggtctatgattttgatcctgaatgggtccctccttttcaacttgtaagtatttcattgggctatgtgagagacaaacttccggcatggctattcacacagagttctctaactgatctaaagattttagactcaactgcttcatttgaacctcttgacaagttttggaactttgctactcaacttgaatatttcgttttggtaaacaacacaatcaatggagacatatcaaatgtgttgctaagctcaaaattggtttggttagattccaataatttaagaggtggcatgcctcgtatatcaccagaagtgcgtgttttgcgtatatataataactcattgtctggatctatttctcctctcttgtgtgacaacatgaaaaataaaagcaatttagtgtacttggggatgggttataatcatttttctggagaactcacagattgttggaataattggaaatcattggttcttattgattttggatacaacaacctaacaggcaacattcctcactccatgggctccttgtctaaccttcgttttgtatatctggaaagcaacaagttatttggggaggtacctttttcactaaaaaattgccagaatctttggatacttgatattggtgacaataatctttctggagttataccaagctggtggggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagtaatgcttcaacttataaagttggctttactgttcaatcaccagatttctcggtaagcattgcatgtggtataaggatgtttataaaaggcaaagaattaaatcgtgtttatttgatgaatgacattgatctctcgaataacaacttgtctggaagtgtgcctttggagatttatatgctgactggattacaatccttgaatttgtcccataatcaattaatgggaacaataccacaagagataggcaacttgaaacaattggaggccattgatctctcaagaaatcaattctcgggagaaattcctgtgtccttgtctgccttgcattacctttcagtcttgaatttgtcgttcaacaatttaatgggcaaaatcccatcagggacccaacttggttcaacagaccttagctatattggcaattctgacctctgtggacctccgcttacaaagatatgcccacaagatgaaaaatctcacaatattacaaaacccgtgagagaagaagatgatgatgatgataaatctgaagtatattcctggttctacatgggcatgggaattggatttgctgtaggattttggggagtttttggaaccattttgttcaacaggagatgtaggcatgtttattttagatttctgcaccgaatgtacgactttgtgattcgaaagatgacctccatctactga

SEQ ID NO: 116061 - DNA, 714 bp, Glycine max
  Peptide Sequence Number=SeqID_232839
atggaaatcatgattcccttttttttttttttttggttttctagaaacattcagtctcccttactgaatgtttctcataaggtctttgcagagatcggcaagcctgataaagtggcattgactgcaatgcttgcagggtatgccatgcatgggcaagggaaagaagcaatagagttctttcaaaggactgtattggaaggtatgaagcctgatcatgttacttttgctctgttaagtgcttgtagccactcagggcttgtcaaggaaggaaaggtttatcgtaacatcaatcttgggaaggaagctgcagagaatttgattgcattaaatccttcagaccctagaaactatatcatgctttccaacatatattctgctgcagacaaaatacacaagaagctggaagagattatgagaaaaattcaagaggttggttttgtgtctgaaactgaatccattctccatgatgttgatgaagaggtcaaaacagatatgattaacaagcatagtgagaagatagcacttgcatttggacttttggttagtaatgctgatatgccattagttataataaaaaatctccaaataagccaggattgcctcaacactgcaaaatttgtctcgctgatagagaagtgtacaatcactatccgagattcaaagcgatttcaccatttttcagatgcatcatgctcttgtggtgattattggtag

SEQ ID NO: 116062 - DNA, 453 bp, Glycine max
  Peptide Sequence Number=SeqID_232840
atggcgaatctcaccaagagaaccatgattttcgccataactcgcgtgtcgtgttggagaaacaagaggcccttacggttacgaaggaagaaaataatttcaaggtgcccaagttcttcaacgcatttgagtttatttcgtccatgtctttcgggtcgacctctcgaggatgttcgagagcaagaggaagacaacggcggtgttcacgtcgaagtgctctatggcggtgattgtggcgaagattgtagtggcggcgtgggggctgaggttccacgtggtggaggtcaaggacttcaagatccagttgcagggtgcggcggaggggaagaaggggaggctggggtcatagtggaggtgttcaaggtggcgctggaggtcactttcgcgacaaagacagtggaaggggagggcttctgttacaaccgatatcccaaacagatccccatcgtttga

SEQ ID NO: 116063 - DNA, 2549 bp, Glycine max
  Peptide Sequence Number=SeqID_232841
atggatgcctctccctcaagtatgaaacttcttaaattccttttactttgcttgctatgtacaatcttgttcaactctgtcatgtgcagttccaagattcattgcaacgagaaggacatgaacacactcctacgctttaaaacaggagtcacagatccttcaggtgtgctctcctcatggtttccaaaattagattgttgtcaatggactggagtcaagtgtgataacatcactggaagagttacacatcttaatctcccttgtcacacaactcaacctaaaattgttgctttggatgagaaggatgacaaatcacactgcctaactggcgaattcagccttactttacttgaacttgaatttttgagctacttgaatttcagcaacaatgacttcaagtctatccaatacaattcaatgggtggtaaaaaatgtgatcacttgtcaagaggtaaccttcctcatctttgtcgaaactccaccaacctccattatcttgatttatcattcaattatgatcttcttgtcgataatctccattggatttcccgtctttcctcattgcaatatcttaaccttgacggtgtccatcttcacaaggaaattgattggcttcaatcagtcaccatgctcccttcacttttagagttgcacttgcagaggtgtcaacttgaaaacatctatccatttcttcattatgctaattttacttcacttcgagttctaaatcttgctgacaatgattttctatcagagttgcctatttggttattcaatcttagttgtgacatctcttatattgagcttagcaaaaatcagatacatagccaactacccaaaacattgccaaatcttagaagtattaagtccttgtttttgtctaagaatcatctcaaaggacccattccaaattggttaggacaacttgaacaactagaagaacttgatttttctcaaaattttttatccggtccaatccccacaagtttgggaaatttatcttctttgacaactttggtactcgattcaaatgagttgaatggaaatcttccagacaatctcaggaatctcttcaacttggaaacactttcaatttcaaaaaattccttgactggaattgtgtctgaaagaaatttactttctttttcaaaattgagatggtttaagatgagttcccctggcctgatctttgattttgatcctgaatgggtccctccttttcaacttcaacttcttgaattgggctatgtgagagacaaacttcctgcatggctattcacacagagttctctaaaatatctaaccattgtagattcaactgcttcatttgaacctcttgacaagttttggaactttgctactcaacttaaatttttctttctggtaaacaacactatcaacggggacatatcaaatgtgttgctgagttcggaatgtgtttggttagtttccaataatttaagaggtgggatgcctcgtatatcaccagatgtggttgttttaactttatataataattcattgtctggatccatttctcctctcttgtgtgacaataggatagataaaagcaatttagtgcatttggacatgggttataaccatttaacgggagaactcacagattgttggaatgattggaaatcgctggttcatattgatttaagttacaacaacctaacaggaaagattcctcactcaatgggctccttgtctaatcttcgttttctgtatctggaaagcaacaagttctttggaaaggtacctttttcactaaataactgcaagaatctttgggtacttgatcttggtcacaataatctttctggagttataccaaactggttgggtcagagtgtgagaggtgttaaattgagatccaatcaattcagtggaaacattcccacacagctatgccaacttggttccttaatggtgatggattttgcaagcaatagattatcaggaccaatacctaattgcttacataacttcacagccatgctttttagtaatgcttcaacccttaaagtcggctatatggttcacttaccaggtttgccaattatcataacatgtagtattacgatgcttataaaagggaacgagttagaatattttaatttaatgaatgtgattgatctctcaaataacatcttgtctggaagtgtgcctttagagatatatatgctcactggactacagtccttgaatttgtcccataatcaattactgggaacaataccacaagagattggcaacttggaactattagaatccattgatctctcaagaaatcaattctcgggagaaattccagagtccatggctgacttgcattatctttcggtcttgaatctgtcattcaacaattttgtggggaaaatcccaacagggacccaacttggttccacaaaccttagctatatcggcaatcctcacctttgtggagctccacttacaaagatatgcccacaagatgaaaagtccaacaacacaaaacatgcaggagaagaagatgatgatgataaatctgaactatactcctg

SEQ ID NO: 116064 - DNA, 240 bp, Glycine max
  Peptide Sequence Number=SeqID_232842
atggaggtgttgacgccaaaagggtggtggcagcagaggaggtggagacggcggtgtcgcgacttcattactatggaaaggtttgaactttggattttgcttacacagagagaaggagtggtgcggcagatcaagaatcagagagaaagaacctttaataccatgaagctcgtttggtctccagaatcagccttgaaatcctacatcgaaactgttaaatcactaaaacaacttgtttaa

SEQ ID NO: 116065 - DNA, 1651 bp, Glycine max
  Peptide Sequence Number=SeqID_232843
atggcaggtgctggctggtccggtgctgatcatgctgatcctgtcaatgatggtattgccgctgccggccgcacgctggaattcgctgccttcccgaccattttgctgttctcaacgctgctgcgtctggcgctgaacgtcgcctcaacgcgtatcatcctgctggaagggcatacgggtgctgatgccgccgggcgcgtggttgaagcctttggtcacttcctcgtgggcggtaatttcgccattggtatcgtggtattcatcatcctcgtgatcatcaacttcatggtcatcaccaaaggtgccggacgtatcgccgaagtgggcgcgcgtttcgtgctggatggtatgcccggcaagcaaatggcgatcgatgccgatttgaacgccggcctgattggtgaagacgaagccaaacgccggcgcaccgaggtgacccaggaagcagatttctacggctcaatggatggtgccagtaagtttgtgcgcggcgacgccatcgccggcatcctgatcatggtgatcaacgtgatcggcggcctgctggtgggcgtggtgcagcacggtatggatctcggccacgccggggaaacctatacgctgctgaccatcggtgacggcctggtggcgcagattccggcgctggtgatctcgaccgctgccggtgtcatcgttacccgcgtcagcaccgatcaggacgtcggcgaacagatgtgccggcgtgattggcctgctgggcctggtgcccggcatgccgaactttgtgttcctgctgttcaccgcggcgctgctcggcctggcctggagacgccggccacggtcgaagcctcgtggaccgacgtgcagctggaagattcgctcggcatggaagtgggctatcgcctgattccgatggtcgatcatctgcaaaacggcgagctgctcgggcgtatccgcagtatccgtaaaaaggtggcgcaggaggtcggcttcctgccgccggtggtgcacattcgtgacaacatggagctgccgccggcgcgctatcgcatcctgatgaagggcgtggagattggcagcggcgatgcttatccgggacgctggatggcgattaacccgggcacggcggcgggcacgctgccgggtgaagcgacggttgacccggcgtttggcctcgcggccatctggatcgacagcgcgctgaaagagcaggcacagattcagggctacaccgtagtggaagccagaagcgcagcagctgctggaccgcgtcacccaggagatgccaaagctgacggaagatctggtgccgggcgtcattaccctgaccacgctgcacaaagtgctgcaaaatctgctgaccgagcgcgtctcgatccgcgacatgcgcaccattatcgaaacgctggccgaacatgcgccggtgcagaacgatccgcaggaactgaccagcgtggtacgcgtcgcgctgggccgcgcgattacccagcagtggttcccgggcaacggcgaagtgcaggtgattggactggatgccacactggagcgtctgctgctgcaggcgctgcagggtggtggcggtctggaaccgggtcttgccgatcgactgctgatgcaggcgcaggccgcgctgcagcagcaggagatgaccggtgcgccgccggtgctgctg

SEQ ID NO: 116066 - DNA, 279 bp, Glycine max
  Peptide Sequence Number=SeqID_232844
atgattaaagaaggattacacatttacttggcgccacaaaccctaactaaagaggaagtgatgcaatcctatcccgcaagggcattgggtagaagactccaagtagattgggctagagatccaagggaaggccctagggttctcatgagccttagggtagattttgagcccatgggctattacttctactttaaggctcatgagaacctaaaccctagagaaaactcttctaaggtttcagccacaaaaaataacaggacaaaactcaaaggaacctaa

SEQ ID NO: 116067 - DNA, 577 bp, Glycine max
  Peptide Sequence Number=SeqID_232845
atgggaagaaaggagcttcaccaccaagatgaaccttggataagaagcttggaaggatgcttcaatggaggaaaagaaagagagaggggggagcacgaaattgaaggactaaaagagggagagaagtggaactttgaagattgcatcaggaagcaagctgagcaggagacacaaaggtggaaggtgtgcagcatagttccacagggtcctcacacattgcaaatgaaccagaccaactttcaccctttgttgatcactatttgcagcaaagaaatggagacttatgaaccagaaactgagattgaagaagaaaagagtatttctggggaggatagtccaactactcctatgcaaaatcaaactccaagtaaagtagaagctgatgcttttgaaaagatagcatctatcagccagaccttaactacaacaaaacagtccctatggaagatggatcttcatgctcttggaatatcctacaagatcaagaggctgaagcaacaacttgttcttgttgaaaggttaacaagaaggcaagccaatgacgagctagcagaaattactaatgatagcaaagttg

SEQ ID NO: 116068 - DNA, 925 bp, Glycine max
  Peptide Sequence Number=SeqID_232846
gtcgactctagaggatcccacagatgagtcaatctcttactatctcataagggtggacccatgggtactagtacctattgcctttagagggcttcacgtcctccccttcagagggctaaacgtcctcgcctttagagggttgcacgccctcgccttcagaggactgcacatcctttcctttagaggattgcatgtcctcgccatcagaggattgtatgtcctcggcttcagagggctacacgtactcgccttcagagggttggacgtcctcctcttcagagggctacacgtgctctactttagagggctgcacgtcctcgcctttagaggactgtacgtcctcgccttcagagggctgcacgtcctcccctttagagggctacagtcctcaccttcagagggctccacgcccttgccttcaaagtactgcatgtcctcaccttcagagggctacactccctcacctttagagagctacacgcccttgcctttagaggactgcacgtgttcgccttcagagagctacacaccctcgcctttagaggactacacttccttgccttcagaggattgcacgtcctcgccttctggggaccacacctcttcgccttcagaaagcttgacgtccttgcctacagagggccacacgtccttgccttcagagggctacacgccttcgccttcagaggattgcacatcctcgccttcaggggactacatgccttcgtctttagagggcttcgcgtcctcgcctgcagagggctacacaccctcgcctttacagggctacacgccctcgccttcagagcgctgcatgccctccccttcagagggctacacgtcctcgccttcagagggctgcacgccctcacctttagagggctacacattctggccttcagagggctacacaccctcgccttag

SEQ ID NO: 116069 - DNA, 582 bp, Glycine max
  Peptide Sequence Number=SeqID_232847
atggcacatcacacgccctcggcttcagagggctacaagccctcgccttcaaaggactacacactcttgccttcagaggactacacgtcctcacctttagagggctacacgccctcaccttcagagggctacacgcccacgccttcagaggactacacgtcctcaccttcagagaactacatgtcctcgccttcagagggctacacgtcctccccttcagagggctacttgccctcgctttcagaggactacacgtcctcgccttcaaagggttgcacgccctcacctttagagaactacacgtcctcttcttcagaggactacacgtcctcgccttttagaggactggacgtcctcaccttcagagggctacacaccctcaccttcagaggactatacgccctcgccttcagaggactacacgtcctcgccttcaaagggctgcatgccctcgccttcagagggttgcacgcattcgtcttcaaagggcgacacgtccttgacttcagagggctgtacgccccctcgcctttagagggctacgcgtcctcactttcagtgggctccatatccacaccttaa

SEQ ID NO: 116070 - DNA, 216 bp, Glycine max
  Peptide Sequence Number=SeqID_232848
atggaagaagatcctaagaagactctcaaattcttagatgctacaaatgcaatcaacttggtcacatcaaagaaaattgtcccctcaaatgaggaatggcccggagaaaaatataaagtactttttgattatgaaaaatgtgttatcaaacatgagtatgataaagatattgagcatataggtttcagagaaaataatgtctacatgattgattga

SEQ ID NO: 116071 - DNA, 687 bp, Glycine max
  Peptide Sequence Number=SeqID_232849
atggccaaaagcaaaaactgtcatgctttgcctcttctccttgccctgatcctcttcttcactcttcttggaacctctcacgcaggtggcatagccatctactgggggcaaaatggtaacgagggcaccctctcagaagcatgtgcaacaggcaaatacacccacataaacatagcctttctcaacaaattcggcaatggccaaaccccagaaatgaacctggctggtcactgcaaccccgcaaccaattcctgcacaaagttcagctccgaaatcaaggactgccaaagcaaagggatcaaggtgttactttcaataggtggtggcattggaagctacactttggcttcagtagaagatgcaagaaacgtttcaacttttctgtggaacactttcttgggaggcaagtcatcatcatcttcaaggccactaggtgatgctgtgttggatggcatagactttgacattgaacttggttcaacacaaaactatgagcaccttgcacgttttcttaaggcgtatagtggggttggcgggaagagggtgtacctaggtgctgctcctcagtgtccaattcctgatagatttttgggcactgcccttaacactggcctttttgactttgtttgggttcagttctacaataaccctccgtgtcagtatgctaatgggaacataactaacctt

SEQ ID NO: 116072 - DNA, 240 bp, Glycine max
  Peptide Sequence Number=SeqID_232850
atgcttattctcttgaaaatattcttcttcaccataataaaatcttcagaggccagcactggtggcattgccatctactggggccaaaacaatagcgacgacaccttgagttccacatgccacactgccaactacgagattgtcaacctagctttcctcagtgtgtttagttgcgccagaactccatcatggaacttcgctggccaccgtggggaccggagcccttgcaccaaactataa

SEQ ID NO: 116073 - DNA, 711 bp, Glycine max
  Peptide Sequence Number=SeqID_232851
atgtcgatgcgcattgcgctggccgttaccgtcgtcctggcgttgagcggttgccgtatcgtttcggagaaaaagctggcggagcttcgctccccggtgaatccgcatgtggcacaggcggcggaaatttaccgcagccaaatcgctccgcaagcggtcaaaacggcgcagccgctgggcgagctgctcgcccggatcgcccaggccaaggattttgacagcgcctgcggtctgctggggtaccgcgctcaaccggagttcccttgttatttcaacgttaaggtcagcggtgaagtcgcggcggtcaacacccgttcgcgcagcggaaaattaacgctcaagctgaccgatgcaccgctcagcagcgtggaggtgcagatcgggccggtttatcgcggtacggcgttgcgcgacagctatcgcgggctgagctacggcgatttcaatgaccaagcgctgttcggcgattttgccagggcgattaatcaggcttcgatcgacgaactggccggatccccgcccaaggtgggtgaccacattaccgtgtacggcgtattcagcagctggcaggcgcctgccgagccgctgttgatcacgccggtcaacgtgctgatcggcgaaaacggcgccggcaagtcgaccatgatgaagctgctggcgggggtgacaccccgacctccggtaccatcgagctggagggtaaagcggtga

SEQ ID NO: 116074 - DNA, 312 bp, Glycine max
  Peptide Sequence Number=SeqID_232852
atgaagaagatcctaggcctacaagctccaatggagcttgcatcaactctcgttctcattctcgatgatgaaaggttagtcttctataaatgcttgtttttgtgtttggttttgatggtgatgatcgatattgaaatcgatagtcaccccttccaccagtctgccgagaaagagtttggttaccaagttcagctaaagttgggaagaaaatgtgtcatattagaaaacctatccactacaactaagatagaatcatgccctcgggctctcttgggcaacccaaggtgtggagcatataagcctttggattag

SEQ ID NO: 116075 - DNA, 930 bp, Glycine max
  Peptide Sequence Number=SeqID_232853
atggcaggaaaacaggcaaggacactcaccctcggcgcggcgattggcgtcgcgctgctgacgttggccggttgcgcgcagccgccgcacaccgacgcgcaggcccagcagcggctggcggatcagtcggtgctggcggtgaactggttccaacagtccggcgaataccaggcgctggcgcatcaggcgttcaacagcgcgcagcgcgccttcgatcaggccagggccgcaccgggccgtaaaaaggcggtggtggtcgatctggatgaaaccatgctggacaacagcgcctactccggttggcaggcgcagcagggccagccgtacgacggcgccacctgggccaaatggacgcaggccgaacaggccggcgcggtgccgggcgcggtgtcgtttgcccgttacgttaacacccatcaggggacgatgttctacgtatcgaaccgcaagcagagcgaatacgccgccacggtggccaacatgcataagctcggtttcaccggcatgtcggaaaagaccgtgctgctcagcaccgacacctccaataagcaggcgcgcttcgacgccatcaaacaagccggctatgacatcgtggtgtacgcgggcgacaacctgaacgacttcggcgccgcgacttaccaccaggacaacgcgcagcgccgggcgttcgtcagcgagaaccagggcaaattcggcactgaattcatcgtgctgcccaacccgctgtacggcgattgggaaagcgggctggcccgcgactacaacaagctgacgccgcagcagaagctgcaggtggcttccaacgccccgccgtcgctggcgcgggcgtattgcgggatgtcacctgccgcttcgaaccccaattggcggtacaacccctgcgccgcgctgccgctcagggtatccagcaccaacaggctgcggcgatga

SEQ ID NO: 116076 - DNA, 467 bp, Glycine max
  Peptide Sequence Number=SeqID_232854
atgtcattgcctagcgctgttcatgtgtcctccattatcaagcgcgaagcctctggtgactgggaagcacgttattgtgttgttttccggatcggttccttcgccaaatataagaaaaaagaaggagtagagacgagagtcgtcatcacggaaagggcagggcggacgaaatcagtgtcctatctttgttttcctcctatctccgatgagaggaaaaaatccaaaggaagcaggcttgcgcaatccgtgaaattccgcaatgtggcggaagtcaaaagaggtgtttttgcgcaatccgtaagtttccgtgacttcttcgaaaggcccacatgggccttccagaagattcctccagaaggttgttgcatgtgtaggaagcaacctggctcgcctgggaattacgcgaagattctcgaccgttcttcaagattcatcgttcgttcttcgttttcttcagtcttcaacgg

SEQ ID NO: 116077 - DNA, 777 bp, Glycine max
  Peptide Sequence Number=SeqID_232855
atggtgggcatggccgccggcatggcgctcagcggccgcacggtctttaccgctaacgccgcgcctttcctgttcgcccgttctaacgagcagatgaaaaacgatgtttgctacacggaaaccaacgtgaaaatgctcggcctgaatgccggattcggctatgggccgctgggggcgacgcaccattgcatgaacgatatcgccatcgcccgcacgctgggcaatctcagcgtctatgcgccggcggatgcgcgacaagcggcagagattgtccgttatgtcatcgcgcaacccggcccggcctatatccgtatggacagcgacaagctgccggtgctgaacgcgagctatcacttccgccccggagagccggaggtgctgcatcaaggatctgacagcctggtgttttgcctggggacggtggcgcacgagtcgatgaaggtgctggaattgggcgataacccgaccatcgtctcgctgccttcgctctggccactcaatgaggcggcggtagtggcgttgatgcgttcgcaccgccgggtgctgaccatggaggagcacgccctcagcggtggcttgggcaccatcatcggtgagctgttgctgcggcatcagctgccgcggccgtttaccgcgctgggcgtgccggcttatgaatttacccacagcagcagccgggcggcgctgcggcggcaatacgccatcgacgccgcagggttgcatgctcagttaacgccatacggggaatgcgatggagcggaacgaatacgacgttaa

SEQ ID NO: 116078 - DNA, 225 bp, Glycine max
  Peptide Sequence Number=SeqID_232856
atgcgtattatccctcacgttttacaacgatctcgttatggcgaggctcctgtacaaatacacgttatcgctctggtgggttcgagagaaccaacacagggtaaaacaggcactgtcgaatcaaggctttgtcagtataacttcccttgcgggatacggtgtacagtgctgaacccaggacgtggggatctcctcttcgacatgccctgtcttgctcgcccctga

SEQ ID NO: 116079 - DNA, 402 bp, Glycine max
  Peptide Sequence Number=SeqID_232857
atggcgtggtttgatcatctgcttactcattttgcgctctatccggcacatctgtttgcgttgttattcgtgatggcgctgggtaaatcgacggtactgatctcctccgtgctgccacccgcctcggtgatgctgctggcgggcatcggcgtcagccaggggagcatgcatcctgggctcgcatggcttgccgtggtaatgggggcaacggtggggtcggtgctaaattaccatgttggccagctgatgggacacacccggctggtcacgcgtttcacgtctaagcatgccgacagcggggatgctcagctaagcgccgtgaaggtctatgccgtcagcctgctttctgcctgcgcgtgggcggcgctgtatgttggcatcgtcgctggcatcagcgtctga

SEQ ID NO: 116080 - DNA, 354 bp, Glycine max
  Peptide Sequence Number=SeqID_232858
atgaaaaaaatccttgatgacctagatgatcttgcaagccagatggataatctaggtttgaaaaaggctagtgatcttgtagctggatcaggatcaggcaaatttcctgcatgggagcacatgcaaatcgcaggagggaatggcgctttccctgtgaacgcgacagctggccatggtgtcgccattaacgatggcgtgttgctggagcttggactcgccagtcaaactggcgagttgatgttagggcactgtttgcccagcctacgcgtgcagcaggaagttgcagagagggacaggctttttgcagatgaaagcgccagtgccactggcgatttgggctgcagttgggagtag

SEQ ID NO: 116081 - DNA, 663 bp, Glycine max
  Peptide Sequence Number=SeqID_232859
atgactgctgtggcggcacggacggcagatttcggatccgccgcgattgagcatcgaccgtacgtccacgcctcttcgcagcacagcacatcgaaagaaggacgtggtcgcggactggtcttcgggccgtcaggcccacgttccaacgtaacgaaatggccgatcaggggcaaatcccgagcgcgtgacccgcccgagtttcagcggctgaccgggggattgcgagggcgtcggacattccccatcgatgcacgcgaacctcaggaaaggcgaccgccggcgctgaggatgctgcgcgtcacggtgaacttcggcgtgcgctcgagctgctcggtcggaccgatcagtcgcgtcagttcggcgcgatacccgagagcggagttgtacaccgtgaagagctctccgccggggcgcaggacacgcgcggtggcctggaacagacgggtggccgcgccggtgtggacactcgccccgaggtggaacggcggattcaacagcacggtgtccacactcgcgtccggaagctcggacgcggcgtcgtcgtgcatgaccgtgacccgctccgcgactccgttcgccgccgcggtcgcccgcgcagacgccgcgggcgccgccgaccggtcggtcgcgatgaccacggcgtcggggtgggtgagcgcgtag

SEQ ID NO: 116082 - DNA, 336 bp, Glycine max
  Peptide Sequence Number=SeqID_232860
atggaaggaaattgtagtgctgtcattcaacgcatccttcccccaaagcataaggatcccagaagtgtcactataccgtgttccattggtgaggttgttgtgggtaaagctctcatagacttgggagctagtatcaatttaaggcctctctccatgtgccaacgacttagagagatagagataatgcccacatgcatgacccttcagttggctgatcgctccatcacaagaccatatggagtgatcgaagacgttttggttaaggtgaatgtgatggaggaaaagagactagagaagaaggttctagaagttggaaccttgttggacccaggatga

SEQ ID NO: 116083 - DNA, 120 bp, Glycine max
  Peptide Sequence Number=SeqID_232861
atgacggtcatctctgtggcattggtgtcactggcacttgacatgaagggattttcagagattctgagagataaaaaagattgtgaaaggttgaatgtgataactgaaccgttgcactga

SEQ ID NO: 116084 - DNA, 458 bp, Glycine max
  Peptide Sequence Number=SeqID_232862
gagcaagagcctcgcttttgtcgaccacaccgccttttgtcgccatgactcaagagctggtagcccgcggagacaccttacggttatccgcacctcgtcattcagtgaccccaagtgtgattcacgagcagagaccaatatggtcatctgcgccctttccggagatgtcagcattttccgatggagactttccaagtctcacaagttatccagaactacgtcatgtgacgtgcaccctttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccttgtatcatccagaggcggcgggcccgatgatacgcggaaatacccgagtg

SEQ ID NO: 116085 - DNA, 1323 bp, Glycine max
  Peptide Sequence Number=SeqID_232863
atgtccaagtctctgccctactccaccaaagatgttgactacgacaacgccaagtttcgcccccgttctttcttcaaggttgctactcagaacttactcaccagtaacctaaggcgtgattgtggtagctgtagtacagggaagtttctgtttttgatattgatctttggtgttgcttatcttatgctggcacatacgagttcaggcggtgtagtttctgatgatgaagcaattgtgaatagaaacagttacgcaaatagcagcattgttaatggtgctggcaaaataaagaggttctggagacggccgccgaggcttcctcctagattatcgccggatgaaaagggaagtggtaatggaaatgaccatgtatcggggaatccggatgttgttaggtcaatgtggattgctaggcaaaagaaagtcaaggaagctttcgttcatgcttggtctggatacaagaaatttgccatgggttacgatgaacttatgccgctcagccagcatggaattgatggattaggagggttgggtgctacggtggtggatgctctcgacacggctatgatcatgggtcttgatgaggttgtggctgaagctggatcctgggttgaagaacacctttctgagagaattagtaaaaagggtcaagtgaatttatttgaaaccacgatacgggttttgggtgggcttttaagtgcgtaccatctaagtggtggggagaaaggaacgaacttaactcatgcaggacctaaaccagcagtttatctagaaactgctaaggatttggctgaccgtctgctatctgcttttacggccagtccaactgctattccgtttagtgatgttattctgcatgaaaagtcagcccatccagctcccggaggactgagtagcacatcggaagtttccactttacagcttgagtttaattatctcagtcagatatctggtgatcagaaatatagtttggaagcaatgaaagtcatggagcacatgaagactcttccaaagattgaaggactagttcctatctacattagccctcattctggtgagtttagtggagaaaatattagactgggatctcgtggggacagttactatgagtacttaatcaaagtatggcttcagagtggagcaagtagcaatagtaatacatcatacctatatgaaatgtataatgaagcaatgaatggtgttagacatcttcttgttcggaaatcaattccaaatggactagtttttgtcggagaattgccttatggatctaacagtaatttcagcccaaaaatggatcacctggtatgcagtactttctaa

SEQ ID NO: 116086 - DNA, 2307 bp, Glycine max
  Peptide Sequence Number=SeqID_232864
atgtcggtttcttgtgttaaaaacttcttccagaggttctggcaagatgaatttcaaacgggaaatattccccatggaagctttttggccaatgatgatctccttccatctcttggagctaggataaaccaggaaactagacttagaagatacataatctctcctttccatcctcgctatagggcttgggagttggtactggttgttctagtcatatactcagcttggatttgcccatttgagtttgcatttcttccttacaaggaaaatgctctattcatcgcagacaacattgtcaatggcttctttgccattgacatagtgttgacattctttgttgcataccttgatcgccattcttatcttcttgttgatgatccaaagaagattgcgatcagcttcctcttcaatcatagcagtgaacttggcttcaaagttcttaacatgtttcggttatggaggttgagacgagtcagttctctgtttgcaagacttgaaaaggacattcgcttcaattatttttggactaggtgcacaaagctcattgctgtgaccttgttcgcggtgcactgtgcgggatgctttaactatctcattgcagataggtatccagattctaaaagaacatggattggtgcagtgtacccaaatttcaaagaagaaaatctttgggacagatatgtcactgcaatatactggtccattgtcactcttactaccacaggctatggggatttacatgctgagaacacgagagagatgctgtttgatatagcttacatgctgttcaacttgggtttaacatcatacatcattggaaacatgactaaccttgtagtccactggaccagccgtaccagaaattttaaaatcttgcataattttcctgttagtttcatgagggacacagtcaaagcagcttctgaatttgcttcaagaaatcatttgccccatcgcattcaggatcaaatgttgtcacatatatgtttaaggttcaaaacagaaggactgaagcagcaagaaacattgaatgatcttccaaaggcaattcgttcaagcattgcacaccatctgttttttcctgtcgtgcaaaaggtctaccttttccaaggagtctcacatgatttccttttccaactggtttcagatatggaagctgagtatttcccacctaaggaagatgtgatgctgcaaaacgagtcatctacagaactttatgtgctggtttcaggggcagtggatctggttcgctacatggatgggcatgatcatgttcacgggaaggcagttgcagtagatgcatttggagagattggagttttatatcatataccacagcctttcacagttcggaccacagaactttctcagattttaagaatcaacaaaacatccttaatgaatgtcttacacgcaaatccaggagacgcacaaattacaatggataaccttttaatgagattaaaggggcttgaaggttttggctttgaatatccatgcacagattctggacggcttacacatgaagtgcttcaaggaggtaacacgagaggaaacttttctcacgagtgtactaataattcacctgagcattcattaatgcatgaaggagagtgcttagatattaggaactcggagaccagtttgcgtaaagtgactaatgatgatcatttagtccctaaacataacgtgatccttgagcatgttagaagagatcctcatgcccctgcacacaaagggaatctagacattgttgaaattctgcttggaagagatgcacatcctaacccaaattccatagggtggacacaaaaagctcgagtaaaacagccgaaaaacaagagcatttgtgaccaaaaaatgagttgtgaaaacgagaagttagatgaatatagaatagagatagcggagccagaaatccttgaccttgacagaaatggctccaccagaaacacaaggcaagatggtattagatctatcaagttcccattagagaaaataaatacaaactccaattcaagaaattctaactgtccaagtgatagagaatcggcaaggctcaccaagaagagagtaacaatccacttgctacaaagcaggagtacctcacggggtcagcatggaaaattaataatcctgcctgattcattacaagagctgctcaaaattgccgatgacaaatttggtggcttcaaccctataaaagtaattaatacagagaatgcagagatagatgacataaatgtcatccgggatggagatcatctctttcttctgtgcagcggtgatgaagatttgagttcatga

SEQ ID NO: 116087 - DNA, 321 bp, Glycine max
  Peptide Sequence Number=SeqID_232865
atggtggtggtggcagtgatcatgttagtggtgataacagtggtcatgatgatgattacggtggtgacgacaataacaatcatattggtgatggtggcggttgatgatcatgctagtgattgtaatggtaatcatgacacttgtggcgggaacgatcgtgataatggtgatagtcatagtgatcatagaaagagtgagagcttgaaagaaccaaaacaaagtagttcatttatggatagctggaggttgttgcctctgccttgtcaatttttggttttcggtatatgggttggattgacccaacaacctatagcttactaa

SEQ ID NO: 116088 - DNA, 356 bp, Glycine max
  Peptide Sequence Number=SeqID_232866
tgatcaacgggttcccatgaaccctaagagaataaaggtcattcctgagtggctcactccaccaacaccactcattgagttggtgagaaaccatgttccttcatgggaagatgcccaggaaatgggtgttgagggaaggagcccagagtatgatgaacctcgggatttgaggtcaaatcctttccaaggtggagggaatgatgcaatcctatcccgcaagggcattgggaatcttcttgaggaagcttctcaaggaggtgagcttagttatgagagggcatcctcttcaagcttcttatccaaggcaattcttggtggtgaagctccttcttccttggcttatttcctagtggatg

SEQ ID NO: 116089 - DNA, 489 bp, Glycine max
  Peptide Sequence Number=SeqID_232867
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggccctcttccccgggcgtcgaacagtcaactcagaactggtacggacaaggggaatccgactgtttaa

SEQ ID NO: 116090 - DNA, 605 bp, Glycine max
  misc_feature (576)..(576): n is a, c, g, or t
  Peptide Sequence Number=SeqID_232868
atggggtttggttatgccgcctggaacgtcggcattctacacggcaatgtgacagtgctggcggccgcttcgtactttatcccgattatctcggcggtactggctgcggttatgttgaagtcacacctgaacatcgcgttctggcaaggcactgccatggccgttaatccgacgacatcggggaaagacaggagttaccatgtcaaataccatttctgtagaagacgtggatcctttgtcgatggctacgtgctcagtattatcggcatcgccatgatgaaagtctcacctgcactaggtctgagcgcattctgggaaggattgattgccgcctcggcgctgatcggtatcttcttcggtggttttatcggcggtgcgctgactgaccgtcttggccgccgcgtactctatttcgttgggccgacgctgtttgtcgtctgctctctggcgcaatactgggtgcaaagcggtgaagtgctgtttgcgctgcgctttatgaatggcgttgccgtcgggattgaatacccggtcgcgaccgctttcctggtggagtttctgccgaagaaaaaccgcggnccctgcctcgcgacgctgactatcctctg

SEQ ID NO: 116091 - DNA, 414 bp, Glycine max
  Peptide Sequence Number=SeqID_232869
atggcatccacaaagagaaaaagcacagcttctagatcacaaactcaatatgacaccaggcaattccaatctttggaagcctggaacaaatacacagatagcattctcggtcggaatatccttccagagagaaatgttcaattatatcatactgagtttgatgagttcaaagtagaattggagaggcgtaatctacacaaatgcctcaccaacctccaggagggaagcattgatgtggcggttgtcaaagaattttatgccaacttgtacagccctaaggatcagtcacccaagcaagcacgactaagaggacatttgataaagattgatgcagacaacctcaatgaattccttgagacactagtggtactagaggaaggagagaccctacccactctagattctgcaggttga

SEQ ID NO: 116092 - DNA, 314 bp, Glycine max
  Peptide Sequence Number=SeqID_232870
cgagaattcgctaagcgcaaccttcagcggctaagcgcgaggaagaatccagaagaagatgagctgtcaagttcgctaagcgcaccgctccagatctgcgctaagcacacgagcatgaacaaggccacctatttaagcctgaaatcagatttgcaaagggagtttgacacttttcttgagaagctctacatgcacgaaggtgaaggagacctcctcaccacttgtgtttttgcagtctttcatcttattcttctctttgttgtaaaggaggtttccgaactatggaaagctaaatcctctgttggatcttccct

SEQ ID NO: 116093 - DNA, 347 bp, Glycine max
  Peptide Sequence Number=SeqID_232871
aaatactttgtaaggttgaagctcaagaggaaagccctgtaaaagagcatgagtcaagagaaaaagatgaggaacaagcacaacaacaatgggagaagtactcaacagtagaaaacaatcaagaaagtattctccaaatcaataaccttcctcatcaatggattgacaagaaaagaaggcaaggagagcatgaggaaaccttaagtgccattctttctttaatcactaacacctttcctgaaatgaattggaatgtacttctaaactacatgaagttcatggaatttctagctaaaaggagaaactgcaaggaagatgtgttctatgcgactttcatgccaccttga

SEQ ID NO: 116094 - DNA, 459 bp, Glycine max
  Peptide Sequence Number=SeqID_232872
atgctcgctaagcgtaatttgctccctatggcctccagaaagagaagaacgtccacttctagacctcaagagccttatgataccactagatttgtatctgaggtcacttggaagaggtacgagcagaacgtccactccagaaacatcctccttgaaaggaatgtggacctctacgccactcagtacgacgagttccgaaaagtgctcaagaggaggaggtggcacaaggccttgaccaggcaacctgataaccacattgatgtggccctggtcaaggagttttatgctagtttgtttgatccagaggataagtccccgatgcaggtcaaggtgcggggcaagttgattaagtttgatgcggcaactcttaacaagttcctagagacccctatagttttggagccaggggagagatactccacatattctaggttctgtcacatgcatccggacccatag

SEQ ID NO: 116095 - DNA, 171 bp, Glycine max
  Peptide Sequence Number=SeqID_232873
atgaaaaggaaagcaaagggtacttacttggacatggctcgcttggcggatttaatgcctcatgatgcaatagtggggttgcgcttagcgagatgctctcgcttagcgctatgccattctagagaaggttttaggcttagcgagatgacccgcttagcccaattgccatga

SEQ ID NO: 116096 - DNA, 528 bp, Glycine max
  Peptide Sequence Number=SeqID_232874
atggtggaaagggataaatttgatcatatagaggaaaggctaagggccattgaaggaggaagagttatggatagtgcccgatgtggttattcctccaaagttcaagatgaaaaattgttgatgcatttcttccaggaaagtcttactggggcaaccgtcacttggtatactaatatggaaccttcccgagtctattcttggaaggacctaatggttgccttcattagacagtatcagtacaattttgatatggctccggatagaatgcaactacaaatcatgtgtaagagggagcatagatctttcaaagaatacacccaaaggtggagggatctaatagctcaagtagtgcccccaatgatggagagagagatgataataatgatagtagacacactacctgtgttctactatgagaagattgatgtagctccatgtgaagcttgtaggccttggatcttcttcatcaatggagtcctttgcttcttgaagtttaatggcagcagaatgaagaaggaagaaagatga

SEQ ID NO: 116097 - DNA, 477 bp, Glycine max
  Peptide Sequence Number=SeqID_232875
atgaagatgaacatgaacttaggatcactcatttctggtcagatttcactcattgctcagtccaactcctcgcggcttggatttacagctttgattactgccttgtgcaaggcccgaggagtcacctcagattctcttaccttcgagtcacttaacctagccattaatttggcctatattaagaagaattgttggaacttggatgaaccttcagtcacttttccagggacccaaaaatccaaggctagaagatctgaggccccatctacatcagctgcctctactccccctacatcagctccatctacttctgctcttccttcaccaccagcagctccagttcttccagagcctgcatcagggccagctcctgatcatacagagtttgcaggatgtggtccaacagcggccagttatgagcttggaggagtttgttcagaagatggcctggccaggagtccagcggggatcctctag

SEQ ID NO: 116098 - DNA, 1230 bp, Glycine max
  Peptide Sequence Number=SeqID_232876
atgggaagtgtattagattttttcctaagaagttccacgaagcaaaaattgttgaccaagatggatttccagtatataggagaagaaataacggacgtatgtccacaattgttactcaaatacagaacacacctgaatgtcaaatggtgcaatcagagtacatcaatcaaatacatgtttaagtacatctacaaaggttcttatcagattacaatagatattgttaatgtgcagaaccaaaatagtagacagaatcaggttgacgatgaaattaaacactatcttgattgccggtatgtctcgccccctaaagcatgttggaagatttttgcattccctatgcatggacgtgcaccaacaattgaacgtctctatttccaccttcaaaatcaatggcctgtttactggacagatagtcaacaaattagggtagtactatccaagagtacaatcaaagaatcaacgtttacagcttggatggattctaataaaatataccatcatggacgggatcttacttatgctgaatatgtgtccaaattcatttatgttgcacacaaaagatgctggcaaccaagaaaacaaggaaatacaatagggaggcttatatgggtacccccttcaactagagagttgttctacatgaggatgatgctttcctccgttaaagggtcacaatcttacaaagatatcagaacaatagacaatgtcgtctaccatacatttagagaagcatgctttgcaaaaggtttcctagtaagtgatcaagaatttgttggtgctttaggagaggctaacacttggggaactccacacttccttagaaagttatttgtcaagctgctatttatgaataccatggatagaccagaatatgtgtgggaacaaacttggcaatggatggcagatgatattgtatttaatcatagaagacaagatgagcaggtttctattttcaataagattatgtgtgttgttgcaagtcaatcagggggagtttattttctctatggatatggtggaactggcaagacctttatgtggaaaactttatcatctgctatacggtttaatggaggcattgttttaacagtggcatcaagtgggattgcttcattattgcttcccggaggtagaacatcacattctaagtttgctataccagtgcttacaacacaaaattcaacatgcaatattcatcaagggagtgacttggctgaattgttgtag

SEQ ID NO: 116099 - DNA, 357 bp, Glycine max
  Peptide Sequence Number=SeqID_232877
atggaggctatgaaggagcaaatgatcacaatgatggaagccatgatgagtatgagaaaaatgaaggaggtcaacatggctacagtcattgccaaaagtatcgccactgaggtgaactcgactcacccatttggccttaatcaagccaaagaagagaaggttcaagcagctgatgactcgcttagcgaggtagatccgctcagcgagatgaatccgcttagcgaggcatccagctcgcttagcggatgggaaaccctagaagaggataagccagagatgtgctcacccagtgcacaacaagctcgcccagcgtggatgtcgtctcttctcgcgctcagtgcgcccactctcgcttag

SEQ ID NO: 116100 - DNA, 264 bp, Glycine max
  Peptide Sequence Number=SeqID_232878
atgagtcatggcccgagaagaatgaaaagaaaagctataaagaaagaagatccaagaaggcgtatattgcttgggatgacaatgactcatccgatggttcggagaaggagatcaatcttctatccaaggactatgaaagtgatgagaacatctctcaagaagtttaagtatgaaaaacaaaaggctgacttccatcttcaaagatctaggcacttaagtcatgaaaaagtcaggaagagtgtaattgattaccaaatgttgtaa

SEQ ID NO: 116101 - DNA, 324 bp, Glycine max
  Peptide Sequence Number=SeqID_232879
atggagaatgagtcatctgaggccattatcccagagccatttgatataggagaagaggcaaaagagacacaggtgagacaggtagctgctaccactcctaagcgatcccttaaggctacttcagagccttctgcaccaatggtaaatctaccttcacctcagcctgcagcagaaccttccactcctcttctacagatggcagaggacccaactacacctgtcctagctgtggacacttctcctcccgctactccagagcttcagctgaaagatgaggagaatggtcaaacacaggacacacaggaccagtcacaggaattttaa

SEQ ID NO: 116102 - DNA, 514 bp, Glycine max
  Peptide Sequence Number=SeqID_232880
acgatcgtcgacgtgcgtccgcggcagcggctacctcaagcccgggctgtacggtccgactttcggcgagcgcatcgcggcactcgaccccgctctgacacccgacctcgtcatcatccagggctccatcaacgaccgggcccagggcgccgacggctaccgcgaggcggtcaccgccgcgtgggacgcactcacggcgaagtacccggcagcggcgatcgtcgtgctcggtccggcgccgcacgaactgccggtcggcgcggagaccgcccgcatcgacgccgacctcgccgaactcgccggtgcccgtggatggtggtacatctcccccgtcaccgagcagtggatcaccgaacagaactatctcgacctcatcgacgtcgaggccggccgcaagcatccctccaccgaagggcaccgctatctcgccgagaagctcgctgcggcactcggcgaactgcgtgtcgcccctgtgacggaagcaggcgggtccgagagcacccccgacgagtga

SEQ ID NO: 116103 - DNA, 303 bp, Glycine max
  Peptide Sequence Number=SeqID_232881
ttctacgaagtgcctatcacctccaacaagggcatcagcccccctactaatcgagttttcatcaagaagtactgcgtctccaggcaggcacagggcgaaacaccacagcagcctggggatggccggcagtgggcaatagacgcaccgccatcacctctagagttcacctcaactcatccacaaaaaggtagcaagatgccttggacacgcatgtatgtagcaaaatacctcacaaaaatatacgtatgtttaggtagcaaaatacctcatgaaaaagagagagagcgagcaagaaaagaataa

SEQ ID NO: 116104 - DNA, 342 bp, Glycine max
  Peptide Sequence Number=SeqID_232882
atgcagtggttttttcagatttcgcacccttttgtgacgccgacggaggacactggtgagccgagacctgcgcctccccctcccactcatgatgatgacttcgtcgagccacctgtcgccgaggttccagtcgcgtcagatccccctacgcattatgtggttgattgcacagcatgtatcaggattggaaggattgctgagcatttggagcgtgtcatcaacctcaggatggtgactgcaaggactgacttatatgatatcatgaatctttgtctgaggatagttagagatgtcgacccaaatgacagtcctagaccgcgacagagacctcgcatagattag

SEQ ID NO: 116105 - DNA, 462 bp, Glycine max
  Peptide Sequence Number=SeqID_232883
atggacaaggtagaggcaattgtggctctgataccaaatgttagactaaaccttttaacctgtgatgttgcaaactacaaaagaaacacagtactaattaaacctgatatttctgaaccttatgaactcttaattgcattattgcaatgcacaccatacacaaagactaataagccagaacaagatccaacttttgtcaatactgaggatcaaagctatatgatgttgtcagtcccctcatcaaacagacagaacggatgcctcgttgcatttacacagttccatcatacttccaaccctaatcaagtttctttgaaatgcaaaaagctatatggttgcacaaagaacaggggtgcagatacaatcaaattcaaagaggggcaccacaaagccctcttacctcagagactatgtataagaaagaaagggagaaaggaagatgacctggaagctgacccatga

SEQ ID NO: 116106 - DNA, 861 bp, Glycine max
  Peptide Sequence Number=SeqID_232884
atgtatgtatttgttgtgtacccactacccaaggttgccttcaaacccaaatgtgcagggagaaatctgaataaagtaggtgtagcggagatgaggatgttgcggtggatgtgtggtaagactcgacaggataaaattagaaacgaagctattagagagagggttggagtagcgcctattgtagaaaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatgatttcaaagctcatttggagcacaaaatttcgtgctcttctctccctctcccttcattcatctccttcttcctccaagctcttatccatggcctcctatggtgtggcgtctcctctctctctccctttctccattccgctgccattcatcttccaagaagcaaaggaatccattgatgaagaagatcctaggcctacaagctccaatggagcttgcatcaatgtctctagtcaattcatctggcttgcttggtgcatggaattacgaatagaccaaattgagatgagtagaatcaatcaattgtttctaatgatattggtacattttgacttcccactgcatacattttgtggttaccctcctgagattgttaacaaaatgccaaaaaaggaacttgctgaggagcttctctttgtgtatgctataagagataatatcatcgatcctgttaaagacgaggtacttggtcctctgaatttttctgaaaaataa

SEQ ID NO: 116107 - DNA, 312 bp, Glycine max
  Peptide Sequence Number=SeqID_232885
atgacccttgagaaggcctactgtctagctaaagacaataaactaagcgctggttgggaggtgaagtcaacgataggaggggtgccaatagcaaaagagaagtgggctgcacgaagccacacgcctagcgcacatccgcgtgctacgtgcccaggtaccattacgctaagccatacacagaggcttagcgagatcaagcaacgtggagaagaaaagaggagtgcgctaagccactgggaaagccacaaaaggaaaatgcaccatgcgcttagccggcaacatcgcgctaagcgcgtgccagcagcaccatga

SEQ ID NO: 116108 - DNA, 429 bp, Glycine max
  Peptide Sequence Number=SeqID_232886
atggctcactcaatgaattacaatgtactactaaagaataaatacggtaagagtgaggactctacctggaggattgttaaggtatttagagtaccacttgatacaggacttctactttggcacaaatactttatcccgctcaagagaactagtgttggagtggtgatggcgatggctaccagagtggaggacaaggacaacaatatcatcaagcaactggtagtcactgaatgcatggtggccacactcatgggcaatgacccaaactccagtaaggatgcaaccttggacagcccagtagattggccatgccaagaaagagaaagggctgggaaggacgtggaagtaatgggtggcaacataatagaggcagaaggctatggtgaggtcgcaaatgaatcacatttcaaacttagggtgcacatttaa

SEQ ID NO: 116109 - DNA, 363 bp, Glycine max
  Peptide Sequence Number=SeqID_232887
atggtgcgttctagaatggataagatgcaggccatctgtaccactaacaaacactccgacgaagcctggtttctttggaagtggaggaaactctttggcatccaacacaacaatctctcatcttctgatcaatcagctgttagtggcttcgctaaaaaggttttaagaattgatttcttgctcactgcattcttttcaggtggtagtgatacaaaaattgagactgaggagggtaaagaatccacacaacaacaaacttgcatctggggaaaaaacgggggaaggatgttgatagtgagcggcaatcaaaagttgctaaggccaagggagatagcttacctatttatgttcattgatggttag

SEQ ID NO: 116110 - DNA, 365 bp, Glycine max
  Peptide Sequence Number=SeqID_232888
atgccaacaactcagaatattgctcctaggaaggtgccacctgtggctatcatcatctctcatcagaatcttggaggtgatgtaagttcaatttctagactcaaagctttgaagtggcttgacctttcaaataatgattttcatggactgattcctcctacttttggaaatttattttatctcaaatatctagacttgtcttcaaacaagtttaaaggttcaattcctccagaattgggtgctctaaggagcctcaaaacattgaacctttccaataacttgctggttggagagataccaaaggaacttcagggccttgagagtttacatgattttcaaatattcaacaatcacttgatggaagg

SEQ ID NO: 116111 - DNA, 219 bp, Glycine max
  Peptide Sequence Number=SeqID_232889
atggctgattctaaattactgatttatgagggattgacgaccatccacaatgtccttttgtgtagtgatcaagtgaaggtcgatgttgaggaagttcgagatgttgatgcttgtgttcctatacctactaaagagggacttgagggaccgctgaaacctgtagataggttggatcttgatgtcgatcccctatacctgatgacattgaccattccatag

SEQ ID NO: 116112 - DNA, 297 bp, Glycine max
  Peptide Sequence Number=SeqID_232890
atgagaccaatgccaattgcatggtcagagttagagaaatggagagaggaagaagtaaccttcttctgtggtaacccacggaagaaccttcttccgttgactctcgtggaagaagttcttccgtgtagttccacggaagaaggttcttccgcagttcttcttccgttgacactcacggaagaaatattctgcgggcatccacggaagaactttcttctgcagttgacgaaagaaggttattccgtggatgcccgtggaagatttcttccgcgagtgtcaatggaagaagtttgctaa

SEQ ID NO: 116113 - DNA, 192 bp, Glycine max
  Peptide Sequence Number=SeqID_232891
atggatgatggcataaaagaagaagtgttggagacttcgattgtcaccgagaggagtgattccaacaaggacaaagaagagggccatgacttggacagtacactagccaacacaatgaatggtgcttcttcttcggtagagagtccgtccaagaagcgaaggacaagcgaggctggaggagtggttttgtcg

SEQ ID NO: 116114 - DNA, 708 bp, Glycine max
  Peptide Sequence Number=SeqID_232892
atggagtgtgcgagaaaaaccatcaccaccaaatttatgaaatcatccaaattcttccccaaagtggttcgcatttcggtgacggatcaagatgccacagactcctccagtgatgaagaggcagaacgtgtcaaagtgaagaagatagtggttaatgaaattgtttgtgtcaacaacaacaaaaaaagacacaacaatgacaacagtggttgttgctattcaaccaaagataatgaaagtctcaaacaacaacgacagcaaagccttgtttcattaggtgaggagggctacatggacagcaaacaaagtctcaaacaacacaagtttcgcggtgtgcggcagcggccttggggccggtgggccgccgagataagagaccctttgaggcgaacgcgggtttggcttggcaccttcgacactgctgaggaggctgctatggtttacgacaaagccgctattaaattcagaggcgctgaagctgtcaccaatttcatcaaaccgccactgaaagatgatgccgtgtctcttgaaatatgtgagagtgttgttagcggaacgagttgtgcatgtgattcacccacttcagttctcgtgtttcagccttggatggaaccaccattgttggaagaaaccttcaaagaagtttttagtgggttaactgatggttatgatgatgtgatgatacttcattgcaatgatgagaagtga

SEQ ID NO: 116115 - DNA, 210 bp, Glycine max
  Peptide Sequence Number=SeqID_232893
atggagaagaagacagagagaagaagtagacagcgcgaaggagacgaaacatacctaggtatggtggcgaaagagaagaagcagagacttgtgacgatgctcaagtgcgatgaagacgatgctcgagtgcgacgaacacaatgctcagatgcagacagggaccttgaaggtagacggagattagaagaagaagagagcgcgaaagcttag

SEQ ID NO: 116116 - DNA, 201 bp, Glycine max
  Peptide Sequence Number=SeqID_232894
atgttgcggatgaaaccccagaggcgaaggcccacagcttctgcacgtaggcaacggaaagctacacctgttgttgaggatgttcagcatgtggatcatgtagctgacgaggggttttcaggcgggccccacgacacatcaattttgatggactatgttcatcatgtggcagtgactatttggaatggagagccatggtga

SEQ ID NO: 116117 - DNA, 240 bp, Glycine max
  Peptide Sequence Number=SeqID_232895
atgtattatgctcacttggctatgaaaaatatccatattagttttctcatgaggctagctcacttggcttacatgcaacaggctccagtacttttccaggggagtgggcattcactaaatcctaccaatagcctggtgttgaaagttctctctgcatctcctacaaccttttttgctaacccaaaatctaaagtgacaactcctccatcactcaatggaacttcaattatacaggcatga

SEQ ID NO: 116118 - DNA, 123 bp, Glycine max
  Peptide Sequence Number=SeqID_232896
atgtggaacttcctaacacccctccacagattcctcttagaacaggcaccaaccacagcgccacagacttgtccagcgaccaagagagagaaggcacacttcttcagctccttaaagaaataa

SEQ ID NO: 116119 - DNA, 318 bp, Glycine max
  Peptide Sequence Number=SeqID_232897
atgccgatctacccttgtggaggaatcgcacccacaaagactcccagtggacccggagaagtccaacagggcccttgggtttccagctctggttacgggcttctgttagtcctacagggtgcccgttccccccagcaagggatcgcacctgcaagacacccagtggacccgaagaagtccaacagggtcttggagttaccaactctgattacaggcctctgtcagttctacggagtgcctgtcgcccccagcaaggtcatcaggccccctactaatcgagctttcatcaagaagtattgcgcccccaggcaggcatag

SEQ ID NO: 116120 - DNA, 546 bp, Glycine max
  Peptide Sequence Number=SeqID_232898
atgtgcgtgtcggtggattgcgacaaagaagactctgaagaaggtatctacagcgacgtacaggcagcgcctagatcgtctgcggatcccagatgtctgctggatgctatatgcggagcaccgacctatgcaggactttcatccgatttcgtgcttctcgggacagctccgctgggggcctattgttgtcagatacagaccggagagggttatgcgtcagtaggctgtgtccagtgcattcctgcagaccctatccattcgtgggtgtcatatgatggcgtggacgatacgtggacgcactactcagaccatctggcggcagcatcatcggcattgacacatgcggatcctgatgcggacgagcccagacatgcagtgaaggcttgccatgcaatcgcggaggcgttggagcagcatctaaatgctctaggcacatcgacacatgaagaggtcatccaaaaatgcctcaggattgtcaggggtgtcacaaaagaccgcaatgtgtatgtgaggtctcgacgtaggcggtgcacggatcaacaatag

SEQ ID NO: 116121 - DNA, 399 bp, Glycine max
  Peptide Sequence Number=SeqID_232899
atggagcagtatgaaattctagaacagattggcaaaggtgcatttggttctgcccttcttgtgaggcacaagcacgaaaagaaaaagttaaggtatgtccttaaaaagatccgccttgctcgtcaaactgacagaacccgtagatctgcccaccaggagatggagcttatatctaaagttcgaaatccatttattgtggaatataaagattcctgggtagaaaagggttgttttgtatgtatcatcattggctattgtgaagcaggggatatggccgaagctataaaaaaggctaatggtgttaactttcctgaagaggttgatcactcttgcagcaactccttttcacatatgagcctgacagtttttcattcctatttccgagctctttggaactaa

SEQ ID NO: 116122 - DNA, 888 bp, Glycine max
  Peptide Sequence Number=SeqID_232900
atggccacaataaattttatgaccttgaatcctagtatttctggaactgaacaaatttctcagtgttctactgaaagagctgatggattatccacttgttcagaagagaagatctatgaactatctgtaggttgtgttcgtggcaaatacaaaactgacaaatcaaaagccacaaagttctcaaccgttgagagaacaccaagatctagaggagttacagtttctgccactaccaaaaggcaaacaatggcaacatcaaagacaacccattctggtccaagtgattcacttccagcatctcatgcaccatctggaaaattttccacaccaccaagagccagggcaagggcaacaccaaacttgtacactaatgttcttggaagtgtagactctcttgacgtttccattaatgcaccgcgaattgacaagattgccgaattcccaatgactttctgcgaggatcctttttcacctatccgtggaccatcatcaacatctgcacgttgctcttctagctcagcaggaagtactgctgattgctccatcacaaaggacaagtgtacaatccaggaggacaaagttattctccccacaagtatcactaatgcttgcccgggtccaaagggcactgaatgctctcctgagcacgtaaaagcttgtgtttcaagccattcctctgctgacttagatcagcactggtttgacacctcgtcgtaccagcaacgagcagaggcactggaggggttgctggagttcagtgccaggctcctacaacaagaaaggtttgatgagcttggggtgttgctgaagccattcgggcctgagaaggtttctccaagggaaacagctatttggttgactaagagctttaaacaaactgcggtctaa

SEQ ID NO: 116123 - DNA, 1131 bp, Glycine max
  Peptide Sequence Number=SeqID_232901
atgtccattgactcttccaagaacttcatctactttgctttcctgggaactcctactaaaacacatgagaaactacaacagaaatcttatcttactagggccaaagcacctgagaaggccaaggagattgacgctgatgtgcagaagcaatggcaagaagcagattatcaattggaggatcttattaattgtctgctaccagttcctcccatcagagatatcacacaggtttggttctcaacaagttcaacctgcaagatccaaattccagggataaggggaagtactgtcagatccatattctggggagaaggaaactacaatacccttgttgaggagaagaatggagaattccatggtattcttgaaggaggaaaccagcgatttcaattgaaagcaactaaaccagaaccaagcagcggccatagtagagttttgtgttcagaagagtcatggaaacaggtagctgaagaagcaaagaatcttgagaatgaacacgtgaatggacaaaggaattcaatgcagcatgtgactaagtgggtggaggagaactcaaacgggaaggagtgccttgcagtggcaatcaaactaaggattttgaaaagactggtcagcccaccaccatctccagaaccaccaaacagcaaacacacaattgccctagaggaagacacctctgttaaggaggagctgagagttgtagaagctattagtgaaaattcagatgatgaaggcactactctagaggagttatatgccgaagatgccccacacaaatacctgatgggggtcaaagtgactgtgatcaaggagaagctggttgttgaagactaccccaatcaaagaccacccaaacccaagggtacaaattggatatttgtttcagaatgcaatatcaggtttcatgcaacccttgcttggcgagcttcacccagctcaatgcaaggtcagaccctgttgaggccagccacgacacatttggccccaacaaaaaattcagacaaaggagtgctaatagatagccaaagtgggtttcagttgatagtgaagtccattggaagtcttttgacaaaaaatgcgaattgggatgaaaagcaggcattgttaggatgtatagagaggatggaataa

SEQ ID NO: 116124 - DNA, 1113 bp, Glycine max
  Peptide Sequence Number=SeqID_232902
atgaactacctgtaccctgtgaaagaagagtacttagaatcgccgccaccatcatcgtcgtcgccaacaacaggagttgatgagtcagcaatggttcctcctccgaggccaatggaggggcttcacgaaatagggccacccccatttctgaccaagacttacgatgcagtggaggaccccaccactagccacatagtttcatggaacagaggaggtgccagctttgtggtttgggatccacacgctttctccagagaccttcttcctagatacttcaagcacaacaatttctcaagcttcgtcaggcaactaaacacttacggttttagaaaaattgatccagataggtgggagtttgcaaatgaaggattccttagagggcacaggcaccagttggcaagcataaggagaaggaaacaaccttctcggccttattcttcttcttcttcttctcaacaagcacaaggtcactgtgttgaagttggtcgctttggacttgatgaagaggttgatcgtttgaggcgtgacaagcacgtgctgatgatggagcttgtgaggctgagacagcagcaactgaacacaaggtcataccttcaagcaatggaggagaggctaagagggacagaaattaagcagcaacaaatgatggctttcttggctagagctttgaagaatccaacttttattcagcagctacttcagcagaaggagaagaggaaggagcttgaagaggccatgtccaagaagaggagaaggccaattgagggagggccaagtggggttggagaaccaagcagtggaggagaagaaggaagaagcagtgttaaggttgagcctcttgtgttaggtgaatatggttttggagtgtcagagttggaagtgttagctatggagatgcaaggttatggtaggggaaggagggaacaagaggaggagcctgaggcactagaatcacaagagaggctggagaaagagcttgatgaagggttctgggaagaacttttcagtgagggttttgagggtgaattggatattccaacttcccaagaccaagatgaagatgtcagtgtgttggccaatcgctttggttacttgggttcaagtcctaaatga

SEQ ID NO: 116125 - DNA, 630 bp, Glycine max
  Peptide Sequence Number=SeqID_232903
atggaggttactggtggttattctagcaacagggagcagagggatgacatgttggaactctcagagacacttttcaccttcactttgccaagtgaagttgcacttaacaatcttggaagtgtttatgttgactgtggtaaattggacttggctgctgattgttatatcaatgctcttaaaatccgacacacccgagctcatcatggtcttgctcgcgttcattgtctgaaaaatgataaggctgcagcttatatggaaatgaccgaacttattaagaaggcaaaaaacaatgcatctgcttatgagaagaggtctgagtactgtgatcgtgaacaagcaaaggcagatctggagatggtcactagattagatccacttcgggcctatccttatagatatcgtgctgcagtattgatggacaaccacaaggaagaggaagccattgcagaactctctagagctattgcgtttaaagctgatttgcacctcttgcatctacgtgcagcattccatgaacataaagaggacgtcttaggtgcgctaagagactgtcgtgctgctctctcagttgatccaaaccaccaagaaatgctggaacttcatagtcgagtcaatagacacgagccatga

SEQ ID NO: 116126 - DNA, 3309 bp, Glycine max
  Peptide Sequence Number=SeqID_232904
atgtggatgcagttttttcgggcaaacaattccattcacccattattcaatggtggaagagccagtgcaactattggcaatggcacggcttgctcaggacctaaaactgttggaagatggttgaaggaccgaagagaaaagaagaaagaagaaaacagaacccacaatgctcagttgcatgctactatatcagtggctgcagtggctgctgctgtagcagccattgcggctgcaacagcaggctcatctgcaccaagcaaggatgagaagatggcaaagactgacacggctgttgcttctgcagcaacattggttgctgcacagtgtgtggaggctgctgaagcaatgggggctgagcgtgatcaccttgcttctgtggttagctctgctgtgaatgtccgttctcatgatgatatcactactcttactgctgcagctgccacagctctaagaggggcagcaaccttgaaagcaagagctttgaaggaggtatggaatattgccactgtgacaccactagaaagaggcatagggggaattggactatgtggtaaaagtattaacagtaataccagtaataccagcaataccagcactagtgatagtggggaaattttcaaaggagaaaattttccagggtcctgcagccaagatctacttgctaagggcagtgaattactcaagcgcacccgtaaagatgttgtgttagatatatgcgcggatttaccagcatggccaggaagacatcttcttgatgatggtgaaaagcgacggtactttggattgaagacagatgcaagagggattgtggacaatgaggaggacaatgtaaagagcaaggcctccgggggaggaaacgaagaaaagagcgatggggcgaacgaagacgacgacggaggcgacggcgatggtgaggagcaactgaatggtgaggatggtgtagaccttgcgaatgaaggcccaacggagttgagggttctcaagcatggcggggtagagtggcctgggattggcattgccatccccaccgctttcaacatctcttttcatcaacatgttttctttctttcctcagtgcttagcctactaaaagggtgtggtgctgttgtggagatccgagatttgtttcgtctcttatgccccatgaggagtttcttccctgctgaatcctgtaaagaggctcacccaaatgctttgaatcctcagtcttggcttcatattgaaagagggaaacttcccaagttgtcatcacacccctcatctgcctcaattgaatctctgatcaaggtcccacagccagctatactgcctttctttaagcctgttgattatgtggaagttttagctcgaatccatgaagaactcgagtcttgtcctccgcaagagagatcaaacttgtttttgttacaataccaggtcttcaggggccttggggaagttaaattgatgcgtagaagcctccagggagcttggcagagagctcacactgttcatgagaagattatatttggggcatggctgaaatatgagaagcaagaggaagagctaatggctgacttgcttgcagcttgtggtaaatgtgcgaaggagtttgcacctgtagatatagcatttcatcttccatttgatgtaaatgcaagttctgaggggagaacgaccaatgagaaccgcatttctcaaaatgttacttttacgattggaagtgaaaagatagtttgtgatagacaaaaaatttcagaactttcagcaccatttcatgcaatgctcaaggggcatttcagtgaatcactctctgagacaatagatttgtcagaaaacaatatctctccctcaggtatgaaggcaataagtgatttcagtttgaatggcagtttaattgaggtccctccaaatcttttgttggagatattagtttttgcaaacaagtattgttgtgaaagacttaaagatgcttgtgatagaagacttgcatccttagtttcctccaaagaagatgctgtggagctcatggaatatgctcttgatgaacattcaagtgtccttgctgcatcttgtttacaagtccttttgcgtgaccttccaaactgtatgaatgacaatcgggtggtggagatatttgttcatgctaataagcagcagctagaagtcatggttgggccaggtatatttgcacttttctgtttcttaagtgaagtttctatgaaccttaattctagttcagacacaacagctcatttcctggaacggttagttgagtttgctgagaatggcaagcagagacttctagctttacatcaattgggatgtgtaagactcttaaggaaagaatatgatgaagcacgttgtctttttgaaggggctgtaaatgcaggccatatgtattctgtggcaggtttagctagactggactatataaagggtgacaagctgctatcttatgggcaacttagctcagtcatttcatctgttacttcacttggatggatgtatcaggaaagatcactatactgtgacggtgacaaaaggtgggaggaccttgagaaagcaagtaatttggatcctactcttatatatccttacatgtacagagctgccactttaatgaggacacagaatgctcatgctgcactagcagaaatcaatcggattcttgggttcaaactttcactagaatgcttggaaatacgattttttatccacctttctcttgaggactataaagcagctctatgtgatgttcaaacaattcttactctgcgttcagattatagaatgtttgaggggcgtgttgctgcatcccaactctgtactcttgtgcgtgagcatgttgaacgttggacaactgcagattgttgggcacgattatatgattgttggtctgcagttgatgatattggatctctatctgttatctaccagatgcttgaatctgatgcagcaaaaggtattctatacttcagacagtcattgcttctcctaaggttgaactgtcccgaggctgctatgcgtagtttactgttagctcggcaacatgcatcaagtgagcatgaacgacttgtatatgaggggtggatcttatatgatacaggtcattatgaggaagggctccagaaagctgaagagtctattgacatcaaaagatcttttgaggcctttttcctgaaggcctatgcattggctgactctagtatagatccatcatgttcaccaactgttatttcacttctggaagatgccttgaagtgtccttcagataatctgcgcaaaggtcaggagagatctctccaagggtttccccttcgtaaatga

SEQ ID NO: 116127 - DNA, 450 bp, Glycine max
  Peptide Sequence Number=SeqID_232905
atgttgatgaaaagagatgttgaaagcggtggggatggcaatgccaatcccaggccactctaccccgccatgcttgagaaccctcaactccgttgggccttcattcgcaaggtctacaccatcctcaccattcagttgctcctcaccatcgccgtcgcctccgtcgtcgtcttcgttcgccccatcgctcttttcttcgtttcctcccccggaggccttgctctttacattgtcctcctcattgctccattgataactgtgtgtccgctttactattaccaccagaaacaccctctgaattacatccttctcttcattttcaccgttacgttagcctttgcggttggattgacttgcgcctttactagcggtaacatctatctcgtcaacattctctcttcttttatagcgtacgaagaggaggatgtcaggcaggctgtttgttcttaa

SEQ ID NO: 116128 - DNA, 255 bp, Glycine max
  Peptide Sequence Number=SeqID_232906
atgatgatgtccctcagtgccatcatcaataccactaacccccttaacacaactcatgaaatcgccaagcagattatcaattccaatcccctccttgccttagcaatccctccaaaatcaccgcaactggcccctctctaccaatcattctcatggacaatgacaacaactccaactccaatattgtcaccacgctttgaggagatggcaaagaaggaacctggggctcgacatgccgatgacgatgggtattag

SEQ ID NO: 116129 - DNA, 432 bp, Glycine max
  Peptide Sequence Number=SeqID_232907
actttgaaccacttcacttctgcttcactcaagaaactcccttccatgatctattcatggcaatgggatttctatgctacgtctaatcacaccttctcttttatgatgatattttcattctctcgcttcttcttcacccatcatgtagaccccatcattgaagaggttgacttagacactgatgctatgtttggctccatggatcatgcccttgttgagaaaaaggctcataaatggtctttaattggagacttcttttacaagaaagcaaatggatggaaacctcctcactctcccacgtctccaggtagccctcttaccatctcctttgataatctggcaggaaaacatcaaagtatgaagaaagtagaatctaagggggagctcttatgcctgaaggaagcacaatctaagggggagctcctatggtga

SEQ ID NO: 116130 - DNA, 201 bp, Glycine max
  Peptide Sequence Number=SeqID_232908
atggagctccagatgcacgcatacatgcagcatttggctgatcagcaggcagcaaaccataggggccaaatgcagtggaatgacagctcctatcagtatacactgcaccagcatcgccaggaccgtaacccttacttgtggcctactcccgagcagatcagagccactattgcatggcctagggacaggcccaatttttag

SEQ ID NO: 116131 - DNA, 330 bp, Glycine max
  Peptide Sequence Number=SeqID_232909
atggtggattttatgctctatggaaagcaacacctagagtcatctgataagaagggtttggtcagtttcctaaggattgccaatctcatgtacatgtgcagactcattcacagttttttgattaacatagtcatgcctagattgggatcaagagactatcttcaagcgtttaaggatagattccatgccaagaacaagaacaactatattccttatggaatacttttgactcagatcatgaggaatagtgaaccagaaggtagtaatcgattaccagtagccaggattgtttttcaaactgatttacaaagctgtaatcgattaccatga

SEQ ID NO: 116132 - DNA, 332 bp, Glycine max
  Peptide Sequence Number=SeqID_232910
atggagagaagtatgatagatgctggcagtggtggagtccttggagacatgacccctgctgaagccagaaatttaattgagaagatggcttcaaactcccaacaatttagtgccagaagtgatgctattgtcattagaggagtgcatgaagtagccatgaattcatctccatcagctgagactaagaagcttgaagacctttgcccttctgtgcaacaatctgaagcaattgaacagcctgaagcttatgctgtaaacatctacaacagacctcctcaacctcagcagcaaaatcaaccacagcagaacaattatgacctctccaacaacag

SEQ ID NO: 116133 - DNA, 339 bp, Glycine max
  Peptide Sequence Number=SeqID_232911
atgttgaagaactgggtcttgaaaaagcataacaagactttcctagattggtttaaagatacaatctttactgatgaaaatgcttttgaaacattaagaaagttagcagatgagcctaaaagaaatgttataacttggcaaggatacaatataaacaagtattccttttatacaaaagcacaagacaagaaaagtataatgcaaaacagtggggtcaccctaagggctgaatctcaacactttgtacatgatgacaatccccatgtagcttccatcccttactttggtttcattgaagaaatttgtgatgcaatcctaccccctaagggcattggatag

SEQ ID NO: 116134 - DNA, 280 bp, Glycine max
  Peptide Sequence Number=SeqID_232912
atgcctcagcagcaagtgcctagtctctatgagcataccacaaagctggaagagactctagctcagtttatgcaggtttcaatgtctaaccagaagagcacggagtctgccattaagaatctagaggctgatgaaggaaaagctgagaagaaggtggaggagcataaacaacatctggtagctgagttgacacttgaacccatttctgattttgttgaacttgaggaagttgtggaagatgaagatgaccaacatgagagagagacaccaataaaagaga

SEQ ID NO: 116135 - DNA, 240 bp, Glycine max
  Peptide Sequence Number=SeqID_232913
atggcaggtgccgatagccttgatcagcaaacggaggtattcatgaaggcaatgctcaagactggagtggacgttcttgcggttctgtggggccaggtgggggaacggacacgccatcgacaagaagttgagtgggaccgaagcgttatgccgaaaggcccgcatggggcggttcaagtccgctccccccacaccagttttcctatggccaacccaaggggccggcaaaatggcttatag

SEQ ID NO: 116136 - DNA, 160 bp, Glycine max
  Peptide Sequence Number=SeqID_232914
tgtagtttacaaaagcaaaggtgaaacgaaagatattgagctggtagaggaggaacaggcacagattggtgctgattcttctagtgagacctccaataaatctgagaattataaggaggaagcacgaaatgcaacacagaagcataaaccaagagggtag

SEQ ID NO: 116137 - DNA, 657 bp, Glycine max
  Peptide Sequence Number=SeqID_232915
atggcgaagactaatgcagagcgtaaagcagcccaacgcgagcgccagcgactggctggtattgtccctgtcgaaatcaagctagatcagcaagaggctgagatgttacgagagaattgtgcagctcgccggccacaacgcgaaccatacgacctggatgaatacatcacaatgctgatcaggaaggataacgccgaattaaaaaagcagctggcggcacggaataaacggtgctgcggtaagtgcaaagacaaactaccaggtgacccagcaggttgttatttccttggtgattctgagtgttggcaaacctacggatggcatgaaaccaaattaacaatgttgacacttgaagaatgggctgcggagcgataccgcagcaaaccgccctctcttaataccttgcggcgttgcgctaaagaggggcacttcgccccgcccgcacgtaaagaaggcaagttatggcgcgtgcgagaagatgctgagctagttggcccactcaccactccggtcattaagcacaacgataatccgaagcttcgaaggatattgaacgatggcagccagaccacccgcaaggccaataaggtctactggcgataccggcatccggttacagggaagtaccacgctcttggtgacaatgagcggaagctc

SEQ ID NO: 116138 - DNA, 397 bp, Glycine max
  Peptide Sequence Number=SeqID_232916
cctgcccaccctggaaacggctcagccggaggtagggtccagcggctggaagagcacccgcacgtcgcgtggtgtccggtgccccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 116139 - DNA, 174 bp, Glycine max
  Peptide Sequence Number=SeqID_232917
aatccacaactgtataacaaagatgctgagatattgaccaccgtgtgctatttcagatacatgctttatatacaaggggaagttgtcattaaacaccctaaacacggtagcatcccacataacctgcaacagcttcaaaaaaagttgtgggatggtcaatgtcatcagatataa

SEQ ID NO: 116140 - DNA, 580 bp, Glycine max
  Peptide Sequence Number=SeqID_232918
atggtcattcccaagttcaaggtgccgaactttgacaagtacaaggggactacttgccccgataaccatctaaagatgtattgtcggaagatgggggcatatgctaaagatgggaaaccgctgatacatttcttccaagaaagtcttactggggcagctgtcacctggtatactaacttggaaccttcccgagtcccattcttagaaggacctaatggttgccttcgttgggcagtatcaggatctggcagccccaagtggcaccccccaatgatggaaagggagatgataatcatgatggtagacacattaccagtattctactatgaaaagatggtgggttacacaccttcaagctttgcggatttggtcttcgccggtgaaaggattgaagtaggtctgaaaataggcaaatctgatcatcctgctttgataaatgaaaaaactggtgcaaataaagaggatgagaaggagggagaaacctatgtagtgactgccattcctataggtccaagtttcccaccaacccaacaatgtcattactcagccaataacaacccttctccttacccaccagcca

SEQ ID NO: 116141 - DNA, 210 bp, Glycine max
  Peptide Sequence Number=SeqID_232919
atggatctattttctatcaaccaatacaaaatcgacagcctcattgttggaagtgccaagtatgtaatcaggcaaggaaaggggtggcttgccatagataacctcaaagggagtgagtcttgtgctagaggctttcaggatcatggtatagccttgggaagaaggcaaggcaatgaaaaatccaaggagacatcctcccatactgcatga

SEQ ID NO: 116142 - DNA, 549 bp, Glycine max
  Peptide Sequence Number=SeqID_232920
atgtacggagtgctcacgctgatcttactttcaggtgccgtgcatctatttttaaaaagccataaaaattgggggtacggaagggtatctaccttcaagtataaggattttgcggccaggcttattaacattctcctactcggtttttgtggggtgttttgctcattcgcctatgacatcatgattgtttccaacgatgcccctgggaaaacgcaattcgaggtatctacctatatttgcaaagctgggggattgatgttggcttatattgctttgtcaaaaagcttgaatccagacttaactaaggcggatttacgcagattattaaagagcgaaaaaagtgcggctgacaccaacccagcgaacagccgccaaaactacacacagcataaatttttgccggatatctgcgcttgctttcgttgcagtgccgccggcgcggcgcataaggtgtggcgactggtaaacaacgcccccaaagttttcagtctgaccacatcggtatgctcactcatgagtttcaggattctcctccgcttccagacttaa

SEQ ID NO: 116143 - DNA, 324 bp, Glycine max
  Peptide Sequence Number=SeqID_232921
atgcacacacgaagtttcacaaatccacaattccttagaataggcctaactcacaaaaaggtccccagtggagtcgccaactgtcgcaacatgcccttcgcgggcgagcgagggcgaggctcacgggtgcgctttccaaaggaggaaaggtgcgcagagtcgccaccaacgtttatttgtgggaaacgtcggaaaaaccgaaggataccggtcaaaatgaaaattctaagtttgggagttgtatttacgcttgaggaaggtcgacaaaagcggggctttagctcctacgtaccctcctttggagaggaaatcagacctacgtag

SEQ ID NO: 116144 - DNA, 285 bp, Glycine max
  Peptide Sequence Number=SeqID_232922
atgtttgcaggaatgaaagttctagtgaccaatacatcaacaccctatcatagaggaggtatgatgaatgcatcagggcatgtttatgctatgcgcgataaatgcgtttatctacggacacaagagcttggaagaccatctcttcttaccaacaatgcattgggtatcatggttcatttgcagtcattaccatggtgcccaatgcatgccattaagaaggttaagcatactttccgaattcccatgacgaagatgacgaaaacaaatgcaagacatgagcaatga

SEQ ID NO: 116145 - DNA, 492 bp, Glycine max
  misc_feature (405)..(405): n is a, c, g, or t
  misc_feature (418)..(418): n is a, c, g, or t
  Peptide Sequence Number=SeqID_232923
atgctaaacatccaaaatctcatttgtggttatgagaaaatttcatcagcagattctccttccccggtagacacattattttttgtccgaaaagcatatgttgatctgattagttggaagttttatctctttactaaagcacgttcgcattttagcgaagaaaacatcgagactatttctagtctcacaagttatccagaactacgtaggtctgagttcctcattggaggatacgtaggagcaggagcctcgcttttgtcgaccgcaccgctttttgttaccatgacccaaaagctggtagcccgcggagacaccttacggtcatcctcacctcgtcattcagtaaccccaagtgtgattgacgagcggaggccaatgtggtcatctgcgccctttccggaggtngtcagcattttcntggtggagactttttcaagtctcacaagttatctagaactacgtaggtctgagttcctcattgaggatacgtag

SEQ ID NO: 116146 - DNA, 261 bp, Glycine max
  Peptide Sequence Number=SeqID_232924
atgggtgccaagtacctcgaagtggtcaaacaagggtcgcatcccaacaacggatggtccctggacgaaattaggatgcagaatgaccataatttgtctctgcgtgttattggacatgatcgagcctgggcggcaagacacagaatgaccataatttgtctctgcatgccaccgaacacgatcacctctggatggcgaaaaggtttgcggaatgaccataatttgtctccgcccaactctcgacttactgtccccgaatga

SEQ ID NO: 116147 - DNA, 188 bp, Glycine max
  Peptide Sequence Number=SeqID_232925
aaaatagagtagatgatcatggtgatgacaaggaaggaggaataggtgttgtgggtgcttcagatggtccgtggcggcgatggccagcaacagcggtggtggaggacggagatatgaaggtttggagattagggaaaaagaggcacatcgagaggagtttggttgcacaatgtgactggtttacgtga

SEQ ID NO: 116148 - DNA, 252 bp, Glycine max
  Peptide Sequence Number=SeqID_232926
gcgcagggtgatgcaccgcaggccgcagatgcaccgccaccacctcatcaggctgatccggctgggtcatttggcatggagcgatacttacagcacttggtttgccagcaggcagccaaccacagggcgcatgtgcagacccatgactgtctctaccagctcagtctcagtctacagagccagggtttcgctcctttttcgtgccctactccagatcagtttagggctgaggtcgcatggcccggggattag

SEQ ID NO: 116149 - DNA, 375 bp, Glycine max
  Peptide Sequence Number=SeqID_232927
atgtcgatgtacacaaaattattgaaggacctcctcaccaggaaaggcaaatacatcaacaatgggagcatagttgtggaaggaaattgtagtgcgatgatccaaagaatttttcctccaaaattcaaagaccccgaaagcgtgaccattccttgtttagtaagggcagtatttgtggggaagactcatattgatttaggattgtcgcaacatgcccttttgcgggcgtgcgaggcgaggctcacgggtgcgctttccaaaggaggaaagatgcgcggagttgccaccaacatttatttgtggaaaacgtcggaaaaaccgaacgaaactggtcaaaacaaaaattctaagttcgggagttgtatttacgtttga

SEQ ID NO: 116150 - DNA, 216 bp, Glycine max
  Peptide Sequence Number=SeqID_232928
atgttccccgccacctacattcttttaatgtgccttctaagttccttctcacccacaatcaacgctcttcttaacctcactttaccccaccaacgccctcacctcgaatccgtcgtccacgatctccaacggaaggtgaatgcctcactatggagaagggaaatgttgtcaaccccgttcctgacaccctctgccattttccagtacttcttgtag

SEQ ID NO: 116151 - DNA, 624 bp, Glycine max
  Peptide Sequence Number=SeqID_232929
atgactactcaatccaatatcgttcgggtaaatcaaaccgggctgcagacgcattgtcgagaatccctgaagctacccatggctcctgtttcattttttgcatttcggcaagccattcagactgacccttctactcatctggattgttccattgctcaggatctaattttacagaaaggtcgtgtttggttgcctaatgggcttcacttcatcagaaccttgctggaagaattccatacgacgcccacaggtttattgtgcccattgtcggttccttctgctccttgggaggacttatccttggactttattatggggctccctacatatcaaggacagaccacaattttggtcgtggtcggtcgcttctgcaaaggcatacacttgggcatgttacaccctcactacactgcctatacagtggcactccttttcatggatattgtgggaacatcgaagattgatgcagtgggtgatagattaaccaataaggaagctttgctcacaagcttgcgaaggaaactccttaaggcacatgaagtgatgaagctcaatgttgatattcatcgacaagaagtgagttttaagactggagattgggttatggttaagctacacccttag

SEQ ID NO: 116152 - DNA, 495 bp, Glycine max
  Peptide Sequence Number=SeqID_232930
atgcacaaagtcgccgatcagatcaccacggccacccgcattccgctgctgcatatcgctgacgccacggcacaacgcattcgtcaggccggcgtgaaacgcgtcggtctgctggcgaccgcgttcaccatggagcaggaattctataaaggccgccttgagcagcaatatgacatcgaggtgctggtaccggacgctcccggacgtaaaacggtgcacgacattatttatcaggagctgtgcctcggcgtgattcgtgatgagtcacgcgcgcagtaccgtgacatcatcgctcagctggtggcacaaggggctgaagccattatccttggctgtaccgaaatcacgctgctggttaaagcggaggatgcggcggtgccgctgttcgataccacattaatccatgcgcaggacgcggcacaacgccgacccgcatggtcgcacagggatgtgccagaactggctgccagcactggcagccttttttgtggctga

SEQ ID NO: 116153 - DNA, 579 bp, Glycine max
  Peptide Sequence Number=SeqID_232931
atgatgatcgcgaccgccgcgctgctggctgaacaccagctgtttgccagcggggaaattattctcagcgccggcggtggcgcgtggtttgatgtggccgcggcctgcttcagcgcggcacagttgccgctgccggtcacgccgctgattcgatccggtgcgtacatggcacatgacagcggcttgtatgcacgcattgccccctttgcgcagccgggtgcaacgcaccatttcagcgccgcactggagatctggggccgcgtgttatcgcgtccggagccggggctggcctttgtcgatttcggccggcgcgatgtgccgttcgatcaggatctgcccaatccgctgtggattcgtcaggcggacggcagcgcaccgcgcgcggctacgcatttgcgcatcaccgacgtcaacgatcagcacgcttatttgcagttaccggcggacgatccgctgcaaccgggcgactggattggctgcggcatttcccatccctgtaccgcatttgacaagtggcgttatttaccgttggtggatgatgactattgcgtcaccgattcactggaaaccgcgttctga

SEQ ID NO: 116154 - DNA, 360 bp, Glycine max
  Peptide Sequence Number=SeqID_232932
atggggataaggggttgtatcaactataattttgtcatcgcaataagacagcttggctatcccatgaggggagcaccgtcggtggagagcctcacacctttcgtaacacggggtttcagtgaccccaacgcaaggatgcttcaaggagtccacaaggcatgggaaaaggtgcaaagaaaagacagagaacttaggggaagtggcaacgggatcattggcgactatcgtaagtggctgagagccaacacacaaggtctggattggctcctgaagctgagagccgctaaggaggaggaggctgaagccccagaagaaagtgaagaggtgcaagccctcaaagtggagcttgagaaagcctaa

SEQ ID NO: 116155 - DNA, 507 bp, Glycine max
  Peptide Sequence Number=SeqID_232933
atggccaaaatttcatttgtgcatctctttcttgttatagcggccattcaacattggcctcaccagctcaacataaaaatgccttcttgcatggtccatgctatactctcgccaccccttggtagaatactagaatcattgcagataaaaccagaagatgaggggttaaagagtctccaggacgtgcaggctgtaaggtggaaattccaaggaaagaaggtagtaagtgctaaatgggtgttcagaaacaagctggatgagacagttaaggttgtgagaaacatgacaaagttagttgttaaagaacaacctcctgggtttgagagtaacacttttccataccatgactacagatcaaacaaaccagcaattcatcaaacgaaatatgtcaaagaacttcttaagaagttcaaattggaagatgcaaaagagatgaaaaatcccacgcatccaacaacatcacttggactggatgaggaatccaacaaagtggagaactcccaataa

SEQ ID NO: 116156 - DNA, 114 bp, Glycine max
  Peptide Sequence Number=SeqID_232934
atggccacttctgacccttggaaacttagtgttgaagcaatgagctcgcccaagaaagctggagctcacctaggtgttatagatggaatgtgggtggtttgtctaggcttttga

SEQ ID NO: 116157 - DNA, 894 bp, Glycine max
  Peptide Sequence Number=SeqID_232935
atgtgtcatagggaacgacaaagtatgaatgtcttgattcatcggaacagaattgaccggaatcgcaccggagttggttggaattgcaccactgaagttgtttggaatcacaccaccggagtttgttggagtcgtgccgcaaaaattagttggaaccgcaccggtgttaaccagaattgcaccggagtttgtggaagccatgaaagggatcagagagctctgaatatcatattaactggacatctctaccttgccaaggttggtctgagtggtagtggaaagagcacattacttaaccttctacttcgtctctatgagcctagtagtggtcagatatatatcgatgggtttcctcttaacgaattggatatcaggtggctgcgggagcacattggatatgttgcacaggaaccccatctctttcacatggacatcaagtcaaacataaagtatggttgccccacgaacataaaacaagcagatattgaacgagcagcgaaaaaggccaatgcccatgactttatttcttcacttcctaatggatatgaaacccttgttgatgacaatgcacttagtggtggacaaaagcagcgaattgctatcgccagagccattcttagggaccctgttattatgatacttgatgaagcaaccagtgctctagattccgagagtgagcattatatcaaggaggtgctgtatgcattaaaagatgaatctaaaacgagaaccatcattatcatagcacataggctttctactataaaagctgccgataagatctttgttatggatgatggtcgcatcattgagatgggagatcatgaagagcttatgcgcaacgatggactttatgcaaaattaactaaaattcaagcagatattttgacttga

SEQ ID NO: 116158 - DNA, 717 bp, Glycine max
  Peptide Sequence Number=SeqID_232936
atgtggcaaaagcaagatctatgcttgtttggcttcaatccatgctttcgagctcgatgcttgctcgagttcttggatcgactcattcgtatcagctaccatcgcgaacacatggattcgattcttgaaggtcttcctagggatttcgattctataattgctttcattgagagccatcttccgcacatcacaactgaagaagctgaaggttttatccttccacaagaactaagacttagaaaatacaacaagcttgattcttcgagtaattctttcgcgcctactgtgaatcttactcaagcaagttcttcgcattctactgaaaatgatagcttgaattcatactcagacactaatgttgtgtatacaaatcagtattcctcagattctagaggcactggtggccgtaatggccacggagaaagaggttttcaactgtggtggtggccatggtggtcgaagctcaggcctccacaagtcatagtggcaaattctgactccactgcatcatttacttggtttccagactctggagcatcattccatgtgaccaataattctcagaatattcagcaaaactcaccttttgaggtccagaccagatcttcattggtaatggacaaggtactcagaaaggttcagagaactgctgtcagagttgagaactcagaagaattcttgaagctcattagaaagatgaagtttgctaccctttga

SEQ ID NO: 116159 - DNA, 747 bp, Glycine max
  Peptide Sequence Number=SeqID_232937
atgagagagagtgagagagagcctgagagagcgatagctccagcgagggatgaggaccaagagtggactacggtgaggcgagggagaggtaaacagagggtgggagtgagatcgagagaggatcccgaaacgcactacactagcgaaaggcatggacaaactcgaaggtaccaaaaggcaaattggagggaaaaagcaaacgttactactttctacttcacaaggttccttgactacataacagagaaggatttatgggttcagttcaagagatggggggatgtaagggaggtctttatacccaatcaccggaataaggatggcagaagatacggcttcgttagattcacaggcgtagctgatgaacgaaaacttgagagacagcttgataacattgtgctggggggacttaagttgtacgtcaacattcctaggtacgggagacgaaacaagaggatcgaagagcagatagacaaaaacggtatcacgcaggaagggcatagcataacagagaacaaagggcgccttgcaggaactcgatacaggaacccctctatgacctacgccaaggtgctgtctgccaacaattgcgatgcagaactacgcaggaaataccaacacccacaccctagagccatggagtcccactcatctatccatctcgatgtatcacaaggggaaaaggaaaaatacactgatacatgggtaggccgtttaaaaaacttgggaagcttcgaagacaattga

SEQ ID NO: 116160 - DNA, 219 bp, Glycine max
  Peptide Sequence Number=SeqID_232938
atggaaatgggagggatagaacttgccatgggtcagcacagaagagagaaaatctataaatggtaccaaaaatgccaaacagtgaggtacagaactgcaaatggacaaatggccagaactggctgctcatgtgccacaccatatgcaaaggagtggtacaaggagagaaaaatgcaagacacgtgtgcaaaggagtggtacaaggagagaaaaatgtga

SEQ ID NO: 116161 - DNA, 768 bp, Glycine max
  Peptide Sequence Number=SeqID_232939
atgatgtcccctgatccaaatttccttcattccacccttggcttatcccagattcccagatggaacatcttcttcccctgcaactccaccaaatcccaaacccaccatttttcctccctcacccattcgggtcgctccgaaatcttccgggtttccggcccggaaacccggtcccaagtcgggtttccgttcgcaaaacgggttgggtcttcgacatccattctccccagcggaagctggtgggccttgccggagctccgggaagacggcgcggagccgacggcggcgatgctcgctctccggcgaatgtgggagttggtcgccgatgagagactggtcgcgtttgtggcggctgggtcccttgtaatcgctgctctttcagaaatcaccatgccgagtatattggctgcatcaatattttcggcacagagtggtgagactgtggcattctctaggaatgcactgtttttgcttgttctgtgtttaacttcagggatatgcagtgatattctggaaattctgggaaagttaaaacagccagaaagaagaaaaaggaaggccttaggaataggaacagccaaccctagcctcaggaacggccaacccaatgaaatcactttgtatagtatttttccccctcctcttcaccactactctgtgatccttttatgctccacacccattcggttaggattccctatttccactttcttccagctcagcattctcatcattctcctcaccattccctgtctggaccatgactaa

SEQ ID NO: 116162 - DNA, 852 bp, Glycine max
  Peptide Sequence Number=SeqID_232940
atggctttatcttggcctctggcattatctgccttggtgatttgttctattttatctgcaattttcctggtttatggccacggtggtcatggtggcggtggtggtggtattggtggaggtgacattggtggtagtggcaatacatatagtggtggcagtgataatgtggtggtggcagtcaatagtgacgatgttggtgattgtggtggtgacgttggtggtagcaatgtcggtggtgttggtggcgatggtggtggcagtgacagtggtggtagaggtgttggtgatggcagcaagtgtgatagtggtgacaatgatggtggtagtgagattgatggtggtggttgtggtagcaattccggtggtgatggtgatgcagtggaggtggtggtgatgtcggtggcggtggtgatagcggtgctggtggtgacagcaagctatgccggtgacaatgatggtgatggtggaaatgacggaggtggtattggtgacggcggcagtggtgatggtggtggtggcggtagtggcgacgacagcaaaaaaatgtcattgtcaaattttggaaatatgtatcaaagaaaggcagcaaagttaatccaagatttcacagcttgtgccaatgacgttgctcaggagacactttcttcaataagaattgtccgagcttatggaacagggaaaaaagaatttggaaggtgctttattttgtttttgctgaccagtgtgcctgctctgcacgggcagcagaaacaaaacagtggcccgtgttttaaaactgcaaaagaaaaaaggtcagaactgcacgaaagccatactgattcaattgcaattgctataaaggatttgccttaa

SEQ ID NO: 116163 - DNA, 420 bp, Glycine max
  Peptide Sequence Number=SeqID_232941
atggtgcggtcgctggactgggggtcagccaaacagcagcaaaacagaaccaaacaacagcaaaatagggtcgctgaaggaagaggaggaggatggcacagtagccggacggtgggtcacaccggaaaaggtgtccacagctgtttggatactgggatgggtcgcgcagaaaacagtgtcacatttttctctccttgtaccactcctttgcacacgtgtcttgcatttttctctccttgtaccactcctttgcatatggtgtggcacatgagcagccagttctggccactgtcaccgccactcaacttgtcccagctggatgttctccatgatggtttgggaaaagtgagtggtgttcttcatgacttcaatgaactcttgccccttgccaacatccctgtcgaggaattggaatggtga

SEQ ID NO: 116164 - DNA, 543 bp, Glycine max
  Peptide Sequence Number=SeqID_232942
atgactcgtgaaaattcattcaaaacatggattgcttttacgcgagccttagagacagaatttggcccatcaccgtatgaatgtcctagatctcagttgtttaaactcgctcaaattggttcagttcagtcatattacgtgcagttcacggctttagctaatcaagttttggttggaaatggaaatgccttgactgctgaaggattaattcaagacttggaggtgaaaatccaaggtcatacactgaagctaccagtgtacctacttccagtttctggtgctgatctagtgctcggggctgcatggttagcaacaattgtgcctcatctttctgattataatataccggatgatatggaaccagaattggccatgatactttacacttatagaacagtcttagatgtgccatcaggattaccccctagcagaactcacaatcattcaatcccattggttgaaggtgctggaccagtaaaagtcaagccatataggtatcctcacagccggaaggatcagattgaagtaattaatgatagctga

SEQ ID NO: 116165 - DNA, 309 bp, Glycine max
  Peptide Sequence Number=SeqID_232943
atgggcttgataagcgggaaccagtttggcccattagggaataatggaaactctaacaggataggaacttcagaaatatcccatgattcttaccaagaaaatattttagaaagcataaaaatagaaatcgagctacaatatgaattatccgtagcagaatctgattataattctgtcaaaatcaacaaaattacaacttttgataatatacagcagattatagacggattaaataaaacaggtataataggagaagaccctgttggatcaagtggcctcagaataattaagaagggggggttgaattaa

SEQ ID NO: 116166 - DNA, 228 bp, Glycine max
  Peptide Sequence Number=SeqID_232944
atggcgagattcggtaccatgttaaggatgattcttgaggaaagacttaaacctcaattagtacttttctgtgaagtaaagggtgttacagatcttgatgtaagctccattggagcttgtaggcctaggatcttcttcatcaatggattcatttgcttcttggaagatgaatggcagcggaatggagaaggaagagagagaggagacgccacttcaaggagaatatga

SEQ ID NO: 116167 - DNA, 411 bp, Glycine max
  Peptide Sequence Number=SeqID_232945
atgcccccgactgtccctgttaatcagtactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 116168 - DNA, 171 bp, Glycine max
  Peptide Sequence Number=SeqID_232946
atggaacaattccgatgggggggaacctatcttagcatggaaaccatgaggcttttaaataaaagtgatggaagtagaagccacataggtgtcacaactccccacgacaatgtgggtgctcttgactatcaatttctcttccaacattcttcccacacctttgtgggttag

SEQ ID NO: 116169 - DNA, 136 bp, Glycine max
  Peptide Sequence Number=SeqID_232947
atggaagaaaaaaatgaaggttacaatcattactctactgatgggggcggtgtaactggggttgcaggagcagagactggttgtggcttggcttctactgatgttggcagtgtaactggggttgcaggctcacttg

SEQ ID NO: 116170 - DNA, 219 bp, Glycine max
  Peptide Sequence Number=SeqID_232948
atgcatgttaaacaacaccaaaaagatatgcaattggagtatgatgttttggccaggagaagaagacagagtcgcgaaaaagatgcagcaaaatacctgggtacagtgacggggtgtcacggtggcgacatgtcacggtcgcaagctgtcacggtggttgtagagggagatagagtcgcgaagatgaagcttagacggagaagaagagatcgcgagtaa

SEQ ID NO: 116171 - DNA, 171 bp, Glycine max
  Peptide Sequence Number=SeqID_232949
atgaattttgcatttaggaaggggggagggactagggatgaggaccgtgagaatccagcgcaaggggtgaagcaacatcgcatggcttctaatgtagactcgttgccttctatatcaaataataacataagggtgaggtatgtgagcaagagaggagaggaatgggcgtga

SEQ ID NO: 116172 - DNA, 318 bp, Glycine max
  Peptide Sequence Number=SeqID_232950
atggcagaaccctcaaagaagagaaaaggctcatcctccaccaccaccgctgcaggccaacaccgccatggcacatccagtgacccaccaacaccacccccctccttctttttcttctctaagctcaccattagggctctacgcacatccatcgctaagtgcagcttcaacgcgcttagcacgacagaagaatctgatagagcatcaatatcaaggtcgcactctaagcgcaagatcagtgagctaagcgcagcgattgtcttctgccaagctcagcgcatgactggcgctaagctcaaatccacttactcgcgctaa

SEQ ID NO: 116173 - DNA, 831 bp, Glycine max
  Peptide Sequence Number=SeqID_232951
atgggatcacaatactctccccttattgaggtggatttacaggcattggctgcacgtcttagcactaaaggaagtaatgtagaaactgttgatgttgacccatcaggcgacaaaaatgtgagcttaaaacccactatggggttatacgtgcaacgacaacatactacagtgttggtggccttggggaaaatatgtgaggggggatctgccattcacaatgtcacttatgctgatgatgttgtaagggtaagtgttgacaaagttatagaaggtgacgccgaagtgcccttcccgacatcagagattcaatatgtctggcaggctcttcaaacattcattgcatggccaacaaatcttatgaaaaaagtgtcacatgaggagtccgatactagtccaaagaaacttcctgaaacagatgaaagggggacgaatgattttgaccatgatccgttgcgtcaactgattaagagcctatatttcatgtatgacacacctgttgagttgaagtgggatggcagcaaatttgggctttcaaatgttgatgcttcattcttcttgacattctctgatgtaaatgaaatagtagcaagatacaaatgtttgaacatatctatactacagttatggatgttgtttttggatgagtggagctcaactttgggtcatgcttccgagtatggattccttgagccacaatcgatagaccatgcaaaggatcgacgtgctgaatacgttgatcatgctattattataagcagtgcaatgaagtcagcaaacacaattgcggatggtacaaataatccagcaactcctaagtggattgaagtcaag

SEQ ID NO: 116174 - DNA, 1611 bp, Glycine max
  Peptide Sequence Number=SeqID_232952
atggcttatttttcttcttggcattatagtatttcagagaattattggcaattaaagaaacatgtccctattgaagaagagtctgtttctcagaaccaaaattcatccatactgaaaagtgaggattatttttcttcttgtgctatgttatctcttaatgtcaaggatcctcgagaattgccatggaagaagactgttgttccactggagtccctttcaactaagactccaagtgatgcacaagaaactaaatacaaagagcttgctgaattgggaggaatattggaagagaataaagatttatcttcattatcaaggtcaaaacttgaagacagccagtttgatattgacgatctatggtatgctaccaccagagggttgaggcccccagtggaagacaatgtcctttccaaggagaaataccatgaacgtatggttaatttcttccttgatgatatagattctggagagatcaactcttcaactaaggtgcagtgctcgagatcttgccctattcttcttttaaaaaatgatatgaaggaattgattataggatggtctgttatacttcccttaagttgggtcaaagccttctggattccgctcatctctaatggggcacatgcaataggtttgcaagagaagaactggatttcatgtgaaatggggctaccatttttcccttcagatttcccagattgtaaggcatactcttgcttaatggaagccaaagctgctgcatttaataaaaaagcagaactctgtcctcttgtgacaaggcatttaagagttcccatactgcctccatggggtattgttcgcattacttttgacaaagtgattaatgcaatggagactcctgatctttcaactagggaagatttgatcaatgctaattcattaccaaacccttgccatggaaactttgaaatttcaaaatctgactctgggagtaattcgtttgatggaactgtagtgaggacaggttgtatgctgactactttcctcaacgaaaccaaaacttgtcaattgttattgtttccttatgcagcagatggaaaggctagaatatctaagtttattaatggtgaactaaagcttgatccaagacatagaagctctgacatttatgaccataagcaatgttttgtaagagttcatctgaatccattcaaggaaggatgttttgaagagggtgcagttatttgtgcaccatatccttctgatatatctttatggacttcaagttgtgagaaaagagaagagggacttcaaatgtctcaatctgctatgcggttatacttcaaagaacattcctctggtaaatggggaatgcagataccagatgattcaattgctagaatgtctcaccggtggcctattggctttgtcacaacagcttctgttcaaggaagcaaaagtctagtagcagagggcttttgcgaggctgttttactatctaatttgagagaagaacagtggaaggagatgcctatgaagaagaggagggaaatatacgtacttgtcaggaatttaagatctacagcatatagacttgctcttgcctctattgttcttgaatatcaggaaaatgacattgagttcttgtaa

SEQ ID NO: 116175 - DNA, 144 bp, Glycine max
  Peptide Sequence Number=SeqID_232953
atggttaagtgcaaatgtgaggtatccgctattatgttcacgtcgcgtagtgtgaaccatccggggataaggaatccagttcttgcagattttttcaataggttgatgatactaaggctggcaataatgtttccacagaaatga

SEQ ID NO: 116176 - DNA, 1320 bp, Glycine max
  Peptide Sequence Number=SeqID_232954
atggagaacagtttatacgatgaactactgcaagaaatcttccagaaacttccctcatcatcctcgtcctccgtctccctcgtctgcaagcggtggctccgcctccaccgttcctccacaacctccctctctctccgcctcacaacccctcacttctctctcatcccttctctctcctccttcctctcccaccaccctttcctctcctccctctctctctccctctccccacccctcttctctctctccccacacctcctctcgctcatcatctctcccttttccaacctcctctcgctctctctcacccccgcacccgtttctctctcctccctactctctctctccgcctcctgcccccgcttaaattccctccgcatcaccctcccgagacctgtttttctcaactggctcctctccttcccctgcctcaaggaattgtcaattactttctcttctgatgatgaagaaagtcatgattttgattccgattctgattttgaattggggttggggttggagagtatttgtttggtggggattcgcagcgacgattggggggataggagggtcttattcgtctttctcaagtccttgcaaggtctcgaggaaattgagctgagaacttgcaggactgtggtttatgctgttctcttagaacttgtggagcattgtacctccttgagttccctcttagttcatgatggtggaagcaaagagggattactccagttctttactcagtgtaggtgtaatgtacgaaaaatcgatcttcgtttgcctctagacctcaacaaccaccatctctcagagatggcgaggaatttcgaggggctaacgagcgttaggcttcagagctgttgcctcgttagcggcgagggcttgaaggccctcgccgcagcgttgaaaggcctggaagaattggcgcttgttaactgtgacgtggttgaaacagaaccgggtctgcttgccacattggggcagcatttgaggaaattgaagatgctcgacttgtcgcacaacgaaatgctgcacgacaaggagttcgtttcgatgacggtttcgtgcgttcatttgattgacttgaaggtgagaggatgcaaggggctcaccagttttgccatggcttccattctcaggagctgcaagcagctccagaatgtggatgttgtcaactgctccgggattcactctgaggctgttgagttgtttgttaagaattgttgtcgtttgagaagaatggaggttgaggggagcaagctctctgatgctgcgaaaatgtgggcggcgagtaagtttattgaagttgttgttgtgtag

SEQ ID NO: 116177 - DNA, 9408 bp, Glycine max
  Peptide Sequence Number=SeqID_232955
atggacaacatcagcgtggtgaaagaagaacaagcagaccaccaatcggaagaatcgagcgtgtcgaatgtcagtacaaaacacacaacagcggaaggacacgacacatcagaaagcagcacaaaattaactggtgatttcaatggtgatgaacacacaatagtagacacgcgctcagaagagaatttagagaacaagaatgcaagtgaaattaaagcagagaaagaaacagatgcaaatcaatcgaccgatgtgaagactcaaaagacagacaacgaaggtgtgcatgaagataaatccctgcaaccaacacatgatgaaacatcgatcggaaacgaaacagttgctgagactagtcgagataagagacaaccagaagcagaatttaaagagaaaattaacgaagaggtgaagactccacaaaatgatattgaggagactgtggaaataaacacaaatgatactgagaaacaggaagaggttccagcatctcacgccgacgagaaacaagggattgaggatgatggcaaattcgatctagaagaagcgaaagggattgaagaagcaacaaaagcacagttaccagaggaagaagtcaacacaacattgcccattactgcctttgtccaaggcgatactgatcaaataccacagcagcaaacactgcaggatgatgattcagaagtgattgatattgccctgaaaatcgacacttcagaaactgaacttgctggaaggtccaacattgttgagaaacctgaacaacctgaaaacaaggacaacattggcgaggtgaaagaagaacaagcagaccaccagtcagaagaattgagcgtgtcgaatgtcagtacaaattatataacaccggaaggacatgtcacatcagaatgcagcacaaaattaacaggtgatgtcgatgtcgatggacggacaatagtagtcacgtgctcggaagaaaatttagagaacaaggatgcatgtgaaattacttcagagaaagaaacagatgcaaatcaatcaactgatgtggagataccaaagacagaagccaaaggtgtatatgaagataaatccctgcaaccaacacttgacgaagcattgattggaaacgaaacagttgctgagagtagtcgagatgacagacagccagaagcagaatttacagagaagattaatgaagaggtgaagcctccacaaaatgataaggaggaaactgcagaaataaacacaaatggtactgagaaacaggaagagattccagcatctcaggccgaggagaaactagggattgaggatgatggaaaatttgaccaagaagatgcaaaacagattgaagaagcaacaaaaacacggttaccagaggaagaagtcaagaaaacattgcccactgctgcctctgtccacggcgatactgatcaaataccacagcagcaaacactggatgatgatgattcagaagtgatggatattgcaaagaacatcgacacaccagaaattgaacttggtggaaggtccactgttgttgaggaacctgaacaatccgaaacaaaggacaatgttggtgtggtgaaagaagaacaagtagaccaccagtcagaacaattgagcatttcaaatgtcattacaaattatacaatactggaaggacacatcacatcagaaagcagcacaaaattaactggtgatgttgacgtcgatggatggacaatagtagtcacacgttcaaaagagaatttagagaacaaggatgcatgtgaaattacagcaaagaaaaaaacagatgcaaatcaaccaaccgatgtggagataccaaagacagaaaccaaaggtgtgcatgaagatagatccgtgcaaccaatacctgatgaaacattgattagcaacgaaacagttgctgagagtgatcaagatgagagacagccagaagcagaatttacagagaagattaacgatgaggtgaagactccacaaaacgatactttggagactgcagaaataaataaaaatgatactgagaaacaggaagaggttccagcatctcacgctgaggagaaacgagggattgaggatgatagcaaattcgatccagaagaagcaaaagggattgaagaaggaacacaaacacagttaccagaggaagaagtcaacacaacattgcccactgctgcctgtgtccaaggcgatactgatgaaataccgcagcagcaaacactgcaagatgattattcagaagtgattgatattgcaaagagcatcgacactccagaaattgaacttggcggaaggtccactgttgttgaggaacctgaacaacccgaaaatgtggacaacgtcggtgaggtgaaagaagaacaagcaggccaccaatcagaagaattgagtgtgtcgaatgtcagtacaaattatacaacaccggaaggacacatcacatcagaaagcaacacaaaattaactggtgatgtcgatgtcgatggacggacaatagtggtcacgcactcagaagagactttagacaacaaggatgattgcgaaattacagcagagaaagaaacagatgcaaatcaatcaactgatgtggatataccaaagacacaaaccgaaggtgtgcataaagataaatccctgcaaccaacacatgacgaagcatcaatcggaaacgaaacagttgctgagagtagtcgagatgagagacagccagaagcagaacttacagagaagattaacgaagacgtgaagtctccactaaatgatactgaggagactgcagaaataaacaaaaatgatactgagaaacagaaagagattcctgcatctcacaccgaggagaaactagggattgaggatgatggcaaatttgatcaagaagatgcaaaacagattgaacaagaaacaaaaacacagttaccagagaaagaagtcaagacaacattgcccactactgcctttgtccaaggcgatactgatcaaataccacagcagcaaacactgcatgatgatgattcagaagtgattgatattgcaaagaacattgacactccagaaattgaacttggcggatggtccactgttgtggaggaacccgaacaacccgaaaaaaccgacaacatcggcgtggtgaaagatgtaaaagcagaccaccaatttgaagaatctaacgtgttgaatggaagtacaaattatacaacaccgggaggacacatcacatcagaaagcagcaaaaactcaactggtgatgtggacatcgatgaacagataatagtagacacgtgctcagaagggaatttagagaacaagtatgcaagcgaaattacagcagagaaagaaacagatgcaaatcaattgaccgatgtggagataccaaagacagaaaccgaaggtgtacatgaagataaatccctccaaccaacacttgacgaaacatctattggaaacgaaatagttgttgagagtagtcaagatgagagagaggaagaagaggaattcacagaaaagttaaatgaagaggtgaagattccacaaaatgataccgaggagactggagaaataaacaccaatgatactgagaaacaggaagaggatcaagcatcacacgccaaggagaaactagggattgaggatgagggacaattatatcaagaagaagaaaaagggattaaagaagcaacagaaccacagttcccagaggaagaagtcaagataacattgcccactgctgcctttgtccaaggcgatactgatcaaataccgcagcaacaaacactgcacaatgatgaatcagaagcgattgatattgcaaagaaaatcgacactccagaaattgaacttgacagaaggtccactgttgttgaggaacctcaacaatctgaaaacaaggacaacgttggcgtgttggaagaagaacaagcagaccaccaatcagaacaatcgagcatttcgaatgtcagtacaaattatacaataccggaaggacacgccacatcagaaagcagcacaaaattaactggtgatgtcaacgccgatgaacaaacaatagtagacacacgctcagaagagaatttagagaacaaggacacaagagaaactacagcagagaaagaaacagatgcaaatcaatcgactgatgtggagataccaaagacagaaaccgaaggcatgcatgaagataattccctgcaaccaacacttgatgaagcatcgatcggaaacgaaacaattgctgagagtagtcaagatgagagacagacagaagaggaacttacagaaaagtttaacgaagaggtgaagactccacaaaatgataccgaggagactgcagaaataaacaccaatgaccctgagaaacaggaagaggatccagcatctcacgctgaggagaaactagggattgagaatgatggcaaattagatcaagaagaagcaaaagggattgaagaagcaacaaaaccgcagttcctagaggaagaagtcaagacaacattgcccactactgcctttgtccaaggcgatactgaccaaatacagcaccgacaaacactgcatgatgatgaatcagaagcgattgacattgcaaagaacatacacacactagaaaatgaacttggcagaaggtccactatcgttgaggaacctaaacaacccgaaaacaaagacaacatcggcgtggtgaaagaagaacaagcagacaaccaatcagaacaaatgagcatgtcgaatggaagtacaaattatacaataccggaaggacacgtcacatcagaaagcagcacaaaatcaactggtgatgtcgatgtcgatgaacggacaatagtagacacatgcttagaagagaacttagagaacaaggatgcatgtgaaatcacagcagggaaagcaacagatggatatcaatcaattgatgtggagataccaaagaaagaaatcggaggtgtgccagaagataaagccctgcaagcaatacctgacacagcatctatcggaaacaaagcacttgacgagagtagtcaagtggagagacagtcagaagcagaatttacagagaagtttaacgaagaagtgcagacaccaaaatatgatactgaggagactgcagaaataaacaccaccattgatactgagaaacaagaaggggttcctgcatctgaaggcaaggagaaactagggattgagcatgatgggaaacttgatcaagaagaagcaaaagggattgaagaagcaacaaaaatgcagttaccagaggaaaaggtgcagacaacattgcccactgctgcctttgtccaaggtgatgctgatcaaataccgcagcaacaaactctgcatgatgatgaatcagaagcgattaacattgccaagaacatatgcacaccagaaattgaactagacgaaaagtcaactgttgatgagcaatgtgaacaacctgaaaccaaggacaacatcggcatattaaaacaacaagcagaccaccaatcagtacaatcaagtgtgccaagtgtcattacaaattatgcaacagcagaaggacatgttaaatcaaaaagcagcacaaaattaactgatgatgtcaatgtcgatcaacagaaaactgtagactcatgctctaaaaagaatttagagaacaaggatacaagtgaaatttcagcaaagcaagcaatagatgccaaacaatctactgatgcggagatacctaagtcagaaactgaaggtgtgcttgaagataaagccttgcaaacaatacttgatgaagcattggtcaaaaatgaagcagttgatgaaagtagtccagaggatagacagctagaagcagaatttacagagaagtttaacgaagaggggcagacaccacaatatgatattaaggagactgcagaaataaacaccaccaatgctactgagaaacaggaagaggttcctgcatctaatgcaaaggaaaatgtaggggtcgaggacgatagcaaattcaatcaagaagaagccaaagggattgaagaagcaacaataaagcagttaccagttgaagaagtagagacaacattgcccactgattcctttgtccaaggtgatactgatcaaaaaccgaagcaacaaacactgcaccatgatgaatcagaagttattgatattgctcagaacatctacacaccagaaattgaactcgaccgaaagttcattgtggttgaggaacctgaacaacctgaaaccaaggacatcggcatagtaaaagaagaacaagcaaaccaccaatcacaagaatcaagcatgcagactgtcattacaagttatacaacagcagagggacacgtcacatcagaaagcaccacaaaattaactgatgatgtcaacatctatgaacagaaaacaataaacgcacgctcaatagaggatttagagaacagggatgcaagtgaaattacagcagagcaagtaagacataccaaacaatcgactgatggggagattccaaagtcagaaaccaaaggtgtgcctgaagataaagccttgcaaacaatacttgacgatgtaacggatggaaatgaagcagttgatcagagccgtcaagaggcgagacagccagaaccaaaatttacagaaaagtttaacgaagaggtgcagacaacaccatatgatactgaggagacttcagaaataaatgccactaatgatactgagaaacaagaaaaggttcaggcatctcacaccaaggagaaactagggattgaggatgatggcatattctatcaagaagaagcaaaagggattgaagaagcaacaaaaatgcagttactggaggaattagtccagacaacattgcccaccgttgcctctgtcgaaggtgatattgatcaaatttcgcagcaacaaacattgcatgatgatgaatcggaagcgattgataatgccaagagctgcatatcagaaattgaacccgacagaaaatctactgctgttgagtatatattgaaccaggaacctgaacaacctgaaaccaagaccaacaccggcataccaatagaagaagaagcagaccatcaatcagaagaatcaagtgtggagagtctgattacaaattatataacagcagaaggacatgtgatatcagaaagcagcacaaaattaagagatgatgtcaacgtcaatcaacagaagagtgtagaatcaggcttggttgagtttttagagaacaaggatgcaggtcatatcagagtagaaggaacatattccaaacaattgactgatgcagagatacaaagttcagaaacagaaggtccacaagaggaagaagtccattcaaaattgcctgctgtaactgtacaaggtgaatctgatcaaaacttacagcaacaaacacttgatgatgatgaatcagaagcaatcaataatgccaagagatgcataccagaaaaagaacttgatagaatgtccactgttgttgaggaacctgaaaccaatgccaatgttggcatagtaaaagaagaacaatcagacaaccaatcgcaaggatcaagcatgcaaaatatgattgcaaattatataacagcagaaggacatctggcatcagaaagcaatacaaaattaaattatgatgtgaatgaacagaagatagtagactcacagtcagaagagaatttagagaacaaggatgcaagtaaaatcaccacagaggaagcaacagatgccaaacaattgactgatgttgagatacaaaaattagaaaccgatggtgtgcctgaaaataacgccatgcaaacattacccaacatagcattggtcagagtcgaagaagttcacgatagtaagcaagaagagatacaacgagatgcagaattttcagtgacatttacaaaaaagatgcagacaacacaatatgagtttgacgcaaaaaatggcattcctgaggcatatggggaaaaggacgatacatgccatctcaatgcagaaaacgaacagaaattagaatcccaaccagtagcacagaacaaggggactacattcataaatcatccgtatcaggatggagagactgcagaaatgaaccccactaatggtattgaggtagaaaagattccagcaaatcatgccaaggagaaactagtgattgaggatgatggtaaattcaatcaagaagaagcaaaagggatcgaagaagcaacaaaaacactgttactaaatactgcaacagagagcctaacagaggaagaagtccaggaaatattgcccactcctgcaattgtccaacgtgacacaaagcaaatcatgcaacaacaaacacttcacaatgatgaatcagaagcaattgataaggaaaagagctgcataccagaaaatgaacttgacagaaagttcattgctgttgaggaatctgatcaacctgaaaccaaggccaatgctggcatagtaaaagaagaacaagcagacaaccaatcacaagtatcaagcatgcagagtgtgattacaaactatataacagcagaaggacatctggcatcagaaagcagtacaaaattaagttttatgaatgaacagaagacagtagacgcgtcagtagagaatttagaaatcaaggatgcaagtgaaatcacagcagaggaagcaacagatgccaaacaattgactgatgaggagatacaaaaatcagaaaccgaaagtgtgtatgaagataaggccctgcaaacattacccagtacagcatctgtccgtattgaagttgagaaaagcattcaagagatacatacagaaacagaattagcagtgacagataccaaagaggggcagatatcagaaaatgagtctgaggcaaaaaaggaagtttctgagtatatgttaaaaaaggcttttgatctgcacaaagtggcatgccagaccggtgcagaaaatgaactgaaagctgaattcctatctgaagagcggagccaggaaactatagttacaaagcatccaaatttggaaggagagagcatagagataaacccaacaagtgaaactgaagaacatgaacaggtaccagcatcacacaccggagagaaattagagatcaacgatgatgggaatttcatacaagaggaagaaaaagagatggaaaaagaaactgaaaggcagttgcttaaaactgcaacagaaagtgtaccagaagatgaagtccagacaaccctgccaacatcaacaattgttaaaggtgagacagttgaaggaattgttcaggaacaaacactcgaggaagagaaatcagcagcaatagataacaatagtggcagaccagaaaataaacttgagggaatggctaatgttgttgagacaattgatcaacatgaatccatggccaaggtcagcactgaaaatgaagaacatgccaaccgccattctgaacagtctagcatggagaatgtaattacaaagcatatcaattcagaaggaatg

SEQ ID NO: 116178 - DNA, 1551 bp, Glycine max
  Peptide Sequence Number=SeqID_232956
atggtgcgacccttcttcaatgaattacaaatgcctctatcctcctcctcctcctcttccgccgccgccgccaactccgccgtctccggcgagatcatgctgttcggcgtcagagtcgtggtggactccatgaggaagagtgtgagtatgaacaacctctcgcagtacaagctccctcgcgacgccgccggatacgcctccgccgccgacgcagctccgatcgactccggcaagaaccgcgaccgcaagcgagttggcgttaaggttcgtgaaataacacatcctggtgtcaaagtgtccaggtttgtgttagaattttccaacctgccggaagaagaatcggatcgacggaaaagactactgaatattctatcgacaaagttgagaggcggtgctagaacaaatgcagatactcaggaacaccccgagtgccaaggagatagatatagtcacaagcgaggttgggtttggacaatgatcaagaagccgtattttgcttctaacagagaccactgggagcagagggattttgagtcatatggtccaatcaaacaggctggttctctgattcaaggagattcaggcatgttccctcaatcgcaaggaaagctatcacagagtgaaaactatttgtcttctcaatcccccattgatcaagaaccacagtttaacagtgggaacttcatggctctctttaaccatcaaccacttggtacaccttgtgatgttgtaggtagcttacttggtcaaggagtaaatgcttcacagaatgctgtttctccaccgtccaaggacatactttgggcaagccatgccatggttgttgctggcaacccattcctcaggattgattttcctcttgatttatctatttctttcaaccttaagggaactaaatcaccgcagtttgatgtttggtgggagattgtgagtatgagctgcaaatgccttgtaaatgtggatattatgcactattttgggatagactccaaggctgttgagttgcttgttaagaattcttctcatttgaggagaatgaaggttgaggggagcaagctctggtgctgcaaaaatttgggcgtcaaggttttttgggtgggagatacttggatgtgggatttcaagtggagaaggagatggttcgaatgggagacatttttggttacaaccataaatcacatgttagcaaatgttagaattcagaaacagggtcgtgatagttggtggtggcttgatgacaacactggaatatactcagtaaaatatgggtatagggtcttgcataatttacttatgggaagtcaaccaacagaggcgttttcaatgatttggaaattgaaggatgtgttttgcgctttttgcggacaatttgaggaaacaaccccgattgaaccattttggcagcatttacataaagttttgaaaaaagaagcagaaatgtgggtggaagctggttatgcagaatattcatgcgtatcaagtttcaacttttcttttgctcaatggatgtctaacctggctttgtgtatgtctacttcatgggatggataa

SEQ ID NO: 116179 - DNA, 378 bp, Glycine max
  Peptide Sequence Number=SeqID_232957
atggagttatatatggaagaagtaccgaaggaggatacaaatctgaaggacaagcagatggacgggctagtaatctcgttatctgatgtagaatcactgagatgggcatcaccatggcttaacactttggtgatgaatgtgttgaataaaatattccttaaggtggataagctgacatctattcactctagtggaaaatttgtcaggatatgtgttgaaatagaactagaaaagcctcttatatctcatacctatgtgaggagttacaagttgaacatggagtatgaagggctccattctatttcctttagatgtggcagagttggtcacaagcgagatcaatgctcaaaacttatgagcattccaaaggatgcatag

SEQ ID NO: 116180 - DNA, 738 bp, Glycine max
  Peptide Sequence Number=SeqID_232958
atgacagatgcacctgaggataaagccatctcaactttgcctgagatagttgaggaaagcattcaagaagtaatacaaaaggaagctgaatcagaagtgatcgataccaaagaggagcagagaccaggaaatgattttgtaaagaacatggaagttctcgagggatttgatttacacaaagcgcaaggcaacaccactctggaaaatgaaatgaaagcagaagtccagtctgaagcaaagagccgggagatcattatcgagcatcaaaatttgctggagactgcagaaataagtccaagaaatgatactaaagaacctgaaaaggaacataaagtcaccacaggtatctctgaatcagtatctgcagataccacagagcaaacagacacaggaaaaccggaaactccagaggccgaaatcactcaaccaggcatcacaaaagaagacgaagcaggagacgaattcgaaaaaataagcccatcatctagtgtgagtgtgatatccagagactctcaagacaccgacacgaaagtttcacacaaaaaatctcatggcatcctatcaggtgtagggtcaaaggtgaagcactcaatttccaaagtgaagaaggccattacaggcaagacaggacactacgtgcacgtgcaacactttttagcctatgcgaatcaatggtgggtcaagggcagggcaggaaatgcgagggttttcgctggcgccaatgaaggtggcgtatga

SEQ ID NO: 116181 - DNA, 471 bp, Glycine max
  Peptide Sequence Number=SeqID_232959
atggggacatcgaagcatccatccaacgtggccaaagatgacccaaaagtggtgcatgcaattcaaccacgtgtgcgtaacttgaatggaaaaaatccagaggtagctaaaggtagggaccttcgtatagggggcttctccctcaccgccattgcctttgccactgtgatcgccaaaattcaacacctgtcatccatttctagtacagttcattttgaccttaaatgtactatgagaatgtcttggattgtctcatatgatatgtctaaggccaaagaaaaagctaaaaagagtggtattttaacatggattggatgtgcatctaatactcgcattgaatgcaccaccagatacatcttcatatcaacgataataacgacgaaggtggtggcaatcgatggtgatggtgatcagggtggtggcatgatttatgttgcttcagggataaaaagatatctaaaactaaattaa

SEQ ID NO: 116182 - DNA, 1164 bp, Glycine max
  Peptide Sequence Number=SeqID_232960
accatccagatatcattggaggagaaggcagaagctttggcaaataaaagggagtggacctcattcattgacatattagcactattggtgtttggaactatactatttctgaatgtagacgggctagtggacctagcagcgatcgacacctatcttgcttatcaccatagcaagcaaagcctggtcatcaccattttggcagatacatatgatacactcgacttgaggtgcgagaagagcagtgcaagaattatctattgtacgcctactctttatgtgtggttggtctcccatgttttcgtcatgaaggagcgtccattagccggctcccccgatggaaagaaggaggggcaagagtgttatgctcgctaccctatgagaggtgcaccatcggaggagatcatcgcgtgtttcgttgcacgaggcttcaatgaagccaatgcgaagatacttcaaagagttcgtaaagcatggaatacagtggaaatgaaagataaggagcttaggggaagtagcaatggcatcatcggtggctatcacaagtggttgaattctaggacgcaagggataacttggctcccaaagctaaaaggcctaagtgggaaagaagctgaagtccctaaggaaagcaaagaagtgcaagctttgaaagcggaactcgaaaaaacaagagtgatcaaggagaagctaaagacggcagtcactagagtcaggaaagattgtgatgagctgagagggaccgagagggacgagtcaaggatggaaagcatggtgttagaggataagttgaaggcttgtcaaaggtcgaagagaagcttgatggaacgggaagcaagagagagggtgaccgaatcattgcgaagggaagctatgaaatggatggataggttcgctctcactctaaatgggagtcaagggcttccaaggttgttagccaaagccaaggcaatgatcaacacgaacgaacaagctttacggcacccttaccgaacatgcgccaggggtagaatcatgagtgaggtagacgaagttcaggaagagatgaaggccgacatggaggccatgaaagaccaaatagctcctatgatggaggccatgttgagcatgaagaaaataatggaaagcaatgcgactattgttgccactactagcgctgccgcttag

SEQ ID NO: 116183 - DNA, 219 bp, Glycine max
  Peptide Sequence Number=SeqID_232961
atggaaaagtcattagttggaaatccatatgcgggtcgactgactaaagatgagaagattgttgttgttgatatgacgaagtccatgttgaagccaagaaatattctcttgacattgaaggagcacaatgccaacagttatacaacaatcaaacaaatttacaatgccagacatgcttatcattctttcataagacggagtaacactgaaatgcaataa

SEQ ID NO: 116184 - DNA, 255 bp, Glycine max
  Peptide Sequence Number=SeqID_232962
atggaggattgcactagagggtccacactatgcaatcatgaagaatggctccaaactcattggtggaggatgcatgaacgaaaacgacgcatgaacgaaaacgcaatttatggggctccgaaacagggtagagaatggagaattgcactaagcaatcactacgcatggctccaaactcgtgggtggaggatgcatgaacgaaaacgcaattcatggggctccgaaaaaggggtagagaatggagaattgcactaa

SEQ ID NO: 116185 - DNA, 1095 bp, Glycine max
  Peptide Sequence Number=SeqID_232963
atgaggctacaaagaacagatctctatgaagtaccaacactgacacgaacatccagatatggacacgtggacatctttcaaacacatcaaactcaacccggacacggacatcggtgtcgtgtcggtgtcggtatcgtgtcggacaccggacacggcaaggggctggagtgtccgtctgtgggtcatgatctctcccattgtaagagaaaagcggttgaggaacaaccaagaccaacaccaaagcctagcaccctccaaaacgggaagtttgttgctcttattgattattccctgaagagacttgacaatgctcgcccaacttccccaaggcctcaaattgggaattctaaccttgtaaaagaggaaggccaaaatggtttatctgtgggaattggtcaacaaccatctgctcaagaggcctcatcttcagataccaaagactccaatttacaaagtgcaattggagtatctctagaatcccgccccgctaaaaggcaaaatactagtcctgcaaacactggggaactacctcaagaccctttgttggaggaggatggacaattcactaaagttctttcaagatcgcaaaaaaagaaagataaggcaaaatctactgcctctactaaagggaaaagactcaaaaatcactttgcgattcaccatggtccttggagtttcgtaggcaatttcaattccattaatgaggctcatgaaaagaaggggggcataattccttttcatcttgcttgtgaagagttcaaagcttggattgatgtcaatcttctcacctatcttgacactaggggagttgagttcacttggtccaacaacataaaggccaatgcccgtattgatcttagattaaagaaagttatttgcaacaatgaatgcttccaatgttggccttggttatctgattgcaccctgcccaaaagcaaatccgatcaccaccctattctcttggtggtcaaagaggtttgggacacatcggtctcaggtgcaaatcaagccttagattgggtagcttttgttcaacaacaaatttctactcaaggacctacaaaggacctcattgctgctgatgcccaagcctaa

SEQ ID NO: 116186 - DNA, 2857 bp, Glycine max
  Peptide Sequence Number=SeqID_232964
ttctttagcctatctagataagctaaaggagctcaatctttcgttcaatcgtctccaaggtgaattgtcttctgagttctctaatctgaagcagttacaagttcttgacttgagccacaatatgctatctggaccagttggtggggcattttccggtttgcaatccattcaaatactgaatatttctagcaattcatttgttggagacctcttccatttcgggggattacaacatcttagtgctctcaacataagcaacaattcattcaccggccagttcaattcacaaatttgcagcacctccaagggtattcatattcttgatatatccaaaaatcattttgctggtggtcttgaatggttgggcaactgtagcacgtctctccaagagttacatttggattccaatttattttctggccctcttcctgattctttgtattcaatgtcagccttggagcagctctcagtctctgtgaacaacctctctggtcaattaagcaaggagctaagtaacctctcaagcctaaaatctctaataatttctggaaaccatttttcagaggaactcccaaatgtttttgggaatcttttgaaccttgaacaactaataggaaacaccaattcattttctggatcattgccttccaccttggctttatgctcaaaactccgagtgcttgatcttcgaaataattctttgacaggttctgttgctcttaatttctctgggttgtctaatcttttcactttggatcttggtagcaatcattttaatggatcccttccaaattccttgtcctattgccatgaattgacaatgttaagccttgctaaaaatgaattaactggccaaatccccgagagctatgcaaacctcacttcccttttgactctgtctttgtcaaacaatagctttgagaacttatctggggcactttatgtactgcagcagtgcaaaaatctcaccactcttgtcctcacaaagaatttccatggtgaggaaattccagaaaaattaacagcaagcttcaagagccttgtggttttagcacttggaaattgtggtctcaaaggccgtattcctgcctggctattgaattgcccgaaattggaagttcttgatttgtcttggaaccatttgaaaggtagtgtcccttcttggattggtcagatggaccgtttgttctacttggatttgtcaaataattctcttacaggagaaataccaaaaggtttgacacagctgaggggcctcatatcctccaattatcatatatcaagtctctttgcatctgctgctattcctctctatgtcaagagaaacaagagtgctagtgggctgcaatataaccatgcctcaagtttccctccttcaatatacttgagcaataacagattaagtggaacaatatggcctgaaattggtcgtttaaaagaacttcatatcttggatttaagcaggaacaacatcaccggcaccattcctagctctatttcagagatgaagaatttggaaacattagatttatcttataatagtctcgttggaactattcctccatcatttaacagcctcacattcttgtctaagttcagtgtagcatataaccacttatggggattaattccaattggaggacaattttcaagtttcccaaattcaagttttgagggcaactgggggctttgtggggaaatatttcatcattgtaacgagaaagatgtgggcttgagggccaaccatgtgggaaaatttagtaaaagcaatatccttggcataacaattgggttaggagttgggcttgcactgcttcttgctgttattctgctaagagtgtcaaagagggacgaggataagccagttgataacattgatgaggagcttagctgtccaaacaggaggcccgaagcactcacttcttcaaaattggtgttttttaagaattcagattgcaaggatctcacagttgaagatttgttaaaatccactggcaattttaaccaagaaaatataattggttgtggtgggtttggtcttgtctacaaggggaatcttccaaatggcacaaaggtagctatcaagaaactttcagggtactgtggtcaggtagaacgtgaattccaagctgaagtggaggcactctcaagagctcaacataagaaccttgtttcacttaaaggttattgccagcatttcagtgacagattattaatttactcctacttggagaatggaagccttgactattggctgcatgagagtgaagatggaaattcagctctaaaatgggatgcaagactcaagattgccaaaggtgcagctcatggattagcttatttgcacaaggagtgtgaaccacatatcgtgcatcgtgatattaaatccagcaacatacttttggatgataaattcaaagcttatttggctgactttggtctctcaaggctacttcaaccttatgatacccatgtttcaacagatttagtaggaactttaggatatattcctccagaatacagtcaggtactgaaagcaactttcaagggtgatatttatagctttggtgttgttcttgttgagcttcttactggtcgaaggccggtagaagtcatcatcgggcaacgtagcaggaatctagtgtcttgggtgttgcagataaaatctgagaatagggagcaggaaatttttgattcagtcatttggcacaaggataatgagaaacagctcttagaggtactagctattgcttgtaaatgtatagatgaagatccaaggcagagaccccatattgaattagttgtttcatggcttgataatgtaggatttgatggctctgagcagtcatcattttaa

SEQ ID NO: 116187 - DNA, 819 bp, Glycine max
  Peptide Sequence Number=SeqID_232965
atggagccattattttcttcagcagcagcaatatgtgtggtgactgtgttggtagctgtgattcccatatgggcactgaagatgctgaactcgctgtggcttaggccaaagaggtttgaaaggcttcttagagcgcaaggttttcatggtgacccatactcactttctcatcacaactccaaccaaacccttttgcaacaacaccagctcaattcccaaccttttcctctatccgatgatgttgctcctcgtgtatcctccttgttacatcacactatcgacaaatatggtgaaaaaagtatttttgaggctcaaaacctttttgagcagttgctgataagtaaaggatgtgcaggcaagaaatccttcttttgggaaggtagaacaccaaaggtgatcattacggacccaaatcaactcaaagaagtcttcaacaacattcatgacttccagaagccaaagtttagtgacaatgtcaagttcttgttcgctggcctgttaaattatgagggtgacaagtgggctaaacatcgaagaattatgaacccagcatttcactcagaaaaattgaaaaatatgctaccagcattttctcaaagctgccatgatatgattagcatgtggaagggaatgttgtcatcagatggaaaatgtgagattgacatttggcctttccttcagaatttaactcgtgatgtaatttctcaaacagcatttggaagcagctatgcagaaggagaaaaattttttcgaaatctgagaatgcaggggtatcttttaatggcaggaaagtacaagaacataccaatattgcggtaa

SEQ ID NO: 116188 - DNA, 180 bp, Glycine max
  Peptide Sequence Number=SeqID_232966
atggaatacttacttgtcggtgatgaacaaaagcgcaaaacggaatcaaaaaatgcgaaaaaggatgaccctagggctgcaaattcgtcaatcccgtgggtatggcttttgaaaggggggaaaagaagggtggctcgcccaggcgagcccagctcgctcaggcgagcccagctcgcctag

SEQ ID NO: 116189 - DNA, 390 bp, Glycine max
  Peptide Sequence Number=SeqID_232967
atggacaagctccaaatgcttagacaagggagtatgagtgctgaaaaatatagacaacaaatggaactactccttttaagagctggacttagggaggaggaaagaacaagcatagctaggttccttagtgggcttaatatggaagtgagggacaaggttgaactccttccatatagggacctagatgagctagtccaactttgtataaaagtggagcaacaacttaaaagaaagccttcttcaaaatcttatggctttcactcttatccaaggaatgacaaagcccaaggaattttgggggctgcacctagggatgggaataggctaggctggcctacaggggcctacgacctggcctacataaagcttggcttgacctggcctatttaa

SEQ ID NO: 116190 - DNA, 327 bp, Glycine max
  Peptide Sequence Number=SeqID_232968
atgataacctttggtgttctaccttcccaaaggaaggatttcttgcctgcacatcctttacttatcagcaacagctcaaaaaggcttcaacaactaagaagtatacttacgactcattgcgataagacggtggcaatgatgctagtggggaacaaatgtgacttggagaatataagggcggtgaacattgacgaagggaaaagccttgcggaagcggaaggcttgtttttcatggaaacgtctgtgttggactccacaaacgtgaagacggcattcgagatggaaagcgggtataaattgtataattgggttacaaagagcttataa

SEQ ID NO: 116191 - DNA, 267 bp, Glycine max
  Peptide Sequence Number=SeqID_232969
atggaagtagaacgacacaacaaaagggagaagaggcttacctcgatggtcgacagtggagcagcgcaatgcactttcttctctgacaattctttgtcgtcctccacgagttttctctcctccgtcgtcagtagtgctatggaggagagaaaacttgtggaggatgacaaagaactactggaggagaaactaggagggccatggacaacaaacacataccacaaacaataccaataccagttcaatggaggagaaggaggagactaa

SEQ ID NO: 116192 - DNA, 426 bp, Glycine max
  Peptide Sequence Number=SeqID_232970
atgttggtcagaattctcgacctacgacaagaacattggagccccaaacttttgtttgagatcatcaaggggattgattctccgattgtgctagatgaggctacgaagagcagatcctttgggcattttgctcgtgttttagtggatttggacttgacagggaaacttctttctgaatttttagttgaacgagaatccttcgctttttttcgcctgtgggtcatgatctcttcctttgtaagagaaaagcaattgcggaacaaccaggaccagcaccaaagcctagcaccctctaaaaagggaagtttgttgctcttactgattattccctcgaagatccctgaccatgcttgcccaacttccctaaggcctgaaattgggaattctaacctcgtagaagaaggccaaaacgatttatttgtgtga

SEQ ID NO: 116193 - DNA, 309 bp, Glycine max
  Peptide Sequence Number=SeqID_232971
atgtatgtcaagccttacatggttgtagttcagagtaacaatattgaaaagcatgagcttcttaagataagacgtgttactacttatatttacaagaaggcaggtagatggaaacagtccattgccttgtcaaagaaggataacctttacaaagatgccatggagacagcctcacaatctggtgaccgtgaacttgctgaggagttgcttgtttatttcattgatcaggttgataatattggaacaaatgaagcaaaagaaaatggcagcagtaatgaacaagctatatggctggtagcagcaaggtag

SEQ ID NO: 116194 - DNA, 261 bp, Glycine max
  Peptide Sequence Number=SeqID_232972
atgggggtgcaaatagtaatttttgaatctggcccttctagaggtttctgggcaatttcttgcttaagctggattacttctggaggaagcaacacagctcgcttgggcgagctgggcggcaacctcctccccctttttcctataaataggctgaagggggctgttctaagggtcctggatccccctgatgatgtatttcagctgttttgggtgaaaaaaattgtttccgtgatgaaaatccaagccgaggtgcttccgtaa

SEQ ID NO: 116195 - DNA, 462 bp, Glycine max
  Peptide Sequence Number=SeqID_232973
atgtttattctaaccccaattgcgataaactcaccccttacctataagtgggctcacatgtgtattccaacggtgatagcaacatctctagcaatttcttgtgattcctcaagcttttcctctgattgctctgatagagtttccaaacgtcagagagaaggagaagggattgaagcctccattttatactgtctatgtgcgatgcgtatttctccctccatagatattgtcttacaaatcccaacgttgaagcgtaggagcattagtgtggagaatgcggattgtgtgttgtgtggtagtggtggtgaagaggttagccatttatttgttctctatcaattttcaaatcaagtgtggagcacggtttataaatggtgggatgtcagacacaaaggaaatggatcttctagccttaattatattccaggcttccacaatcgggtttcatctcctatggaatga

SEQ ID NO: 116196 - DNA, 210 bp, Glycine max
  Peptide Sequence Number=SeqID_232974
atggaacgagaagcgaaaagagaattgtaccggatacattgttcttccgaggagaacaacatagaagatgatatagaaggaggaattggtgttggctgtgctccggaggctctgtggtgtcaagttccgatggtcgcggtagaggttgaagcccccttccacttctttgatgattctgccattgtaggagttttcaattttaaccggtag

SEQ ID NO: 116197 - DNA, 213 bp, Glycine max
  Peptide Sequence Number=SeqID_232975
atggcgcccgagaacattgagaagactacattcgtcaccttgtggggaacgctctgttataaggtgatgtcctttgggctcaagaacaccggggcaacctatcaaagggctatggtggcgttattccatgatatgacgcataaggagattgaagtctacgtggatgatatgatagccaaatctaggactgaggaggaacacctcgtcaactag

SEQ ID NO: 116198 - DNA, 3231 bp, Glycine max
  Peptide Sequence Number=SeqID_232976
atggagcgttgggaagatgcgtttgcaaagctttctgcatccatgacttcgaagttcgatgaacttctcagtcgcatgaatcagttagaaacctcccacgccaacactcatgctccgtcatcgtttgcggctgcctccgcagcgtccacctccaacgcagcttatagattgaagcttgaggttccgagatttgatggaacggatcctgaaggatggatattcaaggtgacacagttctttgagtatcacgcgacgtcgaaacccgataggttgacgataacgtccttctatatggagggcccagccttggcatggttccaatggatgtatcgaagtggccaactctcttcatggtcagcctttcttcacgccatccatgctaggttttcgtcctcagcatatgaagatcccacgggagttttgtgcaaactcacgcagcgaaccaccgtatcagcgtacctctcggagtttgaaactcttgctaacagggttatcggacttccagtgccatttgtcttgagttgctttatatcaggacttaatcctgcaatctggagggaggttcaagtgatgcaaccacactcactagctcaggcagtttcatttgcgcgccttcatgaagagaagttcctcgatagtcgccgtcagggaagtaaaccttcctcttccatatcttcggggacgagtgccacgcgtcctccatcttccttgaacgcacctctacaagattcgtcactactgccttctgcgagcagaccacgtgcttccaccatccccttcaagagactaacaccgtcggagctcgctcttcgccgggaacaaggcttatgttttaattgcgaagaaaaatattcgaggggacataaatgtgcatcctctctatttttgtttgtcacagaggaagatgatgataaccgcgatatggaccctggaccatcccagttaaccccttcatcgcaggaatcgtctccgacacagattagcttacatgccttgtctggtcacggagcaccgaagactttacgcctcaccggattaattcatgatcatcgcgttcaaattttgatcgatggaggcacttcgctgcaattacaaccatgcgagacctccactctgcgtgtcacggttggtaatggtgaggaattgcagtgcaatcaggtttgcacgaatattgccgtgagaatacaaaagcatgaatttcaggttgatttccatgtcttgcccatacaggggcttgatgttgtactaggagtccaatggctcaaagccttaggaccagttctcactgattacacgacgcttacgatgaaattcatctacaatggccagttgattgagctcgtgggggatcgtgactcatcccttcagatgatctcaccttctcagttacagagatgggtggatacagccctacccccatcaagacccatagatcacgccattaccctcctccctcacttagccccagtcaacgtaaaaccctatcgttacccacacttccaaaaacaagagatagagacccaggtcgcagcgatgctcagacaaggccatatccaacatagctcaagcccgttttcttccccaattctattagttaagaagcacgatggaacttggcgtttctgcgtggattatagggcgcttaacgcgatcacaattcgagatcgtttccccattccgacggtggatgagcttctcgacgagctcggaggtgctgtttggttttcgaagctcgatctgatgcaaggataccatcagatcctgatgaaagagttcgatatcagcaagatggcgttccgcacccatcatgggcattacaaatttcgcgtaatgcccttcggtctttgtaatgctccatcgacgtttcaagcaacgatgaacaggttgtttcagcctcacttacggaggtatatcatcgtcttctttgatgatatactgatctacagtcgcattttggatgagcatcttaatcacttggaaatcgtgtttcaggtgcaagccattcaagcttggccgcagccacgatcaacgcgagctttgcgtggctttctaggactagtagggttctatcgcaggtttataaaagggtacgcgatgatagcccacccactatctcaaccactgaccaaggcggagctggtttggtctctggaagccgaaagcgcattccacatgctcaagaaggcagtcacgatggcgccggtgctcgctcttctggacttcactaagccttttatggtagaaaccgatgcttcgggcttggggataggcactgtgcaggatgggcatccgatctccttcttcagcaagcagttctgcccaaggttgctgaggtcttccacttatgtccgggaactagccgccatcaccgccgcggttaagaaatggcggcagtacctattgggccaccatttcatcatattaacagaccataggagcctgaagaaactgatgaatcaggccgttcagaccctagagcaacataaatacttagcacgactactgggttttgattatgttatccaatatcgagcagggaagagcaatgtagttgcagacgcgctatctcggtcaggagtatcagcacctgcttcgctcttcattatttcagttcctcacttcgtttttctcgaagatttgagaagggaattgcaggcaaaccccgaattcactgagttaaggaagaagatgatcgtagagcctcatgcataccctgatcattcactagctcaggacctcattctctatcgtggtcgcatatggctaccaccaaactgttccttcatcaagatactactctcggagttccatcaatccctaacaggaggacatatgggtttccgcaaaaccctaaaccgagtaactaagaatttcatgtgggaaacgagcactcgcgacacgcgtgacttcgtatccaactgtttagaatgtcaactggtgaagtacgaaccagcgaaacccagaggccttttatatcctctcccagtgccgtcgcagccatgggaggacctttcgatggatttcatcgtaggactcccagcatatcggggtaacacatgtatgctggttattgtggatcgcttctccaagggagtgcatctgggaatgcttcccccgcatcacacatcgcagaccgtggctcagttattcatggagatggtgggcaaattgcatgggatgcctcggagcatcacgtcggatcgtgatccgcttttcctgagcaagttctag

SEQ ID NO: 116199 - DNA, 558 bp, Glycine max
  Peptide Sequence Number=SeqID_232977
atggtgcaacaactttctcgcccttacctttcgtgtgctctttcagtgtctcacagcgcagctctctcacccttccctttctctctcgcgatcgagccccaaagctttccaagcctcaaggaagccgtgaactccaagcccaagaagaagaaaggaacttattcgatttatgatgttggcatgaagaagaaaggtgttgatgagtttcctttctgtgttcatttggtttgttgggagaaggagaatgtctcgagtgaggcgttggagagtgcattccacttgagagtcaggatggatccctcccatgttcttaggatcaacaaaatgctttcatgtgctggagccgataggctccagattgggatgcgaggtgcgtttggaaagttgttggctacttgtgctagagtggctattggccaagtccacctttcggtctgctgcaaggacaacaacaaccaccatgcacaagaagccctccgttgtgctaagtttaagttcctcagatgccataagattatagttagtaggaagtggtatgtatctggacatggctactaa

SEQ ID NO: 116200 - DNA, 228 bp, Glycine max
  Peptide Sequence Number=SeqID_232978
atgcccacaatttgtcaaacaatcaacaacaacccagataactgtgtgattggcagaaggaggcaaattagtgatgaagtccatggagatgtcttcccaaacctgattgggaactggcaatggttggaggagaccaaaggatttcacagtttttcacaaactcttaaacctttttgtacattccagaccaataaaagattgcagataactgcactagagtggccttaa

SEQ ID NO: 116201 - DNA, 603 bp, Glycine max
  Peptide Sequence Number=SeqID_232979
atggctatgcttattgctgacatgttaaaggaggggatcattcgcccttccactagcccctactcctcatcagttctcttagtcaagaagaaggatggttcgtggcatttttgtgtggattataggacctttaatgcccttacggtccgtgaccgtttccccattcccacaattgatgagctactggatgagctcaagggtgcttccttcttctctaagattgacttacgttcaggctaccaccatgtcagattagcggagaaagatattccgaaaatggggtttcaaacatttgatggacactatgagtttttagtgatgccttttggcctcactaacgcactgtctagcttccaagcggccatgaatgaccttttgcatcccttcttatgcaaatttgttttgattttgttgcttttataccaacaccagttctatgctaaattttccaagtgtcgctttggagtaacttcagtggactatttgagacacataatcagccatcaaggggtacaagtggactcggacaaaatcagagctatgatggattggcctacccccacttccttgactaccctacgagccttccttggtctcacatga

SEQ ID NO: 116202 - DNA, 826 bp, Glycine max
  Peptide Sequence Number=SeqID_232980
gcccttggcacgtctagcatcttgttcaactggggttaggtatttaattgggaatggggacttggtagaggaaggggcagggagtgctaatttgttgggtggtgtgggaagcaagggaggaagggttttaggaggcatccatgggggcttagcgaataaggttggggtagcttgtagcttggtttcaactagtttgaggcctaagaggaaacagtttatcatggcagtactagggcatgttggtgattttcaaagccattggaaccagccatatagcatgaaagctgggaaaggtgatgagcaggagcaatggaatagtgttaaaaaattgttcaacctggaatacccattcaaggggggtgtctatggtgcaggatggtggggttggtggattgtgggttttgttttctataagcagttcttgaaggagttggaaagttttaagttggacgatttcggatttttcagtgtgggatctagtcatcatgtgaggatcccggctagagatttttggccattcgaatcgggtgtcttaaatgggctgggaaagttcatgtgtatgcctcaatgggaacagaccaagaagatggtggacgaagagcatttcattgcacaaagcaacgtgaagggtaaagagaaattgaagaagcttgtggatgagaacaaagagaaggaaatgtccttgttcatggttcaatggcttaaaacaaggaaggttcagccagaacataacatgaccaaggctgatttcaatgctgtttcatcgatgattgatcaaaatcgaaaggacattgctgaaaggatggaaattttgagtgttagtgag

SEQ ID NO: 116203 - DNA, 216 bp, Glycine max
  Peptide Sequence Number=SeqID_232981
atgggcccgaaatctaccctaaggctcataagaaccctagggccttctcttgcacttcacaccttccttgcttggccgacacatctggtcaagtctttatcacaccaggtagctgtgtctccgccaaaaccacctccgaagcccgatccggaggtcgatgatccgctttatctgatgacattgaccatcctagagcttttcttaaggccttatcag

SEQ ID NO: 116204 - DNA, 925 bp, Glycine max
  Peptide Sequence Number=SeqID_232982
atgtcatttgcttccgcgcgggcattgcgccgatgttcatgcggcgattcgcgggtgagaggcaatcgtggacgacaggcgacgggcaatgcgtgggttgttacgaatccgccccgcagcgctgcaagctgccattgccggccgcggccggctgcgcgagaatccgcggcagtcggtgccgccacaggggtggctacccgggttctttacagggcgaagacaaacgtgccagcagtcatggatggtcgagtgggcgggaaaatggcgggcagatgggcgcgccgcatcgcggcgtccgtgctggggttggcggcgggcttggcgcaggccgcccatgtcgtggtcgacaccggtcatacgccccggcagccgggcgcgacaggcgccagcgggcgggtggagtacctgtacaacctggacctgagcggcgcggtggcggccgacctgcaggcatcgggtgatcgcgtgacgcgggtgtcggccgacggcgccgaggtgccgctgggtcgccgtacccggatcgcgccgggtgcggatttcttcatctcgatccaccacgactcgatgcagcagcactacatcgacgccggccgccagcgcgaattcgcggggttttctattttcgtgtcgcggctcaatccccgttatgaggacagcctgcgctgcgccaaggcgatcggcgaagcgctgctggcggcgggcgagaagccgtcgctgtatcacgccgaacccatcgccggtgaaaaccggccgttgctggacccgcgcctgggtgtgcatcgctacgatgggctggcggtgctcaagaccgccacgatgccggcggtgctggtggaggcgggggtgatcgtgaatccggatgaggaaagcccggctggccaagctcgagaccatccagcggctggctcgcgcgattgccgatggc

SEQ ID NO: 116205 - DNA, 405 bp, Glycine max
  Peptide Sequence Number=SeqID_232983
atggttaccggcgcgtggcgttcaggccgctctcattttggcgcgctaccatcaaagccatgcccctcgcatccgcgggcgcatcccggctcgcggcatccttacccggaggtccccagcatgagcaatctgaacggaaaagtcgccgtcgtcaccggcgccgccagcggcatcggcaaggaaatcgcgctgaccctgtcgcgcgccggcgccgcggtcgccattgccgacttgaaccaggccggcgccgacgccgtcgcccgcgaaatcgaacaggccggcggcaaggccatgggcgttgccatggacgtcaccaacgaagacgccgtcaaccagggcatcgaccgcgtcgccgccgcctatggcagcatcgacatcctgatctcgaacgccggcatccagatc

SEQ ID NO: 116206 - DNA, 156 bp, Glycine max
  Peptide Sequence Number=SeqID_232984
atggttgaagaaaagcatacgtaccaagctaaaaacaataaagttgatcgagattcttggtcttcaatggattggaaggccttagaacttgaagcttcaagctccttattaggtaggcctgtgcatggatcagagaaaggaaagataaaaaattaa

SEQ ID NO: 116207 - DNA, 360 bp, Glycine max
  Peptide Sequence Number=SeqID_232985
atggtgaaccaagagagtttcattgcagatactatccagaaaggtggagaccaaataaagaaaattgtgaaggacaacaaagaaatggagatgacaatattaatgtatcagtgcttcaatacgggcattgttgagcctagtaataacatgaccatgtctgatttgaatgttcttttcgtctgtgacatagctctttgtggagcttctaggccctggatcttcttcatcaatggagtcctttgcttcttgaagatcaatggcagcgaaatggagaacgaaaatgattggagacaccacttcaaggagaagatgagtcaagaagaagctcaccaccataggaagccatggataagagcttga

SEQ ID NO: 116208 - DNA, 207 bp, Glycine max
  Peptide Sequence Number=SeqID_232986
atgaggtttgcctatgtcaggaaggcatctagatgctcgtctggatcggttgtctcatcataccgtttgaggttaagtggcttccaccccaagggtatgtctgcctcgataatacggtcgacgaaacgatgccgacagacaatccgtgttgctggacagtgcatgtatgagggacttaggtcgtctatagtgttgcttatgcgttaa

SEQ ID NO: 116209 - DNA, 234 bp, Glycine max
  Peptide Sequence Number=SeqID_232987
atgtggcaacggggattgcatcagtctgtcattgaacaaaagctgagagacattactagaaggatggaaatgctgaacgtcaacgaggcggtggtgttgaggccaccgcagcaacctgagatgcaaacaccggtggaagcacttccacctgtggcaccgcccgaagaaacggcgacaacgctgaattatgaccatggagcatctgatgtcaatgctgaccccttgcaaagctag

SEQ ID NO: 116210 - DNA, 1593 bp, Glycine max
  Peptide Sequence Number=SeqID_232988
atgcgcaatcttggcctggcggcgcggtttgtctctggctacctgatccagctcaaggctgatgttgaggcactggatggaccgagtggcaccgataaggactttaccgacctacatgcgtggacggaggtctttattcctggcgctggctgggtggggctggacccgacgtctggcttgatggctggcgaaggacatatcccactagcgtgtaccgcattgccatcttcagcagcccctgtgacaggctttaccgatgtggcagaggtgacgtttagtcatgaaatgaaggtcacccgtatccatgaagatccgcgtgtgaccaagccatatagtgaaaaggattggcaggcaattcttaagctgggtgagcaggtagacaaacagctcaccaaaatggatgtgcggctgacacaagggggggagccaacatttgtctccatcgatgacatggatggcgcacagtggaatactgctgccttgggtgaacataaacgcaagttggcgggtgagctggcgttacgtttgaaagatcacttcgcgcctcatggattcttgcactatggccaggggaagtggtatccaggtgagccgttgccgcggtgggccatcaatatttactggcggccagatggtaaaccagtatggcgggacgccagcctgttctcggcggaaggccttggggatggttacggtattaagcaggcgcaggtgtttgccacccacttggcggatatcttgggttttcccaaggcgtgtgtgatgcctgcctatgaagatgtcatgagtctggcacagcaggagcagcaactgcctgccaatattgatccactcaaagccgacttgaaggatgcagccgagcgcaagcggctggctagcctgctcagtcaggggctggggcaggtagtggggtacatcatgccgcttaagccagacgaaagccgcagtgctggtgaatggttgaccagcaaatggccgttacggcgtgagcacttatacctgttggggggtgattcgccaatgggcttgcgcttgcccttgtcttcactgccctggcaattgcctgccgacattgagccggagtttgcccccgacacgtttgcagaaaaaacagctttggatgagaccaagacgcccacagtgagggtgaagcatcagacgacccaacctactgcacgcgaagtgatacatactgcattgtgcgttcaggtcaggcagggccggttatacgtattcatgccaccagtgacccggctggaagattacctggatttgctgagcgcgattgaacagacggccagtgatctcaaattgaaattatggttggaaggctataccccgccccgtgacagccgcctgaaattgctcagcgtgacgccggatcctggcgtgattgaggtgaatatccatccggcaaaaagctggaaagagctggttgcgaatgtcggtacgttgtatgaagaggcgcgtttatgccgcctggcaacagaaaaattcatgctggatggccgtcataccggtaccggtggcgggaatcatgtgaccctgggaggtgagacggcagcagacagcccgatgctacgacgccctgat

SEQ ID NO: 116211 - DNA, 1131 bp, Glycine max
  Peptide Sequence Number=SeqID_232989
atgtctcgcatcccggcgggcgtaaggacagcaccttcccggtcaatgccaatgaagcggaggcgcgtcgatttgcacgcttctggtcgcatgggcattcaccgggccgggtggatgtggccaagctgtgaacatcctgttacactcagtgtcttgtcattgcttaaccagctttatttttctgaccgctacaacgaactgttggatagcagtggtcaggcacgtccgcattggcaggcattggtctcgcaactggagaccgaagagccgacggccatgcgcaaacgcatagaggccgtccagcgccagattcgtgataacggcgtcacttacaacgtttatgccgatacccatggcgtgcaacggccttgggacctggatgtgctgccattgattatcccgcaggaggaatggcagcatattgccgcctcggtggcgcagcgtgccaccttgctcaatcgagtgttgctggatatttatggcgagcagcgcttattgtccagtggtcaattgccgcccgccctaatttatgggcatagcggctttttgccctcttgtgtcggtatcccgcattacgacaacatggcgctgcatagctatgcggtcgacctggcgcgggcgcccaacgggcagtggtgggtggtgtctgaccgtacacagacgcctaccggcgccgggtatgcgctggaaaatcgcaccattatttctagcgcttttcctgagttgtttcgtgacctcaacatcgagcgcttgagtgggttctttgccagcatgcgtgacagccttgcgcactgggggcatcgtgtggcggctaaccaggcacagactgtccctggggtgaccgcgctgggacagggggagccgccgctcattgtgatcctgactccagggccctataacgaaacctatcacgagcagtccttcctggcaggttatctggggtatccactggtacatgggagcgatctgactgtacgtaacggcatcgtctggctcaaaaccatcgccggacttaagccggtgcatgtgattttgcgccgcatcgatgatgattactgcgatccactggagctcaatgcggactccttgctaggcgtggccggcctgacccaggctgcacgtttggggaat

SEQ ID NO: 116212 - DNA, 555 bp, Glycine max
  Peptide Sequence Number=SeqID_232990
atgcaagaaaacaaattgtgttttctggaaaatgagatgaactcgctaagcgagcatgttgtgctaagcgagttcatcaatactcactgtatgctaagcgaggctgaatcactaagcccagaatcaagaaaaagagctagaatagaggacatcccttcgtcatccactccaactcctccgttagtaactgtaggacaggatgtccaaagctcactaactgtagttcctatgctacaaagcttattccgaggacagtttattatcatgcacagcctgcaagagttggctcacaataggccaatcatatctatggagaattttcttgagcaagtagcttggcctgaagatcaacttccattggttaattcagagccagctaacccacaatcttcagtggtgaatccaccttcttcgcctaagattgaagcagttcccctatctcctcctctgattgtcatttttgacgcatcatcaaatgaagcaactgctcctcctgattcaccagctgcagaaacagctgacccgccctgtttccccaattggaggaattgctaa

SEQ ID NO: 116213 - DNA, 1272 bp, Glycine max
  Peptide Sequence Number=SeqID_232991
atggacagaaacattcttgactctctgttcttaaacatccactttcatggccttgacatgaaagaaggatcaatcccagcagccttaatttataggatccagtacaaggtcatgaatacttgtgcatctagagtcctgttaaaacctcaaagaggagaaacaaccttgtttatcactgatatgacaaaggctaacgtgtctctcccaagaaaaataaaatgggatgaagtaactcttcccgaaagatgggttatggataaggccacaccgtctattccccgacccgctccaaccatagagcatattaagcaagataactccggaaaggtagagataaccttcaataggagaaattctttttcatcaagaatagaagcctctaggtctgaatatgagtcagccagaaggtctttttcagttagaacccgttcaattccagtaggactaaccagatctgagtcacataaccagttccctactgtaaacctccaaggattagacactacttctagcatacctagaacaacttacaaccaagaacaggaggacgaccaaaacattgataaggaaacccttaggaaagatttctattctccggagaatgaacctcaaaagagatggtttttccaacattacaagggtacaaaccgaaaacaaatccaagacaagttctacgaatttgtcgaaagagtcaaaattaatgtcattttctttgattggtttcatgcttatgccatcagaaaggatatagattacccttggaaacaagacatcataggtgatccaacaacaaatgtcataacaaactggcaagtgaaggatggtgagttaatccaatcggaattacctcccacaacacaatatcaactaccaaatatcaaagacagtaacaataaacctgtcatggcaattccattcaagacaaaagatgtcaacgaggaagtaacctctaaagacattaaaagcctaatggaacaggcaaattataccaataaatacctacaagctttaggagaaaccattaaaactaaggtagttcctaaacaaaaatcaattgaggaagcttcgccaagtgtccccattgaaaaacctttattcaaacctttcaaagttagtgagaaggctaaacgaaaaattagggaacttagaaaaactaaatccttaactgaaggcgtaggtgacaatcatagtgaattactaaacacgatcggtagtttacttaaggtcattccagatactccccaagcctcggaaatacttccaaaatggtaa

SEQ ID NO: 116214 - DNA, 267 bp, Glycine max
  Peptide Sequence Number=SeqID_232992
gaagagaggctgcaaagagacatatctaaaagtgctcatttaagctgcacctctcagaataagaaaagaaagaaaactaagggtgctactaaagggtcttctcaacaaaagaaactaaagaaggatgaggaatttacttgctacttctgcaagaagtctggacacatgaagaaagagtgtcccaaatacttgatgggtggattctggtgctactactcacataagtgtaaccatgctgggttgccggtggagccgactgccaagtga

SEQ ID NO: 116215 - DNA, 525 bp, Glycine max
  Peptide Sequence Number=SeqID_232993
atgtcttctgagcctccgtttttccacagaataattcctaatgcttggaacacccaccagtgtaacaagaataagtccttaaccttaacactgcctcagaaccatggtggttctgatgatcacttgccactataccattttaatgcaactgagaaggaaaaactagactacaaccccaagaaaattcccttaaatctgttaccaaaaattgtttgtctaacttttgctgctttggggtatcaaacgatcacatcccaagaccaaccttgtattcttggacctgctatagtgattgcttttgtagcttcactctctgtggtgttattttcaaacaatgataccataacccgttcctacccacggcttgcagctattgttgagctaattgggtatctctctttcacactcagtttcttggtaatgataagagttttcttctctggaaatttgatcttgtggattatcataggagggttggctatgggttggatcatgctaatcctccttatacgcttatttacatga

SEQ ID NO: 116216 - DNA, 426 bp, Glycine max
  Peptide Sequence Number=SeqID_232994
atgaaacaaaaaggaaaaagaaagaaagaccgcgaaggtcgacatgttatagttaagaagtataaatcattcgtaaagagaaaacgtatcttctggaaacaagggactgacgctaagagtttattttccggaataaccgagataagaatggatgaattcattgaactgatgaaagaacataacttggaaacgttggaatcctcattctttcccccgaagcaaaggacagtggaatctcctcaagggagagcaaataaaatgctaaaacccgatttcccaaagaaaggaaaggaggaagtgggaagaacaggaataaatgacaagaaaagaaagaacaagaacaataaaaaagaaagaaaaagaacgatccccgatcaaagatcgaaaggaagtgaaactggaaaagatcggaggaaaacagagtaa

SEQ ID NO: 116217 - DNA, 690 bp, Glycine max
  Peptide Sequence Number=SeqID_232995
atgctcgccgcggtcttcactctcatggttgattccttctccattaattacttcaggaagaagcttactacttctaccgctgaatccaccacagcttcttcccttgaagccggcgagaacaaggaaggagacatgttcggtcatggacattgtcatggccatgtaaatggacatcgtggagatgggatgagcgtgaatggggaacagttgctgcgttaccgtgttgtggctcaggtgttggagatggggattgtggtgcactcggtggtgattggtttgtcattgggagcttcgttgaacccgtgcacgattaggcctctcattgctgcgctctgctttcatcaattgtttgaaggaatgggcttaggtggatgcatacttcaggctgaatatggaatgaaggtgaaggctataatggtcttcttcttctcggcaacgacgccgtttgggatcgcgttggggatcggattatcgaacgtgtatagcgacgcgagtccaactgcgcttattgtggaagggattctgaacgctgtttcggcggggcttttgaattatatggcacttgttgagttgttgggcgctgatttcatggggcccaagttacaaggcagaacaaatgtcatggcttgggcttttgtggcagttttgcttggggcagggggcatgtcagtgatggcaatatgggcgtag

SEQ ID NO: 116218 - DNA, 111 bp, Glycine max
  Peptide Sequence Number=SeqID_232996
atgagtggtaatgactggttaaaagagatttgttctaacagtgcatgtgcaaaggaagaccgtgttaatgacacgggttcatgtccaggccgggaattcttcaatttgtaa

SEQ ID NO: 116219 - DNA, 1055 bp, Glycine max
  Peptide Sequence Number=SeqID_232997
atggatcgcggcgcggcacgcgacgtccctgggcacgggccaatagcgcccggcctgtcgtccaccttgcggatgcggcggaaagcgtggaaccccttccgcgtttgcggcgatccgcgcgattcaggagcaagacgtggttttgatttcctcggttcgttccccccccggcgtgggcagccaacgcatccggcggcgccagccgggccgcccggcgcgatggcccgcggcgctcctggtgctggccttatgctgcgggccgctggcggccggcgcgcaagacggcctgggcctgatgtacgcgaatgcgcaaggcggcgagaaggacgatgcgcaagcggtggcatggttgcgccgcgccgccgagcagggggaagccggcgcgcagactacgcgcttgccgcgcaatggtgcgagaaagccgccgtccagggcaatgccgaagcgcagaccatgctcggccggatgtacgcccagggccagggggtggcgcgccaggaagacctggccgtgcaatggtggcgccgcgccgccgaccagggctacgccgaggcccggtatcagttgggcgaccacttcttcgacgcccctgccccgcggcgggacgatgcccaggccaggcgctggttcgccctggcggcggcccagggccacgccgaggcccagaacaacctcggcgtcatgtacgcggacggactgggcgggccgcgcgaggtcggcaaggcggtcgagtggttccgcaaggccgccgaacaggggctgcccaaggcgcagaacaatctcggcgccatgtacttcaccggcagtggcgtgcccgccgacgataagctcgccgtgcagtggtggcgccgcgccgccgaccaggggaatgccgccgcgcaggaccgcctgggcggcgcttatctgtccggccggggcgtgccccaggacgatttgcacgcctcgcaatggttgcgcaaagccgccgagcagaaccatgcaccggcccaggacacgctgggcacgctgtatgagcagggacgaggcgtgccgaaggacgaatcgcaggctgtgcg

SEQ ID NO: 116220 - DNA, 732 bp, Glycine max
  Peptide Sequence Number=SeqID_232998
atggcttctaggaaaagaaaggcaccatctacacccacacaagttagatttgacagatcaagatttacttcccaagaggcttgggaaagatatacatacattattgtgcctaggaagcttctgccagagaggaacgtggtggacgaggagttgactgactttggggatggcaacattgatgttgctattgtgaaggaattctacaccaacctctatgaccgcaaggacaaatcacctaagcaggagttggctgctaagctctgtatcccagggaggggattcgagcttaatgctgatgggcaacccctgaagattttgaggaagaacatgaccaccttagctcagacatggagtgttctttccttctcaaacttgattcccacctcccaacttctgatgaaggccagagggaatagatctaaggtccttttcatagcagcattagaggcaccaacaccttcttcttctacacttcctccttcttcctccatagatattccaccagcagaccagccttcttcctctggaaggggtggggcctccacagcccaggagcctgtgactgaggagcccacaacaccagcatcatcaccagcagtagcagaggaggagaacactccaactcagacccctcagccatctccaccatctgcaccttctcttgaggagactcatccatcatcagcactggatcttaatgaagaccagccacaggaggagcaggacgtttaa

SEQ ID NO: 116221 - DNA, 267 bp, Glycine max
  Peptide Sequence Number=SeqID_232999
atgattcttgatgactatgaaggagaagagcattattgtggcaaaggaacaaatgtgaggagtgtttcttttttgccaagaagccaagagaagatacgagattcggctaaagttgtgataaaacaagacatgaagggaggagagcataaatatgggtttaacaacaataaacgtgagaagccagagaaggtaagggtggtggatgatgaaactggcgacaaacatgagctgtatgaagtcctaaggatgccatctagatgtgtatga

SEQ ID NO: 116222 - DNA, 1961 bp, Glycine max
  Peptide Sequence Number=SeqID_233000
atggacccaaccaaggttcaagtagtggtgaattggcgtactccgctcaatgccaaagatcaagattgtccaacctttaaggcgctcaccaagaaagatgggttttgttggggatcggctcaggccagtgcctttgaagatctcaaacgccttctcatgcaagacagacaacctaatgcctattttagtaaggcgctttcaccctggacgatctccaaattagtctataaaaaggagattatggctctgactttatctgttcaacattggcgtcattacctgtttgggaggagctttaagctcatggggtatcagtttgaagtcatttacaaaccaggccctgataacaaggatgcgaatgctttatcctgtcaacaccttgctcctgaacttcatgccatctcgatcagtccttattgggtgtatttcccaaggatacgtgcagaagttcagcaggatcccaactcggctcaattgagcagtgccctgcaatccaaccctaacaccaatcgcaactatacccttcgcgatggatttttattctttaagggaggacattcggggttcaccaagacttacaagaggctcgctttgtcctttctttggaaggggatgcagaagtccattatggactatatttgtcggtgtgatgtttgccagaggaacaaatatcacgccatgtcccctgtgggtctgctccaacccattccaattctagagagaatttgggaggaaatctctatggatttcatcacaggattaccacgctcccagggttatgaggtgaacagtagcggaagccttcatacaggatgggaccacgttcaagatgagcaccacttacacccccggatcgatggccaaatggaggtggtcattggaaaccttcctttgctgctttgcttcaaaacagcctaccaagtggcatttgtggttgtcctcggcagaattttgaatggttccgcggtgagttccttacccctgatgttggagattgatgactcagaaacatccagtccggaagctatacttgctactcgtgtcaggaagcatcagggcacaccaatggaggaatggctgatcctttggacgtcacaacccacggaagaggcaacttgggaagtggcacattccatcaaggacaaatttcccagtttctaccttgaggacaaggcaaatttcataggggatgaattgggagctgtgagaacctttctcaagcttgggggagcatctgctctcgatgatgaatcctatatcttacctgtgctcttacgatttgatggtcaacctgaggttgacgaggagacgacagcttctcaaaagagtaagagaaaagaatatgttggaaggagatgggcagattgggttggaattgagaagtttttcaaggagaaaaaatggcaattcagtataactggaacgtcagagagagcaatggtcattggcctgggtggcctcaatctgtttggagttattattcttggaaccatgttgaaagatacggctgttgcacccagtagcttcattaaatttgtagccgacatatttcctcttcttcagaatgtcggtttggggcttaactcaatccaaaagctagctcaagagatttatgctggttccttctttgcaattcctcttgttcggtggttttttattcggaaaaagaatgctgatatcgaaaagagaaacaaagctaggcagcagtgtgcacaagttcttgaattacctgacacttcactaaggcagaagtcaactgttaaaattagagaaactgacggattcttgagtgaaaaccgtgtgccagagtatgcagtggatatctggttatatagtgctcgggacatggccgaaaagacagtcataggacaggatcaaattgtgtatagtactgacaaggacttacttgagcaagagtatgaagctcgcgaatgggataaaaaatttcgggagctagagag

SEQ ID NO: 116223 - DNA, 337 bp, Glycine max
  Peptide Sequence Number=SeqID_233001
atggcagatacagtcgataagaatgaggtaaatctatgctttgaatctaatacttcttctagtgcttcttcagatgatgaaaaggatatgccttatgatcacgtggacaatggatgttcatggcacatgacaggggaaatgtttatgttccttgacctaaaatcacttgaaggaggagcagttgcctttggaaacatagtcaaaaggatcctaaggtacctcaaaagaactttctcatgggatctccatctaaaacctgcttctactcctttttccatcaatgccttcaatgacgcatattgggcctccgatccgaatgacaagaagcccacatctg

SEQ ID NO: 116224 - DNA, 405 bp, Glycine max
  Peptide Sequence Number=SeqID_233002
atggctctcatgggatctaaaagcaattttgggaatatccgcttccctcatccgaatttggtggaaaccagatatcaaatctatcttggaataaacttgggagccatgaagttcatctatcaattcactaatggtaggaatcagatactcatccaaaactgtgacccgattcagagctcagaagttgacgcacatcctctaggtctcatcctttttcttgacgagaataataggattggaaaaagggcttaccgaattgcggatgatgtcatcataaagaagttctcccacttatttcttgatctcatctttatggtggaaaagcacgaagaatcgagttggaggagggtggtatccaccatagccacaccgtgtaagaggccctacaaagttggagaacggtga

SEQ ID NO: 116225 - DNA, 306 bp, Glycine max
  Peptide Sequence Number=SeqID_233003
atggtgccttccaagctcaaaggaatgttttaccacatagccataagactacttcatgaaattatagtggagagagaggcttggggtgatggagcaacaataaagatcaagaaagcatcccaagtgatatgctgtaaggcaccacaaaaaatgggaactatattaggacttccaaaagaaatgctatgctggcttctattaaacatggaattgaactcaacgggattagtcttccaccctacaaggaaaggaaaccacccttcgaatttgggcttaaggcctaactcaaaccggcttttaaggtag

SEQ ID NO: 116226 - DNA, 261 bp, Glycine max
  Peptide Sequence Number=SeqID_233004
atggcgttggagatgcgcttcgctccttccttctatgacaacccgagaagggctctccccaaattatcccaacatggcacggtcaattcttacctttcagaattcaagagtttagctaatcgcattgttggtttacctccttcgtgtcttcttagttgtttcttttcatgtttatcaccagagatccgccgtgaggttcaggcactgcaaccattgtcccacgtccaggccgccgctttggctaaattgcaggaggactaa

SEQ ID NO: 116227 - DNA, 645 bp, Glycine max
  Peptide Sequence Number=SeqID_233005
atgactggcatacttttatttttgaaagagcaacatattttaaagggacgccacaatgataccaggtgtttccaatctctggaagcttggaatagatatacggacaacattcttggtcggaacatcattccgaagagaaatgttaaaatttatcatactgagttcgacaagtttaaagtgttgttggagaggcgtaatctccacaaacgcctcaccaaactccaagatggaagcatagacatggcagtggtgaaggaattttatgctaatctatacagcccagaggaaccagcccctaaacaagctagagtaagaggacatctgattaagatcgatgcagacaacctaaatgaatttcttcagattccagtgggccagccatggaaacttcttagaaaagatctgaagacactggcccagacatggaatgtcttctcttactccaacctagctcccacatccaacacctcagatttgaacatggacagagctaggttggtctatggcttggtgtctaacatggacatgaacatcggagcccttatctcagccttaatcactgccctttgcaaagctagaggatttacctctaacagtctgacctatgagagcctgagcccggacattaacttggcctacatttag

SEQ ID NO: 116228 - DNA, 240 bp, Glycine max
  Peptide Sequence Number=SeqID_233006
atgaacgtgctaagcgtgcttgttgcgcttagcctgttcatcgcagctgttaaatttttggatttccagatgatcacgctaagcggaccatgtcgcgctaagcgtgctaagcgcgccctgtgtgctaagcctaagggtcattctggtgaggctgagctaagcccaacatgctacgctaagcccataccctcttctgttttgaaaatggctaggcgtgagtctgctgcgcttagcccatga

SEQ ID NO: 116229 - DNA, 261 bp, Glycine max
  Peptide Sequence Number=SeqID_233007
atgaaaaatttgggaacattgattgcaagaaaaaagaactcagcatcaggcctagcccaacatctcgctcaacgcaaagcacgtgctaagcgcgaaggaagcagtcacactaagcgtgcaacacgcgctaagcatgcaaaccagaacaatggcgctaagcgagagcagctcgctaagcgcgagatccagcacgcgttgagcgagaggagcgcgctaagcaagcttacgatggtccaagtccactttagcagctataaatag

SEQ ID NO: 116230 - DNA, 120 bp, Glycine max
  Peptide Sequence Number=SeqID_233008
atgacgactctttgcaaatccagaagaaaggtgtcaaagggcaataattgtcaattttgtgaaattaagacatttccaaaaggattgcctaaagtagattccttacaatccaaaccataa

SEQ ID NO: 116231 - DNA, 300 bp, Glycine max
  Peptide Sequence Number=SeqID_233009
atgaagaactggatgcagaattcaaagaaggatgtgtacctaggagcctacttgaatggtgcacattggcaaatagtaatcattttgcctaaggaaaatcttgtcatctggttttgttcgttgcataataggccaaacaactacctgaagggaattattaacatgttagttctattcttcaatacatttgcattagcattagttgggaacatcaattttttaattgtacaatacgcatccatgtttgtattgaataatgctttgaaaggacttgacgatactccacaaagtaaatcctag

SEQ ID NO: 116232 - DNA, 606 bp, Glycine max
  Peptide Sequence Number=SeqID_233010
atggtcactgctgctaaatcttcaaaccaccactcgccccccagtgctccgtcaccggcgcagcccggagacggcaacagccccaagttcccgcgaaaaaatcttccctcgccgtgggctcaggtagttcgcggcggcgagccggaatcggcgggcggcattcaccaatcaccgccgtcatcgtcctcgtcgtcgtcctcgtctctggttgctgatcaagccccgtcatcggaggtgattccggtgtcgtcgccggtggataattctaatacggttggtgatgtagatagttccgatggcgctgaaggcaatgcggattgttctaaaaagcccgtttggaacaagccctcaaacggcgtcgtcgtcgtcgagactgggcctgtaatgggcgctgctgaatcatggcccactttgcttgcgtccaccaaaggttctgctaaattgcctgctgaatcgtcctccaagactgttaccgatgatggatcactctccacttctcagtggccaatgacttcacaatctcctcagaaacaagcgactactattgcaaaacctagttctgcaccaaattataatgtgcctagtagacaaagatcgatgaagcgg

SEQ ID NO: 116233 - DNA, 396 bp, Glycine max
  Peptide Sequence Number=SeqID_233011
atgaattatgcgccctttatcattcaggaacaacaggttgggtggcatagtaagttgggtggtaaaacgcgcagagacagattcaacaccctttgtcattcagatttcgcaagtcgagtgataaacgcgcagagacaagtctgcgccctttgtcattcagggacagtaagtcgagaggtgggcggagacaaattatggtcattccgcgcaccttttcgccatccagaggcgatcgtgtccggtggcatgcagagacaaattaatggtcattctgtatctcgctgcccaggctcgatcgtttccaacaaaacgcagagacaaattatggtcattcagcgtcttgtatcaactgagaggaacaaattcgacagtatcaggatgatgtgtcggtactga

SEQ ID NO: 116234 - DNA, 267 bp, Glycine max
  Peptide Sequence Number=SeqID_233012
atgaccaccacgaaaaacacgacggtgacgatgccatttcggtcaacgaaatatgaaaatgacgacggcatcgttacgcatacaaagatgacacaatatacgataaactccaaacttgggtgtgtgtcgctgtggtcatcatcgacgggaatgaatgtatggtggtcgtcgctgtggttgggaaatttggcaacgaactacttctggaaacaaggctgtagaagtgtgggagatgaagcactttcaggaaccagactttggaaatga

SEQ ID NO: 116235 - DNA, 804 bp, Glycine max
  Peptide Sequence Number=SeqID_233013
atgaaaaggaagtgcatgtatactttagaaaatgttgatccaatggggggtcctgttagtgaaattgggccggtgattaaagtacatgcaatgcctataaattgcagtgcagaaaatgttgttgagactgttactgaagagtgtactcaaaatggtattgaagatatggatgatgatggtgctaaaggtggttcagatgatgaaaatgaagtagttggacttggtgtacaagatgtagaaactgaagtcgttgaaacaacagttgaaacagaacctgaagttgttggagttgaaactgaagtgaacagtgatgcagatgatgatgaagttaaagaacgtgatggggatgttgattttttttatcattttgaaagtgacttagactatgtatatgtgtctccagaagatgatggacaatcaagtgacacattggcagatagttaccagtctaaagaattccaatcccttcccaacagtgatgatgaaggtgactccaattctaaaatcatgtatcctcaatacaatcctacaaatagttttggacaagtgcatttggaggttggaatggagtttgataccatcaaaatgtttattgaagttgtcagagactttactattttccatggcagagatttgaaatgggtaaaagttgacaccattcgagctaaagcacgttgtaaacaagttggatgttcatgggaaatttattgttcatggtctgaagttacaaaagctttcaaatcaagacttttttggaggagcacatatgtggaagggtcttcaaaaataaacaagttacaatga

SEQ ID NO: 116236 - DNA, 321 bp, Glycine max
  Peptide Sequence Number=SeqID_233014
atggagggtcatcatctccatcaccggcaacaacaattacaacaacatcaccaccctcatcacaacatcacaactagtaacgtggatgccacggataggttcccccaatggagcatccaagagaccaaagagttcctcgtgatccgtgccgagctggatcagactttcatggagacaaagaggaacaaacagctttgggaagtcatctccaaccggatgaaggaaaagggtttccatagaagtgcagaacagtgcaagtgcaagtggaaaaacctcgttacccgctacaagtttgagaccgagattattaagtgtttatga

SEQ ID NO: 116237 - DNA, 410 bp, Glycine max
  Peptide Sequence Number=SeqID_233015
atgatcctttgcttcaatgaccaccatgaaacttcaatccctaaccctcattcgttgctcagcactcccctcccatcagacttagacttgcaaagatcaacggtgcttctcacactagcaagcattcttcaaagttcaaaccgtctatgcttcttctccgagcacattttaatcttccttggagaacccccaagaatcacatctgcaacagtacttttcgtctatggcctaatccctcaaatattcaccaacgttgtaaacttccccattcaaaaattcctcgaagcctggagcatagtggctccaaatctttccaagtctgattctgaggccgatatagcacggcaacgcggtggagttctggcggccggagacaacgatcaaagggagtgcagaagaacgaatgacgg

SEQ ID NO: 116238 - DNA, 1104 bp, Glycine max
  Peptide Sequence Number=SeqID_233016
atgtggccaacactcgggcagagtccgaaagggttaggtaatcagttagatcaggaggtgctagtggtgttgacttctagtttggatatcttgggatttacttcatccgggtcatttactttgtcttcccactcttctaccttttcttgggatgataaggacgaagatcaatatggtcttaaggaggtagtcaatgagtccatggaggttgtttctggcaagagagttgatgttagggtgtcatgtactgataatgttgagtcggtgttgcaactgaaatgtcgagcaattactaagaaggataagcctcctccaataaccctccttagttacttgtgggtagacgacaaggttggaacatattttatcctatattctgataatctaagcattctccactttattaattatgctcgggtttgtcccttcgtggatgatgactttagcccaatccatctttgtgcttgccgaaatgacacctttgcaaatccaaattgggttttcttggctaaagagaaatcgatgcggggtgatagatcgagtatcggtgagactactaatgtgtcaatgagatatgatgattttcctgaagacaacctaaccaatactaagaagtgtaatttgaccatattggcaacactccccctaagttttccaaccaagccgataattactttgtataagtcttcgattgtgatgaaggacttaagagatattgttcgtcttgttgggatggatgcactcaattgtgtgagtgtgtgcattgaggttagagttatcgccgctaatgcaatcgttactggtcctgcttcttgggcgaaaaaccttaaaaggaaaaaggactcaattgttgccttgaagagtaaaatgtataccttgaaaggacctttgacaaaggctaaaaaggagaatcctaagaatgttgagtttgatattttcaaggatgttcatgaaagaactttaatttccattcaagacattcataaaaagactcctcgcactagctggccactgactcctcctgttaaaacccaaatgactaatgctaatactaatatgggtgacactaaggtgaatgacaaagatgaagtgattgataattag

SEQ ID NO: 116239 - DNA, 690 bp, Glycine max
  Peptide Sequence Number=SeqID_233017
atggattgggaggtcatctcgattagcggttcctcattagaggatactcaccgaggtgcctccaatagcgagtcctcttccttggaaaggataagagtctcacgtcgaactagtgggggcacttttcacccttgcaggagggtgcggcctttcgtcactgccacgaagcctatcttagttactatgatccttcctccttctacttcttggggtgtggggaaaggttttggtagtagagatgccaaggcatctcctcacatggatgatgttctgaaacacaagtcctctctcacctcgacagtaagtgttgttgcgcttcagcaccagtgtactctgttggagcacttgaatgtggccccatctcaactccacccaaacagttgggcgatgtgtgccaagaagcttttcgagtttgactcaaacatctttagccattttaaaggccacttctttaaggtcctatctactgatgtcatggctgatggcataccactgatgtttaacagggacgaggagcctcgcttcccgttctactggcagtttgaccctactaggctcaagtcatatgatgaggatctattgactcttgtggagaaggtcaacaaagcaattttggagcagttgccaggctcgttggacgcatgggccattttgtctcttccttcggcgagcgatcgctcattgccttag

SEQ ID NO: 116240 - DNA, 1350 bp, Glycine max
  Peptide Sequence Number=SeqID_233018
atgtccatcacggacaacatgatagaagtagtccagacaacacttgtccaggctcgggggcttgacaagccacaccggtttgcaattctctcacttgttgaggttaccacacccgacactggaaaccacttgtccacacttgggggctcgaaaaactcgtcaccctctacctatcaagactattatcccagacatcagacaaactcccttaacatgggacaaactctttcaacaccggacaatctctttttcccacaagccaactcagagcttggggggcttatggatagggtgttggcgctgcgtgtcatagaggggttagttggtggcattgtgcgcctcgcgaaggtgaagtgtggtgcactatgcagaggtggagggtggaggggaagggaggctgttgaggggaagaggaaggagaaggggggggagaagatgagtcaagaagaagttcaccactataggaagccatggataagagcttggagcccactaatccaagatcaagttcaagattctccactaagtgtgcttagggggccagaggggaaagaaggtgagagggggaagggaggctacggaggggaaggggattgtgatgaagggaaaagtgaaaaaataaatagaggagaaggtgaggaggatacacatctaattggtttgtggcttaatgtctcaatggatctaattgttggtgatgttcaaggccattacaagcaatctgttgatttgaagaaaaacgggtacacagagattgatgtaatggttcatacatattccatttggaaggaagatgagggaagcaattttactttagagaatgcatggcgactgctgaaaaatcaacctaaaagatcagatcaaatcaaagaaactagttccaagagaacaaagatttctactaaagggaattacacgccatcatctaattcgaagaaaccgattgaagctatagaaagtgacacaccatcacaaatcccccgcccaatggggcaaaagtcagccaagaggaagatgaaggggaaaggagctacaatgtcttcacctattgtggacttgatgagcatggaagcagtaataagggaaaaaagtgaagccaccaaaaaggtagtagaggcaaaggttaaggagagagaaaaggtgttatacgaaattctaatgaaagacacatctaccatatctgaagaacaacacaagaaacacgaagtcagttgtactccactcactcgtaaaattgatccaaactctgactttgatagaatttggaaagaaattgttgatgaaatattggaatacaacactgaagaagaaatcatgaggtacttgcatgaggtgcaacaacaagcatag

SEQ ID NO: 116241 - DNA, 210 bp, Glycine max
  Peptide Sequence Number=SeqID_233019
atgaaatattgcaaaactacaagtggtgaggaagtctccttcacctctaggatctcacaatcactcacaaactcatctcaagctctcaaatcggctcctgcttcgagctctggtggccttgttcgtgctcgtgcgcttagcgcacgtatggaccgcttagcgcacgttagtgacttttggcttagtgcgcctttcttgcttagaggatga

SEQ ID NO: 116242 - DNA, 1068 bp, Glycine max
  Peptide Sequence Number=SeqID_233020
atgactaacacttgtattatggatgacttcgcctatagaccattcgtaaagcaggtcggaccgggaggtagggatgtgccaccatctacggttgttgctgttgttgaaaaagagggtcaacctgctagcgaggttggccatattgttgttgatgttgaggtcacccccaacggttcttcctctgtcttggcaaaaaggaagagggatgtgcctctagctccatcggccgttgaggctactgctactgctacttctgctcctgctccttctccttcttctattattgttgttcaagaggttaccattgttgctattgaagttttcataccagctactttggctagttctcttgcggcgttgccgtccaccgtcataagttttggtgtggtgaccactagtgctcctacagtgcttccttattcctctaatccttcggtggcttctgcctctactattttggcggctgtagcgtcgccttcttcgttctctcaccctcgtgtctcccttgatcacttttataagtcgaaacaaaagacctcggttggctttgtgtcagccttcgacaagaaccttattaggtcagctggggtggagaatgctactgactctgccaaagtctttctccaaagaagtttggcaattttggagaagagtgaacaacgacatcaagaggctgtgcagaaggtggcgtccttggaggcggaggtcgccaaatggaggactactactcgtactctttggcgagtggagcgccctaaggtggccaatgctactgttgcttttgctaaggcagtgaggttgaactaccaatatctttcaaagttggtggcgtattggccaaagttgcttctgtacaagaaggaggtcgtggagcagcatgaaaaagggtttttggaggccgtcaagcaagctgatttctttgtgaaggaccttaacttgggtctcttcaatcccttcaaggatgtgaaggatggtatcatgctagatgaggaaggcattattgcggacgacgaggctattgatgaagggcagggtgttgtgaagcaaggtgatgatgcttgtgtctag

SEQ ID NO: 116243 - DNA, 252 bp, Glycine max
  Peptide Sequence Number=SeqID_233021
atgggagaagaacgacgtaagactgtcaaagaagaagtcgacaagctcctcaaggaaaactttatcagagaagtcaggcgctacataccaacaactgatggactgagtcttcaaacaacaaattggacaaaacgtcgaggcaaagacaagttccctgacttcatgatcacacatcgggggattgaagccaaccccgacaaatgcactgccatactagagatgcgcaacccaaattacatccaagaagtctag

SEQ ID NO: 116244 - DNA, 357 bp, Glycine max
  Peptide Sequence Number=SeqID_233022
atgacactcgttgtgagtgacatgtactggagacgttatggcgtactcttgcatacgtgcctcttacaaagtggcatgtactggagacatggtggtgtgaatcagtgggactcactaagggtggatcttgggttttgccagccctttggaggattgaccagggaatcgtccgacctgggttttgggcatcgtgctcttccacacatgtcgctcgtcgtgggtggcacacactggagacatggtgataagcttttgcatatatgtcactcgtcgtgggtggcatatactggagttgtgatggcaatacgctcttgcatgtatgtcactcgctgtgggtggcatacaccggagtcatga

SEQ ID NO: 116245 - DNA, 279 bp, Glycine max
  Peptide Sequence Number=SeqID_233023
atggggtgtagcaagcaaatgctcacctcctcccatgggcccaaaatctaccctaaggctcatgagaaccctagggccttctcttacatctctggctcaatcttcttagagtcttctatccaatgcccttggggggtagtattgcatcaggatacaccattggaagttgctgaggagggagtctcaagcacagcagaggcagatattgacgatgattatgtagcagacgtcactgtggtatgggacttgggatccatggcccactccagctcaggatga

SEQ ID NO: 116246 - DNA, 645 bp, Glycine max
  Peptide Sequence Number=SeqID_233024
atggcatcttcgaacccaccatgtgcggcttgcaagttcctgcggagaaagtgccaacccgaatgcgtgttcgcgccatacttcccaccggaccagcctcagaggttcgtcaacgtgcacagaatcttcggagccagcaatgtctcgaagcttctcaatgagttgcaccctcaccagcgcgaagacgcagtgaattctctagcctacgaagccgaaatgcgcctccgagaccctgttaatgggtgtgttggaatcatctctcttcttcaccagcagcttcgccagctccacatggacctccagagtgccaaatttgagctctcaaggatccataacttgggtgtaaccatacccactggatacggtcacacttctgctgcggttatcacgcccgttagcgcctctcatgttatgaatggtgctgatggtagctatgataaccgctattataaccaacaacatagttatcatcagtgtgtgcctcagcagttagttaggaactttgttggtgcagggaacaactgtgatgagggtaatgtgttggccataaacattgctagttttgggccattgagtcagctccagcagcctagtgctgctgctgttgctcgtgatgaccctcacactagggttcatcactcttag

SEQ ID NO: 116247 - DNA, 6294 bp, Glycine max
  Peptide Sequence Number=SeqID_233025
atggaattcctttacgggtttgcatcctctatttcaagagacttggtatgtggagcagtaaatcaattacgttatccttgttgctttaacaattttgttgaagagcttgaaaaagaagaaggctatttgattgcaacaatagatagtgtccaaaaccgttttgaactcgccaagaaacaaacgagaaaggttgctgaagttggtgataagtggctaaaggatgctaacattgacgcaaacaaagtgaatcagttgctaaaagaggccagaacaaaaaagagttcctgttttgggcactgtccaaattggatttggcgatatcaattaggaaagaagttagcaaatagaaaaaggaaacttgaaaagtgcattgaagaaggtagacaatatgttgaaattgaaagcattgctacacttccttttggcacacatgattttctttcagaaaaaagtttgacttttgagagtagacagcctgcttatgagcaactaatggaagcactgaaagatgatgaggtcgccgtgattggattgtatgggatggggggttgtggtaaaaccacattagcaatggaagttaggaagaaagtagaagcagaacgtctttttgatgaagtgctttttgtgcctgtgtctagtacagtacaagttcaaaggattcaagaaaagattgcaagttcaatgcagtatatatttccagaaaacgaagaaatggagagagctcaacgcttgtacacgagactaactcaagataataggattcttgtgattttggatgatgtgtgggagaagcttgattttggtgccatagggattccttccactgaacatcataagggttgcaagattctcattaccactcgatcagaagaagtttgtactatgatggactgccataaaaagattcacctgccaatcttaacagatggagaagcatggaatcttttccaaaagaaagcccttgtatccgaaggcgcatctgataccttaaagcatttggcaagagagatttcagataagtgcaaaggattgcctgttgccattgcagctgttgctagtagcttgaagggcaaagctgaggaggtgtggagtgttacattgatgagattcacaagttcgaaaccagtgaatattggaaagggtttgcagaatccttacacgtgcctacagttaagctatgataatttggattctgaagaagccaaatcacttttcctgttgtgttctgtattcccagaggattctcacattccaatagaacttctaacaagatttgcaattgggttgggttttgttggagaagtttgctcatatgaagaggccagaaatgaagtgattgtagccaaaattaagctcacgagttcttgtttattgttgtgtgtggatgataaaagggtcaaaatgcacgacttagttcgctatgtagcccgcaggatagcaaagaatgagaataagatgattgagtgtgcattggaaaaggatgcgactttggagcataattcagtgagatatttgtgcagtaaaaaaattccagatgaactagactgttccaatcttgagtttctgtatttatatacaaatttggatgtatcagatggaattttcaaaggcatgagaatgcttagagttttgtttctttgcaataaggataggtacagaaggccattgttgtcaatgtcattaaaatcatcaacaaatcttcgttgtgtactcctacgcaactgggaattaggcgacatctcatttttgggcgatgttaagaaacttgaaagtcttacattacataattgttcattccttgaattaccagatgttgttgctacacaattgacaagcttgagattgttggatttgtcagaatgtgacatgaaacatagtccttttgaagtgattggaagactcccacaattagaagagctgtactttgctgatcatagatcaaaatgggatttctacaatgaacatgctgctgaattcttccaagagtttagagttccccaagcattgcaaaggtatcacatacaattaggaaacatgtttgctggttttcaagaggagtttcttaatcgtcacagaaccttatttcttagttatttggatctatctaatgcagcatttaaggatttggccaaaaaggcagaggttttgtgtctagcaaatattgagggaggtgcaaaaaatattctccccgacatatttcaaatagaaggaggtatgagtcatttgattgagcttttgatacgtgactctgagaagatagagtgtttgattgacactagtcatcatttgagcgaggtaggagctatcttctccaacttgcattgcctaagaattgagcgcatgaagcatatgggagccttataccatggttctctacctcctaggtgccattttgagaaattaaaggacttgtacttaagtcattgtccaaagctgatatgccttttcactcttgaggttgctcaaaatctggtacagttggaaaaattagaaataatatcctgtcctggactgaagcatatagtgactgatgatgacaaagaggagataagtacaaatgataaaaggttgttgttccgaaaattaaaacggctccatgtcagagagtgcgacaagttaaaatatttgatcccaatcacttttgctcatggccttgtacaattagagaatttggaaattgtatctaatagtgagttgaaatacctgtttggccattgcacaaaaggagatcatctggctggtcagaatcaaaatgaacttaagattgagcttactgccttagaagagcttactcttatcatgttgccagagatcatcagcatttgtcctgaagtttgttatccaacatggccattgcttcgtcagtttacattgcagaattgtccaggattctccattgtgtctatcaatacttgcttggcttttcataacaatgacataattaatgaagcttcatatctaacagtgcaaaatataaaagaagtccgggtcaataactgtgagttagaaggtatcatgcagctggcagaactatccattgatggaaaacaagatccattgatatcttgtttggaaatgctgtatttagagaatctgcctcaattgaggtatatatgtaaaggagataaaaaatccttgaacctcctccaaaatcttcaacaaatggaggtaagtggatgcagaaaattaaagtccatcttttcagcatgtatctctggaggcctacctcaactgaaagagctgaaaattgaaaattgcagtcagctacaacaaatcattgaggataaggagcctcaaaacccaggatcattcaatcttcccaaccttactaggctaacgctaaaatcttgtccaattttgggttcattgttctcagcatccacagctgaaaccttgacttcattggaagaattgacaatagaagattgccatggtttgaagcatatacaaatttatggaagagctcatacaaataaaaaagaagtgattcaagatgatcatgactttcagagttatgtgccattttttccaagtttgaaaaagttgagtattatgagatgccacttactggagtatgtattctccatctcatttgccagaggcatgaggaaattggaaattatagaaatcagagaggctcctgagttgagacatgtatttggtcagaacattcattcttcccagcaataccaaagcaagtttcaaattgagtttcctgttttggaaagagtgacactccatagtacaccaaatatgattggcattttcccagaaaattattctgcaacatgctcatctttgcaattgcttgtcatgaacaatattgggctgtccactctatctatcaataatttgaaggttgatttagaagctacacattcagatcatagttctaaaacggattcaagggtaatgagtatgacaactaagcaaaagttagcatctgttattattgagaactcggaaatcaaagaaattttcaatctggagggatttcctatcaatggacaacaaatgactttgtggatacaagtcctagagttagttaatttaccaaagctaaggtatatatggaagagttccaaacattttgtgtgccttcaagttcaacatcttcatgaactacacatttgcaactgtccaaaactaaaggttatcttctctgtctctatcttgagaatgctacctctgttaaagatcctcattgtaaaacattgtgaggaattggagcaaatcattgaggatgataaagaaaatggaaatggatcaaatcctcaatccccaaaagtatgcttctcacatcttaaactccttcttgtctcacactgcaacaacttaaagcatctgttccttatctccatttaccacgagtttccagaactagagcatctgatcctaaatcaaaatactcgactagtgcaagtgtttcaaggtgaaacaggtgtgagagaagggagggtggaggttttgcttccgaaactgaaacatgttgtattaatgcaacagccaaacctcataaatttatgtgatgggattgaatttcagactgtgatcaatcttcttgtgcacgattgtccaaagttctcactaacttcaacaactactgtcgaggacatgctgcggacctctaattctgtacccctacatttagtgctagatcctttcataaactatctgacacatttcactttcaataaggaaattgatttctatctccgtcctcaattactcaacataagtggtatcacaacaaaaggctttgatgtccttacctcaaagaaagaaaacaaagggacaaaagacttgcaatcatgggaccagagacttccacttattcctataccaaacttgatgaagagtattgaggatgtagtgaaagattggattcaggaggaggctccatcagaggaagttaagaaagaaactttgtccattggtgtagaaggtgctggcttggatggtgttgttgtggctcacaccaagcctagtggtgcggagatggtatcggatttctgggtggttgaacaaggtgataggcctaatcaacacaggagaggaacttcatcatgtcagaggattcagaatcttgatgatagcatccaagaagaatctaacttgcttgataaagaaggtgaagtaggtgttgtttctaagaacagcattgtggctcaaagaaatgaaaaaccagagatggaaattgcttcagagaaaccagcaatagtaaattccttaactaacttggaactggttgaaggggcatctctaagttatttggatattcctctacataaaacacactcaaatgggttggtggatggacaatcgatgagtgaaccgttttatatgaaccaacaaaagctacttggagaaatagcaagtaccgttgaaattcctcagagtgaaattatgcccagccaaactgaaacatacactgctaaagaaagtgaaggccatactataaatattctagactttgtagccaatgatctcatgagtttatttcaacctgtggaatatgatggtgaaggccatgtaaccgaagataaccaggttgtaaaggtccttgcagaccttgaaaggtgtctaaagatgccactgaaggacatagctagctctgagactgacagcctccttcttttaactgctcttaactttttgtccaatcttcctttaaaagatgtaactctctcagatggacttaaagatattgtagactctatgcacacacagttcccaagcattctatgttccttcaagcaagcctttgccaccactgacaagttggaagcacatgaagctcaccagaatgtggtagctgttactcttgcttccaaaatatctggggcgaagaattttatggatgaaggtcaacagaaggaagcggttttgaaggaacgaatcactaggttgaagaaagaaataaaagattgtgaggctgacttatcatctcttcaagaggaaaagaagaaatgcattgcagaaactatacggtacaaagaggagtttgaaaatgtgaggaaagaaaaatctcaaatggtggaagatcaaagaaaagttcggcaagaattatttgaggttaggcaaataaggtgcgcaagtgttggccatctcttaacaaccagtatgaggctgatagcagagaaagaaaaaaacaaaattcttcaaatacttatcgcctcaatgttggggaaagatcacaaacaacaacaacaacaacaacgacaacaacaacaacaacaagtgaaagcaaagtggatcacttttccttctgtgcaaataatgataggttcttga

SEQ ID NO: 116248 - DNA, 915 bp, Glycine max
  Peptide Sequence Number=SeqID_233026
atggcttccaagaagagacgcatttcctcctccaagcatcaggagccttatggcacgtccagatttgtgtctgaggtcacatgggagcaatatgagatgaacatccacaacagaaacatcctccctgagagaaacatggagttagcttactcccactatgacgagttcctccgggagttagagcgctgtcaatggcatatgaatctcactcgccagatggagaaccacattgatttggtgttagttaaggagttttactccaacctctatgacccaaaggatcgctcccccaggcaatgcaaggtgcgagggaagacgatcaagttcgatgcagccatattgaacactttcctggagacacatgtggtattcgagcctaggggggcaccgtggaagctactaaggaaggacttgactacacttgctcagacatggagtgtctttccctactccaacctcgctcctacttctcacacctatgaccttaatatggatagagcgaggttggtttacggccttgtcattaagatggacatggaccagggctcaatcatttccgaacaaatttctcatatgacccaatccaactcctctaggttgggctttcctgcccttatcacagccctatgcatagccagaggagtagtgtctgactctctaactttcgagtctctcagcctgaccattaatttgacctatattaggaaaaactgctggaacccaaaggatccttccatcacattccctgggtcccgcaaggccagtgccagggccccttcaaacgctctagcttcaactccagcaccagcaccagtaccttcatgtggagcttgtaggccttggatcttcttcaccaataaagtcatttgcttcttgaagttcaatggcagcggaatgaagaaggaagaaagatga

SEQ ID NO: 116249 - DNA, 108 bp, Glycine max
  Peptide Sequence Number=SeqID_233027
atggcgaagctcaaagaagggaatgttggtgcaacttcagagatcttccaggacattgctgattactaccataatttgtgtttaacatgttactacatgatgtcttag

SEQ ID NO: 116250 - DNA, 114 bp, Glycine max
  Peptide Sequence Number=SeqID_233028
atgcaatcacttgtgactaagaaaccaagcactagaagcaggcagctgaatcatgcctttgaaccagagtatagggtggcaccaccaagcaagagccaaaccaaattttattga

SEQ ID NO: 116251 - DNA, 366 bp, Glycine max
  Peptide Sequence Number=SeqID_233029
atgtcaatgcctcctacacctgaacttcccattgccctacgcaaagtgaaggttgtaccggatgatagtattgatctattcaaagccggtttggtggctaagggctacaacacaaatgaaaatatgttttcgttatggattttgaacttagtacaaaatttaaaatggaaacatgtttccgcttacaaaatcaacaatgaaaatgtattttctcatataaaacctacaacagaatcacaattttgttgcagtcgaaaaacagaggagaggaagggagaagagggagaggccgtgagatttgaattgagggggaccaataacaaaggtggtaggggcaacaacaactcccctaaactatttacttaa

SEQ ID NO: 116252 - DNA, 498 bp, Glycine max
  Peptide Sequence Number=SeqID_233030
atggagaccaaatacgagagagggttctcattgtacactccacacagtggcgttactcgcactgatgttcccattttgattttgctgccacaaatcaaattgttcttcgtcaaaccagtggggtttatggagagaaagaggaaggacggggaaaggaaaattcattacagaaaatcaaaagtctccctaatacacggaggcttatatcaagatgttaaaacaaatacaacagggcaaagggaatccttgttcaaaaaagcagttttgtcgagagtaaacagtcggttcattttagcaagtcatagaatggaagacatcttaggagagattactgggttccatataccagaacaccaactaacagtaggcttgacacctctaatatgcgcttgccaggcataccccgcagctagagaaaataaaaaaatctccctaatacaagaagacctatatcaagatgctaaaacaaatgcaacagatgcgcttgccaacaagtaa

SEQ ID NO: 116253 - DNA, 2454 bp, Glycine max
  Peptide Sequence Number=SeqID_233031
atggcaatgacgaaaaagatttcaatgcaatatcaagggaaaaaggtgtttcactgtagtctgcgtctttcttcagatgttgattcactcttttgcttgaatcaagatatgaatgaatcacatgatgtagttgaaccaagtgaagttttgtcactgcaaccttttcaacctaccgattttatagagaacatgcattccatgatggatcctcttacctgtgaacaagatgtattggctactttcatcccagaaaccgtggaaaagggtgcttcgaaatctctcattgatacaattgattctgttggacaacagaaagaaggatctgaggttaaagattttgaaggtgctgatgtcagtaatgcagttaaactttctattgctgcatctgaggcattggtcatacatgatttagtgaagatggactcagttttagaaacaatgcgtacagaagctgtacttgaagttgcacttcgtgtgaagcaggcacggcttgaggggttggaagatggcttccaatcctcaaatgaggaatctaactatagtgattctctttctgatttggatgatttcattatggaagatacctatgaagatataggcttacccattgatgttcctgttgagaataatctttgcagttcaactatatttcaagtaaaaggtgtgtccggtgctgaaaatgatagtagatgcaataataaacatagtgatggtgagcttacttctcagcttgccaattttgatgataaatctaaacaaaagcagttagaagctaatgtggagagggaggtgcagcaagactcacctcgttattctttacattgtgagaaagagatgcattctgatgatcctggtttgggtgaaaacactctcaaacattttgatgataatcttcgtatttctcatcaatgcataaagtatagtactgatgttttggcccccaaccagacagttgggttgactatggttggtttgacttcaatcaagccaccaaacagtgtcaacttgccacttgttgagaattctggaaatttcattaacagctcacagaatgatgtaaagaaaaaagaattagattcatcttcattaaatcagaacaatgcaaaatggattccgaagattctcgtcagagagacaagctttcttacagaatctgtagatattgttccagatgagaattcctttgtgctgaaacatcatcccaagtgttccattggttctcagctaagtgtgccttctgaagactcacacaacaaacgtgatgagggcatattgcagtctcaagatgtgatcagatgttctagtctatcattgactgatcctctttgttcagttgttccgtgtagcctttccttagagcatgtcaactataatactgatattgacaaaaaaaatgatactaaggattttgtcccatccatctctgaatttgaggtggacaattttcaaagtatcttagataagaatgtaaaatttggctgtagtgatgagaaaattatgtctatatcagatggtaaagatattccaatcactgaaacaatgatggatgaacaaatcactgggaagttaacaaggattgaacatacttgtcttaagacttatagcatgattataccaaaccaagatttcaacctaaagtataatttggatgaacttccaaccgatcagagtatgggtagtgctgcatccttgggcacaaagatttcacagagccaatctgcttcaaagcatgcagatgaaaacaaaaacaaagaagataatcagcctttggttgatcataagtcaactcttgaaataacagatgacaagagtggcaatgagttaaaagcagcagatgcaagtgacatttcaacagaaccaacacaaaacaggagatcacctcttattctaaatcatcggatacgccggtgtttgcagggccctatgaatgttgcaaatggtatcagtgtagagaaaattatgacgcagcatgtagtaccagaagctgttgctcaaaatcggcagaacaataatcttaataaactgcagctagagagcaataatgtacacagtggacatgttagagtcagaaagcaagtacatttctcagaaaaagtggaggagcttcatccaaaaaggaaatgctcaaagttggaatcctcacataaaagatgttcatctgttagagcaaaaaggggacgagtttcaaagtcattgaccacttctgtgccatgtatgaaacattctttgacaaattattgcagaagtgcagtgaatgaatttatatttcaaggtatagagttccttctcaccggaatatctagtcagaaggaaaggaacatggaagcacttataaggaattctggtggggtggttctttatgatattccctctccacaaaattcaggggggaagagaaattcaactttatatcactttcccattattctttgtatgagaaaggtttgtttctaa

SEQ ID NO: 116254 - DNA, 750 bp, Glycine max
  Peptide Sequence Number=SeqID_233032
atgatccatgccaaccaaaccaactgtgcactttttgtgggaacttgggtccaagatgactcttaccctatctatcaatcctctaactgccccatcatagatccacagttcaactgcaagatgtttggccgccctgattctgattacctcagatacagatggagacccctcaactgtgacctccctaggttcaatggggtggagtttctactgcaaatgaagggcaaaactgtgatgtttgtgggtgactcactagggcgcaaccaatggcaatcactgatttgcatgatatatgctgcagttcctcagacacaaacacaattggtcagaggggaaccactctcaaccttcagattcttggactacggtgtgaccatttcattttacagggctccttatttggtagagattgatgtggtccaagggaagaggattttgaggttggaggaggttgatgggaatggtgacgtttggagaagtgttgatgtgctgtctttcaacactggacattggtgggatcatcaaggctctcttcaagggtgggattatatggaattaggaggcaaatactaccaagatatggatcgtttagcagctttggaaaggggtatgaaaacatgggctaactgggtggactccaatgttgatagaagcagaaccaaagtgttcttcctgggaatttctccttcacataccaacatatccaaaccggacacatttgcattcttggatttggatagtttaccttag

SEQ ID NO: 116255 - DNA, 732 bp, Glycine max
  Peptide Sequence Number=SeqID_233033
atgatgcttctcaaagtactggccgacagcttgctgtattggatatatgagcactttcctagtgttcatgaaagtgtgactgataaagggtacgatgagacatcaccatgtgcctgtcgatggcttactacgaaagcttattcgaagggattcgcagcatcgacataccagacatgtatagatgcactaacgatccctgacggtaagcttagatggggtcccattgtggtcacacatcgcccggtggtgcaccaatttgtctacattcataccattcctccactgcctattggtgccaccttgtcatttaaggatatggatggcaggtggatgcattactcggaccatctagtagctgcgggacagatttgtcttgtgcctggccagtgtgtagcagattacatggacttgttctttgggatatctcattcattcatcacacccacacagtcaactgattcacctaaacatccacctgtcccacagcatgagacatacgtggagccagatatcccggaggtcccagtggcaccaaaagctggaccttcagagtcagttgatcagcccagacatgcagtggatgcttgcgaagcgatcgcagaaaggttggagcatgtgctcaacctaaggatggtcactgtaggcacagagttacatgacatcatggaagactaccagaggatcgctaggggtgtcaccttagatggaaatatgtatgttagggtgcgatga

SEQ ID NO: 116256 - DNA, 213 bp, Glycine max
  Peptide Sequence Number=SeqID_233034
atgaagtcgtggtttcacattgccaagaatgtcaaggccaaatgcaaatccttaattggtcaaaaaaatgcttgggagtatgtcatggatgcagggaatagtctggttgattgtccttctgaacaggttgaatctgctcattgggatttaaaaagagtattacataatagccctggagacctgtgtagtgtttgggatgccatgacaacatga

SEQ ID NO: 116257 - DNA, 467 bp, Glycine max
  Peptide Sequence Number=SeqID_233035
gtcaaggaatcttaggggcggcaccttctaagcccaaagatgataaggggaagacaatagaaaaacaaccccctaaggctatcatttatagtagccaagatgaagctactacttcacattcctctagtgaaagtgaagaagcaaaatgggaagaatctagtgaagaaatctacccccaagaagaaagacaacctttaatggttaaggaggagtgtaaggaggcaagtgtctccttcaagaggttagcgaagaaggaaagtcattttgcaataaagacaaacattaaagaaacttcccctcttagacaacctccacatcttttcctttgtaaaaagacacttgttagcactgccatgcctcttgggcttgaggttattcctcaagtaaaggagttattggatgaagttagcgaggaaccatgtttcctcatgggaagatgcccaggaaaggggttttcagacacttga

SEQ ID NO: 116258 - DNA, 660 bp, Glycine max
  Peptide Sequence Number=SeqID_233036
atggttcaacaagcttattggaatttggaggaacttcttatggtgggtcaagaaacacttcgaaaattgtctggattagttgggaaagagtatgctccctcaaagaaaaatgcggccttgggattaaaaatctctacctctttaatattagcctcttatctaagtggaggtttgctcaacaagtttggtgaaatcaataccctttgtgacattcaagcatgtgctatcatttatactccgaatgaaccagaggctaaggtttggccatctgaccagggagtgaatagtgtgatttccaggtttatgggagcttttgaattggcaataagcaagataatgttatgtcaagagaaccatttaaaaagaaacataaacaaagcccaggggcagctaaagaaattgaggaatgaaaacaagaagaaggagattgaccttttcacgtgtcaatactttgctgatgtcacattgttggctgataaaaatttggagattacaaagaaaaatgaaattctccaagtccaagaggtgacactagctattgaaaatggaggagaaaccaagactgaagaaaagcaagcacttgtggccaatgtggatgccatgccaaatctgaatggtctaatgacaacaatgaggatgatagggatgggatccatgtga

SEQ ID NO: 116259 - DNA, 138 bp, Glycine max
  Peptide Sequence Number=SeqID_233037
atgccaaacggtgtcgttttgtcttctgaagtcgctttctacaatgccgtgggaagggtaaaccggataccgggtggtccgggtcgctcacaccgggaccaccgcctctttcgtcttgtctaccgccacgtgatgtag

SEQ ID NO: 116260 - DNA, 256 bp, Glycine max
  Peptide Sequence Number=SeqID_233038
atggcaccaatattgttgtgctattttgtgttgaacgcttggttttgtcattgtggtccagtttctctcgttggtggttgttttgcaaatattgagagaggtagcagttcggtggagttggctcgatcggttgcccatgaaaacggatttgttgcagtcattatgaggaagaaggaatttgttagaagagacactgagagtcagaaatgtgattgtccgttcaagcttcgtgagaaaccagtgattggagggcaag

SEQ ID NO: 116261 - DNA, 240 bp, Glycine max
  Peptide Sequence Number=SeqID_233039
atggaggtggaccttagaagaagcggtcttgcagctgctagaggaaaatcatttgggcagcaaggccatcagccaccacttggtgatgagtctctggttgatcgagacgatgcactagagattacatgtcaaaagtctgatcaggctgctctaaatgttggggcatcacctcatagtggtggccaagagaatggcactcagggatggatgcatgagttctattgcccttataaaaaatag

SEQ ID NO: 116262 - DNA, 837 bp, Glycine max
  Peptide Sequence Number=SeqID_233040
atggctttcactttatcttttaatgatttatatcaggtagtaacattctgggaaggggagatagttgatacaaagaattatactttcttcactggcaaatgggaggcatctcccgaggatgatataaggcactggtctaaatttccatctttttctcccttattgggccaagtggaggctgatggtggcaagtctttggacctgagcaactatccttacatattcatgaggctcttcgctatgcgaaggtatgggggagggatattgtgcgcagccttacccttgcatatgcaaagaggctgtttccggattcgaacccatgaccaacaagtcaccaaggcacaactttaccgctgcaccagggctcgccctcaccaagagaaaatgataatgttgaaaaaaaaaaggtggaaggagcagtactttgtgaatgttggaaccgactgtggattaaccatagccggattttactacatttgtttctcttgcagcgatggctctatcagtggattctattatgatcccaatagcagagcacgcaaaatggacttgacctggtgggctcggctggccagccttcaagtagggccaggatgggctctcaaaaagattatggttagaaccaaaggtttaggtcggactttaggcaggattataggaagagccctaggagataagctagtggtgatgcggatgaatccccccagcagcgaaggcctacaacatctacacatagacagtgagaagttgcacctgttgctgaggatgtttagcatgtggatcatgcagatgatgaggtccatgaacagcctaaagaaacagctgctgatgatgtag

SEQ ID NO: 116263 - DNA, 533 bp, Glycine max
  Peptide Sequence Number=SeqID_233041
atgaaggagaacatcatgtccacccctcacactggccgtcgcgcgactcgcatcacggcagcagtcctcaccggcctgtgcgcgatatctatgagcgcctgcgccggatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 116264 - DNA, 216 bp, Glycine max
  Peptide Sequence Number=SeqID_233042
atgggtagggaaaaaacacatgtcagaccattgaccaatctttttaatttgaaaggagaaactcaaagggtggtgtcgcaacctacccttcggcgagagggcgacgcgaaactcacgggtgcatcttccaagaagggaatacgcgcagagtcgccaccaacgtttattcgaggaaaacgccggaaaaaccggaaagacgtggcctacgaactttaa

SEQ ID NO: 116265 - DNA, 267 bp, Glycine max
  Peptide Sequence Number=SeqID_233043
atgttgggctatgaaaagggtatcacgttacttaaaaaccaaaagggaaatggagttgcagaatccgctcatgttgagttgctaccaaaggctcaagcacatttgccatatgcttatgagaggaagaggggcatgcttctagcagctgtgtggggggagagatctaaaattagggttactcagaagtctaataggaggtcagggagtgcaaattctcatgctggaatcatagaactattgggagacaaaattgaattaaggacttag

SEQ ID NO: 116266 - DNA, 351 bp, Glycine max
  Peptide Sequence Number=SeqID_233044
atgacacgggacgagtatgcatgcgtgaaatcaatgacgaatcacaacaaaaagtatgtggttggtagctgttgcaacctacccttcggagggggcacgaaaaggccaagatcgtgggccaaagcgtttgtctccgagggagaaaacgagcggagtcaccaccaacgtttattcgaggaaaacgttagaaaaaccaaaaagatgatgaccctggaacctcttcccagcctcccttcatgcctatttatagcaaaacaaggcatttgggatgaaggtagctcgccctggcaagctgagctcacccaggcgagttgttacttcattctgaagcaaccttgcttgccctggtga

SEQ ID NO: 116267 - DNA, 3795 bp, Glycine max
  Peptide Sequence Number=SeqID_233045
atgacatatgaggatcccacaggattactctgcaagctgaagcaacgttcgtcagtagcagcttacctttcgaaatttgaagcactagcaaacaagattatcgggttactagcgccatttgaggaaaaactacttgatgctcgtcgttcttcaacctatcgtgccctaccgtccacagctggatcagctacaacacgctcttcgtctacgaacacaactccaccattgttacccacaccaacgcgcaattcatcaagcattccctttaaaaggttaaccccggaagaattagctagccgccgtgagaaggggctatgctttcagtgtgatgaaaaattctcgcgcggacacaaatgtcaatcctccttgttcctgttagtcatggaagatgagaaagaagtggaagacattgagctcttgagtcttcacgcattgtccggtcacttggcaccggaaacattgcgtctgagaggtctcgtcaataaccaacctatcagtatactgatagatggagggagtacgcataacttcctccataatcgtgtggttatgagactgggcctaacaccaacggaaacgacttcactgcgtgtcacagtgggcaatggtgatgagatcaggtgccatcagttgtgcactgtagtccaggttcatattcaacagcaattgtttaccattgattttcacgtattgccgttgtgcggtgcggatgtagtgctgggtgtgcagtggttaaagacccttggaccagtgctaacggattacggcgccttaacaatgaagttcattgtgaatggtaaactcatcgaattaaagggagatcgtgagaaggaatgtgagcaggtttccccatcgcaattacgcagattcgttcataccaatcctgcaagcactttttttcatattcgcattgaagccacaactaaaaccaaacctcagatggttcatcctataccagagattgagactttactaacctcatatgcttcccttttccagcctctcgcaaccttaccaccatcacgagccacagatcacactatcaacttactaccaaactccattcccgtaaacgttagaccgtataaatacccatattttcagaagaaggagatcgaagaacaggtggcagccatgcttgcacgaggacttatacaacccagctctagtcccttttcatcacccgtcctgttggtcagaaagaaagacgattcatggcgtttttgtgtggattatagagcccttaatgccatcaccgtacgagatcgtttttcgattccgacggtggatgaactgcttgacgagttgggagggacgcggtggttttctaagttagatctaacgcaaggctatcatcagatattgatgaaccctaacgatatcagcaaaaccgcatttaggacgcatcaagggcactacgaatttcgcgtaatgccctttggattatgcaacacgccttcatcatttcaagccacaatgaatcaattgtttcagccttacttgagaaagtacattatcgtattttttgatgacatcttgatatacaacaaaaccattcacgatcatcttctccatctagaaaaagcttttcaggtgttaatggcgagacagttctcccttaaacgttcaaaatgcaccttcgcgcaacaacaactagagtatcttgggcatatggtggccggacatggagttacgccggtaccagagaaggtgcaggccatacaacaatggccaacacctcgatctccacgagctttacgcggttttctcggcttagctgggttctatcggaaattcatccaaggttatgcaatgctagctgctccactcaccagacttttatgtcaaggtcaatttgattggaatcaagaagccacgaattccttccaaaaccttaagaaggccctcacggcggcccccgtgctcgcgctgccggactttagtgtcccatttgtggttgaagctgacgtgtccggtgccggaatgggcgcggtgctcatgcagaaaggtcatccttttgcttactttagtaagcaattctgccctcgactcttaaactcgtctatgtatgtacacgagttggcagcgatcataacggcgcactggtaccttgctcgtctattaggatatgactatacaatccagtaccgcgtcggtaaagccaacattgtcgcagatgcgttatcccggtccatggaaactgctagcatctacctcttgtcagtaccatgcttcgtcttcctcgaagaccttcataaagaattggcttccctaccagccttcctggccttacgtgatagtattctgaaagagcctgaggggcgtatctggttacctcctacctcctccttcatccacctcttgctcgaagagtttcaccagtcaccaatggggggcacatgggcattcaaaaaacgctacaacgtctccaggataacttcatatgggcctcgaacaaggaggatacgcagaattttgtggcggcatgcatcacctgtcaattcactaaatacgataaccgcaaggctgcaaggcttctctgtcccatctccgttccgacattgccctgggaacacctgtatcttcgtggtggttgaccgtttttcgaaaggattgcatttgggaatgctaccattgcaacacaccgctcacaccgtggccctgctgttcattgacatggtgggtcacctccatggtatgccaaagagcataatttcagatagggaccccttatttgtgagcaagttctggcgggagctcttcaccttaagcggtaccaaactccgactaagttctgcatatcatccacagtcggacgggcagactgaggtcgcaaaccgaatagtggagcaatatttacgggccttcgtacacgagaaaccagcaacttgggacgatacttaccctgggccgaatggtcgtacaatacgtcgtgccactccgccacaggaatgtcaccctttggagttactttcggccagaaaccgcccacgtatccccaatatctctcaagaacgtatgaagacaagtgttgatcgccaccgacgtgagcaagaattcatggtgggagactgggtgatggttaaactcaggccacgaagacaaacctcagtcacgggtacaacatactcgaagttaggaaaacgctactatggaccatttcgagtgattgaacgcatggagaaggtagcctacaagttacagcttccgaaatattcacgcattcatcctgtcttccatgtgtcccttctcaagccagctgtcgcgccaaccaccgcggataccgttgaccttccgccactaactaccgacaaccacccagtcgtcatgcccttggccattgtggcttccaaaattgtaccatccgaaaccagacccaagcacatggtgttagtccaatggcgaggattaccactcgaggagacgtcatgggaagattggtctgtcttgaagactattcaccaccttgaggacaaggtgttcctcgaagggcaatggagtgctatgagaggaggtgatgagggggtaccatcagcaaaggagaatgaagcacgtgacaaatgtgaaggttcagagattagccttaggagagagagaacgaatctggttgttattctgttagaaggacagagccaagtctctgtcattcaagatggattgtcgtggttcatgggattctctggagctaatgaagggaacccacagatcagtgccaagaaatcatatggactatatgagtatatggccaaaagatttgtgctcaacttcaagggaaaaatgttaggtagcttttga

SEQ ID NO: 116268 - DNA, 213 bp, Glycine max
  Peptide Sequence Number=SeqID_233046
atggtcaatgaaagcaccactgttatcttggcgttcgagggccaaggaacctccagaactgagaaggagaaagaagtatcgaaaggaattttattcatgattcacgtgctgaattacaagtatgctggtatgaaccttgctcgtaacggtctagcccgtgctacttcctgcacctcccttgctgatggtacccctcagcacctcctctcataa

SEQ ID NO: 116269 - DNA, 270 bp, Glycine max
  Peptide Sequence Number=SeqID_233047
atggataaccttaataacactctgacaccttttgtagttaggaaagaggtgaggagcatgactattaaggcaacatataaagaagatatcataaggtttaaggtctctatggattgtggtattgtggaattgaaagaggaaattgccaaaagattgaaactaaaggtgggaacatttgatatcaagtatatggataggggtggacctccaagagtgcatggacatctcaagatcatcaggcagcaacataatcaggcttgtggtgcatga

SEQ ID NO: 116270 - DNA, 384 bp, Glycine max
  Peptide Sequence Number=SeqID_233048
atggcggaatccacgtgctcgaagacttccgttgatcatctcaaagatgccattgctaagcttatagcatctcagttcgccatgaactcaaagattgacgatctcctccaccgcatgtcacagctcgaagctcatcagcaacaaccacaacctctcacgccaccgtcatcatcaacaagccacacaccatctcacaacctgcagcaccgcatgaagttggatgttccacgctttgatggctctgatccaacgggatggatcttcaaaataacgcaattcttcgagtatcatgcaacgccggagcaggaacggttaacaatagcttccttctatatggaaggacctgcactggcctggttccagtggatgcatcgcaacgcgtag

SEQ ID NO: 116271 - DNA, 840 bp, Glycine max
  Peptide Sequence Number=SeqID_233049
atgacgcgtgaggctgaggtaacaaatgattttgatcagtctttaaagcagaaacatcgtggagcaattatcccttggttgatagataacaatgtggtggctttgtattcattggtattctgccgtgatgcaaataactctggagaagctggtaatgtaacttggaccttgttgaagacactgaaaaaaagtgatactgatagctggggagaatctgatcttacatgggatgaagttgaaggtttgagtcaaaagcagagcaagcttagtgaggcacttaatgttttgcagagggagggggaaatgatttctgttgccactttaagaatttttggcaagagggttgctgaaataccctttgtggctaccaggaggagattgttctgccttgaagtttgtagagttatgaaaaaggacaccaacctgaattcctcacagctccaaaataatcagagtatagttgatgctacagttgattgtcatctttcagatgtgcctcttaatccatcagaaaatattcacaatccagatagctatcctccaactgtgccatcttctctggttgaagatgaacctgagttttgtcctgaggcagttgatgtttgtagagttatgaaaaaggacaccaacatgaactccttgcagctccaaaatgatcagagtatagttgatactatagttgattgtcatctttcagatgtgcctcttaatccatcacaaaatattcataatctagatagctttcctccaactgcgccatcttctctggttgaagatgtatcgcttctggaaaataattatatattaggggttgcactctctaaaatggccattgaataa

SEQ ID NO: 116272 - DNA, 258 bp, Glycine max
  Peptide Sequence Number=SeqID_233050
atgatgggagatgcatcaaagtttattcatatttctcccaaaaatagtggacatgtgacctatgaagacaacaacaaagcgatcattgcaaaatcaaggggtagtgaacgatacaaatggatattccttttactcgtaacctacaaatggttgtcatcatcaaaaaggagaagaatgagaatcatacaagtttttggtgatgccaaagtattacctaaagatggttgtcatcatcaaaaagggggagaatgtgaatga

SEQ ID NO: 116273 - DNA, 264 bp, Glycine max
  Peptide Sequence Number=SeqID_233051
atgggtgccaagtacctcgaagtggtcaaacgatggtcgcatcccaacaatggatggtccccggacgaaattagggtgaaaatgaggctaagtcatgaagtgctaaaaggtataactttaacaagggcccagggcacagaacaccatagcacaccatatttcgggaaaagagctctagaggcagaaagaggagtagcttttgcaaagatacctaggttttataagcttattactattagggtttcgtttgcaatggttggctaa

SEQ ID NO: 116274 - DNA, 507 bp, Glycine max
  Peptide Sequence Number=SeqID_233052
atgattgatctcaatcaaactctcaaggaattggctacaccagatcttgtgtataaaccttggtgtattcaatatcctgacacggagtttcatggtcttgcaggtgaagatccagacaagcatcttaaggagtgtcatgtagtgagttccaccatgcgaccccatgacatttatgaggattatgtgacgatgaaagcatttccagtctctctggatggcgctttaatggacaaaactcctattgttgccagacaattgatttccaactttgatcttggttgttttgactgggcctatgatgaatttgatgattatgttgttgcatgtagtatttgtgcagagatttcttctacaattctttttgattgttatgcagggatcatttatctcatttcagatagcacttgggtttcatctgtccaagtggtccctaagaagtcatgcatcattgttgtgaagaaccaggataatgggttgatcccaactatagtggccaatagttggtga

SEQ ID NO: 116275 - DNA, 297 bp, Glycine max
  Peptide Sequence Number=SeqID_233053
atgactgaaggagagcaaacacttgtggccaatgtggatgccatgccaaatctgaattggtctaatgacaacatcgatgatggtgatggggatgggattgatgtgaagattggaagatgtttgctcaaaaaggttggtgaaatcactactctttgtgacattcaagcgtgtgctatcatttatactccagatgaacctaaggctgaggtttggccatatgaccagagagtggatagtgtcatttctaggtttaggggagtttttgaattggcaataagcaagagaatgttatgttaa

SEQ ID NO: 116276 - DNA, 264 bp, Glycine max
  Peptide Sequence Number=SeqID_233054
atggagagaatgaggaggaggcagcccatgacagagccaatggtggagcccaccatgtcgagccttagggccctgaggttgatgtgggcctggaaggctttgttagcatccttgttgttgagcagattcaatgctagcttcagcccctatgccactaatgacgagaagaggaagaagctaaacgacaccacttcgaagatgaggagcttcttcgctacatcgatgttgatgtcacaagaagagcgattctcaaggctgcactag

SEQ ID NO: 116277 - DNA, 3339 bp, Glycine max
  Peptide Sequence Number=SeqID_233055
atggacatggtcgataataatcaaaataagcaaagaccagggttttcaagaaagcttggtgtcaatgaaaaagtggaggtgaggagtgtggatttggggtttctaggatcatggcaccctgcgacagttatacagtgtgagaagctgaagcggcatgtcagatataacaatgttttggatgatagtggggtgaattatcttgaggaggcagtgagtgtttcagaagctttggatggtgataatgaatgttacagctactcgcgtggatccattaggccaatgcctcctttggttgagtttgagagaggggaccttaagttcggtctgtgtgttgatgtgaactatgaggaagcttggtgggaaggtgttatattcgacgaccactgtgacggaatggagaagaggagtgtgttttttcccgacttgggtgatgaaatgcaagttggaattcatcagttgcggattactcaggactggcatgaagttactggggagtgggagcagcgggggaactgggtgtttcttgatttggttgaggagcagaagaggaaatcgtttgttgcagtttcggctaagcagatttggtatgatgtacgcataaaaaatggatttgagaagattcgagagtggacatgtaatatgaagtacttgtggagaaatctggtaatggaggtaattaatgactacttatctcttacggtaaatgaagttatcttagtgttgaatcttccatggagtttattaaatgaagcaccggagcccgaatctgttgaagctatggctagtgttgacttaagcgtgacctttcctgataaggaaattgttgtgcagaaagaaccagttcctcctgttaaagaggtcttacccaagttgcaaaaagaaattggcccctgtggtgctttctggtctgaagaaagtagagaaaataaatcctcaactcatttaaggtcacactattggaaacctctgaagttgtctgaagttgcattatgccctgatgctgttagggaatatctacttgctcccaaccgagcagataaggcattgtggatggaaaaattacaaaaacatcttgtatgtcttggatggaaaattgagtggtcaaataaaaataatattaagcgttacaggtataatgttcctgataagcagggcaaaaagttttacctttcgctcattgaagtttgtagagatatggaaaaggaccccggcacaaactccttgcagctccaaaatgatcagagtatagttgatcctacagtagactgtcatcttccagatgtgcctcttaatccatcagaaaatattcagaatccagatatctttcctccaactatttcatcttctctggttgaagatgaagttgaagatgtacctaagttttgtcctgaggctgttgagcagtattatcgctcgtatatatccaacatgagtcgggctgataaaaaacaatggatactgaaagcaaagaaccatttgttagccgaaggatggatttttgactatccacctccaactaataagaaaaggggaataatatacatttctccactaaatcgaagattcccaacactccatgcagcatgcagattttgtatgggaaaaagtatttctaaattggctaggtctgacatgaaacatttaaatgtctcaggcatgaatgaagaaaatgttgatcaggtttggagcggggatctagtttgtagatcagctggaaatctagtttgtagatcagctggaaatcgaaagcgaaagagcttggggaattcaaaggccaacatacccaagtgccaaagcaatggattggctctacgggtgctaagatcaaaaaagagggcacaaaaggtgtctgccccttctcttataaatcataaacctctgaatgttctgtcttacttgatagacaacagcatcatcttaccaaggtgtaaggtttattataaggtgaaaggcaggcaccgtaaagtctgtactttggctgatgggaaaataactcgtgatggaatcaagtgtaactgttgcatgggaatatacagttttgttggctttgaaaatcatgctagtggtagtagtacttgcagaccctctgctaggatctttttggaagatggtagatcactattagattgccagataaaaatgatgcatgatcataagacaagggaaactactggaaaatcattcagtggtttgtctctagttgagaatgactacatttgttctgtttgtcactatggtggtgaacttattttatgtgataaatgcccgtcttcatttcataagacatgtcttggtttggaggacatccctaatggtgactggttttgtccatcatgttgttgtgggatttgtggccaaaggaaaattgacggagatgatgaggttggacaattacttccttgcattcagtgtgaacataaatatcatgttaggtgcctggaaaatggagctgcagatatatcaacaagatatcttggaaattggttctgtggaaaagactgtgaaaagatttggcattgtcaggggttggcttatttgcatcatgaagatcagcctgccatcttgcatttttatttcaggagatgggtgagtgcaaacagaaggatatatgagggccttcataaattattaggagagccagtttcggtgggtgtggacaatctaacttggacattggtgaagtttatcaaccccgacagttgtgaacatgatagtagtaaaagtgacttattggcagaaagttacagcaagctcaatcttgctatttcggtgatgcatgaatgttttgagccccttaaggaatccttaacaaacagagatcttgtggaagatgttatattcagcagatggtcagagctaaacagattgaatttccagggtttctatactgtgctacttgagagaaatgaagaactaattagtgtggcaactgttagggtctatgggaagaaggttgctgaaatacctcttgttggtaccagattacaatatcgtcgacgtggaatgtgtcacattttaatagaagagcttgaaaagaacatagaagaacttgaaaaggttcgtcgttggcggtgcgcagatgtggtggtcacacggatctgggtttgtggggtcgaggagggcggtgtgcagtcagtggtgtgcagcggcactacagtggtgccagggctgcgcggttcaaactctctctctctccttctccagatacaagaaaaaggcttgtgtctagaccatctcagcctccactttgccgccgccatcgtcaatggcggcgacgacaacgaccaccaccaccatcgcaagcaagggagtaacttggggtttgtgaacgggaagtag

SEQ ID NO: 116278 - DNA, 225 bp, Glycine max
  Peptide Sequence Number=SeqID_233056
atgggcgtcactatcccagccaggttcgttttcgtcgaccccgtccgcgttctcaatcgttcctaccaccgtttctccttctacctactattcccgtttcttcaaatccccaactccgtctcctccaccgatagttcctctctcagaaaacggaaacggaaaccccaagagcctccacctctgaacgaaagagaactaattgctctacagcgtcaccagttttaa

SEQ ID NO: 116279 - DNA, 1050 bp, Glycine max
  Peptide Sequence Number=SeqID_233057
atggagctctctgtgcccttcagattccgatcacggaacctcctctcaccctctacacacatacccatcacctacccttccaagcatcaaccaccctttttaactaagtttgtcaacaaacccaagatttctaaactaacggtgagagcgcagagaagggcacccattgaagggctgagcgatgagttgaacgctatagctcgttgtaaccttgactttgcttacactcgaagaagggtccgcgctgctttcgctgatatgcagcagcagctggatcattgcttgttcaagaatgctcctgctgggatcagaactgaagaatggtacgaaaggaattctaggggattggaaattttctgcaaaagctggatgccaaagcctggcattccaatcaaggcctctgtgtgtttctgtcatggatatggtgatacttgcaccttcttttttgaaggtatagccaggataattgctgcttctgggtacagtgtctttgcaatggactatccaggttttggtctttcagaaggattgcatggttatataccaaaatttgattatctggttgatgatgttatagagcattatacaaaaattaaagccagacctgatctcagtggcttgcctcgatttatattagggcagtcaatgggtggagcagtttctcttaaagttcatttgagggagccaaataattgggatggaatgatacttgtagcaccaatgtgtaaatgtctccgtcaattctttaatatagatgagggactactaaatgctattgtcaatgtctctggaaagtctgtgatttgcctgatgctgcagctagcagttgaacactttaggaaactgtataaaggaatggtatccaaaattttctgtgaattagaagaatctttacaaatgtctataaggatttttttccaaatcaggatggtaaaaggtacagcaatctgtgagaaaggtatctactctgagaagtggtgcctgggcaatactttgggcactgtatcctgggagggtataaaccttgtcagacactaccttatttcttaa

SEQ ID NO: 116280 - DNA, 195 bp, Glycine max
  Peptide Sequence Number=SeqID_233058
atggtgatttttagccatggagttgcagcgaaagataaaggagaagaggaatttccaaggatatgtcaaaggtatcttagcatattccctttagatgccacaagaatggaaggtgtaactcgagcacatgggaaaggaatatgccacaagaatattctacaggaatattccaagaatatgccaaaggcatcttag

SEQ ID NO: 116281 - DNA, 513 bp, Glycine max
  Peptide Sequence Number=SeqID_233059
atgagtgtgaaggagataaatgcaaagtcaaaggacgagtacaggtggactaaagctgatcaaggaacttctcctcatgcaatcacgcaaggcctaccgctttggaaagcatggtgggctacttgtcgtcgagatcaccaaaagcagttggggcaaaacgagactccaaagcctggaggaactacagtcatgagtggatctgcccattgtgatacatccattggtaccatactaatgttgattagtcaaggtcaaaagaggcacaacaatgatatgttcttctgcaagggtagcatggaagtggtttcaactgtggaatcgtacgagttggcagtagaacgaacctccgatgctagcacgagtttggcaatgtcgtccatgtggtcaataaaggatgattgcaagcgggtcaagcgttgcactatatcatcaagtttgtcagggtgggtactggagtttttggatcgtgttgcaacaaccatgagtcagagaagggagaggagctctcaatga

SEQ ID NO: 116282 - DNA, 627 bp, Glycine max
  Peptide Sequence Number=SeqID_233060
atgaagcttgctcatggatcaaggcatgtagaattgaagggagaatccgactcgggtctgactttgctctattttagccagggtttgcatttctctattgttgtcacaaacccttaccttcgtgaccttcttcatgagttctatttcttgttcaaagagcccacacaattgccaccaccacgatccactgaccaccactttccattattgccaaactctaccttggtcaacatgcgttcgtatcagtacccatatgtgcaaaaattggaaattgaggttcatgttaccaagatgtttgtaactggttggatacaacctaccagtagtccattttcttctccaaagttcctctttaagaagaaggattgttattggtgtatgtttattgattatcgtgcacttaatgcccttatggaggaaagatgcgcggattcgccaccaacgtttatttgtgggaaacgtcggaaaaaccgaaggaaaccgatcaaaacaaaaattctaagttcgggagttgtatttacgtttgagaaaggtattaacacctctcacgtcgacaaaagcggggcttttgctcctacgtaccctccattgaagaggaaatcagacctacgtagttctttcttaaga

SEQ ID NO: 116283 - DNA, 375 bp, Glycine max
  Peptide Sequence Number=SeqID_233061
atgccgccagggctgcttggcttcaaagttgttccagacagaggaatggagacttctccagaaacatatctgattgaggaaactgaatatcctctcattatcggatccggcaatagagcctctgctggtggagcagagaggttaaaagggatctgtagggcgccggataggagtgatgcggaaacagagggagggtgtagagagggaaaaggcaacaggaagtggaagagggccttttctggcacccagaatgtctcaagtgtacaaaaggatgaagcatggagagtaaatgtccgtatacaaggatgtgaccttgagcatgggtatttgtgtggcaccatggaagctcttaatgttcctatggcagacacacct

SEQ ID NO: 116284 - DNA, 789 bp, Glycine max
  Peptide Sequence Number=SeqID_233062
atgagtgttgattattctccacaaacctcatctcagagtaattacactcagcataatggcaattctggtcagacttttagtgatccccatccctctaatgtttggactaacaatacttacaaatctggaaataccagcaatcaggcaaaccctagtgccagtgatatgctaaccaatgcacagcctcagtccaattctacaaactggattcctgattccgagccctttgaaggaccagaacagattttcataggaaatggccaaggtctgaaaattcactattctggttcttccatttttatatcacctcataattcttctgtctctttatctctcaatcatctcccgcatgttcccaccataacaaagaaccttatatctgtcagtaaatttgcaaaagataattcagtgttctttgagtttcatgctaatcactgtgctgtcaaatctcaggttaccaatgaagtgttacttcaaggtactgttggtcctgatggtctatacatttttcccaacatccagtttcattcatcttcagctggtgttgcttcatactgcttgtctagtgctgtctattctgttaatcctgccacttctaaagtcaattatcctttagatacttgtaataagattgacaattctcttgtaaatccaccttgtgttgctggaaaatctcgtagacttccctcttccccttctaattctgtttattcctttcctttggaattagtatatagtgatctttggggtccttctcatgttccttccaccaatggttacctatactga

SEQ ID NO: 116285 - DNA, 324 bp, Glycine max
  Peptide Sequence Number=SeqID_233063
atggtcaccttgcacacccctaacagcaagggtgacgcctccttcgcaaacgagaaagcatgtctctacctagcgcctccttcattgacaggacacctaagtggtgtcaaacctcagcctagtgcctcctgcaaaaagacaaaggacgaacacaaagcgccattatcctacatggcaaaattcatccctgacaggtggtttgaaggaggagactccttgttagggaagaggcatgtgttagcattctgtactatagattctaaattttggtttgattgcaaaattctttttataaaaccttccagtttgtgcccaaactcttga

SEQ ID NO: 116286 - DNA, 624 bp, Glycine max
  Peptide Sequence Number=SeqID_233064
atggcggaatggcatcgcgggtttttggataaacgccaccaaatagcggtggcgttgcgggggatgagcaccagtgcgacgaaagcaccagcaccacacaccagcacaccacgcacacgacgaacggacgacggctgcggcggcaacggctacagtttgcgacggcaacgtgtgtatggttccttagaaaatgtggacaaggctgatgcttatcaagttgctggtgtattggtgttggaggatcttgatgctgttcttgatgttgggggagtgtatgaccctgctcgagatcggtatgatcatcatcaaaaaggatttgaagaagtttttgggcatggtttctccactaaattgagtagtgctggtcttgtttataagcattttggaaaggagattatagccaaagaacttaaggtagatgaggaacaccgagatgtgcattacatatatttggctgtttacaagagcttcatggagtgtcgtagtgtaagagccatcaagaaatcaaaaagtatggatgttacaaatggtatcggagcaaacctctctcccaatacactgtggttcgaggatgaactaggcaaaaactggtgggcatgtaacaccgcaatcgaatcacactag

SEQ ID NO: 116287 - DNA, 522 bp, Glycine max
  Peptide Sequence Number=SeqID_233065
atgccagaagctcagccaatctcctctcctatggcttccagctgcaagcttactaaagctggttcggacctcttcactgatccaactttatacagttatagtagggctctttgtgatgctgactgggcatctgatgttgatgatagaaggtcaacctcgggtgttgctatatatttggggctaaatcttatatcccgatggtcatgcaagcagcaagttgttgcaagatctagtagagaagcagaatatagaagcttggcagtcactgctgcagagttatcctggattcagaccctgttgaatgagttacaagttcccttcagtacacctattgttttttgcgataatcagagtgctgttgcccttgctcacgatcctgttctgcatatgattgtgcaccatgttcctgcccttgatcagtgggcaaatgctcttacaaagccactttctccaagcagatttacttttctgagggccaaactcaatgtgcttgagactcccttaaagtctcacccaccttga

SEQ ID NO: 116288 - DNA, 294 bp, Glycine max
  Peptide Sequence Number=SeqID_233066
atgccaatacctctccctgcggcatcgcactccactccattttataacaatttccttgataggctatctgatgaaagaagcaaacaatggcgagtgcaggcagttgcagtatctcctgacagttttcagagccgaaaggctctaccctcacagtggcaagggttaagggatgaagaattgtcgaaggagtctggcattccaggatgtgtttttgtgcatatgagcggatttattggtggaaacaaaaactttgacggtgccttggccatggcgaaggctgctttgacaatgtag

SEQ ID NO: 116289 - DNA, 330 bp, Glycine max
  Peptide Sequence Number=SeqID_233067
atggatatagttaaagaaaatatacaacttaagagcaccctagtttcgggtttggaattgccacactgctcagcaataatctctgcatcttcttcttcacatcacaatcacagaaacatgcccgtgagagtattggagaacaccgcagcaccttcttctcaggtttcaggtgctaattcgggaaggagttcgtgccaatcttgtagtcttctaggcgttgggcagcaacctgtaccggtctctgatgatggtgatttgtatgggtatctaaggcgtcattcattgggccaatgtggttcagcacgaattgagtgtcaacggaaacagtag

SEQ ID NO: 116290 - DNA, 1494 bp, Glycine max
  Peptide Sequence Number=SeqID_233068
atggcaattaacattttgaaccctcaaaaggctcaagcaagcccttctaatctttcaattttcgaagttcttgattttccacatcttctcatggccaccaacctcaacatgctcctcaagttcctgtctttgttggtgttccttctgatcccagtttcatctcagcaaaaccagcttttctatgctggattcaagggtttgaaaagcaacaacatgacccttgatggggtagcagaaatagagccaaatggggtactgaaactcacaaatgattcaagtaaagtgatgggtcatgctttttatccaaccccttttaggttcaagaactctagtggtggtggtaataaagctttctccttttcttcctcttttgctttggctattgttccagagtttccaaagctaggagggcatggccttgcctttgcaattgcacctactaaggaactgaaggctcatccaagccagtatcttggtcttcttgactcaactggcatagggaacttctccaaccacctctttgctgttgagtttgacacagccaaagattttgagtttggagatattgatgacaaccatgttggaattgacatcaatagtttgtcctccattgcttctgcatctgcaggttactactctggagatgaggattcaaccaaacagaatgtcaccctccaaagtggggtacctattctagcttgggttgattatgatgctgctcaaagtgtggtccatgtcacaatttctgcatcttctaccaaaccaaaaaggccactcttgtcctatcatgtggatctttcaccaatctttgaggatttaatgtatgttgggttctctgcatcaacagggatgcttgctagctcccattacatcttgggttggagcttcaagatcaatgggccagctctaccccttgatctctcttctctcccacagcttccagggccaaagaagaaacacacgtctctgataattggggtttcagcctctgttgtttttcttgtattgtgtgctgtcttattaggcatctacatgtacagaaggtacaagaatgctgatgttatagaagcttgggagcttgagattgggccacataggtactcctaccaagaactcaagaaagcaacaaaagggttcaaggataaagggctgcttggacaaggtgggtttggtagtgtttacaaaggaacattgccaaattccaatacccaagttgctgttaagagaatttcacatgactccaatcaaggccttagggaatttgtgtcagaaatagccagcataggccggcttcgccaccggaatttggttcagctgctggggtggtgtcgccgccgtggtgacctcctccttgtgtatgacttcatggaaaatgggagtttagacaagtacttgtttgatgagccagaaatagtcttaagttgggagcaaaggtttaaggtcatcaaggatgttgcttcagcccttttgtatcttcatgagggctatgagcag

SEQ ID NO: 116291 - DNA, 390 bp, Glycine max
  Peptide Sequence Number=SeqID_233069
gttggggatgatattaaggtatttccaacatgcgttgatgaaatcctgttgaaaacttgggctgtcagatttaagttccgttcacaattacgccaatcatctgtgttggatgtgagtgaagaactccatcatattcaatcattgatagccacccttgggttgaaggaacaatcaaataagggaaaaggaatagctgttgagccagaaagttcaccaccaatttttgttcccacgccaccgttgccacagtcttctgattacgatcctggaaactctacctgtttaactccaaccaaaaggattagttgtcagcaatccagttctgattttgattctgatgagcatgcacagtatcagttatcaactaacaaacatatcaaggctgagtaa

SEQ ID NO: 116292 - DNA, 240 bp, Glycine max
  Peptide Sequence Number=SeqID_233070
atggttgattcagtgttaggcaaccacgactatatgggtgatgcagaggctcaattgagcccggtccttagagaaattgatagcagatggctttgctcaaggtcctttattgtagattcaggtgatgccttaagtacactgactttgaaggaacttaagcagttggagaacagacttgaaagaggaatcactagaatcagatctaagaaagtacgatgcaaatgttgcaataacgtgtaa

SEQ ID NO: 116293 - DNA, 501 bp, Glycine max
  Peptide Sequence Number=SeqID_233071
atgttggacaattttgccaaggtgtgggaacccaagaccacaaccatccaggaaatgatgaagaagggaaagtttcaacattcctctagacataaagattccatattcaaaaagaagaatcaggaggaaaacaatgagatcatttgctttgagtgtagaaagcctggactcatgaaggctaaatgtccccagcaaaagaagaggagatattctaggggaaagaagaagaaaagtctgatgatcacttgggatgacttagacagtgagaaaagcgacagtctagatgatgaacaagccaacatttgtctcatgatagatacaaatgatgaattacccttttctagaagtattcagtttcagcccgtagcatctcatgctgatgtagttagagagaaaagaggaacaaaaacaatattagcaaatggccagctaagagatttaatcatttttctaatgggaaaatctcaattaaaaggtagaactagctttagctttagataa

SEQ ID NO: 116294 - DNA, 1038 bp, Glycine max
  Peptide Sequence Number=SeqID_233072
atgggaattgggggagcagagggaaaagagattgataagattctagaggcagatactaataacatgtctcagcattcctcatcttcggttgttgctcttgcaatcaagggtgacaagaaaagcaaatatgtggtacagtgtgcacttaataagtttgttccagagggaatgattattttcaagctgattcatgtccatgctggtattaaaggagttccaacgccattgggaaatgtgatccctctttcacaagtgcgtaatgatgtagcaactgcattcaaaaaggaagtggagtggcaaacaaatcaaatgcttctacctttcaagataatgtgtgagcaaagaaaggtgcatgtggatgttgtagtgattgaatcagatgatgtggcaactgcagtagcagaggaagtagctaagggtgccataaccaaacttgttgttggagcttcatctcacggcttatttaaaagtaaacagaaaggtatgtctacgaaaatatcagtatgcacaccaagattttgtacaatttatgctatttcaaagggaaaattgtccatacgcccatcagacatgccgattggtggaagcattatagatgatgccagtgaaagtgaaaccagtttgtccaccagcagctcatctaactacaactccacctctcagacagaatctgcctctgtttcatcatatgctggtttacaatcctcttcgctaacaacacaacgattccaagctctttcaagtataaatagtgctcttctaagcacaaatccaagttttcctgacactaaccattctagaggccaatctctagatcttgggacagaaaatactgctacaagttctgccagaaactcggacattgatcatgccttaagtcgagtctctagttgcaaaagctttatttcagatactgaatcttggatgtatgatcaaaattctagcaaggaagtgcaactagaaactacacttccatcacctaataggcaggtgatggaaccctcttggaaaaaaaagtcatatacacttgtgatatga

SEQ ID NO: 116295 - DNA, 210 bp, Glycine max
  Peptide Sequence Number=SeqID_233073
atgggaatttccttagttttcatgatcgtctatgtttggagccgcgagtttccaaatgcacgaattaacatttatggtgttgtatcattgaagggacatctatactacttcttaacagtgcttcaccctcttgctggaggaaagttcaagttcaagactcctctctgggtgtatccttttttaccacgttcctatggccactatgattaa

SEQ ID NO: 116296 - DNA, 288 bp, Glycine max
  Peptide Sequence Number=SeqID_233074
atgcggttgaatgctgagatccaacttgaagaaagtcgcgtaggggcatcatgttggaatttgttagagctcgtaagacaaaactcaattggttgttttcacaccacaaagaccccacttttgatagagaaagaattctccaagaatggaggttcgttaaggagacagtcctcaaagttgttggatgaccacgattggtacctaggaaatgatcgtaggaatgagttatccttgggagtgaagtttcgacttgtgaatgatatcaccgaaccaacttggaaactttga

SEQ ID NO: 116297 - DNA, 261 bp, Glycine max
  Peptide Sequence Number=SeqID_233075
atgaaggataatggaggtttaaggagtacttacttaaagctcttgaatattccaaggatatgccaaaggcatcttaacatattccaagaatatgccaaaggcatcttagcatattgcaagaatatgccaaaggcatcttggcatatttcttttagatgctacaagaatggaaggtgttactctaacacatgggaaaggaatatgccacaagaatattccaaaggaatattccaagaatatgccaaaggcatcttagcatag

SEQ ID NO: 116298 - DNA, 318 bp, Glycine max
  Peptide Sequence Number=SeqID_233076
gaagcgctttttacactgaagaagaggaatcaaaagaaattgcttgcttacaaaggagtggggatgtctcctccacctctaggaatctcacaatcactcaaaaactcactaatctccctaaaagatgaaaacttggccccttgctctactctacgctctctgaaattcacactcttcaggcctctgagtaggcttcctgatcttgacgtcgcgcttagcgccaatctcgcgcttagcgcgacacgtgcttgcatagcagatgtctttccagattcccctttacttgctaagcatgctggtgttgggcttagccgttga

SEQ ID NO: 116299 - DNA, 762 bp, Glycine max
  Peptide Sequence Number=SeqID_233077
atggagcagagcattggtgaacgcaggttagcatacgatgaatgtttctacgcaaggactgcttatcctcaacgctcgcttctcttccaatttctccttccgaggttgtcggtttttccaccttcgcaacagtgtgaagggccgagaaggggtttctctaaaaacatgtcttgcagtgtcagtgtggataattctgatatggttcatccagccacagatgcttatgctggagaggcagttgaagctttgaaagctggctcattggaagcagttaacagaatttacgagattaaaggccgtagacatacaagccctctggctatttgtgttggtgacgtatcagatatagcccgttttgctgtcactgaccatttacctcatggtctgcttgattgcctcctacctgggcctgagtcaagtattcttgaacgatctttgaacccaggatttgatagtataggagttagagtgcctgattgcaatttcatcaggatcattgcctgtggttcaggaactgccctagcccttaccagtgcaaacctaagtggccagtcaagtaatccttctggcgtctatcctgacttatcttcattcactggaagtggcgtctaccctgacttatcttccttcactggaagtggcgtctacccaaacttatcttccttcaccggaagtggcgtttatcctgacttatcttccttcaccggaagtggcgtcatccaaaccttcgtagcctgtatcaaacgatccgctcctactcag

SEQ ID NO: 116300 - DNA, 195 bp, Glycine max
  Peptide Sequence Number=SeqID_233078
atggggcatgttggaactattcttctcaattgtgccttcctatatgacatcttttgcgcgtttgtctctaaacggtggttccatgagagtgtgatgatagtaatagctcgaggtgataagagtggaaaagatggtatccccatgcttctcaagataccacggtctgttttgctagagatagggggagcaacataa

SEQ ID NO: 116301 - DNA, 495 bp, Glycine max
  Peptide Sequence Number=SeqID_233079
atgaaagatggcaattgggtgaaagtgatgcaagaagagcctgaccaatttcagaagaatgatgtttggaagctagtcgaactaccaaaaggaaagaaagtagttagagcaaaatgggtattttgcaacaaactggacaaaggtggtaaggttatgaagcaaggcaaggttatttgccaaaggttacttacaataggaagcaatatgaaggtgtatcaaatggatgtaaaaagtgcatctctaaatggcttaatccaagaggaattttatgttgaacaacctccaggatttgaaagtgaaacccttcctaaacatgtttttaaaatcaacaaagacttatatgaacttcaacaacctcccaaagcttggcattgggtattgggcaagaaatttagaatctccgaccatgtgggaactggggtagaatacattactgaatttgggatgagcaacagagaagagtggagaattgtgaagttgcagtggattaagtga

SEQ ID NO: 116302 - DNA, 1545 bp, Glycine max
  Peptide Sequence Number=SeqID_233080
atggttgtttcttattaccgaagactatctgcggatatgccaaaaccagataaggttctgattgttgaaagagtaattgagtccttaggactccaggcagtgagggattcccttgttgggacagtagagaagagaggtatatctggagggcaacgaaagcgtgtaaatgtagggatggagatggttatggagccttcattattaatcttagatgagcctacaactggcctagacagtgcatcttccactttactacttaaagcacttcgtcgcgaagcacttgaaggggtaaatatttgcatggtacttcaccaaccaagctatactttgttcagaatgtttgatgatataatctttctagccaaaggtggccttactgcatatcatggccctgttaagaaagtagaagaatactttgccagcattggcatcaccgtaccggatcgcgtgaatcctccagaccattttatcgacattttggaaggtttagtgaaaccaaatggaaatgtgacccatcaacaacttcctgtaagatggatgctacataatagttacccagtaccaccagatatgcttcattttgctgatcaaattgctgcctcctcctcctcctcctccacctcaaatgtaaatgatgcaataaagggtgcagatgaagctgttgatcaatcctttgctaatgagttttgggaggatatgaagagtaatgttcagatgcaaagagatcatatagaggcaaccttcttaaagactaaggacttatcaaatcgaagagctcccggtgtatctcgacaatatagatattaccttgggcggatttgtaagcagacactacgggaaggaaaatcacaagcagttgattaccttctcttattagttgctggtgctatattaggaactcttactaaagtaaatgatgaaacatttgggtcccttggatatacctataccgttattgctgtctctttactttgcaagattgcagcactcagagcattttctctggataaattacaatactggagggagagtgcatcaggaattagcagtctggctcatttcttggccaaagatacaattgaacttttcaatataatcatcaaacctgtagtttatttgtccatgttctatttttttagcaatccaaggtcaagcttcggaagtaattacgcggttttggtctgccttgtgtactgtgtatctggcatggcttatgcaatagcaatttattttgagcctgctccagcacaactgtggtcagtgcttctcccagttgttatgactctcattgcaaaccagacaagagatactgtctttatgaagatccttgtaaagttgtgctatccaaattgggctttggaggcctttatcattgcaaatgctgaaaggtttactggagtgtggctgataactcggtgtagttcactaatgaatagtggctataatgtcagcgactggcctctttgtctggttgccctcattttttacggtataattgctcgagttgtggccttcttttgtttagtgatcactcaaaagaagtga

SEQ ID NO: 116303 - DNA, 474 bp, Glycine max
  Peptide Sequence Number=SeqID_233081
atgcagtctagttcaagtcaggttgcaatgaagtgtttttcattctactttggagagaagaaggatggtcacaagagcttgcagtcaatattgagccggttcaacagttctacttatgttgaggctgaaatgagaagatctggttctgaattgaactctatggatgcctcagacaacagcacagactcccttaggagaagttcttttcccagtttgtcccaaagacccagcaaccttagagtatttactgtatctgaactgaaaacagccacaaagagttttagtcgctctgtcatgcttggagaaggggggttcggatgtgtctacaaggggttgatcaagagtgtagatgatccttccacaaaaattgaagttgcagttaaacaacttggtagacgaggaattcaggcaaggttttgttttgccttctatgttgtcctcttgaaatattttgaattgttgattcattggtag

SEQ ID NO: 116304 - DNA, 1109 bp, Glycine max
  Peptide Sequence Number=SeqID_233082
atgaggaactgtgcatcatggctccctcttcttttcacgttgatccctctcctcgcgtcgcggattcgatgcgccgacaacaactttgcaccctccttttactccgaagaaatctacaaggagcttcaaaacctcgcttccctgttaaacaaggacattaaagcagtatctgatcatgcttcgaacgagattgcttcatgcggaactagttttccacaacgtgctgaaccaaatgttggaatcgccactagaagaaggagaaaggctaaatccagggaatctgctgctagacaagtaagagaaactgtacaagcccgagaaaggtggaaaatagcaaaagatgttgctaagaaaggtagagggggattgcaagagcaattgtctcgtactttttctcgcaaaaaatcgttaaagcaaccagatcattctagccaagctaaacgtggtacgggcgatacatttttgccaccaatgcctccaaattcttcaggcatgtatgagcagccatcagcaggttcaaaggcacaaaacaaggaacctaccaaccttactaaaatgttgaattccttcgaggatgacccgcatagcaacgaaggattcaatctacaaattggagataaaaatattaagaagcagatgccaaagggcaagaatttacacacacaaagccaaattttaaggtatgcttatggtcagatagagaaggagaaagctcaacaagagaagaacaaggacttgactttctccggagttatttcaatggcgactgaaggcgatgttcgaacaaggcctgtgattgaggtagcttttaaagatttaactcttactttgaaaggtaaaaggaaacatataatgagatgtgtgtctggtaaactcatgccgggtcgagtttccgctgtgatgggtccctctggagctggcaaaactacatttctttctgccttggcagggaagacaagaggatgcactatgacaggctcaattctaatcaacggaaagcctgaatccattcattgttatcagaaaattattggttatgtgccacaagatgatattgtgcatggaaacttgacagtggaggaaaatcttcgtttcagtgcaagatgcag

SEQ ID NO: 116305 - DNA, 222 bp, Glycine max
  Peptide Sequence Number=SeqID_233083
atgcacacatcaggggcagaggcagtaagcgatgagggtgaaggcacgaaggaaggacttggtgaggatatgggtggtggagagcttgttgcaggccttgtgggggtgctagatggtgaggatttgggtggcggtggggatcgggggaaatggaagcgtgtggcagagatagacgacaacgggagggtcatagatggaatgatgctactgaggctcctttag

SEQ ID NO: 116306 - DNA, 618 bp, Glycine max
  Peptide Sequence Number=SeqID_233084
atggcaaccaaaacctccattccaagttctcaatccccaaaactctctcgtctccgccctcaatacattcccaaccacatccccgactcctcctacgtccgcatcttggacaccaccctccgcgacggcgaacaatccccgggagccaccatgacagcaaaggagaagctcgacatcgcacggcagctggtgaagctgggcgtggacatcatccagcccggcttcccttctgcgtcgaatagcgacttcatggccgtcaaaatgatagcacaagaggttggcaatgctgttggtgatgatggttatgtgcctgtcattgctagcttctgtcggtgcgttgagaaggacattgctactgcatgggaggctgtgaagtatgctaagaggccacggctttgtacttccatagctacgagccctattcacatggagcacaagctgagaaagagtaaagatcaggtgattcagattgccagggatatggtcaagtttgcacggagtttgggttgcaatgatattcagtttggtgctgaagatgctactagattgagagagaatgaacaaaaccgcaaatcttgcaaaaaaaatagagaagtaaatatctctattttaaaataa

SEQ ID NO: 116307 - DNA, 729 bp, Glycine max
  Peptide Sequence Number=SeqID_233085
gggcataaggaatgggtgacagaagtgaatgttctgggtattgtggagcatcccaatctggtgaaactagtgggatactgtgctgatgatgatgaaagaggaatccagcggcttctgatttatgaatatatgcctaacagaagtgtggaacaccatttatcaccacgatcagaaaatcctctcccatggaataggaggttgaaaacagcccaagatgcggctcgtggcttagcatacctgcatgaggaaatggattttcagataattttcagagatttcaaatcttcaaatatccttctggacgagcagtggaatgcaaagctgtcagacttcgggctagctagattgggaccatctgatgggttgactcatgtctcaacagcggtcgtaggaacaatgggttatgcagctccagaatatgttcaaactggacgtctcacgtcaaagattgatgtatggagctatggtgtcttcctttatgaactcatcactggccggcatcctattgatcgaaatcgccccaagggtgagcagaagctgttggaatggtcagcacaaaaacttgctataatagctaacagatgcttggtcaaaaacccaaagaatcgcccgaagatgagtgaagtgttggaaatggtgactcaggttgtggagtctacagtgagtactaatcaacagccacccttgaagagtgtagctgcctcagcagaagcttctcagggtactaaa

SEQ ID NO: 116308 - DNA, 813 bp, Glycine max
  Peptide Sequence Number=SeqID_233086
atggaaggaagtaggacggtgacaacggagcaaactccctaccacggaggatgggccaggaagattacaaaagtttacatcgcagggaggaaagataaaaagagggcaagattcgaattcacacgctttaaggatgtaaaggatgctcagagattatggctctcagattggacaaaatatttattgaaagtagaaagcttatggttaatatgcccaaattcactagagggtgggagaaactctaagagatggcctgaggtaaaaaggtcggggaagccattgtcattgcaggatgcattcgattcaaacatagtaacatgtaacaagaggaacaaagcaatgttagaaggggaggtggccttaagtgtgtggagtatagcgaaggagatgggggttcggggagagcaaacgatttcaagcaaaacctttgggaagaatggcatttggggtaccatgagagacttatctctgaatgtgcatgggatgaaagtctgggcaaagtgtagaagaattcggtctttggtattagaaagcaagaaattgagggttttgaaaaactccttgaaggaatggagtaaactaatgctcgcaaggatggaccataagatcgatgacaaggtgtctgaaatggaagttattggttgccaatttcttgacgatattgtagcacaagctgagaaacaaagagtcttggccatggctcaggaattttggagtattattagaatcaaggaaagctcaatcctgaaaaatccagggccaaatgggctaagtttggggattcaaattgtcgattttttaactcacacttaa

SEQ ID NO: 116309 - DNA, 366 bp, Glycine max
  Peptide Sequence Number=SeqID_233087
atggtgcacagtggtggtgcccacaaccctaactctccccaagccttcatcctcttccccgtaacccctcttattcttatcgaaccaaaccaagacatccttaacccccaatccttcctctccttaaacccattgaccccctcatcaacacatattcaaaacacctcagccaaacctataaacccttcaacacagattcaaaaatggtggactatcgtggtggggtgcgtggaagacatcgtggttgagggggatggcatgcacagaggggggaggggtcaaggtagcgcaagggaaggggtggtgacacggtttgggagtggcatgggggagggtggcgacacatgtgttttgtatctaggctga

SEQ ID NO: 116310 - DNA, 735 bp, Glycine max
  Peptide Sequence Number=SeqID_233088
atgacgcaggggatgataatcgcaatacaaggatcaagaaacatggcaaggaacagatttgagaacaacagggacatcataagcactatgcctgacgatatcttaggggatattctttctcggttgacattgaaagaagctgctaggactagcgtgcttgcaactaaatggagatatcactggacctttttctctgggctcttggactttgatcattcacttcggaactttcacttgcgtcgagaacatgttggaatcttgactaagtgcaatgtttttgtttatgagtgggagaggttcatgacccgtatggcaaatgtgatgaaatcattgaaaagctcctccctccaaggactcagaatttgcatggatttgggtgacccttggagggtagcagaatgggttaagtatgctgctgagaagcatgttcaaacgttggacctggatttttcataccacttctcagtaccattttatgaaataagtttgaccattgttcataatgtctttccatcaaggggttatgaaatgaagtcattgtgtaacctgcgtttgtcttctgtggacgtgagtggtgaagtcattgagggtttactagcatcttgtccattgcttgaatcaatatgtgtcattgaatcaaaacgccttgtgcgcttgaaagttaggggtgaagcactgaggctgaagcatttggagttggttgaatgccgcattatggatcttgacatctatgct

SEQ ID NO: 116311 - DNA, 264 bp, Glycine max
  Peptide Sequence Number=SeqID_233089
atggttttgtcattgttggtgctcacaatgtgcaatgttgtggatgtaattgaggtttcgccatttgagggaactaaagccataggttcatatctacatatccttactgaagatgatcttcctcatgcccacaagattaacaatgttgttttagatgtgaatgatggcggtgtcaaagatagagagccagaggtggaggagcttcgacatcatgccaatgatcttcaatgtcaaatcactgacattttatttggacttgaatga

SEQ ID NO: 116312 - DNA, 372 bp, Glycine max
  Peptide Sequence Number=SeqID_233090
atgagggcgacatctgtggccgagaacccatttctcatcacaatgatagcacaggcccttgtctcatcgagtggccaactcttccaccgaaaggcgtttaatcgggggtttcaggtttggagggaaggcagtggtagggacaagagaagaagggttgggccgataatggtggcgacagtcgttgagtttctcctcgtgcaactttgggttgaaacgcctgcacttcgcggtggagttcagggtagatcgaagatgaaacaactcagcaaggagggtggagctaggctaactatgcggttcgcaagatgtttgaactcggtgagatactcattcaccgagtcgtgctgttggagcttgaataaagcgcactaa

SEQ ID NO: 116313 - DNA, 120 bp, Glycine max
  Peptide Sequence Number=SeqID_233091
atgattagggagaggctggctggaaggctttgttctcgggacaagtctcgaggcacaattttcaacacctttagtgttcaagaccttgagagatggggtcattttgaagcccatctatga

SEQ ID NO: 116314 - DNA, 492 bp, Glycine max
  Peptide Sequence Number=SeqID_233092
atgccattggagttaggaaaattaattgttgatataaaagacaataccccaggaattgcgaatgttattatttcgactcattgtcataatgatcttgggcttgctactgctaacaccatcgagggtgctcgtacaggtgcacggcaattagaagtaaccattaatgggattggtgaaagggctggaaatgcatcgttagaagaggatagtggcgaggtaaacgggagcatcgacgccaacacgctcgacatattttctggccttgaggaaacaggcgataggctgaccgagaattggaggccagctttgctactccttgagattgcctttttgcaacgctggaccctagggttttgccacaaccagccattgatgaactttaacctagttgtcggaaagagagggttcaagatgtgcgaagtgaaggcgagagcagaggtggagccaaacctcaaaaagaaagcgcgagaggtgatggcttgggaaccttag

SEQ ID NO: 116315 - DNA, 424 bp, Glycine max
  Peptide Sequence Number=SeqID_233093
atgcccttgccagagacgttttgcatctacgacactattgctcaccatcgtgttgtgattttggtggatagcgaaagcattcacaacttcctccaaccccgcttggctaacttcctccaccttccttccaacccgacgtccacgatgcgcgttatgattagtgattgcaccatgctggattgcacctctatgtgccttaacatccccattacgatccagagacatacttttcctgtggacctttaccccttacctattgggggcacaaacatcgtcttaggggtacagtggttaaagcttttaggtcctgtgaccatagaccattcagcactcacgatgagctttacttatttggtccataatataacattgcaagcagatgttccctttacccaagcccagcctcagcccaacaactcaaacg

SEQ ID NO: 116316 - DNA, 1098 bp, Glycine max
  Peptide Sequence Number=SeqID_233094
atggcaccagaaacgttacgcatgatggggtctatgtctgaccagaaagtcctcattttggtggatggaggtagtactcataacttcatcgaggaacgcttggtcaccatgctagggctacatgcacagtctactccactgttacgcgttatgattggtaatggtatcgagatcgaataccaccttcaacatttggattgtgctttttggatcctacaagatggtcaattcttccttaagttatctaaatgttgtgtcgtccaacaacaaattgaatacttgggtcatgtggtgtccgctactggtttttatagatgcttcatcaaaggatatgctaccatagcagcccttttgattcatcccttgaccaaggaacacctcgtctggtcaccggaggccctactagcctttcacgcgttacaagaggcagtcagctcagcaccaggaattgtcctcactctgttaatgccatatttcatttttatggatgaactaaaaggagagctagctggtaaccccaagtttaatgctctacgacaagacttacaagagaacccaaccaatcgtcctactctgacttacactgatgggttgcaagaactgtttaagctatctggcacaaagttacacttaagctcgacttatcatcctcaatctgatggtcaaaccaaggttatgaatcgcataattgagcaatttatgcatgccttcgttcatcatcacccattgccatggggtaagttcttaccttgggtcgagtggtcgtataatacttccagaaatactagcactggaacctccccatttgaggtcacatacggcaataaaccatcgacaatccttcagtatatcacaagctcttcttcagtggaggcagtggacacattactcaccacatgggaggcagtttttgatagcttacgccataaattgttaaaagtgaaagctcaaatgaaacattttgcaaacaataaacatccagaagtacactatgcaaaaggtgactgggctatggtcaaactccatcctctacgtcagtcgtccctaacgggccccaacaagaccaagctcgctaaacgtttttatggccccttcaag

SEQ ID NO: 116317 - DNA, 552 bp, Glycine max
  Peptide Sequence Number=SeqID_233095
atggaccgtgttgatttttatggagtgttgttgcagattaatgttctgaaattggaactgtccaaaccgtatccgggttttcttgaaggcctgcctgtgtttgataatgtggggcagctggaaattcgaattcctcacaggagtggagcggcgcttgatcatcatgtttctttactaagttcattcccttcagtacgcgtgcttaagattaagtcttatggtgatcctgacgctgatcatttccaaaggaacgatctaagtgtagtggaggagaattggaaggccaatctggaacatgagtatccaaacctgagggagctggaagtgtcaggattcagaagagaccccagtcaaatggagttgcttatcagcatatttgagaaggctcctaatctcaacagtgttgttgtggatcccttgtcttcaatacatgtggataggtcacctgatgtcaaggcccggtatagagaaatgaggcgtgagaccaccaaatggcttgctgatgctctcaaaccacatctgcctcctttaactcagttgattgtcctctga

SEQ ID NO: 116318 - DNA, 258 bp, Glycine max
  Peptide Sequence Number=SeqID_233096
atggctatctatgcattcaggatgatccaggctgaagctggtgggcacgtaacacctcgattgaatcacactagaatgggaaggatccaacattgtgcagactatacaattaagaatgaattaaacgaattaattggtgatacctataccaataagatacatctactttttgatagcccatcacttaaaaactccatacttaagagtgcttggcttggaccaattatgggatgggtggccttttggaaagcttcctag

SEQ ID NO: 116319 - DNA, 552 bp, Glycine max
  Peptide Sequence Number=SeqID_233097
atggagaaaagcaaaggtaaggtagaagaagagaagtgtgaatgcaaagtttacgttgaagtttttttagagaagaaaagcgtatacaaatggtcaaaagctactcaaatcctactctgtgtatgctacatccctaaacaatgctatactgcatccctaaacaatgcaaagctagaaagctacaagctgaagccctgcaagctgcaagcccctgctactgaaaaagctgaagcccctgcaagccctgaagcttcacgtgaagcctggcctgtctcgccagcactgtgggcgagtcccacgtggccctatctcgccatcactgtgggcgagtcccacgtagcttgggtgtcgccatttgcattggcgacactgtcctctctccctcctacgtggcttatatcgctcctgctcctggcggcactctcctctttccacctttgccgccagtgggtatggcgggttcagccttgccgccaatggcaatggcggcttcaacccaataacagaccccctccgtcatttcttttaaaacagaccccaatccgtaaatag

SEQ ID NO: 116320 - DNA, 441 bp, Glycine max
  Peptide Sequence Number=SeqID_233098
atgaatgataagcaaaatgtaaaagaaaatggttataggatgcaatatagaacattgaaaaatgatggttgtgaacgtgagaagcatttgaaggccattgcatacccaacaaccttgcaccttaagaagtcaatcgagttcaaattctaccctaataggatttgtcaaaggtttccaatcattaactttcataaaaggaaaggtgtggaacctgaggaagtagatatggcaacgaaggccaaagtggagttccaacaatactttgagctttttaaagaagaggaggaaaaggaaatagagacaacattcaacaacgcttggtccttgcatctagtaagaacataccatttcacaaatacaatgatcattgatgaagaagatatcacttatctaaaaaatagttacacttattggatcttggttcattgtttgataggatga

SEQ ID NO: 116321 - DNA, 261 bp, Glycine max
  Peptide Sequence Number=SeqID_233099
atggctaacaagcttcaacttatctttaggctcaccgatccaaacatggctagctacctcgtccttataggaccaaagcagtgtcaaatccctagggcctcctccaaatggcaatctgatgatatggttgtgctgcctgctgctgctattgtcaagctacatctgcatcacaatgcgttgacacagtcacatgttgcctctacctctccatgtctgagatatgggaagctccttttgtgcgagacatctaaaaaaaactaa

SEQ ID NO: 116322 - DNA, 293 bp, Glycine max
  Peptide Sequence Number=SeqID_233100
atggtgaagggaatggtgaagtccgacgtcgccaacaccaaggcttgcgtcattattagcttcaattggtcaaacgcagccaatccagcatggcctggattttgttggggtctggggccactccatgagacgacaccacatggccaaggtctagttttgagaaccaagaagcacgatccagttcatccagtagctcatcattcgtcagatgggaaaatggtccttaatggtgatagcattgagtgcccgatagtgaacacaacagcgctagctgccatcatttttcttaacca

SEQ ID NO: 116323 - DNA, 573 bp, Glycine max
  Peptide Sequence Number=SeqID_233101
atgacctcacaagttgtcctacacaacaatttcgaaacccaaccctccgtcaccgtcaccaccgccaccaacaccgagtctccacccaccgcgccaccgtcactcgccgtcgtcaagagaccctccaccaaggaccgccacaccaaggtaaacggccgcggccgccgcatccgcatgccaccgctctgcgccgcgcgcattttccagctcacgcgcgagctcggccaccgctccgacggcgagacgatcgagtggctcctccgccacgccgagccctccatcatcgccgccaccggctccggcaccgtccccgccgcccccgtctcctccgttgcgccctccgctccctcctccgagcccatggtcgcctgccccgtcacggcggttggcgctcagggaatgttcgccatggcgccgccgcagccgcagccgaattgccgactcgacctctctccgccggcggggttggaattcgcggtgaatggttaccggcacatgccgttcacggcgctgctgttgcagccggcgacggcggaggataatcagaacgacgagtctctcggcgaacaatga

SEQ ID NO: 116324 - DNA, 1281 bp, Glycine max
  Peptide Sequence Number=SeqID_233102
atgctcaataagactctttcttttgcgatggggtgctgtagttgctttgggttcatcaggacacctaaccgtcaaagtcaaaggtctaagcctactactaacaataatctctgccaggagcctctgttggatgatgatattgaggatgaagagggtgagcctttgtacaatgatgaggttactaacaatagtggagatgaaggtgcggaggaaactcgtcccaagcgatctgaagaaattttgaacttcagagtagagaatggcatgatttgtaggcagtttccagttaaggaaactcgcaaacttgttcgcagcgaggatgaaaatgggaacaagatgataaatgagtatattcgtgagtataagattggttctggtagctatgggaaagtggctctttatcgaagctctgttgatgacaagcattatgcaattaaggttaggaaactttttggtgggcagacagattactgtaggaaacatggccacatgggcatggcctttcataaatcttatttactgaagcttcgagttgcaccctcagaaactgccatgatggatgtactacgtgaggttctcattatgaaaatgctggaacatcctaatatagtcaatctcattgaggtgattgatgacccagagacggacaacttctacatggtacttgaatatgttgaaggaaaatggatttgtgagggttcaggtcccacttgtggcttaggtgaagagactgctaggagatacttgcgtgatatagtttctggattaacatatctccatgctcatcagaatatagtacatctggatattaagccagataatctgttgattacttgtcatggtacagtaaagataggggatttcagtgtcagccaggcttttgaggatgataaagatgagcttcggcgatcacctggcactcctgttttcactgcaccagaatgtgtgaaatatggtggtaaagctgcagacacgtgggcagtaggagttactttatactgtatgatattgggtgaatacccttttcttggagacacccttcaagatacatatgacaaaatagtcaataatcctttagtactccccaacgacatgaatccaccattgaaaaacttaatagaaggacttctttccaaagacccaagtttaaggatgactttgggtgctgttgcggaagatagctgggttattggagatgatggtccaattcctgattacctttgttggtgcaaaaggaagagcttgggaattgaggacaatgatgagagcaatactgactaa

SEQ ID NO: 116325 - DNA, 234 bp, Glycine max
  Peptide Sequence Number=SeqID_233103
atggctccaaagaagcttctttctaagagggcaatgaaagatgcagttggagaaggatccagtgcggccccacaaacggatatggaatttgacgaacactggttccgaactgaagaaaaccaacgccactttgaagtgatcaagggttggtctttcctcaaggagagactggtccagttgagggagatcatccttcttgtccttcattgtaagttgatccttagctacccgtga

SEQ ID NO: 116326 - DNA, 207 bp, Glycine max
  Peptide Sequence Number=SeqID_233104
atggtactagttcctaggccttggctcagtgctcatgccaacacagaagcatggctacgcaacggcgaagaatgtagaattttgctcgctgcttcttcacaagatggctgcacttctggccaaaagacttgcagggatcacaaacttgatgctgttgctgctgctgatgattgctttggcttgtgttgctttccagcactgccatga

SEQ ID NO: 116327 - DNA, 1161 bp, Glycine max
  Peptide Sequence Number=SeqID_233105
atgggtggaagaaagtggagcatcttggtggccatcttcatcttacttcttgctatggaagctgtcattgctcaaggtcaaggaaatggaaatggtaatggtaatggtaatggcaaggataaggataaggaagagaaggagagggagaagagggagaagaaggagaaaaaggaaaaggaaaaggagaagaaggaaaaagagaaaaaggacaaaaagcaacgtgatgaagccacaaattatgacaagctgtcatctctgccaaccggccaagaaagagggttctgccgaacaaacactacctgtgagtttaagaccatcgtgtgtccatccgagtgcgcatccagaaagcccaagaagaacaagaagcagaaggcatgtttcattgactgcagcagcagcacatgtgaagccacttgcaaggttagaaaagccaactgtgatggatatggtgctttgtgttatgatcctcgttttgttggtggcgatggtgtgatgttctacttccatggtgccaaaggaggaaactttgccattgtttctgatgatgagttccaaatcaatgctcacttcattggtactcgaccacaaggaaggactcgtgactacacatgggtgcaagcacttgctgtcatgtttgacacacatactcttgtcattgcagccaatagagtgtctcattgggatgacaaggttgactctctcatagtaaagtgggatgatgaactagtgaacattcccactgatggagaggctgaatggaggatcaatggtgatgaaagagaagtggttgtggagagaactgatggtaccaacagtgtgagagtgacagtttcaggtttggttgagatggacattagtgtgaagccaattggagagcaagaaaacaaggttcacaattaccagttgccatcagatgatgcttttgcacatttggagacacaattcaagtttaagaaaagtacagataattttgaaggagttttgggtcaaacttacaggccagggtatgttagccctgtcaaaagaggggttcctatgccaatgatgggtggagaggacaagtaccagactctctctcttttctcaacatcatgtaacctatgcaagtttcataggccatctgagatagcaagcattgaaggactagttgctcagtactga

SEQ ID NO: 116328 - DNA, 930 bp, Glycine max
  Peptide Sequence Number=SeqID_233106
atgggtggaagaaagtggagtatcttggtggccatcttcatcttacttcttgctatggaagctgtcattgctcaaggtcaaggaaatggtaatggtaatggcaagggtaaggataaggaagagaaggagagggagaagagggagaagagggagaaggagaaaaaggaaaaaaagcaacgtgatggcacaaattatgacaagctgtcacctcttccaaccggccaagaaagaggtgcgcatacagaaatcccaagaagaacaagaagcagaaggcttgtttcattgactgcagcagcagcacatgtgaagccacttgcaagattagtttgtttgacagttaggaaagccaacagcgatgggtatggatctctgtgttatgatcctcgcttcgttggtggtgatggtgttatgttctacttccacggagccaaaggaggaaattttgccattgtttctgatgatgacttccaaatcaatgctcacttcattggtactcgaccgcaaggagggactcgtgactacacacatggggctaatggtgatgaaagagaagtggttgtggagagaaccgacgagaccaacagtgtgagagtcacagtttcaggcttggttgagttggatattggtgtgaagccaattggagagcaagaaaacaaggttcacaattaccagttgccatcagatgatgcttttgctcatttggagacacagttcaggtttaagaaaagtactgataattttgaaggagttttgggtcagacttataggccagggtatgttagccctgtcaagagaggggttcctatgccaatgatgggtagggagaaccaataccaaactttctctctcttttcaacatcttgcaacctatgcaggttccagaggccatccgggatagcaagcaccgaaggactggttgctcagtattga

SEQ ID NO: 116329 - DNA, 1218 bp, Glycine max
  Peptide Sequence Number=SeqID_233107
atgagagtgacacagattctgttcgttttgctttggtttttctgcgtttatgcccctcttcgttttgtgcaaatgtcacgtatgaccactgagcatgggtcattgatggcaagcgccgagtcttggtctctgatgtggtcagacctcatccagaaatccaaagatggaggactcgatgtgattgagacttatgttttctggaacttatacgaaccagttcaaggccaggcggtagcagcagcaggtctatatgtgcatctccggattggtccatacgcatgtgctgaatggaactacggtggtttccctctttggctacattttattccgggaattcagttccgaactgataacaaaccatttgaggctgcagtttacaagacaggatcagtatgtgcagccttccttgccaacattgccacatctgatgcaacagtgaccttcaatggaaattcatatcacttacccgcatggtctgtgagcatcttacctgactgcaagaatgtagtgcttaatactgcaaagattaattctgcacctatgatttcaagcttcacaactgaatctttaaaagaagaggttggttctttggaaggttctgactcgggatggagttggattagtgaacctatcggtatttcaaaggctgattcattcccaaaatttggattactggagcaaataaatgcaactgctgataaaagtgactacttgtggtactggttaaggtatatagtataccttcaaggtttagaaagctttcttctgacctccaattcgctgccccatgatgatgctggttctcaaactgtccttcatattgaatcccttggtcatgcccttcatgctttcataaatgggaagcttgtagggagtggaactggcaacagtggcaaagctaaggtcaatgtagacatccccgtcccactagtggctgagaagaacgcaattgatctcctgagtttaactgtggaacttcagaactatggagctttttttgacacatggggtgcggggatcactggcctagtgatatcgaaaggtttgaagaatggaagcactgttgatctttcctcccaacagtggacatatctggttggccttaaatatgaagatttaggtccatctagtggcagttctggacagtggaattcacaatctaccttaccaacaaatcaatcgttgacttggtacaaggtaatctttataagaatgtag

SEQ ID NO: 116330 - DNA, 324 bp, Glycine max
  Peptide Sequence Number=SeqID_233108
cagaatgagagtggaggcactagtgataatgacggtagtgatggtcatgacaataatgatgatgtttgtgaagtgataatggtagccatgacacaaatgatgggtgaaatagtgacaataatgatgatggtttggtcgggtcaagttgcttatcagattgactacacatcgaacccaatgcaatccgggcgggtcatgctcaagggaggcaacacgttaggtcatgtaggccaattaagtgagaataacgacaacaacaacgatggaggcgaaatggtggcgatggtggtagcaacgatgttggtggtgatagtggtggaatga

SEQ ID NO: 116331 - DNA, 585 bp, Glycine max
  Peptide Sequence Number=SeqID_233109
atggcttcctccaacactcccaaacccgaaaataagaagagtaccaaaaaatccgaaatctccaaagccgaaaagaagaaaaccaaaaacgctgaaatccccaaaaccgatggcaaaacgaagaagaacaaagaaatctcacaagaggagaacaagaagaagattaagaaggccaagctcagcaacggcacttcaaaacagcgagacgagggatccaaaaagggagtagcagcagaaggaaacggagaagaggcgaaaatgaacgtgtttccgatgaatcgcatcaggacgatgattaagggcgaagatcccgaaatgcgtgtttctcaggaagcattgtttgccatcaacaacactgtggaaaagttccttgagcagttcacgcaggacgcttatgccttttgtgctcaggaccgcaagaaatgcctcagctatgatcacctagtttacttttccctgcattcaccttaccctacctacaaggttttttacattgctcttgctcgttcagattttgttcctgagagagtaaaagctgaggatgcattaagagagagaagtgcagcaggaaaaggaggaagttaa

SEQ ID NO: 116332 - DNA, 129 bp, Glycine max
  Peptide Sequence Number=SeqID_233110
atggcaagaatgaaggtgaaagcagggcccagattggcgattgatgaagcaagtgttggagaactgaaactcttggccatcaaaatgcaaaacaagaaacacagtttcagaagtgctactgaatactga

SEQ ID NO: 116333 - DNA, 1908 bp, Glycine max
  Peptide Sequence Number=SeqID_233111
atggagagagaaggaaacgattgtgttgtgggggacacatctctcacagcttcaccttttgatggtgaagcttccattttgaggtccacccttttgttgtatcacgttggggaggtcaccctcaccttccactcagataggctgtcttggaaattggtcgaaccattggataatgatgtttcaacttgtttaggcattaaatatttttctaaggttgctactgggatcaaactttctgacatatatgctgttgagttaaatgatcatggttcaattcacatatcaagtctctctcctgctactgaatgtctatttttaggtcaagacataaagatgtacagctttactgtgcatggttttataagaagcaagacccaaccttctcaatgcatcctggttgaatatacttttggtcataaaaatttgccaagatgtcagatgtgggtaaatcaacttaatgcttccttgaaacatgaaattggaagaccaaagaatcttttggtttttgttcatccaaggagtgggaaaggtaatgggtgtagaacctgggaagctgtggctcctatattctctcgtgctaaagttaaaacaaaggtgattgtgacagagagagctggagaggcatttgatgtgatgtcttctataacaaatgtggagcttaactcatttgatggcgttgttgccgttaactggactggaaatagctgtgtaatactttattatactgaaaatttgatggtgataacactcaacaagggcggtgatggatttttcaatgaaatccttaatgggtttctttctcccaggtttaaagctccctacccaccaactccatcagattttgttcatttggctaaatataatggtgattccttggttcttgatgaagatgaaatagttgatgggacttcaattcgaaatgaagaccagtttcctctgattccaagtccaaaacaatctgggtctagaatctcaaattctaattctgaagataaggctgctgaatttcctgttcccaatgaatggtttagatttgggattattcctgcaggttcaactgatgccattgtaatctgtacaactggaactcgagatcctattacttctgcattgcttattgtccttggtaaaagggtgcaccttgacatagctcaagttgtacggtggaaaagaactcctacatctgaggttgaacctaatgtgcgctatgcagcttccttttcagggtatggattttatggtgatgtcatcacagagagtgagaagtatcgctggatgggtcccaaacgttatgattacgctggaacaatggtatttttaaagcacaggtcatatgaggcagaaataacatatgttgaatcagatgaaaccaatttgacttccaaaagggatcatgagggtaatctcttacgggcaataaggtctccacacaaatcagaaaaatgtatctgccgaattaattgcaaagtttgtaatgaaaagccaaatcatgcatcccttggagtttgcagcctcacacctcatctgaattcagaagaaacaagatgggcaagatccaaaggacgctttcttagtgtaggagctgctgtaatctcttgcagaaatgaaaaagcaccggatggattggtggctgacgcacacctgtcagatggtttccttcatcttatattgattagagactgtcctcatgcatcttatttatggcatctgactcaacttacaagaagagggggaagccccttgaattataagtttgttgaacaccataagacccctgcatttacttttacttcttcgggcaatgaaagtgtatggaatgtggatggagagatttttcaggcacaccaactctcagctcaagtgtttagaggccttgtatgcatgtttgcatctggtcctgaagtttaa

SEQ ID NO: 116334 - DNA, 774 bp, Glycine max
  Peptide Sequence Number=SeqID_233112
atgcccaaaaacaaagaatgcaaggagttcatcaaattggtcaaggattgctcacaatctaacattactgacaagtcgattatggggaacctatcaaaaatggctaatttggcagcaaagttgaattccactaggatgcaagcatggagattgaagaaaatgaagaacaactcaattcatctcatgatccatgatgaagctagtaccagtaagagcaagccgagtaaaaaggacaaggacaaatcccatataaaggtacctaataatacttggtggcttgattctagagcaactacgcatgtgtcacatattatgcaaggatttctttcaatccaaaccataaaaggaattaaagagtttctctacataggaaatagaatgagggcaagaatagagggcattgggacttacaaattaatcttggacattaggtgtcatgtagatttggaaggatgtctctatgtacctagatgtttcaggaatttagtttatgttgcaaagttggatgaattaggttttagtttcaagattggaaacaatactcgtggtgaattttcttcacctaaagtccctcatcaagatgttgttccttttgttatattacattcaatcaacacccagagacaacataatattgaaaacccagaggatgatgaaccagcagacaatgtgcaattcataaatgaacaagtgattgaagagaaacaacaaataacaccaagaacaaaaaggcctgaaaggcaaagaaggtcagctatttgtgtattcgcttga

SEQ ID NO: 116335 - DNA, 1533 bp, Glycine max
  Peptide Sequence Number=SeqID_233113
atggcagttgggttggctataacaagtgaaagtggacaaaacaatggaaagataaccctttatgttgtcctctcttgcatgatggctgccatgggaggtgttatctttggttatgacattggaataacaggtggggtgacctcaatggagccatttctgaagaagttcttccacaaagtgtaccttaagatgaaattagctgatgacaaagtcagcaactactgtgtatttgatagccaactattgacctctttcacatcctctctttatgttgctggtcttgttacttccttttttgcttcttatatcaccaaagccttcggtcgcaagccatccatcgtagtcggaggtgctgcatttcttgccggaacaggactaggaggtgcagcttttaatgtgtacatgctgatagttggtagacttttgcttggagttggggttggttttgcaaatcaggcagttcctctgtatctttctgaaatggcactaccacgactaagaggggcaattaacaatggcttccaattaagcattggcattggtgctttgtctgctaatctaataaactacggaacagaaaagattgaaggaggttggggttggcgcatgtccctagccatggcagcagttccagcctcagtcctaacactaggtgcacttttcctccccgaaactcccaacagcgtaatccaacgcagccatgacaaacaaaaggccaagctaatgcttcagcgaatccgaggcatggaagacgtgcaagcagaacttgatgaccttataaaagcaagttctccttcaaaaaccaacaacaaacaatctcttaagctcattttgaaaggaagatataggccacagcttgtgatggcattagcaataccatttttccagcaagtgacagggatcaatgtcattgccttctatgcccctttactttttaggacaattgggttaggagaaagtgcatcgctgttgtcagctgtgatgacaggagtggtaggtactggctcaacattcatatcaatgttcgtagtggataaacttggaaggagaaccttgtttatgattgggggcattcaaatgtttgtatcacagtgtatagttggaggcataatggcacttcatctcaaagatcatggtggattaagcaaagggtatgcttttgttgttttggttatgatatgcatatatgttgctgggtttggatggtcatgggggccactaggttggttagtaccaagtgagatttttcctttggagattagatcagcagggcaaagcatcacagtggcagtgagctttatcttcactttcattgttgctcagacttttctgtccatgctttgccacttcaggtctgggattttcttcttctttggaggttgggtggtggtgatgactacgtttgtgtactatttcctgccagagaccaaaagtgtgccacttgaacagatggagaaagtgtggcaagagcattggttttggaagagaatagtgggtgaagtgagtgatagacagcataaaggtgagatatga

SEQ ID NO: 116336 - DNA, 1104 bp, Glycine max
  Peptide Sequence Number=SeqID_233114
atggacgaaagtgagcgagagggagatgaattcaaaacacaaagagagttttgcggtacgatgcggtgtagagggagttttgccaaggtggtggtggggcatgaaactgtgaaatcggaacagtacccattggttgtgagcacgtggccctttatcgaggctgttagggctgcatggagggctgttgatgctggctcttcagctgtggattctgtggttgaaggatgctcagcttgtgaggaactcagatgtgatgggacagttggtccgggtggaagtccagatgagaatggagaaactacaattgatgctctgataatggatggggtgacaatggaagtaggagctgttgcagccatgagatatgtaaaggatggaattaaagctgccaggttagtgatgcaacatactgaacacactttgctggtaggagagaaagcatcagaatttgctatttcaatgggtcttccaggtcccacgaacttgagttcaccagaatctatggagaagtgggccaaatggaaagatagtcgctgccaaccaaatttcaggaaaaatgtatcacctgcaaatagttgtggtccttatcgtccaacaaattatctggggcatcctgatgaaacatgctccagtactgttcagatgctaactagtaattccaatttacttcgtgtcggtcttcatagccatgatactatatcaatggctgttattgatagaatgggacacattgctgttggcacatcaactaatggagcaacattcaagattcctggcagagtaggagatggtcccattgctggatcctcagcatatgccattgatgaagttggtgcatgttgtgcaactggggatggtgacatcatgatgcgcttccttccatgctatcaagttgtggagagtatgaggttgggaatggaacccaaacttgctgctaaagatgcaataacacgaatagcaagaaaatttccagattttttgggagccattgttgccctcaataaaaagggggaacatgctggtgcctgccatggttggacatttaaatactcagtcaagagccctgcaatgaaagatgtggaagtttttactgtgctaccttga

SEQ ID NO: 116337 - DNA, 312 bp, Glycine max
  Peptide Sequence Number=SeqID_233115
atgtatatgttgagagctgcaccaccaagagctgctccaatgaggaatgcagcaccacctatgaggattgatggttttcggccaaaggctcttgagctggctatcaaatttgcagtagttgctaaccttggtgtcttgcttcatcttggtgtacacatctgggaaaaatttctccaaaaatggcaccatagatgttactccacctgcaattcttgcaaattagtgaagttgatcaaagtatacaatatcagtgatcaaactgaaggagaaaacttgcaaacatatgtaaatgcatatcttttaattaagtaa

SEQ ID NO: 116338 - DNA, 960 bp, Glycine max
  Peptide Sequence Number=SeqID_233116
atggttaggactagaggcctaggtcgtgccttaggtagggttagtggcagaggtctggggagagaggaccgtgatgattctgacgatgctccccagcggcgaaggccgaccgcatccgcacacaggcaacgggtacctgtcactattgcggatgctgagctagtggtacttgtggttgaggctgacgtagctgcgattgaggctgacgtagctgcaactgaggctgacatagctacggctgaggctgaagtagttgtagatgagtcgatggtagaagctgacgtacatgacattggtgcagacattgctgcaaacgccagtgcacaggctgctgcagatgagcctgagggatttctgggtggatcgaccgacccatccgtgctgaccgagtatgctgaggatgttgcagccaacgagtgtcttgagttgaagttatccttccacgggaggaaggtgcataatttaggtaggcttgtccctgccattgagggactagttgctgggacaagactaagtcctttgatcgcgtgttcagtagacaacgacgatcggggacttctatcctcgtttgtcgagtggtggaactgggagacttcaagtttccatcttcttgtgggggaggtcatgatcacgctggacgatgtttcatctcttcttcatctgcccgtcgttggcgacttgcacacctttcagcctctgcacgtggacgaggcgagacagccagggctgagaccgaacactgtcgtggaccgtacgtatgcctgtcttggctacgcaatatgtatcagcacagatgtcaggctgtacattagacagctgcagctcgtgcgtatcttctccatcttttgggttgcactcatttttgcaaacaagagtgtaacccatgttcatgttgtgttcttggacgcactgtgtgacctcagtcagactgggaggtatgcatggggagttgttgccctg

SEQ ID NO: 116339 - DNA, 168 bp, Glycine max
  Peptide Sequence Number=SeqID_233117
atgaaaaaggaatctccaatacccaacgtgctatcaatgcctaatattgctcaattaacaagtggggaaagacctaggattgccaaatgtggcgtcaacatcacggaacaaagaatgatgtgtttagttagtaagaaagatacatcaggaaataagataattcaataa

SEQ ID NO: 116340 - DNA, 363 bp, Glycine max
  Peptide Sequence Number=SeqID_233118
atggagagatttcttccatcagattttggggtggaagaggatagagtaaacccttttcctccgttccaagctgttcttgataagaaaagaaaaattagaagggaaattgaagcagctaagatcccatccttaccccctctacacaatattccagtttccattcttcatagtgtatttgttaaaggggacctcgtgaactttgagctaggagaaaacgaccttgaagcttcacagctatatcctgattataactacacatctattgatcaacttcttgatatattccttgagttaactaaatgtttcagtacagttatagtccaatctagcagcagcaatggcatctgcattagacatagttaa

SEQ ID NO: 116341 - DNA, 306 bp, Glycine max
  Peptide Sequence Number=SeqID_233119
atggaatcttctgctgcttgtcccttacatgtaatccttgagatggttaggcctcttagtgatccttatgggtctgtcagtaggggaagtgatgaggacacaactaagggtaaggactatgaaacacttgaagggcccatgaccaaaggtagacttaaaaaggctcaacccggtgatgaggacacaactaagggcaaggaccatgaagcacttgaagggcctatgactagaggtagacttaaacaggtccaacacgtcatagagacaaggctggtcatttgtataactgccattgataatgattga

SEQ ID NO: 116342 - DNA, 1050 bp, Glycine max
  Peptide Sequence Number=SeqID_233120
atgaatttgcaagagatcgaagagagtactaaagaaaatatggagaggaagaataggattcttgtatttgggggaactggttacattgggaagtatttggtgagggcaagtgtctctttaggccatccaactttggtatacactcgccctcttaatgcacaaactcctccctctaaggcacaagtttgcaaggagtttaactccataggggtcacacttgtccatatgatatatgttgttgaagctaggtttcattttcctaatgagtttgaattgaaagtgcagggtgaacttgagcatgagcagatcttggctgtgattaaacaagtagacattgtgatatgcgctctggcatcccctcaagtgatggagcaactcaaaattatagatgctatcaaagttgctggtaatataaagaggttcattccatcaggatttggcgcggaagaagattcagtaaaacctcttcctccattccaagctgttcttgataagaaaagaaaaattagaagggaaattgaagcagctgggatcccttacacttctatatctgcaaattgttttggtgcatactttgtcaattatttacttcacccatatgaaaatgtgaaggatattactgtctatggcaacggggaagcaaaagctgtgctaaattacgaagaagacattgctatgtatactgttaaagcggcaaatgatccaagaacatgcaaccgcgtcgttatttatcggccacagaagaatatcatatcacagaatgagttgacatcattgtgggagcaaaaatgtggtcagacttttcacaaggctttcatttcggaagaagaaattgtcaagctatcacaatccttaccctctccacacaatattccagtttccatccttcatagtatatttgttaaaggggacctcgtgaggttcgagatagaggaagatgaccttgaagcttcacagctatatcctgattataattacacatccattgaccaacttcttgatatatttcttgttgatcctccaccccctgcatctgctgctttcgaataa

SEQ ID NO: 116343 - DNA, 138 bp, Glycine max
  Peptide Sequence Number=SeqID_233121
atgatcaaggaatccaaggacttggcatctatgttgatggaagctctcttcggaaaatttcttgaatatgaacatgggttgattcgacaatctcatgtggaagatacaaaaaagaaaaggaaagggatttcactcaag

SEQ ID NO: 116344 - DNA, 303 bp, Glycine max
  Peptide Sequence Number=SeqID_233122
atgtctcctccacctctagaaacctcacaatctctcaaaatctcatctaaagctccgcaagatggcttcctcttcaagctcagctctctcttagtctctccacagctaaaaactctcaaaaaaaacttaactccttcagaaatcccagaaggtgaagatgatgcgcttagcgagttggctttcgctcagtgcctctatacagctcatccttcttccagaattgttcatgcgcttagccatcagatggggcgcttagtggatgatgcacttagccagaagatgagcggcttagcgagttcatga

SEQ ID NO: 116345 - DNA, 2046 bp, Glycine max
  Peptide Sequence Number=SeqID_233123
atggagaagctccatttattttcttctcctgcctcttatttccttgaggcatataggccagtgaggaagggtgatatgttccttgtgagaggggggatgagaagtgtggagttcaaggttattgaaactgatcctgctgagtactgtgttgttgctcctgacactgagatcttctgtgagggagagcctgttaaaagggaagatgagaatcgattagatgaggttggttatgatgatgttggtggtgttagaaagcagatggcgcagattcgggaactggtggaactgccattgaggcatccacaattgttcaaatctattggtgttaagccaccaaaaggaattcttctatatggaccacctgggtctggtaagactttaattgctcgggctgttgcaaatgaaactggtgccttctttttctgcattaatggccctgagatcatgtcaaaattggctggtgagagtgaaagcaatctgaggaaggcatttgaggaagctgagaagaatgcaccctctattatcttcattgatgagatagattcaatagctccaaagcgtgaaaagactcatggggaggttgagaggagaattgtttcccaactcttgaccctcatggatgggcttaaatcccgtgcacatgtaattgttattggagccacgaatcgtcccaatagcattgaccctgctcttaggaggtttggaagatttgatcgggagattgatattggtgtaccagatgaagttgggcgtctagaggttcttcgtatccatacaaaaaatatgaagcttgctgaagatgttgatttagaaaggattgctaaggatactcatggatatgttggtgctgatttggctgctttgtgtactgaagctgctcttcagtgcatcagagagaaaatggatgtcattgacttggaagatgagaccattgatgctgagatactgaactcaatggcagtgacaaatgagcatttccagactgctcttgggacaagcaatccttctgctctccgagaaacagttgttgaagtgcctaatgtcagttgggaagacattggtggtcttgaaaatgtgaagagagaactccaagagactgttcaatatccagtggaacacccggaaaaatttgagaagtttggaatgtcaccttccaagggggttcttttctatggtccccctggttgtggtaaaacccttttggcaaaagctattgccaatgaatgtcaggcaaatttcatcagtgtcaaaggtcctgagctactcacaatgtggtttggagaaagtgaggcaaatgtgagggagatttttgacaaagctcgtggttctgctccatgtgtccttttctttgatgaactcgactctattgcaactcagagaggcagcagtgtaggagatgctggtggtgctgctgacagggtgttgaaccaattgcttacagagatggatggcatgtcagcaaagaaaactgtgttcatcattggggccactaatcgaccagacattatagatcctgcacttctgcgaccaggtcgtctggaccaattgatttatatcccacttccagatgaggattcccgccatcagatatttaaagcttgcttgagaaaatctcccgtttcaaaagatgttgaccttagagctcttgccaagtatactcaaggcttcagtggtgcagatattactgaaatttgccaacgtgcatgcaagtatgctataagagagaacattgagaaggacattgagagagaaaggaggaaaagagaaaaccctgaggccatggaagaggatattgaagaggaagaggtagctgaaatcaaagcagctcattttgaagaatcaatgaagtatgcacgaaggagtgtaagtgatgctgacattcgcaagtaccaggcttttgcacaaacattgcagcagtcgagagggtttggatctgacttcacttttgcaaataccagctctgttggtgctgctgctggtgccggggctgcatccgacccttttgcaagtgctggtggagccgatgaagatgatctttacagttag

SEQ ID NO: 116346 - DNA, 291 bp, Glycine max
  Peptide Sequence Number=SeqID_233124
atgacaggtaatgagctaagctcaagctttgtgtattcaactcaaggcgagctcaagcctagtaaagcttggcttggcttgactcattttcacccctacatgtggagatctcttctttttagttggttgtttgggtatggaggatattgtgtgcgaagtgttaaaggaggtcccagtgtatggatgagtgggtcaaactacctagcgggttgtggtcgagctttgcatgatcacggtggctgcagatctaaaattgttaatgaaggtagaagtgtttcatggaggaggtag

SEQ ID NO: 116347 - DNA, 327 bp, Glycine max
  Peptide Sequence Number=SeqID_233125
atgggtttaggttttgttgtcggattcctcgggcttctgattctatttcacgccgcatattctaccatccaatacaagggtttgttgaagattacggaggaagagttttcagggcctcctttgaatgtggtgattgaggtgactctagggttagttttttgcatgtgggctgcactaaccgtgccaggaaagtttttgtcaatccaccctcactctgaagagaacaggtttgattctagtgaatgtgaatttgagcttgtggttgatttgattgtgctaatgttactgttatgttgcttgggtgagaggactgaaagcctgaaatag

SEQ ID NO: 116348 - DNA, 2008 bp, Glycine max
  Peptide Sequence Number=SeqID_233126
tgctgtggaaaatatgatcagaaggtttggtaaagcagttcccatgattgtacaatgtttcattctagtcctttctctgaagttcatctccgttaattgtttagctcacccattagaccctctctcccctgctgaaatcaacaaaacaagggacatagttcaaggttcttaccttggtgccattcctaacattacctatcattttgtggatgcggaagaaccagacaaaaaacgtgtcctagagtggctatcttcaaattcaaaagaagacaagcctattattcctcgccaagccaaggtagttgttcgagccaaaggtgagacacacgagcttgtagtggacttaaccaaaaaatccattgtatcggataaaatctacactggtcatggataccctcctttcacattcaatgagctttttcaagccagcaaattgcctctcacctaccccatattcaaatcatcaatagccaaaagggggttgaatttgtctgaagtttcttgtgtaccatttaccctaggttggtatggagaaaaaatcacaagtagagccctcaaagtgtcatgcttttatagaggaggatcagttaatgtgtgggcaaggcctattgagggaatcacagtgctagttgatgttgattcaatgcagattactatgtacaacgacaggtacattgctcctttgcctaaagctgaaggcacagattttcaatcttcaagcagcaacagcaacagcaggcccaaaacatcatcatctgcttcatgtaatgtgacagatattattgggttcaccatcaagggcaatgaggtcaaatgggctaattgggtttttcatgttgggttcaatgctcgggcaggaatgatcatatcaactgcttctatatttgatgccaaaagacagaaatacagaagtgtgctatataggggtcatgtgtctgagacttttgttccttacatggatcctacagaggagtggtatttcaggactttcatggatgctggtgaatttggctttggacgtgcagccgataccttgcaaccgagggttgattgcccgagcaatgcagtgtatatggatggttacatggcagggcctaatggagaggtgcaacaggttcccagggctatttgcatttttgagaggaattctggcaatgtggcttggaggcacatggaaatcaacaacccccaaaaattggtaaggaatggagaaccagaaattactttggtggtcagaatggttgctactgtgggtaactatgattatgttcttgattgggaattcctaagaagtggcagtataaaagttggggtggatctgacaggtataatggagatgaaagcagtaccctatacagagaaaagtgagataaaagaaagggtgtttggaacattggtggcagaaaacacaatagccaactatcatgatcaccacataacctactatcttgaccttgacattgatgacaatagcaactccttcatcaatgctaagttgcaaagggcaagagcaactgggtttggaacaccaaggaagagttactggacagtagttagggaaattgcaaagagggaagccgaggggagaattcggctcggcttagagccagctgagctgttaatagtcaaccccaacaaaaggacaaagctagggaatgaagtgggttaccggctcatcagtgcacagccaattacttctcttttgtctgatgatgattaccctcaaagaagagcatcttacacaaagtatcagttgtgggtcacttcctataaccggtcagagagatgggctggagggttctatgctgataggagccgtggtgatgatgggttagccgtttggagccagaggaatagagagattgaaaatacagacatagttctatggcacacaattgggatccatcacgttccttatcaagaagattttgcagcaatgccagcaattcatggtggatttgagctgaggccagctaactttttcgaaagtagtccattgcttgaataa

SEQ ID NO: 116349 - DNA, 189 bp, Glycine max
  Peptide Sequence Number=SeqID_233127
atgtcactccagatttgggtaggggttgagagaggctgcaaaaggctagctgatgccaacgtctgtgaaaaactgttgcaactatttcgaatgtgcgaaacatccccacatgacttcccatggcatggcagtagtgtggattcttgctggtatcctagaagatttctagggcttgttatgatagaatag

SEQ ID NO: 116350 - DNA, 213 bp, Glycine max
  Peptide Sequence Number=SeqID_233128
atggaaaagtatttcggaaacgcttatcgtggcgacccgggagtgccccattcggacccggatcgcttcgtcaacatatgggtcggatccgctgccttcgctgttctcacatatttcaatccctacatgtggcagctctctaatcagttcaagtaccaactctctttcccctcttttcaattgattcaaacttcgataatagacgcagcataa

SEQ ID NO: 116351 - DNA, 1527 bp, Glycine max
  Peptide Sequence Number=SeqID_233129
atggggaggctaataagaacttctaaacctcttatcttccactcaaagctcctctgtttttctctgttctatctcttcaccactctgttccttgctctctacacctctctgtcccaatccaaatgtttcttccgatcgtccccttcggatcccgttcagaattctctcttctcttacccttcttcctatggggagcacaagtacgctgtgtcaaccacccgttctacatgttcttcccctgttttcttttcagattactcggatgttgtgaaggagatcaagaattgccgcaataacaatgtaggctattcaggggctctgcggtatatgcaagggaatttggatagttttggggggaatctcaacaccctttcgaggttttcttattttgatcaccaaaatgatagcacggaagttccatgcggatttctgaagaaatttccaattagtgattccgatcgaattgcgatggagaagtgtgacagtgtggttgtggtttcagcaatcttcaatgatcatgataaaattcgtcaaccgaagggccttgggtccaatacattgcaagaagtgtgtttttttatgtttgtagatgatgttaccctcaaaggtcttgaacatcatggattggtttcaataaattcaagagaatacaagataggtgtatggaggattgtgaaggttgcaaaagagaatttgtatcagaacccagcaatgaatggggttataccaaagtatttagtccataggttattcccacattcccacttcagcatttggatagacgcaaagttgcaactaatggttgatccgttattgttgattcattctcttgttatatctaaaaatgtagacatggctatatcaaaacacccttattatgttcataccatggaagaagcaatggcaactgcaagatggaagaaattgttggatgtcaacgccttgaaggaacaaatggagacatactgtgaaaatggattgcaaccatggagtcccaacaaacaaccctatgtgtcagttacaatctgggagagcgtgacggcatttattagtttaaggaatgtgagaacttttgcaccgccattgaccataaatataatatggtacgtaagccttgcaatgtctttagtggtgaaggcttgtgactacaaggtttcttccatatgggatgtaccagatagtgctttgatattaaggaggcatggacttggcagtaacctcttctcctgcctcatattcaatgagttgcaggcatttaacccaagagaccaattgccttttgcatttgttagagatcacatgaagcccaacctgaagctgaacatgtttgaggtagaagtttttgaacaggtggcagtggagtacagacacaatctcaagagcagtgatgggaccactgtgaagaaagtgttcagttcaggaagaaccaaaagggcacaccctgatttgttgtatgtgaatggaagttgttgcagcaagtgccaaaagtatctttctataatgtggggggaatcatcaaatgattaa

SEQ ID NO: 116352 - DNA, 477 bp, Glycine max
  Peptide Sequence Number=SeqID_233130
atggccaccgcaaaaatagagcaccaccgcgaggaagctgagatctacgagggcgaagcggtgtgcacgcaaaagtcacgtctcctcttggacgagattctcctcccaagaggcttgctcccgctggagaacatcgtggagatgggttacaaccgcaccacggggttcgtgtggctgaagcagaggcacaagaaggagcaccgcttcgccaccatcggacgcaccgtctcgtacgcaacggaggtgacggcgttcgtggaggagcaccgcatgcggagggtgacgggtgtcaagaccaaagagctcttcatatgggtcagcatctccgagatcttcgtggatgaccctgcttccggtaagataacgttcgccaactcctctgggattgcaaggtcttttcctctctcagcattctctctccaagaggaacatcaacaacaacagcaagaacatgatcatgcagaaacattagcttga

SEQ ID NO: 116353 - DNA, 741 bp, Glycine max
  Peptide Sequence Number=SeqID_233131
atgaaaaaatttatcaattctaactatggaaaaatatcgtgtaccatccttgccgccggcggtctttctcttttgatttatgtgttaaagagatggcccaaaccaaagcccaagcctgagactgagcccacgctcgggcccaagtccgagccccagtccatgcccaagcttgggcccaagtctgtatccatttttcttagagaacttcatggtggctatcgagcatggaatagattggagacagaaacatacaaagaagctcaaatatcatcagctccagacagcgcaggtgcccttcaacaggaacttcagaaagaacttcctgatttaatgattcttcagcaaaatgtagaggatttggaaaacagtgaaaaggaaggtgtagcagagaatatacttgcacaggcgctaaaaaaggccagtgataaaccacatgaagcctacgagattgaaatgttgctcgtagaagtgctaatctacaagggaggaaaacaagatttagaaactgccctgaaatgtaaatgcttgaaagatgaatcgcttaaagatgcacgacgcccactgttcaaggcaattatataccaaatgctggggagcataaaagaagctaaacaacattgggatgaattcatcgtagtacgagacccagctttccgtcgtgaaatcgattttgatcattttaaacgtcacgtggatcgacttctacaagctaatgctaggcaaaaccatgaaaattcatga

SEQ ID NO: 116354 - DNA, 786 bp, Glycine max
  Peptide Sequence Number=SeqID_233132
atggtggttaattctgttcactctcctggcgcaaacacagatcaaaattcaaattgcaaattcgtttcttcttcatcgcatgttccccgttggctccaagttctcctcacggagaagttctacaacgtttgcataattcacgaagaggcaaagaagaacgagaagaacgtttattgcttggattgttgcattagcctctgccctcactgtttgtccccccaccgctctcatagactcttgcagattagaagatatgtgtatcacgatgttataaggttggatgatgctgcaaagttaattgactgcaattccgttcaatcctacacaaccaacagcgcaaaagtggtatttttaaaccaaaggccacagacaaggaacttcagaggctccggcaatttctgcagcacctgtgacagaagcctgcaagacccataccacttctgctccctctcttgcaagataaattatctcgtcagaacaacggactctctctgcggctacctcttcgagtgcaactacctgccgctactggaatctgggctcgacgatggtctaatgatgactcctgattcggttctcgaaccgtctggttcaggggggtacggaggggtggattgtaggaccaccttggcttgcactgccaccaccgagattgtgaggaagaagaggaccggcggtgccgctttccggcttccgttccggccggcgtgctcgccggtctcggaaatctcggcgtgtctcatgaaccggaggaaagggaacccccagcgggccccactccattga

SEQ ID NO: 116355 - DNA, 648 bp, Glycine max
  Peptide Sequence Number=SeqID_233133
atggggaagaaaacagagctgaaagatcacaaggagacaaccaaagttgaagctgttcttgagcttctcagaaaacaaacacctctcactgttaaacaggagaagttttgcaactatgcttgtgtgaaacggttcctgaaagcaaaaggggataatgtgaaaaaagctgcgaagcaactcaaggcttgtcttgcttggagagagagtgtcatcactgatcacttgatagcagatgatttctcagctgaactggctgatgggttggcctatgtgagtggtcatgatgacgaatccagacctgttatgatttttcgtttgaagcaagactatcaaaagttgcattcccataagatgttcactcgtttgctggcctttacactggaggtggccatttcgaccatgccaaaaaacgtagaacaattcgtgatactttttgacgcaaggcctgaggggcacacagaaagtgtccggagtgccccagaggagtctccaattaatggccatattagagagggcttttacagatcagcatctgctttcatgaacctattgctaccagcactgaaaattgtggccgagtactacccaggaaggctatgcaaagcgtttgtcatagaccctccctcgcttttcgcttacttgtggaag

SEQ ID NO: 116356 - DNA, 1839 bp, Glycine max
  Peptide Sequence Number=SeqID_233134
atgggggatggccacacgactgaaaccagtggtatgtgtaaagaaatcaaaatagagacagaggcaggaaggttcacacttgatgctgtcttgttcgatttggaagatattgatgttattttgggtatgtcttggctaaaaactctaggggtaatgacagtagattggaatacgcagataatgaagtttgaaacagaactgggaacgaaaaccttgagaggagtaaatcaagaggagtctttgtttgccactttgtgtgggggattacctcctgttcgtgtgaaggagcatacaattaagctgaaacagggacatgatccaatcaacgtaaggccatatagatattcttaccatcaaaagaacgagatagaaaaacaagtgaaagagttgttggagattggtcatataaggccaagtcaaagtgaatattcaagtccggtaattctagttaaaaagaaaaacaacaagtggaggatgtgtgtggattatagagctctcaacaaggccacggttccggataaattcccaatcccagtgattgaagaactactagatgagtttcatggttccacctatttctccaagacacatgagggacattatgagtatctagttatgcgctttgggctaatgaatgcgccctctacctttcactctctcatgaatgagcaattgaaatgtgtcttggaagttctgaggaagcaacaactttatgccaacaaggagaagtgtaattttgggcaaagaagcatagagtacctaggacatgtcatttcaaagcaaggggtagaggtggacccaaacaaagtgaaaagcgtgctggattggccagttcccactaatgtcaagggagctcaaaaggcttttgaggaactaaagaataagattacttcagtccctgtcctaaccttgcccaattttgaacaagaatttgagcttgaatgtgatgcatccggtttaggaattggggccattttgatgcaaagcaggaaaccagtggcgtactttagcaaggctttaagtagcagaaatgtcactaaatctgctcatgaaagagagttaatggcagtggcattggctatacaacattggtgtccctacttacttggaaggaaattcactgtctattccgatcaaaagagtttgaagcaacttctccagcaaagaattaccacggggagccagcaaaattggctagctaagttgttggggtataatttcgagattgtatacaaaccgggtttagaaaacaagggggcggatgcattatcaagaagcatgggggagatggagcttaattccttagcatacataccggttattgaagacttgaagcaagatcaaggaaagcatggtgtgttattcttcaaagacagattagtagttgctgaaacctcaagctggattcctaagttaatggaagagtttcatgctactccccaaggaggacactccgggttttatcgtacttataggcgtcttgcttcgaatctgttttggaaaggaatgaagggagatattatgaggtttgtgcaggactgtgatgtttgtcaacgccagaaatacttaacaacagcccctagaggtttattacaacctttaccaataccgaatcaagtatgggaagatatatctttagattttatcacggggctcccgagatccaaagggtttgaggccattctagtcgtggtagacaggctatctaaatatagtcattttattccattaagacacccttacacagcacgagccatagctgaaatatttgtgaaagaggcgattaggtttcatggggtacccaattctgttgtgagtgatcgtgatccgttgttatga

SEQ ID NO: 116357 - DNA, 726 bp, Glycine max
  Peptide Sequence Number=SeqID_233135
atgatgatggctcattctcattatcttcttcacattccatcgttatcatctttatctgcatctctcacttccccgcctcgctcgcttcttcctgttcggacattacaacctaagacgctgtcgtgtcgtgtcccttcatttccaacacgcaccccgtggcacttcaagcctcttcattttgctctctctggggcactctcacttgggttattattcggagtcgtagaattgaaactcaaagtctcaaactttgtaggaattggcgtggctgaggctgcaaaagttggtgtgaacaagccagagttgctccccaaggagtttagtactgtcattgatgttgctgggttcctatccgatggacaggagaaaagactagcagaagagattgctgctcttgaagcggatactggattcaagttaagagttttggcccagaactatcctgttacgccaggtttggctattaaagatttctggcaagtagatgacagaacagttgtttttgttgctgatcccacatttggcaatatattgaatttcaatgttggtgctacggttgatttggatgtcccacgtagcttttggaatcgcttggctgggaagtatgggaacattttctattggaaagaaaagggggaagatgcatctattgaagcagcagttatggcaatttctagttgcttgagagaaccagttgggcctaataattgttctgaggtgaattaa

SEQ ID NO: 116358 - DNA, 591 bp, Glycine max
  Peptide Sequence Number=SeqID_233136
ggaacgcattacaacattcggatccacgcggtccaaaatctcagtcaagtcccctttgaggaaccacagataccctgcgaagttgctccgaatggttcgaataaccgtgtgggcgtttcgaccgggtcgaaacgcgtgagatttaggggagaaccggggttcaaaaaccggttcgagaatcatcaagagaatctcctgaacgacgcggtcctggaagcagggcttgccggattggatagcggcgcggaatttgcgtttggagaggggcttggaaacggcggcgtcgttgggggcgcggaggagagggttggttttgtcgttccattcgaaacggttgcggatgacggcgttgcggagggagaggagggagtggaggacggtggcgtggacggcgttacggggagggaaggtgccggtggcgtgggcgcaggagcgttggtaagcgaggagccagaggtcgaagttggagaggaagccgggagtgagggtcttggttttggttcggtggttgcgaggaatgagttgaaaatggacgcgagaaggaagagagtgtgctgcgacggtactgaaagtgttcgacgattttcctga

SEQ ID NO: 116359 - DNA, 137 bp, Glycine max
  Peptide Sequence Number=SeqID_233137
cagatggtggtgggtacaattgtcattatgatatggtcattttaaaccctattcccactgggcactttttcaactattttctaccgagaactgagaaaagtcactgtttcttgtcttgtcatttagcacttagcatg

SEQ ID NO: 116360 - DNA, 694 bp, Glycine max
  Peptide Sequence Number=SeqID_233138
gagaagtgaaggtggaagtagttcaaagggaattgcaagatagggatgaagctttgagacaattgaaaaatctcttggcaagagcacaagagaggatgaagacacaagcggataagcatagaaaggagatgaattttgagataggtgacttggtgttcctcaaattgaagcaacataggcagcattctgtggctgcaagaatcagtccgaaattaagcgctagatactatgggcctttcgaggtgattgagaggattggggaagtagcttataagttgaaattgcctacaacacatgaagattacaaagttgaaagcacactgcctagtggattggaggatgaccgtgaaggagaaattgaaccagaactggggaaaagcgtagatgaagcaacttgggaagacgaattgacattgaagagccagtttccagaattgagtcttgaggacaagactttacttcaaggagagagtgttgataggaaccaaattcgcaatgggcctttggagcctttagttcatgagatgcagaaaggcccaagggaatgtagacagtttgtaacaggagagagtgggcagttggctacaggagagagtgggagagaggcgagccctggtgcagcggtaaagttgtgccttggtgacttgttggtcatgggttcgaatccggaaacagcctctttgcatatgcaagg

SEQ ID NO: 116361 - DNA, 213 bp, Glycine max
  Peptide Sequence Number=SeqID_233139
atgtgcttgactaggttcatgtttttcggccttgacaacaaggtaccagagttccagacccaagatattggtactaagttaagccatgaaccaggccccagaaaaattaaaaaagaaaaaggatatgaaggagtgaaggaattccatttcgagaagttgctccatcatggtcagaatgtgaaatctgggaggaggcattcatcacaagtatga

SEQ ID NO: 116362 - DNA, 438 bp, Glycine max
  Peptide Sequence Number=SeqID_233140
atggtgaagaggaaaacactatgctactgtgtgattagaaaatatggttctcacaacagcaacgaattcattatcatacgtcaagatggagattttgctcaaagagagttgcaaccattattacatggtaaaatatgccaactatgtggagatgacataggggttaatgaagacggtgacctctttgtggcctgcaacgagtgtgcctttcctgtttgtaaaagctgttatgagtatgaacgtagggagggaaaccaggtctgccctcaatgcaaaacaagattcaagcgtctcaaagggtgtgctagagttgagggggatgaagaggaggatattgatgatgatttggagaatgaattcgattttgatgatggacaaagtaaactacatgatatgaaaacgtccatgtctcatgaggtaatgctaaattctaagtga

SEQ ID NO: 116363 - DNA, 423 bp, Glycine max
  Peptide Sequence Number=SeqID_233141
atggcacacagaaaaaggcgtttagatcaactcaagcatccattcagtcctcacccctttgaagcagttgcatttggctcatggcaagccgtggagttcataaaaattgagggaggaactatgtccatgcattttgtagataatcatcatatggttatggagaaaggacccttgtcagatatacggataaggtcaaggaatgctactttatcagattgctcccgttttctacgtcctggaattgatgtatgtgtgctatctgcccctcaacaatctgatgatgcagatgcaattaatatcgaccctaatatagtgaatggtagtatatggcagaagatggaaattccaccatataaacatgccattgtggcttatggtgccaccatagtaggccttccttcacaaattgtctatggcagaggg

SEQ ID NO: 116364 - DNA, 219 bp, Glycine max
  Peptide Sequence Number=SeqID_233142
atggatccttccaaggacctagctgcttatggctatggtagtattgcgtggaaggaaaagatgaagatatggaagcaaagacaaatgaaaattagtgatatgaaaaaagaaaatgacaatgaagatccagataacactgtagaagatgatgacactgaattccttatccataacacattccatagccacatagttaagtcccttaaacatgttgattag

SEQ ID NO: 116365 - DNA, 3693 bp, Glycine max
  Peptide Sequence Number=SeqID_233143
gtttgggctgatgccaaaataagctctgtacagagaaaacctcatgactctgagtgctcgtgtcagttttatgtcaacttttatgttcatcaaggttcactcggtgcagagctaagaactctcagtagggagatcaaagtggttggaatcaatcaaatatccatcctccaaaaacttgaaagtactccttgtgaaaatcagcactaccggtgggcatcatctgaggactgttccattatatcacacactaaattgcttctgggaaaagtgttatgtgatctttcatggttagttgttaccacagctttaaagaaggtttcaatctgcgtaagatctctacaagacaagctagtgtatcaagttttgggaagggatactgttagcacttcattgaacaatgaatctcacattgatgttgtgaatttcaaaacagacaaaggcatgttagtacccattgtttctcaagtagctacacttaaaaccaagagggttgatcctgaacaggaatcccatgaagataaagaatcaccatcttacaatgtcgaaggcttaaggcgttccaaacgtcggaatgtacaacctgagcgttaccttggttgtgaaaaagtttcccagattgatgttggttcttttagaaacttaccaccagttaagatagacacttggaaagataatgatattgatcatgaaatgtatataccattagccggcctgtttcgttggcaaaagaagtgtctagaaggggatactgacaatcatcaaaaggtcaagaaggtgagtacatgccgggagcttgtggtgtacaaaaggaagaagactaaatcccagaaagtgaggtcaggaggtgatgatcagaatgaacatcaaaatcatctggctattattcctcttcctgctcaacatgatccggtagaagttatacattgtgatgatctatatgacaaggttactagaagttatggtaatgaatcctctgaaatttcttccaagtatcatcatctaactggtaccacttcaaagaagaacgatgttaaattgttaacttttgagtctcattatcatgctgcaaagtcagatgatggagaaaagagtgatgatttgtcatggagatatcattatagttatggcgcccctaagtcacagaggaagggtttaagtgatctggatgatatggtgaatcttggaaataaatgggaagggattagttccagtaaagtagttaaagggaaaaaacaccgtacaacatattttggaagtagagatcatggagaagaaaaaagatacaattataaagacagatccttaaatgcagctgcctacaaggatttgataaattcatacttgaagaatattaatactagaccaaccaatgaagaaccagctattgctgaccagtggaagcaaacggaaacaccaagcagcattgggcaaaagacagaaactgaggtgctccgcaaagaggaggcggaagaagaatctgaaatggatatgctgtggagagaactggaagtgtcattggcatcatgctatctagaagaagacacagaagctaattctgttcaactatttaatcaggattcaaatgctgctgttttcactgagactctggaaaatccgaatgcaggttgtcctcatgatttcagaatgaatgaagaaattggaatttactgctatagatgtggctttgtgagcacggagatcaaatatattacacctccctttttggtcatatgttcgaatcctgaaacagttgctttgcatatgcatgggattcaacattcagtgtggcaccaagaggagaagcagatccctgaagaagattcaaagaccaaggctaatgaagacgatgacattgatctcttgccagctctagactctcctgagaaacctgtgtctcaagaaaatgataacgtttgggtgttaattcccgaacttaaagcaaagttgcacgcccaccagaagaaagcatttgagtttctttggcaaaacattgcagggtccatggacccgggattgatggaagcagcatccaaaagaagaggtggctgtgtggtatctcatactcctggagcgggaaaaacttttctcatcattgcttttcttgttagctacttgaagttattcccagggaagaggccattagtccttgctccaaagacaacactctatacttggtacaaggaatttatcaagtgggatattcctataccagtgtatctgattcatggtcgtagaacctaccgtgtattcaagcagaaatcctcgattgttattcctggagttcctaagcccactgatgatgtcaagcatgttttggattgccttgagaagatacaaaaatggcattcgcacccgagtgttctgatcatgggttatacttcatttttaacattgatgcgagaggattcaaagtttgcacataggaaatacatggctaaggtattgagggaaagccctggggtcatggtgctggatgaagggcacaatcctagaagcaccaaatctaggctgagaaaagttttgatgaaagtgcagacagaactgagaatactgctttctggcacattgtttcagaacaatttctgcgagtacttcaacactttgtgcttggcaaggccaaagtttattcatgaagtactgaaagcattggacccgaaatacaagaggaaaggaaaagtggcaaaaaaagcgagtcatttattagagtcgcgagctagaaaattcttcttagaccaaattgctaagaaaattgactcaagtaatggtagggagaggcggaagggtctaaagatgttgagaaatgtgacaaatggtttcattgatgtgtatgaaggtgggagttctgatggtctacctggtttgcaaatttatacattgctgatgaattcaactgatacacagcacgagattttgcatgaactgcacaagaaaatggccaaagtcaatggataccctctggagctagaacttttgataactctaggttcaatacatccttggttggtgaaatcagcagtatgtgctgagaaatttttcactcaagcgcaattgatggagctagagaaatgcaagtttgatctgagaatagggtccaaagtaaaatttgttttgagtcttatctacagggttgtcaagaaggagaaggttcttatattttgccacaacattgcacctgttaagttatttgtggaatattttgagaagtactttggatggacaaaaggtagggaagtgttggtgctaactggggaactagagctgtttgaaagggggagagtgatggacaagtttgaggagcctggtggagtagcaaagatactacttgcttcaatcactgcttgtgctgaaggcattagtttaacagctgcttcaagagtgatcatgttggactcagagtggaacccttcaaaaacaaagcaagccattgcccgtgcctttcgccccggtcagcagaaagttgtttatgtttatcagctcttggtgacaggttcattggaggaagataagtacaaaagaaccacttggaaagagtgggtttcaagcatgatcttcagtgaggcctttgtggaggacccttctcagtggcaagctgagaagattgaagatgatatactcagggaaatggttgcggaggaccggtctaaatcattccatatgatcatgaagaatgaaaaagcttctaccaacaaataa

SEQ ID NO: 116366 - DNA, 972 bp, Glycine max
  Peptide Sequence Number=SeqID_233144
atgtcgccattctttgttactttcagggacgcggttatcatatttcagttgatggagaccaagtatcagatgctacttggtgcaatatttcttcccaaggtgttcagcttgaaggaagcatcatatagtggagggggaaatattacattcaaaggatctcttgaaaaggatacttacttgaagaggagaatctttcaaggagagttcactttaagcgagctgcctatccacttcttttattctgtgaaatctgatagcaattcttctttgggacttgtacttgagttcacttctaccatcaacaaagcaatgtctatactactcacttcccatggaatggatcatctgtcaagcggatttagcaaagtagtcccaacaagtgaacacaagggaaatgcccctggatgggttatacatgaaggtacaattgaaatgaatggttacattctcactggcattcatgctttgtgctataggccaaatgcccctttcaaagaactgaaatccagaccatttggtcccgattatactgtgccttcctcaactgattattctgcagttcttggtcatatcacagtcaagacttctaactacaagccagattttccagtttctacttcctggctagttgatggtgaatacatcaattggaaatctggtcctcaggattcaaggatcctcagtgttaaaatttcttgggagctgaaagaaggaaagaattttgcatttccacactacaatgtgtatgtggagaaaataccaaagctagcaggtggtaattcaggcactacaatagaacatgtgcaggagtatcttggagtagcacatgtaaactgtttctatgtttctgagctcaaagttcctgctagcatttctaatctcaaatttattatacaagtctgcagttttgatgggacaaatcagaatttagaagactgtccatattatcaattggagataaaaggtctctaa

SEQ ID NO: 116367 - DNA, 204 bp, Glycine max
  Peptide Sequence Number=SeqID_233145
atggtggtggtttcccaccacgagctctacgttctcctgcacctcttcctaggtggtgtcattgcgacagatgaagacagagtcatcattgccgctgaaggcaacatcattgtcagggaggatcttgttgacatcccaggtttcacactcccagaggacctttcaggaaactgcattgtgcaccccgttaagatcacgccctag

SEQ ID NO: 116368 - DNA, 576 bp, Glycine max
  Peptide Sequence Number=SeqID_233146
atgcattcttcagtgactggatcgctagtgatatggtatgacagtgtcaccattaacggtgatctatggtggcaaaatgaactaaatgaatataataagtctttctttgatatatgtgatgggatatttacaaattattcatggcaggaagactatccatggcgatctgcttctgttgctggtgatcgaaagtttgatgtgtacatggggattgacgtatttggaaggggcacatatggtggtggacagtggaatacaaatgttgctcttgatgtaataagaaaagctgacgtctctgctgcaatatttgctcctggatgggtctacgagactaagcaagcaccagattttaagactgctcagaatcgttggtggggtctcgtggaaaaatcttggggtatagtgcgaaagtatcatggaacactaccattctacacaaattttgatcagggacacggttatcatatctcagttgatggagaccaagtatcagatgctacttggtgcaatatttcttctcaaagcattcagtggccattgtacaagaggaacttgcacacaattttcactacatga

SEQ ID NO: 116369 - DNA, 1500 bp, Glycine max
  Peptide Sequence Number=SeqID_233147
atgagttcccttttcatcaaagaaactgaaattctagtacttgaattgccaattgatgaattggttggttggttgttgaagggaacagaagagcacacagtgatttcagtggtagggatgggaggacttggaaaaaccactcttgccaagcacgttttttattctgaaattgtaaaaagtcactttcattgtcgtgcttgcatcaaagtttctcaatcatacactatgagagggttattgatagacatgataaagcaattttgtagggagacaaatgaccgtcttccacagatgttgcaagaaatggatgagaagtcactgatttctaaagtgaggcaatacttgaagcaaaaaaggtatttgatattctttgatgatgtatggcatgaagatttttgtgaccaagttgaatttgctatgcctaataacaacaaaagtagcaggatcatagtcaccactagagtgaggcatgttgctgagtttttcaagaaatcctttcttgttcatgttcacaacctacaaccgttgcttcccgacaaagcatgggaactcttttgcaagaaggcatttagatttgagccagatgggcatttcccaggagagcttgaaggtatatcaaatgaaatttttagaaagtgcaaggggttacctatggagatagtggccattggtgatctattgccaacaaaatccaaaacggcaaaagaggactactccattcatcataacaggttaactagacaatggatagctgaaagggaagttagaagttgtcaagtccatgatttattacatgaagtgattatagcaaaagcaaaggacttaaacttatgccattttgtgcatggacgggatgaatcaggcacaagtagaataactagacgcctatctattgacactagttccaacaatgtgcctaagagttctaacaacacacacattcgtgctattcatgcatttggaaaaggaggactgcttgagccttttatgatgggtcaattatcttcaaagtctaggttgaaagtacttgaacttgaaggtacatcgttaaactatgctcctagtaatttagggaatctttttcacttaaggtacctaaatctaaggagtactaaaatacgggttcttcctacatctgttgataagttgcagaacttagagaccttggatataagagacacgtttgttcatgagttgctaagtgaaataaacaagctcaaaaagttacgacatctttttgcgttctatcgaaactatcaagcagggttttctgttttgggatttacaactggtgtgctaatgaaaaaaggtattaaaaacttgacttccctagaaaatcttactcatgtggaggtagatcatgggggaataaatagatctcatccaagagatgagcatgttaaagcagttaaggaagttaggcttgaggtgtgttcggagggaacatggaaatgcaatatgtgcttcagtggtagagatgacacacctggaatcacttaa

SEQ ID NO: 116370 - DNA, 198 bp, Glycine max
  Peptide Sequence Number=SeqID_233148
atgagtcatctcaagaaggtatcttcgggcatcaaagccttggagaaccttaaagttcttgacttcattagtatgccaactgaatttgttgagagcattgttccggaaaacggaccagattatcagatcatcaatcatgttcccctagtattcgttcgtcattggattggcccaaaagttttgggagatgctcattga

SEQ ID NO: 116371 - DNA, 210 bp, Glycine max
  Peptide Sequence Number=SeqID_233149
atgtggggagtgatattaaccgggaaaaacatcctattggaacttacaagctcaattgttttggtgctgtctcatgaattttctgaccttggtctaggtacactgtgcgtttgtttggggattaggaggaacgaggagtatgaattgctcaggaggaacttcagcgacatcggctgcttgggatttggcattcaggagcacattgattag

SEQ ID NO: 116372 - DNA, 195 bp, Glycine max
  Peptide Sequence Number=SeqID_233150
atggtagaaactagcaagacagaaggggatcccagcggccacggcttttgtgtctcgggagatgtttgctttgaagaggcggttaaggtggcatcagccattacccctgttcctggaggcgtgggaccggttacaatatcaatgctcctctccaacacccttgattctgtgaaacgtgcttttggaatggtttga

SEQ ID NO: 116373 - DNA, 1080 bp, Glycine max
  Peptide Sequence Number=SeqID_233151
atgaagtcaaaacaaatccaatctcaaaactcggaagaacaagatacctggaatttgttgttgaaaactcaaagcatcaaaacaagtactgagacggacatcatacacaatacacgaacacgttgtgccactgatggggtggtggcatggcacagaacactgagaaaagcattgcattccttttctgctccaacttcttgtattttggccccaacctccctgatgtttgggttcccagagagcacacaccccctcacaccctttttccagaaagtctccaatataaagcttgaagtggctgatgagataagaaggatgaagagtggcattgggaagtttcctagactggctgtggttttggtgggtgataggagggactctcacactttcattcacattaagttgaaggcctgtgatcaagttggcattgaaacagtggcttcccagttgcctgaaaactgtgatgaaagtgaactgcttgatgttgtttccggtttcaatgaggacccggatgtgcatggcattcttgtgcaacttcctctgcctcaattttgtgaggtggatgttgatactaatgccttagttattctaacatatttgatgcagcatttggacgaggaaaaaattatcaatgtagtgagtcttgaaaaggatgtggatggctttcatcccttaaatattggaaatcttgcaataagaggaagaaagcccttctttgttccttgtgctcccaagggctgcattgagttgttacctaggcacggtgtggaaatcaaggggaaaagagcagtgataattggaagaagtaaaattgtggggttacccacttccttgctattgcagaggcaccatgcaacagtcagcgtgttacacgcgtatatgaagaacccagaacatataacttctgaagcagatattgtggtagtagatgttggagtccccaacatagtttgtggcaattggataaagaaaggagctgtggtgattgacatgggaacaaatcaagttaaggtgtgctataatgaggtactagaaatttttatcttgttatttcaagaacttggtgctctttccaaatga

SEQ ID NO: 116374 - DNA, 2014 bp, Glycine max
  Peptide Sequence Number=SeqID_233152
atggccaaagctgaaggtggcaaggaaccagtaaatgaacaagcagtagcaaatatgtatgctgcaatgaggtctgagctcaaccaaatttactccaaaataactgaactggagatggaagttagtgagcacacattggttaccaatgccattcaaccacttgaccaatctagacgatgctatcgaatgattggaggggtgcttgtggagagaaccatcaaagaggtcttgcctgctgtgcagcgaaataaagaaggactcgaagaggttgtggcaaggcttaacgaggcgttggaaaagaagaaaaaggaaatttctgagtttgaggctaaatataaaatcaggataaggaaggctgatgctgaggtgaaggatgaatctggtaggaaggaagggtctgctcaaggggttcttgtgggtcctgcagatccgttgcagggcgatttcccagaagtgatagaggagtatttggaacatggctgtatgaaatgcattgccttcaatcgccgtggcacccttcttgctgctggatgcaatgacggaagttgtgttatttgggattttgaaacccgaggcattgctaaaattctgcgtgatgatgaatgttcttctcccataaccagcatttgctggtcaaagtatggtcatcgaattcttgtatctgctgctgataaatcattgatattgtgggatgttatgagtggtaagaaaataacgcggatagttctgcaacaaacccctctacaagctcgtcttcatccaggatcctcgaccccgtctctctgcttagcatgtcctctttcatgtgctccaatgattgttgacctgaatacaggagacacaactttacttaaagtttctgtctcagagacatgcaatggaccaacccctccttcacgtaataaatgttctgatggaattacctccttcacaccaactgctgcttgttttaataagtatgggactctggtttatgtgggaaactcaaaaggggaaattcttgtcattgattacaaaaatggtgacgtgcatgctgtagttccaatctctggtggttctgttataaagaacattgtgttcagcaggaatgggcagtatctgctcacgaattcaaatgatcgaataatacgaatctatgaaaaccttctgcctctgaaagatgaagtcagagcccttgatgacctgagtgggaaccacaacgatctaaataatattgagaatttaaaggctgttggatcaaaatgtttaactttattccgggaatttcaagattccatcacaaaggtacactggaaagcaccttgtttcagtggtgatggtgagtgggtagttggtggttctgctagcaaaggtgagcacaagatttacatatgggatagagctggacatcttgtgaaaatccttgaaggacctaaggaagctctgatagatttagcatggcatcctgtgcatcctattgttgtatctgtttcgctgaatggtttagtttatatatgggcaaaagattatactgagaactggagtgcatttgctcctgatttcaaggagcttgaggaaaatgaggaatatgtagagcgtgaagatgaatttgatctgattcctgagactgagaaggttaaaggacccgatgttgatgaagatgaggaagttgacattgtaaccgtggagaaagatgccactttcagtgattctgatatgtctcaagaagagttatgttacttgccatcaacccctagtcgtgatgttcctgagcagcaagagaaatgtgtagaaagttcttcaaagttgttggacagcaataacactggatcccctctttcagaagaagctggaccaaatggacatatgatgaatcatgcatcaagtcctcttgaagatgatgctgggcgcatgaaaagaaagcggaaaccttcagagaaggtgttggaattacaagcagaaaaagttaagaaaccctcaaaatctagcaaatcggaaaaacctaagagcaaatctttggccgatcaagataatg

SEQ ID NO: 116375 - DNA, 789 bp, Glycine max
  Peptide Sequence Number=SeqID_233153
atggccggcggcaaccatcccaagtcttcccatcacaacaaacctcccccctccgcctcccaccgcaaatctcgctgggaacccaattcctcctccgccaattccccagccgatcccaaatcaaaatcatctaccgccccttcccccaaacccaaatctaacacaaaccctaaccctagccccaaacacctccccttccccttcccggaccccgcccctctgggccctccccctcctcccgcctacggcttccacatgcttgaacgccgcaccatcgtcctcgccgacggtagcgttcgctcctacttcgccctccctcctgattaccaagacttcgccccccgccctctcgacctccctccccgcttctgcctccccgactactcatacaccgccgccgccgccaagcgaaaatacggtgatgatgacggcggtcccagggatgacctcgccaggcagagggagcagcttctccgtaacgccaatggcatttccagggagcagttctctgcgggccccagtgacttgaggccctccaagcactccaggctcgatgggttgtcgaattctacgagacactcgcaggtggatcaggacgcgttgaagaaatccttttgtaacttttcgaagctcattaacgagaatgtctcgcagaagaggacttgcttggaagatggcaagcaggggcgccttcattgtcttgcttgtggcactggcagtttatttatctataaccttaaaagcaaggtagtagttgaatggctcgagggtgttgtgcggttttggtag

SEQ ID NO: 116376 - DNA, 2112 bp, Glycine max
  Peptide Sequence Number=SeqID_233154
atggtgctgcatttgttgtggcagagtgctgtgagtatgtggaagtcgatcccacgggaagatatggaagactatagagcatttgatgagtatgaagggatagaaaatcctgaagatcttgagaggttatacagtgaaattcatcttctcaagacattgaaacacaagaacatcatgaagttctatacttcctgggttgatactaccaacagacacattaactttgtcactgagatgtttacctctgggactctaagacagtacagacttaaacacaaacgggtgaacatcagagctgttaagcattggtgcaggcagattttggaagggcttctgtatctgcacagccatgatcctcctgtgatccatagagatctcaagtgtgacaacattttcatcaatggcaaccaaggggaagtcaaaattggtgatcttggccttgctgcaattctccgcaaatctaatgctgctcgctgtgttggcacacctgagtttatggctccagaagtgtatgaagaggattacaatgagttggttgacatatactcttttggaatgtgcatcttagagatggtcacttttgaatatccttatagtgaatgcaaccatcctgctcaaatttacaagaaagttgtatctgggaagaagcccgaagctctttacaaagtagacaataccgaggttaggcagtttgtagagaaatgcttagcaactgtgtccctcagactttcagctagggaactcttggatgacccttttctccaaatttatgattatggatttgactcaaaagttgtgcagtatcatagagattgctatgaagtaaacccattaattagacaacctttgaatggaatttacagcattaacaacaacttaatgagtggggacactgataatgttggtggttatggacctgtatctaaattggattatcatcgagacgattttgaagcaagtgaaattggtctctttggttgtgaagaggatgacaatttggccgaagttgacaccacaatcaaaggtagaagagaagatgatggcatctttttgagactcagaatagcagataaggaaggtcgaattagaaacatctacttcccatttgacattgagactgataccgcactgagtgttgcaaatgaaatggtagctgagcttgatataaatgaccaagatgtaacaaatttagcaaatatgatagacaatgaaattgcaacattggttccagagtggaaaacaggacccataatagaggaaaaatcagaatgttcaagtgcaagtgtctgcctcaattgtgctgcaaacggttacttgtttgattatgtattatcaaataatccatgtggcaagaaccttcaatttcttcattgttctaaaactggatgtgctgcagttcatggccgattcgaagagataacataccaagttgaagggtctaaaaatagtgctagagaaggtgcattagatgcatcaagccaatccaatgacattcaatatacagatatctgggctcagagagatgaaccagagttatgccatgaagagttaaaagacatacactgtgaccaagctcatgaggcatcaaactcatcaaacatcaaggaggatggaaaaactattaatgtggatgaacaaagtgatctcaataccagaaagccttcttcaaaccctgcaccaaattgtgttttcttggactatgaaaatgaaattaggcaagaactaagatggctcaaagcaaagtaccagatgcagctaagggagcttagagaccaacaacttgggggtaaaccaaaatttactagcatatctcctgacaccgataaattggagcatttgaaagatggaattctgaggctatcagatgcatccaacttgaagatacaaaacaataaaccactattgaaaactatagtttctgggaagcattttcatattgaatcggagaaatgcaacagtttggctgatcaaatggttcaaaatgttgatgagattcgtcggtctaacagtcctgagcaaatgatcacagtcaaggatttctttacaggagtattgcttccacactcacttcagagggcaacctcacttcctgttgatgcagtagatgtctag

SEQ ID NO: 116377 - DNA, 330 bp, Glycine max
  Peptide Sequence Number=SeqID_233155
atgatgctaattaggtcttttgttgggaagatagaaaagggtgtttcacactttgttcacagaaggcccccattgaatgatcacttcaacgaagccacaagtgtgctgccagatgatgttatggaaggatattttgctgtacttgcaataaaggatggagaatccaaaaggttcattgttggcttacattacttgaacgatcctgctttcattgaattgctagatcaagctcaggaggagtttggtttcagacaacaaggaactcttattgttccttgtcagccacaagaattacaaaagattttagatggtcggagttggagagcatag

SEQ ID NO: 116378 - DNA, 462 bp, Glycine max
  Peptide Sequence Number=SeqID_233156
atgggttggcaacttgcttcacacgggctgttcgatgtacgcataaaggctacaggtgacatacatattgatgatcatcacacgaatgaagacgttgcccttgctattggaaccgctttgctgcatgctcttggcgataggaagggtattaaccggtttggtaacttctctgctccactggatgaagcattaatccatgtttcactggatttgtctggccgaccacatctaagttataatttggacatacccactcagagggttgggacatatgatactcagttggtggagcatttcttccaatccctggtgaacacgtctggtatgacacttcacattcagcagttaatgttttatattccaattttgaaaacttttaacagaatatatattgaagcaaccttcaaagcttttgctcgggctattcgacaagcaacagggtatgatccacgtcacctttga

SEQ ID NO: 116379 - DNA, 267 bp, Glycine max
  Peptide Sequence Number=SeqID_233157
atgaacatatttgttacaagctttttcgacaaacccttgcttccatggttatctctccttttgttcttccttctcaaggatcaccaccaacccaaccaccgaccaccaccggcaccgccagttgcgccgccaccaatcactgctcacgtcattgtcagcctccaccaccatttcctccaactctcaaacctcacttctctccaaagtctctttctcacacttggccctcaaactaactcactttctttggggataggaaaagggtaa

SEQ ID NO: 116380 - DNA, 318 bp, Glycine max
  Peptide Sequence Number=SeqID_233158
atgcttaggtcttttgttgggaagatagaaaagggtgtttcacactttgtacacagaaggcctccactgaactacttgagtgaagccacaacaagtgtggtgccagatgatgttagggaaggatattttgctgtacttgcaataaagggtggagaatccaaaaggttcgttgttggattgcattacttgaatgatcctgctttcatggtactgttggatcaagctcaggaagagtttggtttcaggcaaaagggagctcttgcaatcccttgtcagcctcaagaattacagaagattctagatggctggaaagcatag

SEQ ID NO: 116381 - DNA, 411 bp, Glycine max
  Peptide Sequence Number=SeqID_233159
ataactcagtcgcaggagatgagtcatagagagtttaccttggaggactattccagctcctcatcaccacagtacttcaccagtattgttcagccagaggtacaagcgaccaacatctcatatccccattttcttatacagctaatacaaggtaacctattccaaggattgccaaatgaagatccttgcgcccacttggccacttacatagaaatatgtaatacagtcaagatagatggtgttctggaaggtgttatttgcctcaacctattcttcttttcccttgccaacaaatctaagagatggcttcactcatttaaaggaaatagcctgagaacttgggaagaggttgtggagaaaatcttgaagaaatactttccagaatccaagacagcacatggcaaggcttag

SEQ ID NO: 116382 - DNA, 1941 bp, Glycine max
  Peptide Sequence Number=SeqID_233160
gcttaaagcatgctcttgagcaggtagataatggaaagggacttaaacaagattttgaactggaaatgaatgagaaaagaactaaagtgacttttgacctgggggaaaatgaagcatgtgaaagagatcaaggtaaagagatacttagtgagatttgtggtgggtatagaaaaggaaacagactaaaagatgtgggtgatgacatgggggttcagaaagttttgaaacaagctccagatctactaaaaaattgtggaaatgaggctcaaaggatgaaagaaattgagagcccatccggccaagcatttgacagggacgcagttgtgtatatatcatgtgaggatggtctctccaagcaatgtcagaggatgctcaaagatgctaacaagaatggaaaacataagggattggacaaagctttggaacaaatggaaggtaacggagaagggataaacatgaattttgcaaaagaaaccaatgagacatggaaaacagagatggatgactccattcatgaagaaaatattcgaaaaccggaggtatgtcaaggccctattgctgaccaagaaattggaaagacagaaactgactgcaaagttggtgaaaagaaattggaaaaggtgtgtgtggaaaatccaagggataacaggggaaaaggagcttctgaaatgtcccaaggagaagcagagcattcaggaaaggtggcttgcactgcaacaaatttcaatggtgatgagcatagttttagttgtgaacagacatgcactgagaaaactaagactgcccctcaaatggaatttgatgttcaaagtggagagaggaaaattggtgagagagaaaatactaaacagcatgtgaatgttgcactaaaccccgaagaaagcagggaccaaatgccatcaagccaaggtgattacagaaggaacactgtagctgatgaacctgctgcagtgcaagaagtggggaatatccagaaaccttctcaaagggctcatgtatcacattccaccagaagcaaagagaaaaatcttaatgaaacttctgcctcagtagagaaagatgttgagaggataagaagagatagagagttggagaaagatcgtctcagaaagatagaagaggagatggagagagaaagggaaagacagaaagacagaatggctgttgacagtgcaatgctagaggctgagagggaaagggaaagagaaaaagataggatggcggttgataaagcaactttggaggctcgtgatagaacatatgctgatgctcgtgagagagcagaaagggctgcatttgagagagcaactgcagaagctcgacaaagagcgctggccgaggccagagaaagacttgaaaaggcatgcgctgaggccagggacaaaacatatgctgataaggcagctgcagaagccagattgaaagcagagcaaactgctgtagaaagagcaactacagaggctcgagagcgtgcaatggacaaagttaaggttgatagagctgcatttgagtccagagatcgattagtaagatctgtctctgacaaatttagtgtttctttcagatatggtgggagacagggctcttcatcctcagatatgctggatccacattgtcagaactctagctctttcacgcattccagatatccatattcctcagtttatggtgcttcctcttttactgaaagatcagaacgagaaggtgaatcagctcagaggtgtagagctagactggagaggtatcgccgaacagctgagcgtgcagcaaaagctttggaagaaaagaacatgcgtgaccttgtagcccagaaggagcaagctgagagaaattgtgatactctgcagagattagcagaaaccctggatactgaagtcaggaggtggtcaagtggaaaagaaggaaatttgcgtgcattactttcaaccttgcaatatgtag

SEQ ID NO: 116383 - DNA, 2245 bp, Glycine max
  Peptide Sequence Number=SeqID_233161
atggaaagcgtggcgcattctcggcaaccaccacacaagaaaatcaccaccggcgccggcggtttcccagcggaaactctatacgaccacgtctacggcggtgcggcgaagttctccggcggcggccaccaccactccctctccccgcgcttcgaggactacggggaaattttcgcgagcttccacgcgccacgcgcctccgccattccggtgttggatcttccggcgctcgacgctgccggcgaggttttcttcgacttccgaaacgccgcctgcgactactccgaaatcttccgcggcttcgacggcctcaacttttggctctcctacgaggacttgtttcgcggcagcgtttccgaagaagacgatgaagaagaagaagaagcctggtcaccagtggaaactgattcattttctggagactttgaccattttggaattaacgaagggatgccaaatggagatcatttgcggccttttgatggaagtacagagttcaacgtttcgtatcataaggttgatggttcaagcaatgaagatatgtcaaaggggaaaactcatataagtcagctgcgcgctgatcctgaattcactcatgtattcgacgaaatcatgcactttcataagactgatccttccttacaggttgttgatgatgttgaccttgatatggaatttaatgcaagccaggcaaagagaaaccatctgagacaaacggactcatatccgggtaattttgattctggtgaacaggttcttggtagtgatctagatctgcacgatggatgcaacagaaatggttctcattccagtgagacattcgtaactgtgtctgacatcagcctcagaactctaccctctcaagtgccaccgccttctcgcccaccacctgcactggatgcaaaactggggcacaccagtggattttgttcaaacaatgagtgggttgattctgaagagactctaggtgacacttcgccaccattccttgatgtggaggttgatacaaattcatctactgctgctatcaaagaagtcatgcatagacctgaagcaaaacataggagtgctgaagaagtgaaggagagaaagaaggggtttttagaaagcaatgtaaattcaagttatgatgtaaaaaatagtgaagcaaagatgagtatgaatataagtatatttaatagtttgaatgatgagggaatgcagacaacttgtgatcagagaattggcaaaaagaaagtttctgctacagatgaaaggcagaaaactaggaaggctaccccagaaactgtggaattgttagaaggggaaagacttcaaaacatgtttgaggaaatgcacatcaaggaatccagagcatctcaagaatcagatagaagtaccggagttgggatgtggaaagaagcaactgaattttttgaactggtgggaacagtagaatctggaacagtaattcagcccataaaccatagtaatactaagagtttggtacaagataccagaacacatgagtgtggcaagaaagagcgagaaacatttaacattaaagaagaatacagaaatgttaaagaagttgtagaaggttatcagctggaggaaagcaagaagaaatcgaaagcaggaaatggggcttgtgaacagggaaaaaacattaggaaatctaaatcatctaacgaggaatgcaggcagagagagcatgtgaagaatgaggaaatggccgaaatctttgagcttgaaaagagtgagaaagcaagaatggtccacttgcatggaaaaactgaaaagaaagtacctaaggctgaccaatcaggaagcttaaaagatgtgtctgagaaacaatgcaaggagcataaacgagtagagagcgaggaatcaaaagagattgataggcaaaagctaagtgaagttcagtggagcacgaagcatatggaacatgagaaaaaactaaaagaggatgaacagaaacaactgagtatgaaaaggctcaagcagtctcagaaaatggaagagaatggaaaatttcacatagaagcttttgctcttggagctgcagagaatgagcaaggggtgaaaggttctttgaagccagaaatatttgaaagatcagacgagacctttaatctggatagctacaaggacaatttgacttgcaaaagcgaaaatgagattgtccttgaagctaaacagattcagaacaagaaggaattgaaagaagcgtgtaaaaatgaagttgagaaaagcctcaaag

SEQ ID NO: 116384 - DNA, 225 bp, Glycine max
  Peptide Sequence Number=SeqID_233162
atggtggctaaaagaatagaagattttgaaatgttactgaagggctcgctcagcaaggcagattggctaagcgaggcttatctgcttagcgagaaagtcagctcgctaagcaagtacaaaaccctagagaatgttaagtcagagagcagcacacttagtgcacaaccagcccacccagtgaggatgttgtctcttcttgcgcttagcgcatccaagctcgcttag

SEQ ID NO: 116385 - DNA, 549 bp, Glycine max
  Peptide Sequence Number=SeqID_233163
atgatgctctggtctttctttggaaaggtacatgacggtcttgcggtagtgtttgcaccgattaagagatcgctgacaccgatcagcaatgacgattcagcgagagaggttccgggtgacgttttggaagggcactttgtggttcttgctaacaagggtgaagaaagaaaaaggtttattgtggagttgcactatttggatgaccctgcatttttgggactgctggagcgggcaagagaagagtatggtttcagacagaagggggttttggtcattccctgctaccctcaagaactagagaagattctagatcatgaaagtactgttggaggagatggaggcaaattaacggattcagttcaagatattagtgaatgtagcgccatttcatgcaagatcacatgggaaactgcagcagcaacagcaacagcggtggcagaagatgtaagtaagctacggaataatcggactttccacaaaggaatgctctttgcactcccttacaagcctcaaggtctgcagaagttcagagaagagaaagaagcatag

SEQ ID NO: 116386 - DNA, 264 bp, Glycine max
  Peptide Sequence Number=SeqID_233164
atgcttaggaattttgttgggaggatacaaaagggtctttcactgtttgtagctagaaggccagatgcattcagctacttcagtgaagatcgcaccgcaacggcggcacaagatgatgtcagggaagactatttgcatgatcctgcattcttgggacttttggacaaagctcaagaagagtatggtttcaggcaaaagggagctcttgcactcccttgtcgccctcaagagttacagaagattctagatggtcccaaagcatag

SEQ ID NO: 116387 - DNA, 1152 bp, Glycine max
  Peptide Sequence Number=SeqID_233165
atgtctctcagtctctggcatgattatggaaagcaatcaggtggtgatacatttgtgatagagggattcacaaattggaataagaaagaaagactttcatctcatgttggaggtcctaatagtgctcataacattgcttggaggaagtgtcaagatttaatgaatcaaaatcaacatattgaagttgttatatctaagcaatctaaacaagttcgtgacttgtatcgaaggcgtttgacagcgtcaattgattgtattcgttttctattaaagcaaggatttgctttccgtggtcatgatgaatcaaccaattctgctaaccaaggtaatttcctggaacttcttagatttcttgttgaacacaatgaatcaataaatcatgttgtgttggaaaatgctcccgaaaatcatcaattaattgttccaaaaatccaaaaagatattgttaatgctgctgcattagaaaccactaatgctattattattgatcttggagatgaattatttgctatcattgttgatgaagcacgtgacatatcaaacaaggagcaaatggctattgttttgcgttatgttaacaaaaagggaagtattgttgagcgtttttttggtatggttcatgttaaagatactacagctttatcattgaaaatggctattgatgaattgttttgtaaacatgggcttagtatatcaagaattcgtggacaaggttatgatggtgctagcaacatgcaaggggaattttctggtcttaaaagtttaatcttaaaggagaattcatatgctttttatgtacattgttttgcttatcaattacaactcacattagttgttgttgcaaaaaatcacattcaagttgcctctctttttaattttgtgtccactttattaaatgttgttgggggatcttgcaaacgacatgacatgcttcgtgaaaaacaaataaattatgttagagaggcattaggaaaaggagaaattcctagtggacaaggtttgaatcaagaaactagtcttaaacgagctattgatactcgttggggttcacattatgcaactttgatcaatttgatattgatgtattcttctataattgatgttcttgaaattataaaagaagatggatcaaatgcagatcaaagagcttaa

SEQ ID NO: 116388 - DNA, 324 bp, Glycine max
  Peptide Sequence Number=SeqID_233166
atggagcacggtggatggaaatcatcgctgttgcagtggagcatgatgactggaactctccggtgcggcgacagtgataaatgtttagggactcgggttggcaccaagtgtgttgttttggctaataaaggacctatcatggaggatggagttgaggaggatgaagacaacgaagatgaagagtatgatgatgatgactacgagagtgaatacatgaaaaaaaagaaacaagctgccaatggcactgtgaataaacatgacaaagctgtagaaagttcttgctttgataccatgataaatctcatgtttgtcatgaatgaatga

SEQ ID NO: 116389 - DNA, 261 bp, Glycine max
  Peptide Sequence Number=SeqID_233167
atgatgtctttggagaagattggtttgattgcgttgagccatggatgggaacacgaggacacgcgttgcactcgtagtcaacaagagtggcgggtgtgctggggttctggtgggaatttcgacagtggaggtgatgttggtgtggatttggaactgctacatggagagggaggtataggagaggtaagaggtgattggatgaagggttgtgggatatatgggtcgttgtctgaaggtggggatgatgtggagttgggctga

SEQ ID NO: 116390 - DNA, 624 bp, Glycine max
  Peptide Sequence Number=SeqID_233168
atgactttagcgttgtatagtaatcagagaccgatcgggagccttgtcggataccgtaaatctcctcttagagttctgctatgcggagtagatcactttgggaaaatcgttcttgaagcgttcccacgacagataaatgggatcagtggtagctgggacatagcgagaccaagagtggtagtttctgccaatcaaagctggggtgatggaaacagaggatgggttgtcactaggatgaatataataagggctagatgggtcaagacaaggattatagggtggcgtgacaacatcaggattgcttgtgtgggaagttttgagatgcttagatctttatttgggaggatacaaaagggtctctcagtgtttgtaccaagaaggctttcattcaactacttcagtgaagatcatgtcgcaaccgcggcgccagatgatgttatggaaggatattttgctgttcttgcaatcaagggtgaggaaaccaaaaggttcattgttgggttagactacttgaatgatcctgcattcttgggactatggaccaagctcaagaagagtatggttccaaacaacaaggaactcttgcactcccttgtctccctcaagagttacagaagattctag

SEQ ID NO: 116391 - DNA, 225 bp, Glycine max
  Peptide Sequence Number=SeqID_233169
atggaaccacttaccttgaagaagatgacccaccaagaagacaaaacgaaaggaccactggaaagaggaagaaatagtgtcggggctaacatgaagatgaaagaagaagaagcggtgtcggggctaatacagagacgaaaaaagaagaagcggtgtcaggctaagaggaagaagaaacgctgtcgggaggaagacgaaagaagaagcgttgcgggagagaaatga

SEQ ID NO: 116392 - DNA, 969 bp, Glycine max
  Peptide Sequence Number=SeqID_233170
atgaaatttgagattcaagctctggttcgtaatcagacatgggacattgttcagacgccgctgcatgtgagacctattggttgtaagtgggtgtataaaatcaagcgtggttcggatggtcaagatgagaacaattcgggtttttctggccatagcttccatttctcattggcacttgcacaacttgatgttagtaacgcttttctatatggggatctcaacgaggaggtgtatatgactatccctcagggtgtctctggatatcaaccatctcaatgttgcaaactgaagcggtctctttatggcttaaagcaggccagccaccaatggtttgccaagctatccagtctactacaacattatggtttcacgaaggctcatgctgatcacaaccttttcacaaaggtaacatgtcataccatcactgtcttgctcatttatgttgatgatattgttctagttggtaactcaattgctgaaattgataaagccaaacacctcttgagctctaattttcatatatcggatctgggcaaactaaaatatttcttagggattgaggttgctcattcctcctctggtatctctttgtgccaaagaaggagattggttggacatttgatatacctaactagtacccgtccgaacattgtttttgcaacccaacagctcagtcaattcatgattgctcctactcattttcaagctgccttgagagttgttcgttatttaaaggctactcctgggaagggattattcttccgaagaaataattctttccaattatctgattttagtgatgcagattgggccacctgtgttgacactcatcgatcagtcactggatattgtttcttcattgataataatttggtttcatggaaaacaaagaaacaatctacagtctctagatcatctgtagaggctgaatatagagccctcgcctcagtcacttgtgaattgcaatga

SEQ ID NO: 116393 - DNA, 126 bp, Glycine max
  Peptide Sequence Number=SeqID_233171
atggcttatgcagaggatatggtggtatgctttgaagatcaagaaacagggagatgcttgaaagagattccaactaaaatatttcaagatacaattgttgttgaggttgatgatcaactctactaa

SEQ ID NO: 116394 - DNA, 195 bp, Glycine max
  Peptide Sequence Number=SeqID_233172
atgggggtgcagaaaaatgctcctggaaataggagtgatgtaggatggaaagtgttatctcagttgatggggattcccaaaaaattaaatgcaaacaatgtagacggtaattattggtggtgtttattgattgaagcatcatttggccagaacacaaaaatgttgggtcttgcaaatctattagagataaagtga

SEQ ID NO: 116395 - DNA, 285 bp, Glycine max
  Peptide Sequence Number=SeqID_233173
atgcatccgcacataaccgagatacacaaggaagtgatccatgcctctggtcacgtcaggggcgacatcttactttctcaacataaaaaagcacaccaaccagctgccactggaactcccaaaactcagtgttcttacaacattttagtttggatgactcctgggagtacatcctcaccatggtataattgtgggctctcatcagttagctattcctcgcatatgtcgggaaggccaagtcgacactatggaaaacacgaccataaattcagcgccacactctaa

SEQ ID NO: 116396 - DNA, 1668 bp, Glycine max
  Peptide Sequence Number=SeqID_233174
atggacttagtaagagccactgaagcacatcttcactcttactcttccatgggtttgaggactcttgttatcggcatgagagacttgaatgcttcagaatttgagcaatggcatgcatcctttgaggcagcaagcactgctgtgtttggaagggctgcgatgctccgcaaggtttcgagcatcgtagagaacagtctcaccatattaggtgcatctgccattgaagataagctgcaacaaggtgtgccagaatccattgagtctctaaggattgcaggcattaaagtatgggttctgactggagacaaacaagaaactgccatatccattggctactcctcaaagctcctaacaagcaacatgactcagattataatcaatagcaagaacagagaatcatgcagaaaaagtttgcaagatgcccttgtcatgtcgacatctggcgttgccaacaatgctggagtaagttcccatgtgactccagtagccttgattatggatggtaccagccttgtgcatattcttgacagtgaacttgaagaacagctatttcaacttgcaagtaggtgttctgttgttctatgttgccgtgtcgctccgctgcaaaaggctggaattattgcccttgtgaagaatagaacatctgacatgacactagccattggagatggtgctaatgatgtctcaatgattcaaatggctgatgttggagttggcatcagtggacaagaaggccggcaagctgtaatggcatctgattttgcaatggggcagtttaggtttttagttcctctcttattgatacatggtcattggaactaccaacggcttggttacatgatactgtacaatttttacagaaatgctgtccttgttcttgtcctattttggtatgtgctcttcactgccttcactttgacaactgctataaatgaatggagctccacgttatactcaataatctacagttcattgccaactataattgttggtattctcgacaaggatcttggtaaaaggactctccttaagtatcctcaactttatggggcaggacagagacatgaggcctacaacaagaaattatttttgttaacaatgttagatactttgtggcaaagcatggttatcttctgggcacccctctttgcatattggagtagcacaattgatgtggcaagcattggagacctttggactttaggagttgttattttggttaatttacacttggccatggatgtcataaggtggtattgggtgacacatgttgtcatttgggggtccattgttgcaactttcattagtgtcatgatcattgattctatccccaatcttcctggctactgggccttctttgatgctgcaggaactggattgttctggttattgttgcttggaatcatagtaacagcattgcttccgcatttggttatttgtagagaagcagagaagattgggtatgacagggttgttgaaagtggacagtatatctgtttattaccggatttcattggttgctatccgaaggatagaggttttgttatcactgcagagcaagtactcaaaggttcaaatgactctagtgtatggagaaaatctgagtgtgagaggggaaactcatctttgagtacctttagatcccccgaaggagattggtctcggtaa

SEQ ID NO: 116397 - DNA, 192 bp, Glycine max
  Peptide Sequence Number=SeqID_233175
atggcggtagtgatccccgaaaggactttccagtctccatttcctcgatggtacaaccccaacacaacctgcgcttaccatgggggtgtcccgggtccagggtttaatcgacacaggttggctgatgttccaagaggaaatcctaaacgtaaagacaaaccctcttaccagtcatggggggccaacggttaa

SEQ ID NO: 116398 - DNA, 531 bp, Glycine max
  Peptide Sequence Number=SeqID_233176
atggcttctatgatggaagccatgctaagcatgaaaagactcatagaaaggggcacccgtgaagagcctcgggagcgggcccaaggtgactttgactcatatcccctatttaccgctgaggggctggcattcaaagttatgcctcaacccaacaccgcgggagcatctcaaccctgccctctgcaaccgttgcatttctccgtaggggggccaccttcgatagtggaaggaagagagaaacttgatctcatcgaagagagattaaaagctgtcaaagggtttggttattaccctttcgttgacatgacatatttatgtttggtaccggatgttgtcatccctccaaaattcaaggtaccagattttgatagatataaggggaccacttgccctaaaaatcacctgaagatgtattgccggaaaatgggggcgtactctagggacgagaggctattgatgcatttcttcaaagataatttggtcggagcagcggtcatctggtacaccaatttggaggcctctcgcgtctga

SEQ ID NO: 116399 - DNA, 1977 bp, Glycine max
  Peptide Sequence Number=SeqID_233177
atgggttctaataggccaattctaatgacagtaccatctccaacaacttctagtagtaataaccaacaacaacaagatcaccctctcacctctattgatcctgagcttccaaaatcaaactcaagttccatcaacccttttgagaacactttcaacaactcatcatcacgcagaagttctgctgggagcaggagcagcaacaactctatccatgaagtgattagtttgagccgttcagaatccaaaaccaaacctcttaagtactatggctcatcaaagggtggtggtggtgcagattctgaaggactcagcatgtcacaaagggaactaagagatgaggatgcaaggttagtgtacataaacgaccctttgaaaacaaatgaggcttttgagttttcaggaaactcaatccgcacaagcaaatactccctcctcactttcattccaaggaacctctttgaacagttccacagggttgcctatgtgtacttcctcataattgcaatcctcaaccagcttcctcagcttgcagtgtttggaagaacagtttccatcttgccactggcctttgtgctgtttgtcacagctgtgaaggatgtgtatgaggattggagaaggcaccagagtgataaaattgagaacaataggttggcatcagttattatggttgatgatgatggaggaggaggaggtggaggaggaagaagaagaagctttgtggagaaaaaatggagggatgttagagttggtgaggtgataaagatcgaggcaaatgaaaccatcccttgtgacattgtgttgctctcaactagtgatccaactggggttgcatatgtgcagactataaatcttgatggtgagtccaatttgaagacaaggtatgcaaagcaagagacacatggtaaggaaatgtttggtggggttatcaagtgtgagaaaccaaataggaacatttacggatttcttgctaacatggaagttgatggcaagaagttgtcacttggatcatcaaacattgtgcttagaggatgtgaactcaagaacactagttgggctattggtgtagctgtgtattgtgggagtgagaccaaggctatgctgaataactcaggagctccttcgaagagaagccggttggagacacgcatgaattcagagatcatttggttatctttcttccttgtgatgctgtgtacagtcacctcagcttgtgctgctgtgtggctgaagcgccacaaggaagagctgaatctgttgccatattataggaaacttgatttttcagaaggggatgtggatagctatgaatactatggatgggggttggaaattttcttcacatttctcatgtcagtcatagttttccaggtcatgattcccatttccttgtacatttccatggaacttgtgagggttggtcaggcctacttcatgatccaagacaagagaatgtatgatgaggcgacaaagtcaaggtttcagtgcagggctctgaacatcaatgaagatttggggcagattaagtatgttttctctgacaaaactggcactctcactcagaacaagatggagtttcaatgtgcaagcatctggggggttgattacagttctaaagagaacaatagcataatggagggggatgagcttgttgaacattatgtggaagcggatggaaagatcttcagaccaaagatgaaagtgaaagttaatccagagcttttgcagctatcaagaagtggacttcaaaatgtggagggaaaatggattcatgatttctttctgacactggcaacctgcaacaccattgtgcctcttgttgttgacacacctgaccctgatgtcaagctgatagattaccaaggagaatcaccagatgaacaagcactggcttatgctgctgctgcctatggttttatgctcatagaacgaacctctggccatttagtcattgatattcatggacaaagacaaaagtaa

SEQ ID NO: 116400 - DNA, 249 bp, Glycine max
  Peptide Sequence Number=SeqID_233178
atggtggaaagggagatgatcataatgatagtagacacgctatcagtgttctactacaaaaagttgatgggttacatgccttcgagctttgtagatttagtatttataggtgagaggattgaagtaggcctgaaaaaggggaagttcgactatgttggccctgccggtacaaacaacaaaatatttggggcaagtggggcaaagagaaaggaaggggaggcccaagccgtgactgtagctcctgcttag

SEQ ID NO: 116401 - DNA, 1284 bp, Glycine max
  Peptide Sequence Number=SeqID_233179
atggggcagactgatatttcattcaatggatgtacagattcaatggggcagactgagatttcattcagtggatgtacagattcagtagtagcaagggattctttgtcatcttttctttcctcagattcagaagcaatttctccttataatgggcctaattatgaccagtgtcagcaatttgaaacagttattagtgaacaattcacatgggaacctcagctggatgtggatgacaatttcttcagcagtttccaaatgtgcgacctagactcctctgcatatgaaactgggtttcccattattgatgagctaagttcatttgataacagtcaaagctgttataacctttctgatcttctatttcctgggatcaattttacaaacgatggcactgaggaaaatatggagtatcccactctcgaggagacaataggagcagcagattttacttttggaggatcctctgaagggtttcaacagatgtttgattcttcatgggttaatcatctcatgtgccatcaggccattgcatttactgaagaacttactgtcagctccagtgagatttcttcagacagagttgattattgggatcaagagacattcattaagggggttttagacttagcagatgatgctaactcattgcctgcattactaattgatgaaacaagcaaaaggaagaaggttacccttgcccttgatttggatggtaattttctttcatctatgcttactcgtatggatactgacctattcaatgggaaacttttctgggattatatcatgaacaatgtgcttcactaccagaaaaatcaatgtgacggtgctgacttcacatttaagatgatcacggacagggagaggactgtatatgtacggaagaggcccttcctccaagaatttttggcaaaagtatcggagatgtttgaaatcatcattttcacagctagtaaacgcatgtatgctgaaacattgctagatgttcttgatcctgataagaagtttttttctcgacgagtgtgccgagaatcatgcacctggaaagatcgctgctgcgtcaaggatttgactgttcttggaattgacctcgcaaaagtatgcatcatcgacaacactccagaggtattcaggtttcaagttaacaacgggattcccatcaaaagttggtatgacgaccccactgactctgctctgatgtctttgctgccttttctggagaaactggttgatgtggaagatgttcgtccccttattgcagaaaaatttggagcaaggacttaa

SEQ ID NO: 116402 - DNA, 705 bp, Glycine max
  Peptide Sequence Number=SeqID_233180
atggtggcgagtgagcgagcgatggaagaagaagattttgatttcgagaagaaggtttcgataaaggaatcgatgtcgatgtcgatgtcgacagagcttgatccagccaaagttcttcttttgcttcgtggtttcctccaaattcagcaacgcagggccgaagcatattctaagctcaaaagtgggttttctgactacatggcctctggaggggaattggcttacaagcagctctgcagtgaaatcacaatagagtttaacaattgctcgaaaaaagtccttgaaatggagtcactgtttagaagccctgattactgccgagttgatctagcgcagctccttagagctgttcaagatcaggaaaagcagaaacttcaactgaaaacacctcttcaagcctattttagtgtggccaccaggaacatgctactacatactgccaccattcaggtgttaaagaaagccggtcgcccatctgaacgtctggtaagccatgagaattgcaaatttacaaagccagcagagcatgagtgcgttcatgttcaggagattacagaagcttctgggactgaagaagctgaagcagatgctgagtatgacaatgctctaaaagaagctattagaggtgtccaggatgctgtcatggccattaatgaacatctagaagaagtcagatatgaaattgctgcccttgaagcagagtga

SEQ ID NO: 116403 - DNA, 1224 bp, Glycine max
  Peptide Sequence Number=SeqID_233181
atgatatcttgttatggggcacacggaaagggggaggaatctcttttgctgtttaagaagatggtagatgaagggtttaggtcgaaccctgtcacactcccagcaatattgaccagttgtagccgctcgggtctgatagatcaaggcaagcacattttcagctcaatttgttcagactatgggtttgagcctactgtagagcattatgctcgtatggtggatcttctgagccgctgtgtgtatcttctggaagcacttcagttcttggaaaacatgaaagcatcagggacaggaagcatgtggggtgcccttcttgctggttgtgtaatggacaaaaatgttgaagttggagaaatggcagcacatcagctattccaattagaaccagataatgctagcaactacatagctttgtgtgcattaaagccacttcacttgattatggctaggagggctcagcagaagaataaggggtggccttggagctgtactttgactgccaggcaccaagacaggcattcgaggattgagccattacccaccataacacggaactgtgaggcgcacgtggcgtattgtaccaaagacccaaaaggtgtccgtcgcggggagaccagccaaggcatgaatgctgatgtaggggctggggtctgtaatgaggaagaggacgtggcccttacaccgatgagaggtgctccacttctcatcacagttatagcagagccctttatcgtggcgggatgccatctcttcagggagggatggggaggcgggggtggtgaaggatggggttatggtcggaaagggtggcggcgatcattgatcttatcctcctgtaagcgcgctaaagcaacggcttgtggcaaggacaatggtgatgaagccgttcttgtgcatccattgaaaccaactaagggctgggccatcaagataaaaggaagtgacggtgatacggtcgtcgttgggggttccttggtagtaaaaaaattgggtgatcttgaagatccaacccaaggggtcgtgcccattaaagcgagggatgtccagcttgacggggtgacgagtgcttctcggataaagaagaaatggcttcttctaattgatcagtggtggtgcgtcgggtggtatggtccgccattagagaccggcggcaggtcagaccaatgttacgagcaggaaggggacgcgagtttggtttcgaggaccaaggcctcctcacaatga

SEQ ID NO: 116404 - DNA, 282 bp, Glycine max
  Peptide Sequence Number=SeqID_233182
atggcaatgggacgtggtgggtacgggtattgtttccccaatctccgactccgactctccaatatatccgatatccgacgggttaaagtttattatctcattcctgtacccgtcggggagatgctaagtctgaatgggatgatgagggtggatttcatgactcttcctagcattctgaaagcttgtggaaaggaaggagacttgttgaaagcgagagaagttcacgggaatgtagcgagaagctttgattttgatgcagctgctgccattggaatgcgttga

SEQ ID NO: 116405 - DNA, 2379 bp, Glycine max
  Peptide Sequence Number=SeqID_233183
atggccgaagtgatcaacaacatgcctcctgaatccctcgaccaatctccctcctcttccgctcctcctccacctcctcctccgccacccgcctcttcctccggccccgccgacgatctccctccgccgcctctccctcctccgccgcgccgccgggaccgcagggacgaccgcgactttgaccgccaccctaaccgcagccgggattactacgaccgcgacagggacttcaagcgccgccgcagccctagccccggctaccgtgaccgacgatactctcctccaccaccttcgcgccggtcgcctccgccgtacaagcgatcccggagaggaagcccccgcggcggggggtatggacccgatgataggtgtgattcgagcttttgtcctggttttgatgatttgttatgtacgattgaagtatatggagtggaatttgtgtttgtagttgagttggttgttggttgttttggttacgttgctgaaaaagtgatgggaagtgaactatctgattttctttgggggcttcaggttcctttggcggaacactggattttggggttggattggatatttggttatgattattctggtggctatgaacggggagcgggtggaaggactggttatgcagatgagaaatcttatggcaggcttgtacatcgatctgctgggggatatcataatgggatttctgatgtggataatagtcgtggttatgcagatttgtcaagtggaggtgcacaaagaatttctgtcaatggaatggtattcgagaaaggaaatatggctaaggagccaatatattcttataacattgcaggattgaatcatgaggggttgatgtcctataaacaattcattcaggagcttgaagatgatgtgctgccagctgaagctgagcgtaggtatcaagagtacaaatcagagtatatttctacacaaaagcgggcttattttaatgctcacaaggatgaggagtggaatgaaaatgctcgacggcttgcaaaggattttttgcttgatttgcaaagtggaacattagacctaaatcctggtttgaactccacttcatccggtaaatcagggcaagccagtgaacctaattctgaggaagaaacagatggtaaacgaagaagacatgttaggggacctaataaagataatgatttctcagctgctccaaaagctcaccctatcagttctgaacctagacggatacaagcagatattcaacaggctcaggctgttgttcgtaagcttgacagggaaaagggtattgaagataatattttatgcaccagtgaccataataaaaatgatgataaggctcacagtggatctgtgggccccatagtaattatccgtggcttaacatctgttaagggcttagagggtgttgagctacttgacacacttattacgtatctttggcggatacatggtgttgattattatggtatggttgagactaatgaggccaagggttttaggcatgtgaggccagaaggagcagggcatgaagaaacaagtaaatctggttctgactgggagaagaaacttgattcattttggcacggaaggttgaatggccaggatccattggaagtgatgactgccaaggagaagatagatgctgcagcaactgatgtgttggatccacatgttaggaaaattagggatgagaaatatgggtggaagtatggttgtggagctaagggctgcacaaagctttttcatgcagctgaatttgtgcacaaacatttgaagctaaaacaccctgagattgtgatggaactaacatccaaaatgcgcgaggatctttattttcaaaattacatgaatgatcctgatgctcctggtggaatgcctgtcatgcagcaacctcaggatagacctctaaagcgaagattaggaggtttagagggccgattgaaggatgaccgtggtaaccggcgagaccaggacagaagtgacagaatgaatggagataggcctgatggttccccatcccatgaaaggcagatgggaaaccatgatgaagcaatgtatgatgcatatggagggcctggtgtacctgcatttacctcagatatgccccctccaccagttttgatgcctgtacctggtgctgggcctttgggaccctttgtccctgctccaccagaagttgcaatgcagatgttcagggagcaaggaggacctacatcattcgatgcctcgggaaggaagatgcgatctggtcctcatatgggtggaccagcacctataattgctgttcctccatcctttagacctgatcctcgacggatgcgaagttatgaagatctagatgccccagaagacgaagtcactgtgatagactataggagcttgtag

SEQ ID NO: 116406 - DNA, 201 bp, Glycine max
  Peptide Sequence Number=SeqID_233184
atgaggggtttagaaagtcatgcttggttgttgagagtgttggacaattctctagtccaggttgggaacttgggattttcaaacaccctctacttgtcaaatgttgaatgtgaaatcattggaaaacttcagctgtacaaccgcatgaataggatatggaaaaaaatatcacaccacaaacgagatatagttagtgcatga

SEQ ID NO: 116407 - DNA, 2856 bp, Glycine max
  Peptide Sequence Number=SeqID_233185
atggaggtctcaaaacgtgtgcctatggcgaggaaagaggttgggtccaagggagagcccagacaactattagccaaccattttggagtttgcctagtcaagcccaaggatgatattgatggctacttctaccattatgatgttgccatgagttatgaagatgggaaccctgttgaggccaagggtgtagggagaaaggtcttaaatcaagtttgtgaaacatatgttgaactgagaaacatgagttttgcatatgatggtgaaaaaagtctattcactcttggtcctctagcaagtcagaggcttcaatatcctgttgtgttggaggatgtttcatcaaggagggttggaaagaatggaaaccctgctgagagtcctaagggaggatatacaaaaagaatgagaattaggcatcagtttcggccaaaaactatcaacgtggatatcaaatatgcagccaaaattccattgcaagcaattgaagatgcattgcgtggtcgggattctgagaaatctcaggaagcagtgagggttctagacatcatactgagacagcattctgcaaaccagggatacctccttgttcgccaatccttctttcatgacaatcgaagaacctgtactgatataggaggtggtgtgcaagggtgccgcggttttcattcaagctttcgagtcacacaaggaggtttatctctcaacatggatgtgacaaccacaatgattgtaaagcctggccctgtggtggacttccttctccagaatcagagtgttcagaacccaaactacattgattggaccaaggcaaagagaatgctgaagaacctaagaatcagggctaatggtgttgagttcaaaatctctggattgagtgataacacttgcaggaatcagaaatttcttttaaggcaaaagggtacgaatggtgaagtgcaggaaagggaaatcacagttcatgactactttacacgccaaaaactgattggcctgaactattctgctgacatgccatgcatcaatgttggcaaaccaaaacgcccgtcttattttccaatagagctatgtgaaatggtctcgttgcagcgttacaccaaggctctaacaaatttgcaaagggctcagctagtggagaagacaaggcaaaagccccaagttaggagacaagctttggaagatgccttaagaagcagcagatatgacgatgaacctatgcttcgctcttctgggattaccattgaacctaactttgttagactcgttggtcgtgtattggaacccccaaagcttatagttggaggagagaagagcatcattccccggaatgggcgctggaatttcaacaataagaaactatatgaacctttgatgattggtcgttgggccattgtaaacttctcaagtcggtgtgacacaagactcctgatagaactcattaggaggtgtgctgcagctaaagggatgaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtccttggaagaagaaaagtcttgttgaagaagggattgtaacacaatgtattgcaccaacaaagattaatgatcaatacattactaatgtacttttgaaaattaatgcaaagtatggtgggatgaattcgtatctgtcagttgagctttgtaattccattccatttgtttcagctgtaccaaccttgattcttggtatggacgtttctcatggatctcctggtcgatcagatgtgccctctattgctgcggttgtgagctcaagatgttggcctcaaatttcacgttatagagcttcagttcgcacacaatcatcaaaagttgagatgattcaatctctattcaagcctgtggctaatactaataaggatgaaggtatcatcagggaggtgctgttggactttgaaattacttcattcaaaagaaagcctcaacaaattataattttcagggatggagtgagtgaatcacagttcaaccaggtgctcaatattgagttaagtcaaatcattgaggcatgcaaacaccttgatgaaaaatgggatccaaagttcactttgattattgcccagaagaatcatcatactaggttctttcaggccaatgctagagatcaaactaatgttccaccaggaaccgttattgacaacactgtctgtcatcccaaaaacaatgacttctacttgtgtgctcaagctgggatgattctgtgccactttggacaacctctttccccctttggccatggcggaatccaccgtcgtgaccctcccggaactcctctccgtcaccgccgtgggcctggccccctccggcggcatcttggtgggcgtgaacctggagttccctggtttcccttgttgtcaccgctgacgtccaacatcgagatgtgcatctcgcacattggttggtggtgggggacaactcgacctactcactaccatgttttacacgatgaaatcggattctcagctgatgaagtgcaagaattagtgcattcattgtcttatacgtatcagaggagcacaactgctgtatcattagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaa

SEQ ID NO: 116408 - DNA, 699 bp, Glycine max
  Peptide Sequence Number=SeqID_233186
atgcgtgcaccgcacatgcttgttgcaactgacaggcgcaatgtctgtcttcaatgcattctccaacgatcagaaaagggtagagttctcaaatccgatgacttaccttacctgtcatgccaaaaacatgtccatcacggacagcttgacaaaagcaacccggacaacacttgtccaggctcagggcttctcaagccacatcgacttgtaattcttttatactctttgaggttaccatacctgacaccagacaacatgactcttacgagtctacaagttaagtccaggagtcgagtctatgaaactctcacgagtctgcgtaaactctcgagtttgataaccttgtcagacaacacttgtccatacttgggggctcaacaaacttgtcaccctatgcttgtcaagaccactaccccagacatcagacagactcctcaacatgggacaatctctttcaacacgggacaacctttctcacccgcaagttggctcagtgcttggggggcttatgacatgaccaagagcaagagaaaggattcacttgaaggacttggaggacctatgacaagggctagagaaaggaaagcaaatgaagctcttcaacaagtgttgcccatactatttgaatacaagcccaagtttcaaggagaaaagtccaaggttgtgagttgtatcatggcccaaatggaggaggactaa

SEQ ID NO: 116409 - DNA, 2529 bp, Glycine max
  Peptide Sequence Number=SeqID_233187
atggatatagatcttcggttaccttctggtgaacatgataaggaggatgaagaaacaactacaattgataacatgttggacagtgaagaaaaattgcataatggaggtatagatggcagaaatatagttgatgctggcattgaggtacatgctctaaatggtggagatttgaattcacccacagttgatattgtaatgtttaaggaagatacaaatcttgagccactttctggcatggaatttgagtctcatggagaagcttattcattttaccaagaatatgctcggtcgatgggattcaacactgcaatacaaaatagtcgtcgttcaaaaacatcaagagaatttatagatgcaaagtttgcttgttcccgatatggaacaaagcgagagtatgacaaatcatttaatcgcccacgtgcacgacagaacaagcaagattctgaaaattcaactggtcgaagatcttgttcaaagactgattgtaaagcaagcatgcatgtaaaaagaaggtcagatggaaaatgggttatacatagctttgtgaaggagcataatcatgagcttttaccagcccaagcagttagtgaacaaacaagacgaatgtatgctgcgatggctaggcagtttgctgaatacaaaactgtggtcggtctcaagaatgaaaagaatccatttgataaaggtcggaatttgggcctggagtcaggggaggctaaactcatgcttgattttttcatacagatgcaaaacatgaattctaacttcttttatgcagtagatcttggtgaagatcaacgtctgaaaaatcttttatggattgacgctaaaagtaggcatgactatatcaacttttgtgatgtagtgtcgtttgataccacctatgttagaaacaaatataagatgcctcttgcattttttgttggagttaaccagcactaccaatttacattacttggatgtgccctgatatcagacgaaagtgctgccactttttcttggctattttggacgtggctgaaaggagttggtggtcaagttccaaaagtgatcattactgaccatgacaagacattgaagtcagttatttcagatatgtttcctaattcaagtcattgtgtttgcctatggcatatattagggaaggtgtctgaaaatttatctcctgtaattaaaaagcatgagaattttatggcaaaatttgaaaaatgcatttataggtccttgacaagtgatgattttgagaagagatggtggaaaattgttgataagtttgaacttcgagaggatgaatgcatgcagtcattgtatgaagatcgtaagttatgggcaccaacattcatgaaagatgttttcttaggtggtatgtctaccatccagcgatctgaaagtgtaaattccttctttgacaaatatgttcataagaagacctctgtccaagattttgtcaaacagtatgaagcaatcttgcaagacaggtatgaagaggaagcaaaagcagattctgatacatggaataaagtggcaaccttaaaaactccttctcctttggagaagagtgttgcagggattttcacacatgctgtattcaagaagattcaagctgaggttattggtgcagttgcttgtcatcctaaagctgacaggcatgacgatacaaccattgttcacagggttcatgatatggagacaaataaagacttctttgttgtggtgaatcaagtaaaatctgagttgtcctgtatatgtcggttatttgaatacagaggttatctttgtagacatgcattgattgttcttcaatattctggccagtcagtgttcccctctcaatatattttgaaacggtggacaaaagatgcaaaggtcaggaatataataggagaagaatcagaacacgtgctgactagggtgcaacggtacaatgatttatgtcagcgagcactaaaacttattgaagagggatcattgtctcaagagagttatggtattgcattccatgcgctacatgaagcacacaaaagttgtgtgagtgttaacaattctagcaagagtcctacagaagctggtacatcaggggctcatggtcagctttccactgaagacgatacccaaagtagaaatatgagcaagtcaaacaaaaagaagaatccaactaaaaagaaaaaggtgaactcagaagcagaagtgataacagttggggcactagacaacttgcaacaaatggacaaattcagcacaagagcagttacccttgaaggttattatggcacacagcagagcgtgcaagggatgttgaacttaatgggaccaacacgtgatgattattatgggaatcaacagacacttcaggggctgggaccaataagttcgataccaacaagtcacgatggttattatggtacacatcagggcatgcctggtctggcacaactagattttttgcgaactggtttcacatatggcattcgggatgatactaacgtgagagcaacacagttgcatgaggatccatctagacatgcatga

SEQ ID NO: 116410 - DNA, 951 bp, Glycine max
  Peptide Sequence Number=SeqID_233188
atggggtctcaatgtggtggtgataatagtggaaaacattcacaactccagcctctggtgccgcaaaattcaatgtacagcctcacacttgatgaagttcagaatcatttaggtgacttagggaaacctctaagtagcatgaaccttgacgagcttctaaaaaatgtgtggaccgtcgaggcaaaccagtccactggtgtggacattgagggtacagctctaactagtcaagctgcgctgcagcgtcaggctagtctgtcgttaactagtgctctaagcgggaagactgttgatgaggtttggagggatatacaacaaagcaaagataacaaggataagaagtctcaggaaagacagtctacattgggagagatgactttggaggatttcttggtaaaagcagggattgtagctgaagcatctaataggaagaatactggtgctacagtcggcgttgattcaaatgtagtggcgccacagtttcctcaacatggtccttggatacagtatgcacaaccacaatatcagcatccacaacaaggtttaatggggatttatatacctggacagaataaagcacagccattacacatgggagctggtgtggcaacagatgttctgtatgcagatggtcaggtggcattgtcttcacctgttatgggaaccttgtcagatactaggagacctggcagaaaacggggcacgtcagaggatatggtagagaagaccgttgagaggaggcagaagaggatgatcaagaatcgggaatctgctgcccgttctagagcaaggaaacaggcttacacaactgaattggagcacaaagtctctcgtttggaagaggaaaacgaaaagctgaggagacagcaggagctagagaaaatgttgtcaagcaatccacctcctgaacctagataccagattcgccgaacatcatcggcttcattctga

SEQ ID NO: 116411 - DNA, 339 bp, Glycine max
  Peptide Sequence Number=SeqID_233189
atggtacttttgcttcatactctcagccaagacagccttttaaaaatagatgattcaatgacaagcaggctcgactgtccaagcacccaggaaactctaatgcaacacattatgaaaaatgaatggagaagactagaccacaattatcaaagaaagagccccatcataatcttcaaggagaagcagaatcttcttcgtatcctttttttcctgtttcgtactgagagtggcacagtgtatttatggattatccttaatccatttgtaagtcctactgcagaagatgccaaacctcgcaggctgggggcactcccaaaatatggatttagttatatctag

SEQ ID NO: 116412 - DNA, 846 bp, Glycine max
  Peptide Sequence Number=SeqID_233190
atggcggtagcgcatcaacaggcgcaggatctggctgcgccggttcatgcctttgaccagcgggggattgccattggcggtgggcggattgctcaagcggaactcccatgcggcaaagacggtcgtgccggccgctggccagcaatgcacgcggtgaatccgaccgcttccgcagccgccccggtatcggtcagaatccgctcattccctctctggacttcccatggccggtgccagcctgttcgccctgctcgacgatatcgccaccctcctcgacgatgtctcggtcctgaccaaggtcgcggcgaagaaaaccgccggtgtgctgggcgacgacctggcgctgaacgcgcagcaggtgaccggggtcaacgccaaccgcgagctgccggtggtgtgggcggtggccaagggctcgctggtcaacaaggtgatcctggtaccggcagcactggcgatcagcgccctggaggcctggctgcacagccgcggctggaacgtgccgctgatcgtgccgctgatgatgatcggtggtgccttcctctgtttcgaaggcgtggagaagctggcgcaccgcttcctgcactcagccgaggacgacgccgagcatcaggccgaacggcgcaaggcgctggccgatacgcaggtggacatggtggcgtgggagaaggacaaggtgaagggcgcgatccgcaccgacttcatcctctcggccgagatcatcgtgctgaccctgggcgtggtggccaccgcgtcgttcaccaaccaggtggtcacgctggccgtggttgcattggcgatgacggtgttcgtctatgggctggtcgcgggcatcgtgaagcttga

SEQ ID NO: 116413 - DNA, 490 bp, Glycine max
  Peptide Sequence Number=SeqID_233191
gagagcgagggcaaggccagctaaggctccttccacatctgcagctcctcctccagcacgtacctcagcaactccttctacctcaccttctgcatactttcaccgtcttgaagccatgctttggagcatacatcaagggcaaattattttattacaaagtttacaactggtagcacctccagactctattccttctgtagagcagtttaatgaatgggtagcctggcccgggactcagcctccccttcacagggaagacgaaggtcccattgctcaggtaccacaggagatggaggatgggtcatctgagacttctactccagagcccctgatcaaaaggaagagggtagttgaaacacaagaagttgcaaccacttctaagaaatctcttgaggccacttctgagccttcagaaccagtggcagatacggcttcaattcagcaactagcagacccctccactcctgaggatcaaactacagcagtttaa

SEQ ID NO: 116414 - DNA, 171 bp, Glycine max
  Peptide Sequence Number=SeqID_233192
atgagtgttcatcctcaaaggatgaactcgcttaacgcggcttggcttagcgcgaggataagaccgcttagcgaggtttacagattcgaaaagctgcaactctcgttaagccaggctctagctggcttagctaaaatgatgcatcttaagtacagaggagcatgcgcttag

SEQ ID NO: 116415 - DNA, 467 bp, Glycine max
  Peptide Sequence Number=SeqID_233193
tgcatcacttggtggactgcagagacctaaaccagctcaatgtgtactacttggcgtccatatccgaggagctcaaatccgcaagctcctcagactccgaactcatcgagaaaatcgagagctacctcagtgccgtggccaccaaccactacacttgctatgatggcttggttgtgaccaaaagcaacattgccaatgcacttgccgtgccactcaaggatgtgacacagttgtatagtgtgtcacttgggttggtcactgaggctcttgacaaaaacctaaggaggaataagacccgcaagcatggtctccccaccaagaccttcaaggttaggcaaccactagagaagctcatcaaggttagcatcactgatttacttttatttgcatgggagacggacatatcttcaatgggtttttcgtccattcagtcatctgaaccaagcgcagaaaacatgattcattga

SEQ ID NO: 116416 - DNA, 435 bp, Glycine max
  Peptide Sequence Number=SeqID_233194
atgtcaatgggaggaactgatgtgaagccatgtttgagcacctctaagttcaacaagaaggttttggagacaaattggttaacctatctagtgaagatatggggacttgagcatttttccgttttttctatatatctaactagtcttgaggtatctatgtccaagaaacaccagcagtccatcaagatagtcgagctggatgcagctttacgaggacgggttattcagtatcgtgaagtacaaggtcatgaaactgaaaagttcctctcttatttcaaaccatgtattatacctcaacaaggtggagctgcctcaggttttaaacatgatgaggctgaggagcataagacaacagttgtttgtgtgcaaagagaaacatatggtgcatgtcaaataggcaagtttgaccttattcctctgccattaactcattga

SEQ ID NO: 116417 - DNA, 282 bp, Glycine max
  Peptide Sequence Number=SeqID_233195
atggctattagcatttccagcaactactatatgatacgaggatggtcgttcagagttgacgtcgaggaagagccaaatttcatatcccagaagccccaaaatgccaagaagaaggtgatgtccatggtggccagtagatggaggcaatttaagtctacgctgaccactaaatttgtgtatgctgacactgagggtcaggataaagaagatccatctagaaaatatggtatggatcaacaaacttgggaggaatttgttgcaagccgcaagaccgcaaactag

SEQ ID NO: 116418 - DNA, 636 bp, Glycine max
  Peptide Sequence Number=SeqID_233196
atgctgattgagaatacaccattcattgaggaccctccatctcccattgaaagacatatgaaatggaagttaggccacacaaagcgatatgtgcagatgacatctcaggcgacacaagaaatatttgatagaattgactatttacaagaacagacaatgcagggtacctttgttccccatggtcatgatgacatactgagtactgccattgggcgaccggagcacccaggtcgttttcgtgcagcggggtctggtatgacaatcagtcattactatggaagggcatcatgtggctcgagtagttcctttacatccatcacccaacaacaactggttgagattattttaagtcttaaggaagagtggaggagtgcacgtctgagcacaaaggggagcaatcctgaaactgctattaatccatcaggggaagaacgtgttggtcatatgctgccgactatggggttgtatgtgcaacatgatcattgtgcacacctggtggcattgggaaaagcatatgagggggggattaatggcagcggaatggagaaggataaagatgattggagaagccacttcaaggagaagataagtcaagaagaagctcaccaccataggaagccatggataagagcttga

SEQ ID NO: 116419 - DNA, 1687 bp, Glycine max
  Peptide Sequence Number=SeqID_233197
gtatgatgaagaaactgggtttgacgacctgcgtaatgaattcagtggagacccatcatcagcataccgtttgagtgatctcccagacacaaccctagggtcactcttgtcatgtctgatgcagcactgtgatccccctcagaggaggtaccctctagacaagaatgttcccccaccctggtggcccaccgggcttgagatctggtggcccgagctgggctttgctgtcgacccaggcccacctccctacaggaagccccatgacctcaagaaggtatggaagcagtgcgtgctgaccgcagtgatcaagcacatctcccctgacatcaccaagatcaaaaacatggtgcggctttcgaggacccttcaggacaagctcactgccaaggagactgctatttggagtgctgttgtgaaacgtgaagaaacccttgctagaagattgcaccctcatttgttcccagccaaaccaattatcagaaggcctcatcatgcgattcgtggttatgatattgaaggaagtggtgctcgtgctaggaactttcttgggggccaaagtagtcataacccaccaccaacttccaatgttgctgctcatagtaataatagtatgcttctagcaagtggaactgctagaagttttcttggtggccaaagtagtcataatccacaaccaacaagcaatgttggtaatggtggtgctagaaatttctttggggggcaaaattatccaccacttactagcaatgttgatagtggtgatggtagaagttttctgggagggcaaaataatccaccgccaataactagcaatgtggctaatggtattaacaataataatagcatggttacaatgaacaatggcattgttttgccaccagatcatggtgctaataagagaaaggaagttcaaggcatcacaattcctcatgatacctattcctgccatagctctcagtgcccttatcatgaaaccagctttggattcagtgacatgaatgtgaggaacaatcatcagctggcatgcatatacaataatggcaacaacaacaacaacaacattgtgcaagtggttggtggcggtggtggaggctcaagctcttcacagcttggacctggaaaccctaaaaacaatgttaatgtggctcttggtcaatctatgcacattgctgcaccagttgtgaatcagactcagactcagaatcttactattggtcaacctaggcatagtgctgcaccagctgtgaataatcaaaaccagactcttaatgtgatcagtgacaacaataattctggagaaatagggtcaaatggttcgatgcacaacatgaatgttgttgttcctctaggaaaccaaaaccagcagcaggtgcaaaatgttcttcagcctcaggtggtggacagcaacaatttctatggtggtggaagggtttctttggacaagaataataataatctctttggcaacaacagcatgaatattaatagtgttcctcctcttctagtatgccaaaacatgcagcaggtgcaaagtgttcagcctcaggttatggacaagaatttctttgttggtggaagggtttctctggacaagaataataataatctctttgacaacaacatgaacacttttccccttctaggaagccaaaacatgcagcaggtgcaaaatgttcatgagcctcag

SEQ ID NO: 116420 - DNA, 162 bp, Glycine max
  Peptide Sequence Number=SeqID_233198
atgccgaaatgggctgaacagattagagtgaagatcgacaacggcattgaaggtccccttgaagattgttacagctggagaaaatatggaaaaaaagacatccttagtgcaaaatatcccagaagctattgtaggtgcaccttccgcaatactaaggggtga

SEQ ID NO: 116421 - DNA, 798 bp, Glycine max
  Peptide Sequence Number=SeqID_233199
atgaggaatgatagcacaaaggaagcagaaatcgcaaaaacaaagaaaagcaacaggatagcagaaataggggtacaagcagtaagtggaggcactggtcctcgaagccagtattccctttctgatcccctttctgtatcaatttttggtgctctcgttgtcctaatgcctgatttcgagaagaatccaggcccctctgaccgtttggaggatgccttgcttcgccttactacccagaatatgtatttgggcgaatctgttcatgccctgacccttcaactcaaggagcttcttcagcgtacgaacaccacaccacaatcgagcccgattccgatttccccttctccgacgtcacctacacctgcgtcacagcatcgtatgaagttagatatcccacggttcgatggttcagagcctcagggttggatctttaagatcaaccaattttttgagtaccatagtactccagaacaggataaactcaccgtggcttcgttttatatggaaggtcgcgcattggcttggtatcaatggatgaacgcgaacggccattttacttcttggtcatccttcattcaggccttacgtgctcgtttcgctccgactccgtacgatgaccctactggtgctttgttcaagcttacgcagaaggggacagtggcccaatacctgactgagtttgaggatcttgcgactcgtgtggtgggcatctcccctccgctattattgagctgctttatctcgggtctttcccctgagattcgccgggaagttcaagcgcatcagcccctttctatg

SEQ ID NO: 116422 - DNA, 486 bp, Glycine max
  Peptide Sequence Number=SeqID_233200
atggtcttttttccccttaaaaatcatgttgttgcctacagttttgaaggccttgtgcctgaccacatcaagaggctaatagctaaagttaaatccatggattgggaaagaaaatatgagaaagtcttatggaggcaggaaactgaagatcaagctatagttttgaagggtggtgctgttgatgcaagcatggcagcagtaatgaacaaacttagctatttttatagctatatggctggtagcagcaaggtaggctacatttttcgagacccaaagtttagcgcagtccatattccacaagcaataagattttggaagatagattttgaggaaattcatggtttactcaggcaaggtgctacaattgataagatatcttcaaagctttcaccattagtatttactctacttgaatttccaccacccataggaaacaagttgcttttctaccctgaatcagatgatttaattatgaagcacaactaa

SEQ ID NO: 116423 - DNA, 318 bp, Glycine max
  Peptide Sequence Number=SeqID_233201
atggaaaatggaagaggcaagaaatcaagcaaagtggtgaaaagcatagctaggttgaatcataccagcagcaatagaagaattggaaggaggacaagggatggtgtcaagtcagctcatgttcttgacctaatcataagagatcacacattcaaggcattgaacaagaacttcaagacagcaataccacaatcagtggacttgccttcaaatctttcaggcattggagttgatgctgtgacgttcagatgtggaagattgagaaggtatggtgcacacttgaaggagttccatgtattgagaaggtatgctgattag

SEQ ID NO: 116424 - DNA, 285 bp, Glycine max
  Peptide Sequence Number=SeqID_233202
atgaaggtaatattttcgtacttggtgatcgtagagatcgttgttgaagtcgccgcgacaatgaaagagatcgtagatgacattagaggagacagggacggtgaagttgttgtgattgtcgaaggtgacaaagttaatgagggaggtgaggagcaagttgactatattttcgtaggcgaaatcgaacatgaacttgaactaggaacagacttgcacgagagtgtgataggtgttcttagaacatttcacaaaaaattaacaccattaataagggtaactatttag

SEQ ID NO: 116425 - DNA, 3720 bp, Glycine max
  Peptide Sequence Number=SeqID_233203
atggctctccgccgcgagaaagggctttgtttgcgctgtgacgagaagtatcacaggggacacaaatgctcctctcgatttttcattctcatttctgatgacctagaacccataacctctcatatacccattccagacccaacccatcatccaccacccgacccgcccgataacttggacttatacccggcccaaatctcccttaactctttagcaggccatattgccccggagaccctccgttttgtaggccagctttccggccaacccatgctcattttagttgatgggggtagtacccacaactttattcaactgcagatggtcacggaattgggccttttgtgccacgaaacgaggccattacaggtgctagtcggaaatggtcagcatcttacttgcaactatgtttgtgaagcaattccggttgaaatacaaggccttaccttccccattgatttatatgtcttgccgatttcgggtgccaacatagtcttgggcgttcaatggctcagaaccttagggcccgttcttacggattataccaagctctgtatgcaatttttttttcaagatcagttggtgacattacaaggcaacacagaggataccctgggaatgttatcgtcctcacaattccggcgtcttctccggcgacaaagtcctggcttatatttccatatcaccgtggcaccatcagatacgaacccggtttctactgctgattttccggaggacattcgttccttacttactaagtttgaccctctgtttaatccccttcaggacatgcctccggcgagggaaaccgatcatcatatacacttgttaccccaagctactcccgtaaatgtgaaaccatatcggtacccgcacttccaaaaacaggaaatagaagcgcaagtggcctcaatgttgcaaaaggggttgatccaacccagcactagtccgttttcgtcccccgtcttacttgtgaaaaagcacgatggctcatggcgcttctgtgtcgattacagagccttgaatgcgatcacaattaaggatcgatttccgatacccacgattgatgaacttctcgatgaattgggcaatgctcagtgcttctccaagctcgacttgttacagggctaccaccaaatacgcatgcattccggcgacattccgaagacagcttttcgaacacatcacggccactttgagttcaaagtgatgccgttcgggctttgcaatgccccgtcttcctttcaggctactatgaatctcattttccgaccctacctccgccactttgttatcgtcttcttcgacgatatcttgatttacagcccttctttttctgaccatctgaaacatctggaacttacttttcaggtactccttgacaacaactttctcctcaagctgtctaagtgctcctttgcacagtcgcaggtggaatatttggggcatttagtgtcctcacggggggtagaacctctcgcgtccaaagtcgccgctgtggtccaatggccaattcctcagtcaccacgagctctacggagctttctgggtttagctggtttctacagacgttttatcaaaggatatgctatgatcgccgaccccctggtaaaggctacaacaagggagccctttcaatggtcttctcaggcacaaatggcatttgatcaacttaagcatgcgctgtccacggctccggtacttgcattaccagacttccacctaccattcacggtggagacggatgcttctggtattgggatgggggcagtgttgtcccaacaggggcatcccattgcatacttcagtaagcccttcacggccaagcttcttcgatcttcaacctatgtacgggaattgttcgcaatcacagcagcagtaaaaaagtggaggcagtacttgctaggccatccatttacaattgtcaccgaccataggagccttaaggaattgcttacacaggtcatacagaccccagaacagcatacctatttggctcgtttattggggtacaactacacaattcaatatcgttcgggctcacataatcaagctgctgacgcgttgtctcgactaccagagcacatgccacacactgccacgatgtccctgctcctttccgttccatgtttgacttttctagatgaattgcacaagcaattacaccaaaatccccaatatattcagcagttccaggaggttgctaacagctctgagtcacatcctgatttcactattgcacaggacctgttattatataaaggtcgtatctggttgccacgtaacattccactaattcactctcttctcacagagtatcatgccactccaaccggaggacatatgggagtcgcgaaaactattgctcgtttatctgagaattttcaatggcagggactccgacaagatgtcgctgaatttgtggctcgatgtatggagtgccagcaaactaaatacgagaccaaacgtgttgcgggtttactgtgtccgttaccggtaccggcgcggccatgggaggacctatccctagatttcattacagggctgccgccgtgtcaaggaaagaccgttattcttgtggtggttgacagattttcgaaggggatccatctaggttcattaccaacggcacatacggcacatatggtggcatcattgtttgtcgacatcgtcgttaagctgcatggtattccaaggagtctcgtttccgacagagatcctttatttgtcagtcatttttggcaaaatcttttccacctgagtggcacgaagctgcggatgagttcggcgtatcaccctcagagtgatggacaaactgaggtgatgaatcgaattattgagcagtacctgcgttctttcgttcaccaccggccgggaacttggggcaaattgcttccgtgggttgaatggtcccacaatacttcgtggaacgtaggcacgggatcgactccatatgaggtgacatttgggcggaagccctttaattttcctgattaccttgccggatcttctcaaatcgctgccgtcgatgacatgttgacgaaccgtgatgaagtatttcagagcattcgcaagaaactgttaaaagcacaggagtcaatgaaacgacaagcagatgctaaacggagagagttatccttccaaatcggagattgggtccttctgaaactcaggccgtaccggcagcgatctgcgaggggaacacagtcaacttccggcaagttggctaaaagatattacggcccctttcagataattgacaaggtgggagcggtggcatatcgtttgaagttaccggagggaactcgcattcactcagtttttcactgttccctacttaaatcatttcacggtgaacctgatgcagttcgtatagctgacctcccagaacaatttctcaatgaccatcctttaataactccattagctattttggattatcggaaagctgcagataaccagaatgcaccgtgggaagtactggttcaatggcaggggttatccccagatgagacatcatgggaaaattgggatcaacttaaacaggagtatcaccttgaggacaaggtgattttccaagggcctcgggaagttgatagcacaaaggaagcagaaatcgcaaaaacaaagaaaagcaacaggatagcagaaataggggtacaagcagtaagtggtaagaggaaaattagtaagcctgcataccttgatgagtatgtgtga

SEQ ID NO: 116426 - DNA, 726 bp, Glycine max
  Peptide Sequence Number=SeqID_233204
atggattctatggatgatcacaacatgactattgatctcttggacacttcaatgagaaccgttgaagaagaatcgattgaagaagaaggaatgattgaagaagaagaagatgatgatcataatcggcaaaaacaagtattaacgattgaggaactcgagaagaggatgtggagagaccagatactgctgaagaaacttaaggatgagagaaaggagaaagaacaagggcaaacagtggagatgatgaagaagaaggccttgactcgtgcacaagacattgtgctgaagaacatgctcaagatgatggaggtttgtgatgtaaggggttttgtttatggcataattcctgataaggggaagccagtgagtggtgcttctgataaccttcgtggttggtggaaggaaagggttaagtttgatcgtaatggtcctgctgcaatgttgaggtatgatgaagaaactgggtttgacgacctaggtaatgaattcaggggagacccatcatcagcctaccgtttgagtgatctcccagacacaaccctagggtcactcttgtcatgtctgatgcagcactgtgatccccctcagaggaggtaccctctggacaagggtgttcccccaccctggtggcccactgggtttgagatctggtggcccgagctaggctttgctgctgacccaggcccacctccctacaggaagccccatgacctcaagaaggtgtga

SEQ ID NO: 116427 - DNA, 1697 bp, Glycine max
  Peptide Sequence Number=SeqID_233205
aaacccttgctagaagattgcaccctcatttgttcccagcccaaccaattatcagaaggcctcatcatgagattcgtggttatgatattgaaggaagtggtgctcgtgctaggaactttcttgggggccaaagtagtcataacccaccaccaacttccaatgttgctgctcatagtaataatagtatgcttctagcaagtggaactgctagaaattttcttggtggcctaagtagtcataatccacaaccaacaagcaatgttggtaatggtggtgctagaaatttcattggcgggcaaaattatccgccccttaatagcaatgttgataatggtgatggtagaagttttctgggagggcaaaataatccaccaccaataactagcaattttgctaatggtattagcaatgataatagcatggttacaatgaacaatggcattgttttgccaccagatcatggtgctaacaagagaaaggaagttcaaggcatcccaattcctcatgagacctattcctgtcatagccctcagtgcccttataatgaaaccagctttggattcagtgacatgaatgtgaggaacaatcatcagctggcatgcatatacaataatgacaacaacaaccacaacaacgctgtgcaagtggttggtggtgatggtggaggctcaagctcttcacagcttggacgtggaaatcctaaaaacaatgttaatgtggctcttggtcaatctatgcacacttctgcaccagttgtgaatcagtctcagactcagaatcttcctattggtcaacctatgaacatttcagcaccagttgtgagtcaaaatcaggctcttactattggtcaacctatgaacatttcagcaccagttgtgagtcaaaatcagtctcttactactattggtcaacctatgaacatttcagcacctgttgtgagtcaaaatcagtctcttactattggtcaacctatgagcatttcagcaccagttgcgagtcaaaatcagtctcttactattggtcaaccaccagctgtgaataatcaaaaccagactcttaatgtgatcagtgacaacaataattctggagaaatagggtcaaatggtttgatgcacaacatgaatgttgttgttcctctaggaaaccaaaaccagcagcaggtgcaaaatgttcttcagcctcaggtggtggacagcaacaatttctttggtggtggaagggtttctttggacaagaataataataatctctttggcaacaacaacatgaatattaatagtgttcctcctcttctagcaagccaaaacatgcagcagatgcaaagtgttcagcctcaggttatggacaagaatttctatgttggtggaagggtttctctggacaagaataataataatctctttgacaacaacatgaacaattttccccctctagaaagccaaaacatgcaacagttgcaaaatgttcatgagcctcaggttatggacaagagtactttctttggtgaaaggattggtggtggttacaagctgaataatgctgatcaagtgcatggagatttttcaacattaacatcaatggatccttcttcctatgatcaatgggatgcaacaaataattcccaatctgattttatggactctcctttgttgacagcaccgttgacagcaccgagccaggatttcctttggctataa

SEQ ID NO: 116428 - DNA, 2859 bp, Glycine max
  Peptide Sequence Number=SeqID_233206
atggttggcaatggccaacacttggattgttctgcgatttgtgaaggagtttccattctgattcaagacgtcaaattcaccttggacctacacgtcctacccattgtcggcgccaatgtgagcccatcaggactaccccctaaccgtgacaccgaccaccatatccatctccttccccacaccagtcctgtaaatgtgcgcccctacagatattcccattaccagaagaaggagatagagcagcaggtcaatgatatgttacagaagggactcatcaggccaagtacaagtcctttctcgtcaccagtcctcctcgttcgtaagcaagatggttcttggcgattttgcgttgattacagggctcttaacgccgttacggtccgtgatcgattccccattcccacaattgatgaattgctggatgaattgggaggagctcagtatttttccaagcttgatttactccaaggatatcaccaaatccatatgcatgcctctgacatacctaaaactgctttcaaaacccaccatggacattacgaatttaaagtaatgccatttgggctctgcaatgcaccaagctcctttcaggccaccatgaataacatattccggcagcatcttcgccactttatcatcgttttcttcgatgatattttggtgtatagcacctccttcgaagctcatcttcaccacttgacaatcacattccaggtccttcttgataataattttgtattgaaactttcaaaatgttcttttgcgcagaaacaggttgagtatcttggtcatgtcgtatctcacaagggggttgaaccagtagcctcgaagattgaagctattcagcactggccgacacccaaatcggcaaaagctgttaagagctttttgggacatgcgggattttacaggagatttattcgcaattatgccaccattgctgctccattagttcgactcacagctcaggattcttttgattggtcccctcaaacacaagaagcttttgatcacttgaagacagctctctctactgctccagtcttagctcttccggacttcaccataccgttcaccgtcgagactgatgcctccggtatcggcatgggtgccgtgctcacccagaagggacaccctgtagcgtttttcagtaaacctttcacccccgagcttgctgtggcctccacttatgtccgtgagttagttgccatcaccaccgcggtcaaacgatggcgacaatatttgttgggtcaacgcttcatcattataacggaccatcgtagcctcaaggaattacttactcaagtaattcaaactcctgagcagcataaatacttggctcggcttttggggtatgactatgtaattcagttccgttcagggcatcagaatcaagtcgcagatgcattatcccgacaacctgagtcagaactttctcaatgtttggtcctctccgttccttctttgaccttcttggaagaattgcaccgacaattggaagctaaccctgaattctggggtcacgccggaatcacaaagacattagcacggatttcagagaacttcacttggaccggtctcagagaagatgtcaagcaatttgtaacaaattgcatggattgtcaggtcactaagtaccagacacagcgcgtcgcaggactactatgccccttaccggtgccccatcgaccttgggaggacctctcgttagatttcattgtcggtctgccggcgtatctcggcaataccacaattctcgtggtggtggaccgtttttcgaaggggattcatctcggaatgttaccaacgtcgcacacagctcatatggtggcatccttgttcgttgacatggtggttaaaatacatgggatccctcgcagtttggtttccgatagggatcccctctttattagcaagttctggcaagagctgttcaaggctagcggcactcatttacgcatgagctctgcgtatcatccacagagcgatggacaaacagaggtgttgaacaggatagtagagcagtatctcagagctttcgttcacaagagaccaaaccggtggggaaagcttttgccatggattgagtggtcccataacacatcgtggaatgccggtactggaacgactccttatgaggtcacatttgggaagaagcccttcaatttccctgagtacatcacgggaacttcaaacatagaagtagtggaccacttactcacagaccgagatgcgactttccaaaccattcgtaagaagctccttaaagcccaagagattatgaagaggcaagcagatagcaagcggcgtgatgcccagtatcaaaagggaccacaacccactgctggcaagctcgcgaagcgtttctatggacccttccaggtggaagatcgtattggtaccgtggcttataaattgaagttacctgactcagccaggattcaccctgtatttcactgctctaagcttaagccatttcgtgggaactcggagcaacattcagaattgaatttgccacccatttttatccatgaccaaccagttgtacaccctttagctattttggattccaggaaaaatccggcaacaggaacttgggaggtgctaattcaatgggagggtctctctcctgatgagacttcatgggaggattgggcacagttacagcaagacttccaccttgaggacaaggtgcgtctacaagggccgaagagtgttatgaacagagaagcttcaggtggggacagtatggacataacaacaactatagaggaattgccagctcatgcaatcttccaatatcctccagcggatgctgcatatctgagggaagcagccataacagaattagttatgtaa

SEQ ID NO: 116429 - DNA, 303 bp, Glycine max
  Peptide Sequence Number=SeqID_233207
atgcccagtccaagttcacgctgggttttgcctatgaaaacgtcaactcgctcctcacctctcccgtcaactccatcgccttcgacaagcacaacaactttactgtcactgcctcttgtgacaccgactacgatctcttgcagtgtcgcggcgacttcaccaacaatcaatgctctcattgcgtgtcacatgcagtcacccaactcggcaacctttgcatcacctcctgtgacggctcattgcagctcgacaactgaatcgtcaagtacaacaatgccacctttatcggggttgaggatgtga

SEQ ID NO: 116430 - DNA, 490 bp, Glycine max
  Peptide Sequence Number=SeqID_233208
atggaagaggggacatttgaacaaccatctttggagaaacactattatgggaactgtcctggttgtaaggtggatcaagccaaagagctgagaaaggatgtttccattagaaatctttcttatatttggatggcagtgttatgtggcaccaatcccattcaacagagttctattactgctccacatgatatgcatcctcaaagggctttgacatccatattttggggaatgctatctgatcgctatggtagaaaacctgttataatttcagggattattactgttgtcattttcaacacattatttggtcttagcacgaatctttggatggctattagcatgagatttcttcttggaagtttaaatggattacttggaccaataaaggcttatgctgctgaaattttcagagaagagaagcaagctctaggactctcaaactttgttgctgcttggggagtaggactagtcattggccctgcattgggag

SEQ ID NO: 116431 - DNA, 657 bp, Glycine max
  Peptide Sequence Number=SeqID_233209
atggcgagatacttcggcaggggaggcccaattgggtcaccagggtgggctgcacgaagttgtgggtgctgccgccgtcaacaagcagcaccacacggtggtcggccagagttcctgtcatacgcaaggcctcaggtgccaggggtcctcttcttcagttaccaaaagaaaagccctagcggcgcaacgatggccgcgatggtaacgctcatcgcagggcgcggaggagctggcagcaagggtggtagggttggacgaggctctgctgaagcaggaagaacacgaatggggttaggttgcggaggtggtgcgcgagagcgtggagggttgcgcttgaacgagggtgagcggttgatgagcttggacttctctgcgaatctccggtgtgagaccggagatgaagcaactcagaaggaacggggatggcaatccgataaccctattcgcgaggtcttcaaattccgaaagcaaatcgcgtctgcagggcttgtaggaatccaggccacgaggaacaggggaaatgggagggggttatgggagggggttctggctgtgggggaaaacggaggtgggacgatgcagaagttcatcgagcttgaggttcatagattgcatagtgtcggtgaggcgggtgagaatggtttccagattgggtga

SEQ ID NO: 116432 - DNA, 198 bp, Glycine max
  Peptide Sequence Number=SeqID_233210
atggacaaagacttgccacatagacatatgactgacagtgaaaattggattttaatggtagagacttatttgcataacggattgttctacatgaacggatggttcattgcctatgtggatattggtgatttgcgaggttgggataatctttgtagcgggggagttagaggtggccattcaagagagtttgagagctag

SEQ ID NO: 116433 - DNA, 726 bp, Glycine max
  Peptide Sequence Number=SeqID_233211
atgccaagcaccttacaaggaccaaacaaaagtcgcatgtcatcaagcaaaggtccccggacgaaattcgggtataacaataattatgaccacattggcaaaattttgagaagtttatataggaactggagaccgcaggtaacaacgttgagaactttaaagaatcttgattctacgtctcttgaggaacttgtcagtaccctcaaggttcatgaacaagaactccagcaggatgaagaactcaaaagagaaaagtatcttgctcttagtagtcaaaagaacataaaggcatcatcacccagagaacaattcttgagaagtttatccaaagcacttaaagtcgatgattcatctgatgatgaatctgaagaagactcaaatgaagatgaactcatctttatccctcataaaatccataagatgtggagaaaaaagcttggacatttcaagtctgaatgtccagatctagagaaaagtcaagataataagaagttatttaagactaaagaaaagaagggtcttatgagcacgtgggaggacctggacgacacctcgtctaatgaagggtctgaatcagaccaggaagatgagcttttgaagaatcaagaatttaagggtgaacctcaagatgttgtcaaacttcatgaggaaataagaaccttaaagactacattatccaaatttgtcaatggaacaaataatcttaacaaattgttaggatactaa

SEQ ID NO: 116434 - DNA, 360 bp, Glycine max
  Peptide Sequence Number=SeqID_233212
atggctttgagaaaggaaaggttggcacaacactattttgtaaatactttgtcagcttttataagtgcaagtactaaatttgaaatgagcatgatgggagagctgaaattctttcttggattgcaaataaaactaataccccaccaaggcatctacattcatcagaccaagtatgtgaaagaattattgaagaaattcaacatgggtgacgcaaaagagatgaggattgttatgcactccactacataccttggactgaacgaggaatcaatgaaggtggacgggactcagtacagagcaatgattggttcattgctctatctcaccacgtccaggcctaatatcatgttcaatttttaa

SEQ ID NO: 116435 - DNA, 393 bp, Glycine max
  Peptide Sequence Number=SeqID_233213
atgggtgtctctcatccctttgcgattccaagacatatgaagacaagggcaacaaaggccaacccaaagattggtgacaaagaatgggcagcttcctttactagaaataaggaggatccagcctctccatcatcagatagtaagtccatagatgacaactctatctctcccctccacaatcatgcaccattcactcaatcgtgtccacctccatcacctcttaatctagatagatttagaaggactgttccaagggaacccttaacagatgttcagagggaaactataactatccaagcaaccgtagagatgaaacatgactgtgagcacacttcgtctgaggcctttaaggctttattatcagatgccatagttcatcttcctactccataa

SEQ ID NO: 116436 - DNA, 546 bp, Glycine max
  Peptide Sequence Number=SeqID_233214
atgaaacataacaagtttctgacgaaagattcacaagatgtggaaaacaaaggtggatcgagatggaagaactcctcaagaagtgtgcctaaagaaaagaaagacaaagagaaaagctccataattttctatgaatgcaagaaacttttacactttaaatttgaatgcccagagttggaaaagtctcaagacaaaaagaaacacttcaaaaccaaagaaaagaaaggactcatgagcacctgggaagatctagatgacacctcgtctaatgaagaagaagaagaagtcaatctatgtctaatagcaaatacaacttctgaagaatttgaatcagatcaagaggatgaggtaaatctcgatgatcctgaatctcttaaaaaggcttatcatgaactactatcaaactcatccattctttcaaaagcttacaaaaacttgcagaaagatttcaaaaacttgtccaaagatcatatggaacttgaaaagaaccttcaagataaagtaggtgtttcatgggatgagtccactcaaacatgtaatacttga

SEQ ID NO: 116437 - DNA, 212 bp, Glycine max
  Peptide Sequence Number=SeqID_233215
aaggctctgaagtagcctcaagggatcgctcaggtgtggcagcagctacctgtgtcacctgtgtctcctcgaccttttctcctataataaatggctttggatggttgcctcaaatgactcatcctccacatgctgaggtacctggactgtgggaccttcatcttccctgcgaaaagaagattgagttccgagctaggctaccaactcagtga

SEQ ID NO: 116438 - DNA, 210 bp, Glycine max
  Peptide Sequence Number=SeqID_233216
atgagatcaaaggatgctgaatttattttggtagggatcaaaaggtgcatcaacaagaggaataaactggctcaattgggacaagctttccatgaagaaaaagtgtggaggtgtcgcaacctacccttcggcgggagggcgacgcgtgactcgcgggatgcgtgttccacgaaaggaatacgcgcggagtcgccaccaacgtttatttga

SEQ ID NO: 116439 - DNA, 1095 bp, Glycine max
  Peptide Sequence Number=SeqID_233217
atggcgatctgcgcagtgatgatgttgctgcgcaagccggacagcgtgcagtggccggtggcctcaacgctgaaaaagctgctggcgctgtgcgtgatgctgattgtttacggctggctgtttgagaagctgggttttgccctgtgtaccacgctgctgacctttggcatcggcattctgtttggtgcgcgctggtgggcggcggcgctctccggcgcggtaatgggcatttcactgttctacgccttcgatcatctgctggatgtcaccctgccgggcttcgccgtcgccatgacgccggaaaacctgatgattgccctgataggctgctttatcggcaccatcgtcggcctgctgccggggctggggccgattaacggcgtcgcgattctgatgccgctggcgtttgcgttgcacttaccggcggaatctgcgctgatcctgctggcaacggtgtatatcggttgcgaatatggcgggcgcatctcgtcgattctgctcaacgtgccgggggatgccggggcgatcatgacggcgctggatggctatccgatggcgcagcagggcaaagctggtgtggcgctgtcgatctcggcggtcagctcgtttatcggctcgaccattgccatcatcggcatcattctgtttgcgccaatcctcgccaactggtcgctggcgtttggtccggcagagtatttcgcgctgatggtgttcgccattgcctgcctcggcagcatgatgagccacaacccactgaagtcgtttcttgctgcactgatcggcctcggcatggcgacggtgggcgtcgatgccaataccggcgtctatcgctttacctttgacagcgtgcatctctcagacggcatccagtttgtggtggtggtcattggcctgttctcggtgagcgaaattttgctgatgctggagtccaccagcagcggccagaagatggtgcgcgccagcggccgcatgctgttcaacatgaaagaggccgcacaggccaccggcgcaacgctgcgcgcctcgttcattggcttcttgtcggcgtgctgccaggtgccggtgccaccatcgccagcgccattgcctatatga

SEQ ID NO: 116440 - DNA, 882 bp, Glycine max
  Peptide Sequence Number=SeqID_233218
atgaccaacaccgcacgctcaacacgcatcaaatggtggatcgctggcctgatgtggctggccattgccattaactatattgatcgtaccgtactctctgccgccgcaccgcacctgatcaccgagctcgacatcaatccagagatgatgggctttatcatggcggcatttttctggtcctacgcgctgttgcagatcccggcaggctggtttgccgaccgcttcggccagaaaaaaggcctcggcatcgctgtcggctggtggtcgatcgccaccatggcgatggggctcgccaccggctttaaatcgctgctggcgctgcgtctggcgctcggcgtgggtgaagcagcggcttatcccagcaacgccggtattaccgcgcgctggttcccggatcgcgagcgcgccaccgtctccggcctgttcgacagcgcatcaaaatttggcggggccgtcgccatgccgctgatcgtctttatgatcgcgctgttcgactggcgtctgacctttctggcgattggtgccgtcgggctgatctgggtcatcgcctggtacttcatttatgccgagaacccggaagaccacaaagcgatcagcaccgatgaagtgcgcctgatccgcgatggccaggcgcagaagcacggcgataagaacgtgcggccgatgaagtggtacaagctgctgcgctaccgcaacatctgggcgatgtgtattggcttcttcaccatcaattacacttcctacttctttatcacctggctgccaacctacctggtgaaagacaaagggatggatttcctgaaaatgggcatggtggcggcgctgccgctgatctgcggtatggtgattgaggtgctggcgggctgggcgtcggaccgtatg

SEQ ID NO: 116441 - DNA, 141 bp, Glycine max
  Peptide Sequence Number=SeqID_233219
atggggatttctatgtactctgcccggttgttccatttggaagccggggaacttataacagtgttaggccacatgtctgctaaaggtgctaccaatgctttgagaaagctgctagatcaatctgtgcatattttcaggtag

SEQ ID NO: 116442 - DNA, 312 bp, Glycine max
  Peptide Sequence Number=SeqID_233220
gttctcaaactcaaggcccaaaagcccagtcatgctgacgaacatgccctggttcaagttcctgcagccgatggcggtgttccggatcacgatttttcacagcatgattgtttcaagagcaagctagcctctggtgcaagagttatcgctgcaagggatctagtagtggtagcggccctggtggcagacgacgtcatcgagctggtcgcagacggtggaggagtaggggatggtggcaaaggaagtggagagggtagggttgaagatggggtcgggattacccatgcctacaagtggattacccgtgtctaa

SEQ ID NO: 116443 - DNA, 240 bp, Glycine max
  Peptide Sequence Number=SeqID_233221
atggcctttatcatccttagatttatgcattcattccataattcagagattcatgcaaaagccattacccaatatccaacaccggtgcaactggtgaatcccgaacaatgggatgatcaggcaccgatgctggtgcagatggttgtggatcatcaagaactggagctggagatgactgaggaacgggctctggtgatgcttgcacagggcagtgatgagggtaggaaaaccaagccgtga

SEQ ID NO: 116444 - DNA, 540 bp, Glycine max
  Peptide Sequence Number=SeqID_233222
atgtcagaggtgaagagaatcggtgtggtggggggtggccaaatgggatcgggaatagcccaagtcgctgccatgcacgacatcgacgttttggcttcacgacctcgaccctcaagctctctccaaagcctcctcttccatctcttcctccatcaaccgtttcgtttccaaaaaccacatctctcagagcttatccgaacaagacaactagctgcgggtgctgatgctttgaaacgactgcgtctcacgacggatttggaggatttacagctagcggatttgatcattgaggcgattgtggaatccgaagatgtgaaaaagagtttgtttgcgcaactcgataggattgccaatagttctgcgattttggcgtccaacaccagttccatttccgtcacgcgtctagcaacccctaccagcaggccatgtcaggtgataggaatgcattttatgaatccacctcctgtgatgaaattgattgagattgtacgaggtgcagacacttctgaggagacattcgttgctacgaaagcattgtag

SEQ ID NO: 116445 - DNA, 381 bp, Glycine max
  Peptide Sequence Number=SeqID_233223
atggtgtgggccttcaagatcttatgtccattcttcaacttaaggcccagcattcccatgttcatgtactttttccaaatgaagctaaccgggaagatcaactgggtgtcattaaacaatgtttccaagaagatgttcgagtttgactcgaacatgtttcataagttcaaggattgtttcttcaaggttaaggcaaccaatgttgtctctgacgggttatcgttgatgtatgaagagaatagagagcctcattccccttttactggcaattggacctcgcaagatgatgttgtcaaggttacgcctgtcttgcctccctctgtggcgaccaagaagaagcacaacaaagaggttggagtgactggtcaacgcaagaagtag

SEQ ID NO: 116446 - DNA, 248 bp, Glycine max
  Peptide Sequence Number=SeqID_233224
atggctaaatggtgcaattcattcaatgttgaggaccacatcaacaccatgaataggaaaaaggtgattggtaaaaagaaccataataaggaggcgaatgagttggctagtaaaggcttgtacagttcaatgaaaatgagcaacctggggatggttttaggtcccacatcgcatagaaatagaaaagttgagtaccatataagtgaggagaagacccataaacctgagccttatggttttgggttaag

SEQ ID NO: 116447 - DNA, 843 bp, Glycine max
  Peptide Sequence Number=SeqID_233225
atgctgctgtccgtcggcagattccagcatggcctgccaacggccctgtacagggcgcagctcgatgcagcggctgcgcacatgcctgccgcaggtccggagagagccaagggccgagcggatcacgctgaaggtccagggcgtgcgaggcgggaaatgccgggctgcgccggcccaggtggtcgtacagccacagtcccatgcgcagcatccagcgtgggcgcaggtggggctcccacggcagtacgaagcgcaatggatggaccagatggggcgcctgccggcgtaccacctcgcgttcgcccagcgccttgcgcaccaggcccagctcgccctgttccaggtatgcgcggccaggtcgtgctgttcgcacagcagcacgcgcaggccgcggccgctggcatcacgggcgatgccggcgccgttgatgccgccaccgatcaccagcaggccgacgtcttgcatcgtgcctccgcatcctcccgccgctcgactcgggataggggcttggctcgactctacataaaagcagccaagcatgggctcggctctacagcgggcgccgatgccgaagccgacggtccacggatccatcttggcttcgccgatcttctcgccgcccaccttcacgtccgggcgcgaacgcatgtagcgggcgtcagcacgggcgaaccaggtggagttgatgttcatgtccacaccgacggtgccgatcacgcccttggcatccttgaagcggatgtcggtgtcagcgccgttgcccagcttctcgttgctgaagctcgactggtagtagcccacgcccacgaacgggcggaacacgttgtcagcctggccgaagtg

SEQ ID NO: 116448 - DNA, 216 bp, Glycine max
  Peptide Sequence Number=SeqID_233226
atgttccctcatgggaagatgcccaagaaaagggttttcagaccttaccctactctaacatacccaacaccactaagggggagtggtgtctccaatcaccactccttcttcttcattccattgccattgatctttaagaagaaaaagactccattgatgaagaatatccaagtcctacaagctctacatggagctacatcatcttctttgacataa

SEQ ID NO: 116449 - DNA, 955 bp, Glycine max
  Peptide Sequence Number=SeqID_233227
tcgtgtccgatggcacgcagagactaacattgtcttctgcgcccttttgtcatccagaggcgacgggcccgatgacatgcggagacaaattatggtcattccgcatactttttcgccattcagacacagtcgtgtccaatgccacacagagactaacgtcgtcttctatgcccttttgtcatccagaggcagcgggcccgatgacatgcggagacaaattatggtcatcccgcacactttttcgccattcagacacagtcgtgtccgatggcacacaaagactaacgtcgtcttctgcgcccttttgtcatccagaggcggcgggcccgatgacatgcggagacaaattatggtcattccgcacactttttcaccattcagacacagtcgtatccgatggcatgcagagactaacgacgtcttctgcgccttttgccatccagaggcagcgggcccgatgacatgcagagacaaattatggtcattccgcacactttttcgccattcagacacagtcgtgtctgatgacacgcagagactaacgtcgtcttctattgcggcgggcccgatgacatgcgggaaccatttggtcccgcacattttacttatgtcatccagaggcggtgagcccgaagacatgcgagaaccatttggtcccacacttttcaccttttgtcatccagaggcggcgggcccgatgacatgcggagaccaattatgggacagtaagtcgagaggtgggcggagacaaattatggtcattccccacaccttttcaccatccagaggtgatcgtgtccggtggcacgcagagacaaattatggtcattctgcgccttgccacccaggctcgatcgtgtccgaagacacgcagagacaaattatggtcattctgcgccttgtgccaacaaagaggaacaaatttgacagtatcaggatgatgttccgatactga

SEQ ID NO: 116450 - DNA, 330 bp, Glycine max
  Peptide Sequence Number=SeqID_233228
atggtcatgaaatatgctgtgtttcatgatatccaaccgttgacaatgcatatagatttaaccggaacagccagtatgtccaaaatctatgatgatggatacatcccgaaacactcggtccttgaacttcagaaagcctggccaggttctgaggtgagatgggtcacaggtgggcatgtctcttctttctgccccatggtgaattcagaagggctattgttgaaggccttaattgattaccgtggaaggagtctccattgtgacagggacattgcacaggcacaagagattgttttgcaaattgtgaagatattgtttttccaattgtag

SEQ ID NO: 116451 - DNA, 282 bp, Glycine max
  Peptide Sequence Number=SeqID_233229
atggcttgtttcatgttgaccttaatatttgaaagaaatagcaaaggatggaagacgcatggaactggggatcacacatttgaaaggagattgcgtcttggtggaccattgttaaaggaaaatatcgcaaccatggtacttgagaggtcagggtcaaattctgaagagcaaccattgaagagtcacgtggccttttacactggatgtactctgaggcaggttttagcaagatggggatttgtggacttagtatgggtaggacacattctaaattcttgttag

SEQ ID NO: 116452 - DNA, 294 bp, Glycine max
  Peptide Sequence Number=SeqID_233230
atgtcctataacggattatcatggaaggaaggcttagctgaggcttcatcttggttcaagcaatcaggcccacttgggccttccagattcttcctccagaaggttgttgcttctggaggaagcaaccttgctcgcctgggcgagctgggtggcaagctcctcccctattttgctataaatggggggaggagtgaagagagaaggagttcagccttcttggcacttcttattctcttgaaattgctaaggaaaattgtttccgtgaagaaaatccaagtcgaggcacttccgtaa

SEQ ID NO: 116453 - DNA, 504 bp, Glycine max
  Peptide Sequence Number=SeqID_233231
atgatggtcgcaccatctgttacccggattgaggcttcaaaagaactgacagatattgagacccagagaaaacaggaagcaaatgaattttcattcaaattggaaagcacgaggagaaagttgaaggaggccattgaagagatcgatgagtcaaaggagcttgaaatgaaattggttgtgacaatattagattttatggcctctttggatgtcataagaaatgagttgaagcatgtcactgctgagacaaataggttgaagaagaaggaagggaaagtagactcaacagttcaaaatctcaatttcaagattttgagagcaaagtctaaattagaagctgtgtctgctgctgaggaaaaggccagatccatagtcatgagtttgtctcatactcttgaaaagctgaagacaaaaacagaagaagcaaaaaaggaaaatgaggatgtaagccaggaggttgcagccaccaatgagtacagatttttcatccttaactacgtatga

SEQ ID NO: 116454 - DNA, 204 bp, Glycine max
  Peptide Sequence Number=SeqID_233232
atgaaagatagcatgacatcacaattgcaattctcaccaacaaaatcattagcacagaaaagcatacaaaaatatcaaggaaatgtatcttcatcacctcgtacctcgatcaagtcgtacctcagtatatgcaagattacgtctagcaagtctagcaaagcgactgatgacgtagcaaacaaacctcgtacctcgatcaactga

SEQ ID NO: 116455 - DNA, 984 bp, Glycine max
  Peptide Sequence Number=SeqID_233233
atgtggtattgtgctactgactatctgcaaagttgtagacatgaaggttggagcagtgttgccaaatttctaaccaaagatgtccctcaacttctaaagtcagaggatctaaaagacattcaggaagtactctctcttgcttttaaatctcctcccagtgaattgagagggttaataacatggattgttgaagttcgcagacaagaagatgggaatctcacattgagtgaggaggagaaaggaaggctagttatcaaggctcacatactggaacagattcaaacaactggactcttcaaacacgtgacaaggtggttggattctaaaagttcatgttgtaatactttggcaaaccttggtgacaaagatatgttaccagcacttgctgccagtgtttgttgccaagcagcaaatcttttgactgtttgtggtaggctaggtttgttaggtggaaaatgctgtagtcaaatagatgtaaaacatctgaatgctgatagtgaaaatccagtaacattagtttcaggaactgttacaactggtggtggtagtgaacaaggagttgatgtgttggtccctttgtgtcaaagggaaccaagtaggttgtgtctttctaatgaaggtcactgcattggcatgcacccgtctactgcagatgtcttaacggtgcttttattggccttgcccttgcatacgtggtctggcattaaagaagaaaagttgtgtgtggaagctttgagccttctagcaacagaagatctccctcccctacttcaggaagaggtgtttacaaattcaagtggctcgtatctgtcaatttctgtggaccatctggttcacaagaaaccaatggctgttttcaacaaaggaaagtccccatccaactgtttgtcttatgaaagccaatttggatgcctctgtgaagaagaatataaggacttcgatgaagtcgttgctgcagcatctttggttattcctcgctgctag

SEQ ID NO: 116456 - DNA, 1014 bp, Glycine max
  Peptide Sequence Number=SeqID_233234
atggacatgcatgatcacattactacactctcatcgagacgagactctcagcagcgcatcagggttatccagtcttacaagggtactccaacccataggattaacatgagccacacagagattccaaattggataagcgccaaggacataagtcttgtgaccggtggcaccgtgtcatcattgtcgtcctacaacccagagttgcctctccaagaaacattgttgtggcaagggagctttctggatttttggggggttgaacaagagaagtgccctgtggagggcgatgatgtagtttttaggaaggggtggcttgcggtggtggtgggggacaattttgacgatgagggtgaagaagccgatgaggaaggcacagacaacgagagtgccaagtgtccagatgaagacctagcgactaacaatgatgcaacccatatatatgtaccttttcttcttcattttatgttctcctttgcccaagagccagctatgttgggtctcatccaaagcacctcggtccagctcatggagatttggtggcggagtctatggtgtgaatctccagcaagcctccccacagatccctactgtgcatactcattttcaataccttatgataaacacaagattcaaatactgctagctaaattactaaactctcgatccctcgtcaggctgaatatccaagcttcatccgcagatccctcattttttaggagggggtggcttgcggtggtggcgggggacagttttgatgatgagggtgaagaagctgacgaggaaggcatagacaacgagagtgccaagtgtctagatgaagacctagcgactaacaatgatgcagcccagatatatgtaccttttcttcttctttttatgttctcctttgcccaagagccagctatgttgggtctcatccaaagcacctcggtccagctcatggagattcggtggcggagtctatggtgtgaatctcaagcaggcctccccacagatccctactgtgcatactaa

SEQ ID NO: 116457 - DNA, 1379 bp, Glycine max
  Peptide Sequence Number=SeqID_233235
atgatgaacgatattcaagggtacgtgccaatactccttgtttggctagcctcaataatattgctccaagccatattcaaaacctcaaaatttcgccttcctcctagtccatttgccttgccaattattgggcacttccacttactaaaactaccccttcacagatcttttcagaagctctcaaatcgctatggacccttgattcacatctacattggctctacactcactgttgttgtttcctcttcagaaatagccaaagagatcttcaaaacccatgacctttccttctccaatagaccagcaaatgttgctattaactacctcacttacaactcatctgatttcggatttgctccttatggaccctactggaagttcatgaagaaactttgcatgtcagagctcctcaatgggaagatgttggatcaactactacccgttaggcaagaggagatacacaggtttttgctgatgatgaaattgaaaggtgaagcatgcgaggtcgtgaatgttggagatgagtttttgaagctaacaaacagcatagtgatgagaatggcaataggaaaaagctgtttcagaaatgatgatgaggctcacaaggtgacagaaaggatcaaggagtcttccaagggaattgggaagaagctgaaggtggttcatgagaggtttgacaccatgatggagtgtatcattcgggaacatgaagaggcaagaaataaatcgactgaaaaggatgctccaaaagatgttcttgatgctcttttgagtatttctgaagatcaaaactcagaggtgaagataaccagagacaacattaaagccttcttggtggatatgttcacaggaggcacagacacaactgcagttactctagaatggtcactggcagaactaattaaccatccgacagtcatggagaaagcaaggaaggagattgactctatcattggcaaagacagaatggtaatggagatagatatagataatcttccttatctccaagccatagtgaaggagacactgaggcttcaccctccatctccatttgtattgagagagtcaactaggaattgcaccattgctggatatgacattccagcaaagactcaggttttcactaatgtgtgggctattggtagggatccaaagcactgggatgaccctcttgagtttagacctgaaaggtttcttagcaatgaaaatgagagtggaaaaatgggtcaagttggggtcaggggacagcattatcaacttctgccttttgggagtggaagaagagggtgtcctggaacttcactagcgctaaaggttgctcacaccacccttgctgctatgattcaatgctttgaattgaaggctgaagaaaaaggagg

SEQ ID NO: 116458 - DNA, 366 bp, Glycine max
  Peptide Sequence Number=SeqID_233236
atggatggtatggagcatgtagtgaagcatttgaggagtgaaaataaaatctgttggacctgcagaaagaggagctgtggaaggggcctcagatctcttccctctggccttcctgagtcctctgaaagttactattggatcatcaagattccaacagttcatcttaatgtagaagcaagcttgatgatgatgaatcaagttgattcaagtagttttgatgatgacaaaaaacccaagagaatgatttcaagattgagtcaacaagttcaagatcgagataagatcaagattaatttcaagattcaagaaatgacatcaagaagaatcaagattcaagagaagatgatttcacaagggaagtgttga

SEQ ID NO: 116459 - DNA, 327 bp, Glycine max
  Peptide Sequence Number=SeqID_233237
atgaactgttggaatcttgatgatccaatagtaactttcagaggactcaggaaggccagagggaagagatctgaggccccttccacttcagcatcagaggcaccaccaggagaccagccttcttcctctggagggggtggggcctccacagcccaggagcctatgactaaagagcccacaacaccagtaccatcaccagcagcagtagaagaggagaccactccagctcagaccccacaaccatctccaccatctgcacctgctcctgaggagactcagccatcagcattggatattaatgaagaccagccacaggaggagcaggac

SEQ ID NO: 116460 - DNA, 585 bp, Glycine max
  Peptide Sequence Number=SeqID_233238
tctgagaaccgctaaaagggaggaagttgaggcaccgaaggaagacgaagaggtggctcgtagggaagaacatggctggaacaagttccgaggggctctgtggggcagtaacagcgagcttaagctctggaaggaggaaagggaccaatcgcgagaagacaatttgatcttgaaggatgagttgaaggcttgctttaggtccaagaaaagtttgtctcagcggttatgcgagacaaagaccaacatgttagccatcatcagcaagtaccaagaagaactaaatctagccacgacccacgagcatagagtggcagacgagtatgcccaagtgtacgcggaaaaggaggctagaggaagggtgatcgactcgctacatcaagaggcaacgatgtggatggaccgattcgctcttaccttgaatgggagtcaagagattccccaattactagccaaggctaaagcgatggcagacacctactccgcccccgcattgtatgttggtctcgtcctttgtcacgggaagccggaaggtccatatcaccttcttaactgtacacatggagcactgcgcccccaaatgcgcaa

SEQ ID NO: 116461 - DNA, 417 bp, Glycine max
  Peptide Sequence Number=SeqID_233239
atggaggagttgattaacaaaacacaactctctccccccaaaataatcccaacgtcatcacgtcggtttggcggctcctcaacagaatctcatccctacaccctactgctgtcattctgctcccacgaacaaggttcgcgatcatcacagcaagaaaacataagcaaacatcatgagcttacacaccattcattattcaacacccacattcaacaattattcatcatccatccatggatccaatcaagacaactcagaatgatgcatgcacccgacctcaactctccgatgcaatgcggtacgtaccgtatccaataccaaggaaatagccctaagcatgtctacacgacacctcacttaggaaaccatgcagtatttgtcgaggccacccagtcgtgcaccgtaactcccccctag

SEQ ID NO: 116462 - DNA, 183 bp, Glycine max
  Peptide Sequence Number=SeqID_233240
atggtgataatcaacagttgggctaagcgcatatccaccgctaagcgtagcttcagcgtgcttagcgcaaaggagaatctggcagagcatcagcatcaaagtcgtgcgctaagcgcagcaggtgccttcagccaggctaagctcgagactggccctaagcccaatttcacttactcgccctaa

SEQ ID NO: 116463 - DNA, 141 bp, Glycine max
  Peptide Sequence Number=SeqID_233241
atggagaagtgggatctcaagtggagaaggtgttggtttgagtgggaagtgccgatggttgaagagtttcaaagtgctatttccaggaatccattgtcaaaggtggagggattcgtaggtttggtcagaagatggaagtga

SEQ ID NO: 116464 - DNA, 224 bp, Glycine max
  Peptide Sequence Number=SeqID_233242
gaagtttctactctacagcagttggaggattgagatgctatgagaatccaaagaataagattactgcagtacccgccgaggaagagcaaatctggggtgcattcttcaggaacagagaatcagtgaccagtcccaacagtaatataaggttaatgtcagttgagactgcattaggtacaaagggaaaatgtgaggtaatcttagagcttaagaagttagtgtaa

SEQ ID NO: 116465 - DNA, 222 bp, Glycine max
  Peptide Sequence Number=SeqID_233243
atgaccaagaacaacgaagtgacgtcgaggcaagatgcacgccgatcaaggatcgaggtgcatgcaaagtgtggttgcgaagatgaagaagatcatgtgggatgttcgactgtatcattacttttttgtgagaggcatgactgttttcaaagcattatcttgtactgtggcatcaaaacccacattgattcatgggacaatcccggtggggagtgtcgttga

SEQ ID NO: 116466 - DNA, 406 bp, Glycine max
  Peptide Sequence Number=SeqID_233244
gtccatggctactccaccggccttgcctcctcctcctcttgctcctcctcctgcagacgcatcaacgtctctgtctacattgaagcggacacacaaggcgacacagctacgatcgggattgtcgctcgtgataaggtcgacgtgacatacgagacctggaaggaagtccctgctgctcagaaggatttgatatgggaggatattcaggcggaatttgaaatccctgaagcttctgataccgacaaggatggtgtggacgacactgtctgtgaaaaatacgacattaacaaggagaaatgggcccagttttgtcagacccgcagagacccctcgtgggaggatatgcggaaaaaagcacaggccatccagaagcaaaacactgctccccacatgttgtctcgtgggg

SEQ ID NO: 116467 - DNA, 261 bp, Glycine max
  Peptide Sequence Number=SeqID_233245
atgttgattgatagagaattcaacaacaatgtgcttgtacatgacatatatgaacaaagtgatcatgatggagatccaacaacccaacctaaggacactttgtgtgacattggaggtcctatgactaggtctaagactaagaggatgaagcaagctttgcaatacctaataatggagataaagtcttctcaaggtggattagaggctacaccacattgggtcatttttctacaagtggatgaagatttaagcccaaattga

SEQ ID NO: 116468 - DNA, 561 bp, Glycine max
  Peptide Sequence Number=SeqID_233246
atggcttcttcaagtgttaagggaaataccaactcaacaacaactcaaattgaaccactccccccacctttacatcttcatcatcaaccaccacaacatcattttcatcatcatcaaataccagaccaacaaatttcttttggaatgttgccatcttcctcgtcagcctctatcccaggaaatttcttaagcaaagattctggagcttatgatttgggggaattggatcaagccttttttttgtatcttgatggtcaggctgacccttctagtgttcaagaccaaaaacagaactcatcatcaggaatgaggccaccaccaactctcaacattttcccatctcagcctatgcacgcagtgccaccatccaattccaaggttaacatgggattaccctccacacaaaccagtactggctcaaagagacagccagagacatccatggccaagcccaaaccacacaccgaagccgccgctgcacctgagccacccaaagctgtaaaggttcacaaccttgagtatctcagaaacgttaattacaacaagaaaataatgcattag

SEQ ID NO: 116469 - DNA, 615 bp, Glycine max
  Peptide Sequence Number=SeqID_233247
atggatgtgctatatcagcgagagggcaatctcaagggaacaacatcaagttctgagcaggaagcacccaaaacaccagatcctaagacactgagaagacttgctcagaatagagaagcagcaaggaaaagcaggctcaggaaaaaggcgtacgttcagcaactagagtcgagtaggattaagcttaatcagatagaacaagagttacaacgtgctagagctcaaggcatattaatgggtggtggaaatgcacttctgggaggggagcaaggctttcatatggcaatgagtggcattagctcagaggctgcaatatttgacgtggaatatgcgagatggttagaggagcaccaccgcatagtgtgcgagctaagagctgtactccaagaacaccttcacgaaaacgagcttcgtttatatgtggacaattgcttggctcactatgaccaagtaatgaacctgaagagcatggtggccaaaaccgacgtattccaccttgtttttggcgtgtggaagaccccagccgaacgttgctttatgtggattggtggcttcaggccatctgaactcatcaagatagatttggagatcaatttaaggaaaggacaaaaatga

SEQ ID NO: 116470 - DNA, 420 bp, Glycine max
  Peptide Sequence Number=SeqID_233248
atgggtctagcttctggttctacatccataccagaaagtattcgcacagagagtcttgaggtggaattcggcaattacacaatgataaagatggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatacctatatttgtttcattcccctctattgaatgctaaatacactcaagaattaattcatatcaattttggatattatttaatgtcttaa

SEQ ID NO: 116471 - DNA, 174 bp, Glycine max
  Peptide Sequence Number=SeqID_233249
atgccgtggaacctcacggattacctaacaatgggtgttaagtactttgaagcggtcaagcaaaggttgcaggccatcaaacaatggtccccggtagaaactggtgtgaacttgaatggatttagttcaaacaaaaagggaatgcctcaatggttttccataaatcctccatag

SEQ ID NO: 116472 - DNA, 189 bp, Glycine max
  Peptide Sequence Number=SeqID_233250
atgggagttgctacgtgcacccagcattattgctggggcacccagcaaacagtgaagtggcgaaactgcccttcagcaattattcttccggaagaagacaatttccggaagaacgtcatccggaatgtttccggaagaagcttcttccggaagaattccagtgtcttccggaagaagcttcttccggaa

SEQ ID NO: 116473 - DNA, 972 bp, Glycine max
  Peptide Sequence Number=SeqID_233251
atggagaaacctccaaaagtccaaagacaagaagaacactcaaaacaatattcctcaggatctatttgggaaacacatgaaggacacttcacagtagcaactgcttatccatctggattacacatctcaaaggccaccgacgtcaagatagttgtagataaagtgtgtccacacttacctatttgggatacttctaaaaataagggatttaaactccactcttatgatgaaatgcccacaagacagatgaaggtcaatgtggtgaactattccaagaattggagttccttctttagtggaaaaaagctagttcaagctccaaacatatataatgctaaaacattttggaatcagattgtatgggctgacacattgaaggcctcctcatctaattatgatggaagtgacaatgtggatcaccatgactttattcaaagccttcccaccatatttcatgagaccacttatgatctcaccaaaatattggaaagagagttcatagatcatgtgacttatctccattatgctcaaaaggaaagaatagcaaagatggaagaagagttggtttttgctattcctgttaaagagaaaactgctcaagtccaagcggaagcttttgccaaagttatggatgataacattgttcatgatttcattattggcctcactaacattggtgttatgggtgaaaccctaaaggtgtccaaagcagctaaaactgataaggttatacaccaagagaaagaacatgcatttaaacactctgcaacctcaaataaagctacattaagggagaaagatgcacttgatgttgtcattgtttactctaccagttcaagtccccctacacttaactatgctcttctcactattgtgaccaaagatcaagtccaagagatgataggtcaagcaatggattccttcgtcgaacgacagaggcaagaaaatgatcaattcaaaatatccttgtag

SEQ ID NO: 116474 - DNA, 1043 bp, Glycine max
  Peptide Sequence Number=SeqID_233252
ataacttggaaaagtttgactcaaaaagtgataatggaacatttcttggatactttgaaacatcaaaggcattcagagtttacagctcaagaaccttagcagttgaggaaactattcacttgaaatttaatgaaaatgagcctgataatgatttatcaaagctagatgagtcttttgcagatctcagactagatgatgctattaaaaaaaaggagtcatctaatcaaagttcagaagttagagtgtccactcaccatctagatgatcctcaggaagaagtaagggagcccactggatgcttcataaggagaaatcatccagaaagccaaattattgacctactgaaagggaagaaggctgttggagcaaaatgggtattttgtaacagactagatgaaaatggtaacactgtcaaaaacaaggcaagcaatatgaagttgtatcaaatggatgtaaaaagtgcattcctaaatggaataatccaagaggaagtttatgttgaacaacctcgagcatttgagagtgaccctcatcatgtttttaaacttaacaaagcccttgctactaatgaaatgtcgtgtaagggtttttctaagctaatgcgaacagaattcaaaatgagcatgatgggagagctaaaattcttccttggactgcaaataaagcaaacaagcaatggaatctacattcatcaaaccaagtatgtaaaagaacttctaaagaagttcaacatgaataatgcaaaagaaatgaagacacctatgcatccaataacatgtcatggactggatgaagaatcagcagaaatggataggactcaatatagatcaatgattggatcattgctatatctcacaacgttcagacctgacatcataacttctaatcttggtctgtggtttaaaagaagggaagatttcaggcccacaaatttctatgaggttgactatgctggagacaaagttaaaaggaaaaacacaagtggaaactaccatttaattggcggaaacttggttacatggatatgcaagaagcaaggttaa

SEQ ID NO: 116475 - DNA, 731 bp, Glycine max
  Peptide Sequence Number=SeqID_233253
atttagctttggtgaaggagttttatgctaacctttacagctccgaagggccttcaccaaaacaagtcaagatcataggccatttggtgaggattgatgcagacaacctcaacacctttctggagacacctgtggtactagctgagggtgaaaccttacccacatattccaaatactataggtcgtccactgatattagagaaattaaggcttccttatgtatcccaagtcgggggttcatcttgaactctgaaggccaccctgggaagattctcaggaaagatttaacaactcttgctcaggtgtggagtgttctctcgtactccaacctggctcctacatcccacactttggacctgacagtagatcgagctaggctgatctttggcctagtctctgagatggacatgaatgtgggagctctcatctctggtcagattacatctatggcccagtctaactcttctagacttgggttccccgctcttatcactgctttatgtaagtccagaggggttgcttctgacagcctgatcttcgaacgcctgagctcggtcattaacttggcctatatcagaaaaaattattggaaccctgatgatctgacagttactatcagaggggccaggaaagtgaggacaaggctagttgaggccccttccacatctacagctcctcctctagcacataccctaacagttccttttgtcacagcttttgcagattcttag

SEQ ID NO: 116476 - DNA, 231 bp, Glycine max
  Peptide Sequence Number=SeqID_233254
atgaccactcttacatggatatggatgacgttgctatttagcaacattctgcccagtgaccacaatgccaatctccccctgcagatgtatcagttgggatcgcgcccacaagacacccagtggatccgaagaagtccaacagggccctggggtttccagctctggttacgggcctctgtcagtcctacagggtgcccgttcccccagcgaggtcatgccatcgtgacatag

SEQ ID NO: 116477 - DNA, 159 bp, Glycine max
  Peptide Sequence Number=SeqID_233255
atgaggatgcgtagccctctaaaggcgagggcgtgcagccctctgcagattgattgtccttttgaaaaaggtgataattcatgcaaccttatcctatcttttgcaaatctctccgggaactccctcagagtgtatattctgtttgatttagtcacttga

SEQ ID NO: 116478 - DNA, 168 bp, Glycine max
  Peptide Sequence Number=SeqID_233256
atggattatggattagtttcacgggatggggaatatccacattatagccctcaaagaccacatggcggcaacaattatagtcattgtgataatgattatgatggttataatgatggtgatgatagtgataatgatgagctaacgatgattttagaaaaagtgatttga

SEQ ID NO: 116479 - DNA, 889 bp, Glycine max
  Peptide Sequence Number=SeqID_233257
agtagattgggaccaatacttggctgggataggaggcagcacaatcaactggtttcctcgatggaaggaaggaaaggagggagttcttttctcatgtggggactacccaaacgttccattgatagggacgaggggttgtattaactataatcctgcacttgccataagacagttagggtaccccatgaggggagcaccaacggaagagagcctctcgcctttccttgtgagagatttcgacgcgcaaagtctcaagattgtacaaagagtccacaaggagtggggaagccccttaaggaaagataaagaacttaggggcatccgtaatggcatcatcggtggttatcatgaatggctaagaattcgtacacgagggttagattggctctccaagttgaaaattatcaacgaagagatcttcgaagctccggaagaggatgaagaagtccaagctctaaaatcagagctaggaagggcaagactcgccaaagaaaagttcaagacagccgctacaagcatccagaaagagtgtgccgagttacgagaggaaaatgcagctaccgcaaaagcccttgaacaagaaaccaagagggctcgcaaggaaggcaacaatgagctcaagctccgaagagaggaaaaagaccagtcacgagtacatggcatgatcttgaaggaagagttagctgcttgctcaagatccaagaggagtttggcccaacacttagaagccacagagcaaagcatgctagctataatagggcagtacaaagaagaggggattgatgcattgcatcaagaagcgaccatgtggatggataggttcaccttgaccttaaatggaagtcaagacctcccgccactactagccaaagcaaaggccatcgccgaa

SEQ ID NO: 116480 - DNA, 480 bp, Glycine max
  Peptide Sequence Number=SeqID_233258
atgcagacagaactaaacatgagaaggctttctcaccccaacctggtcaatttattgggttactgttgggacgatgatgagcatcttcttgtgtatgagttcatgccaaagggaagcttagacaattatctattcaaaagaaatcgtaacttagaattactttcttggaacacacggcttaaaatagctattggtgcagctcggggattagctttcttgcatgcttctgaaaacaacgtcattcacagagatttcaagtcctcaaatatactacttgatggaaattacaatccaaagatctcagattttggcttggcaaaattggggccttctaagggacaatcccacaattacaatccaaagatctcagattttggcttggcaaaattggggtcttctgagggacaatcacataattacaatccaaagatctcagattttggtttggcaaaattggggccttctgagggacaatcacat

SEQ ID NO: 116481 - DNA, 618 bp, Glycine max
  Peptide Sequence Number=SeqID_233259
atggcatatcatgctagctcaaaagccaatcaagattcaatgaaaaatcatgaaattcattttggcaagagctactcaatagaaaactttcaagggggaccagagttacaaccttactatcaaaatgaagcagaaagaggttccaatctggataaattgttgatgcaattcaaggaaacaactaaatcaactcaacaaccactccaaagggtagaaatccaggttggtgagctggcaaaagaaatgactcaatttatgtccagacgagaaaaatactttatagaggttgaagctcaagaggaaagccctgtaaaagagcatgagtcaagggaaaaagatgaggaacaagcacaaaaacaatgggagaagtactcatcagtagaaaacattcaagaaagtattctccaaatcaataaccttcctcatcaacggattgacaagaaaaaaaggcaaggagagcatgaggaaaccttaagtgccattctttctttaatcactaatacctttcctgaaatgatttggaatgtacttccagactacatgaagttcatggaatttctagctaaaaggcgaaactgcaaggaagatgtgttctatgtgactttcatgccaccttga

SEQ ID NO: 116482 - DNA, 216 bp, Glycine max
  Peptide Sequence Number=SeqID_233260
atggcatgtccgaaagggcaaaaagttgcttctggtacctacgctctagtggaagaagctgagtattggtgggagaatactcgccaatgcctagatgttgaagattgctttacaacaagagaccctcagtctcttaatcccttttcagatgtaagaagaagaaaagaaggaatctctcttgaaagagatagattgaacaatggagcactcaaataa

SEQ ID NO: 116483 - DNA, 164 bp, Glycine max
  Peptide Sequence Number=SeqID_233261
ggccaaattcagtagctctagcccaatcctcttagagcctcttgctcatgactcttgtaactggtcccttcctatggaggattgcatcacaaagggaagcaatgttgaaacttccatcaatgtatcaggggaagagcatgttgcttatgtgatgtcttttccta

SEQ ID NO: 116484 - DNA, 439 bp, Glycine max
  Peptide Sequence Number=SeqID_233262
atggttcagcccccaggggatcctggcctttttgccgctggaaggcgcggatggccattccgtggccgtggtgtggtcgctggaccacagccaggtcggccactggttgaccgccgaggcagccgacttcagccaggccctggcggacatcagccagcacagcctgggccagctggagctgcaaggcccccgcatggcctggcctttgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 116485 - DNA, 1006 bp, Glycine max
  Peptide Sequence Number=SeqID_233263
atggctcagcagctgcagcagcgaagtggatgcccatgcggaaggcaacccttccacgtactggccgatgggcgcggtgacgtcgagcagatgccgctgctggagccggaaaatcagcagggccgtgaacagcttggtgatcgaccccagttcgaacacggtatggcgatcaatcggtgcaggccgggctgccgttcggcctgcagcaatgcggtcagcgaaccgcatcccgccaacgtcgcccggctcgccagcgccgacggtgctgacaggccgaagccagtggccagcagcgccgcacacaggcgacgtcgaacagggtcgtggtacatgcacgtggctcgcagcggcgtcgtggtgatggtagcgcggactgagggccggcccgcgcagggtgcaccgggtgaatccaccccgacagctgccggggacgcgcagcatgccggcgggtcatccgcgatggctgacagctggcacctcgccaccactcagccaccactcatcaaggggaccgctcatgaacatgctccagcaactcgcctcgcagacgccgatctgggtctggctgctcctggccttcctggtcacccgtggcatcgccgccatgaagcctgcagaaacctcgctgcacaaactggcaatcgtgcccgcgctgttcgccgtctggggcgcgtggtcgatcagtcatcgcttcggcgcgtcgctggccgcctggagcgagtggcttgccggcatagccacgggcgcggcacttgcctggctgctgctgaatcgattgaagctgacgctggatcgcagcaccggcaagctctggcgcagcgcggacttcagcctgctgccgctgctgctggtcaccttcctggtgaagtacggcttcgaagtcgcatttgcggtgtcgccgtcgctgacctcccatgccggtttcagtgcggcctacctgctgctgacgggcgggttcactggcatcttcgtcggcaagtacgcccggtacctggcctcgctgcgg

SEQ ID NO: 116486 - DNA, 1212 bp, Glycine max
  Peptide Sequence Number=SeqID_233264
atggtggtagtgggtgcacctagattgcatcggagagtagtagatctgacaaaagtgaaaagattaaaaaggatggccggagaaggtggtggcacatggcagttccgatggcgccggcgaaaggcgggcttgaccggcgatgaagagacgagtccgatggtgctagcagtgacaatttctgaacaacgaaatatggttcattggataagaacactcatcaaaaaagttactggaaaacagaaacagtttgccggaagaagggcaactagtggaatgaaatggaatttgggttcaggttttgaaagattgccgtacaagccggaagggtacaattattggacatggaggggtcataaaatacattatgtagtgcaaggagaaggctctcccattgttcttattcatggttttggggcctctgcattccactggaggtacaacattccagaattggctaagaaacacaaggtatatgccttagacttgctcggttttgggtggagtgacaaagcacttatagattatgatgctatggtgtggagagatcaagttgttgactttgtgaaggaaatagtaaaagaaccaaccgttttagttggaaacagccttggaggatttactgctttggttgcagcaactgggttgcctgatcttgtcaatggtgttgctcttctaaattctgccggacaatttggcgatgggaaaagggaaagtgaaacttctgaagaaacagctctacaaaagtttctcctaaagccattgaaggaagttttccagcgtgtagttcttggatttttattctggcaggcaaagcaaccagctcgggttctgtcagtcctaaaaagtgtgtatataaattcttccaatgtggatgactatcttgtggaatctataacaaggccagctcaagatccaaatgccggagaagtctactacaggttaatgacgcgcttcatgatgaatcagagcaagtacactctagatgctgtcttaagtgaactctcatgcccgttgttgctgctttggggtgaccttgacccatgggttggtccagccaaagcgaatcgaatcaaagagttctatccaaaaactactcttgtgaacttgcaggctgggcattgtccacatgatgagacaccagagcttgtgaacaaggctttattggattggttgaccaccctcactcctgaagtgactctccaaacagtttga

SEQ ID NO: 116487 - DNA, 216 bp, Glycine max
  Peptide Sequence Number=SeqID_233265
atgcggctgaagacggaggcgccggagctcggagtgggaggtggaggtggggtccactttgacgcggagagggagatcgagaagaagagtgtcgacaacggagatgcggtctgggccgtggttcgcgctttgaggaacagaggcgtcaaggtgttcgtcgccggtgatcgcaattcagttatactcactgtaaatccaaaggtgaagccaaaatag

SEQ ID NO: 116488 - DNA, 339 bp, Glycine max
  Peptide Sequence Number=SeqID_233266
atgggaggaaaatgtccgcacaggaacgtgaagaagagaagatattctcacaagaccgcgcggcgaaccaaatttgagctgaaaggggacgacatggtttatgcgcagctcaacaaacccgatcaagagagaccccctttacccgtcgacgaagatttgcctgggatgggccatcggtactttgccaatataactgtgagggatgagcactttaagaccaaacgacacaagaagcgtataaaacaaatgatgggtcctgcaccacatactcaacttgatgccgatttagcttctgggatgggtatgccagacaatggaccaaagctaatgtctatgtaa

SEQ ID NO: 116489 - DNA, 2442 bp, Glycine max
  Peptide Sequence Number=SeqID_233267
atggagtttctaaaagtcaaagcctatgaagtgattggtcatacaatgcattttaaaaagatccagaaggtaggggagagagggctgcaactttcaggaggacaaaagcagagaatagcaattgcaagggcaatgctgaaaaacccagcaattcttctcctagatgaggcaacaagtgcattggactccgagtcagaaaagctggttcaggaggcccttgatcggttcatgattggtagaacaactcttgtaattgctcatcgactctccacgattcgcaaagctgaccttgtggctgtgcttcagcaaggaagtgttactgaaattggaactcatgatgagctctttgctaaaggagaaaatggagtctatgctaagcttatccggatgcaggagatggcacatgaaacttctatgaataatgcaagaaagagtagtgcaaggccttcaagtgccagaaactctgtaagctcacccataattacacggaattcttcttatggccgatcaccgtactcgaggagactatctgacttctctacatctgattttagcctgtcccttgatgcatcacatccaaattacaggcttgaaaagcttgccttcaaagaccaagctagttccttctggcgactcgcaaaaatgaactctcctgaatggctttatgccttaattggttctataggatctgttgtttgtggatcccttagtgcattctttgcttatgttcttagtgctgtcctcagtgtctattacaatccaaaccacagacacatgatccgagaaattgaaaagtactgctacttgttgattggactatcttcagctgcactcctcttcaacacattgcagcactccttctgggatattgtcggtgaaaatcttacaaaacgagtgagggagaaaatgttggctgcagtgcttaaaaatgaaatggcatggtttgatcaggaggaaaatgagagtgctaggattgcagcaaggctatctcttgatgccaacaatgtcagatcagccattggagataggatttcagtaattgtgcagaacactgcacttatgctagttgcctgcactgcagggtttgtactacaatggcgccttgcccttgtactagtagccgtcttccctgttgttgttgcagccacagttttgcagaaaatgttcatgactggtttctctggtgacttggaagctgctcatgccaaggccacacaactagcaggagaggctatagccaatgtaaggacagttgctgctttcaattcagaaaagaaaattgttggccttttcacttccaaccttgaaactccactgcggcgctgcttttggaagggacaaatttctggaagtggatatgggatagctcagtttgcactctatgcttcctatgcacttggtctttggtatgcttcttggcttgtgaagcatggtatatctgatttctctaacacaatccgagtttttatggtactcatggtctcagctaatggtgctgctgaaactttaaccctggctcctgacttcatcaagggtggtcgcgccatgagatcagtctttgatcttcttgaccgaataactgagattgagccagatgatccagatgctacccctgtccctgatcgccttcgtggtgaagtagaacttaagcatgttgatttctcttatccaactagaccagatatgtcagtttttcgcgaccttagtcttcgtgctagggcaggcaaaactcttgcccttgtagggcctagtggctgtggtaagagctcagtcattgcacttatacaaaggttctatgatccaacatccggccgggtcatgattgatggaaaggacataaggaaatacaatctcaagtctcttagaaggcacattgctgtggtacctcaggagccatgcctatttgctacttctatttatgagaacattgcttatggacatgactcagcttctgaagctgagatcatagaggctgcaactcttgccaatgctcacaagttcatatcttctctgcctgatggatacaagacatttgttggtgagaggggagttcaactatctggaggacaaaagcaaagaatagcaattgctagagcttttgtgaggaaggcagaacttatgcttcttgatgaggcaacaagtgcacttgatgctgaatctgagaggtctgttcaggaggcgttagaccgtgcctgctcgggaaaaactactatcattgttgcacacaggctatcaactattaggaatgctaatctcattgcagtgattgatgatgggaaggtggcagagcaaggctcccattcactgttgttaaaaaattaccctgatgggatctatgcacgcatgattcaattacaaaggttcacaaataaccaagtcattgggatggcctcaggttcaagttcttctgcaaggccaaaagatgatgaaagagaaggctaa

SEQ ID NO: 116490 - DNA, 724 bp, Glycine max
  Peptide Sequence Number=SeqID_233268
atgtctggcccaaagaaaagccgtggccgccaaaagatcgagatgaagaaaatgagcaacgagagcaaccttcaagtcaccttctccaagcgccgcagtgggcttttcaagaaagccagtgagctttgcactctctgtggcgctgacgtggctctcgttgttttctctcccggcgagaaggttttctccttcggccaccccaacgtggacgccgtcatagaccgctatctcgggcgggccccaccgacggagtctttcatcgaggcccaccgcgtcgccaacgtgcgtgagctcaacgcgcagctcactcagatcaacaaccacctaaacaatgagaggaagcgggccgaggagctcaatctaatgaagaagggagcccaagcccagctttggtgggcccgacccttggatgggatgagcattgcccagctgaagcagttcaaggcggcgttggaggagctgaagaagcaggttgcgcgtcttgctgatagggccatgcttcagagtgttacaaaccctactcttcaatttttccctggggtttcttcctcttccaattccaaccttgtgcatcagcaacacccactgcaaccccaggtgttccccccacacctgattcagccaccaatgcttcagcacttcatgtttcatgatgggagtatgatgcgccaccatggatttaataacatgggaatgggaggatatggacctgcttttgattcat

SEQ ID NO: 116491 - DNA, 2724 bp, Glycine max
  Peptide Sequence Number=SeqID_233269
atgggtttcttaatggttgccagaagcaacttacccttcattgcttctaaagaagaaattcatcaagaagagtatgactcagttatttcttttctgcaggatgatatttttccttttgtatcttctattttcttaagaaggcttcttcttcctggtgttcatcataatgctactttgtatgcaactctacttgagtatagcaggcatttgggtgaatctgagttgcaaacattaactgctgatgggctaaaaaaggagatactttcactcatagaacatgagaaaaaatccatttcactttttcggtctttggaagatattgaacggattgtggaggtaggctcttcagaagaagttagtgagctcacaggccttgtggatatatttaacgatgatctggattgtgatattctaattgaattgctcagatgtgttataagtttcagccaacagttgggcaaaactgcttcttctatattttatgaatctcttttaactacatcagtgatctcttctgaagatattgttcgctatattgttaagattctggaaactggatattgtatgtcaggcccagtgcttcaaacttctacttctggggatcatatagttgttctggagaaggagctagcagatcataaaagtttgaggaaactttccattgatatgtttttatcgcttcaaggcttgcacaaaaaggcttctgcatggggcaggattttaaaaattgcaaaggtgatgtttgaatctgcctgggactttcttctatttttaagctatttggtggacatcagtggtcaggtccacttgttacatgatgatataaacaaaatacagcttgatttagttccaatgcttcaagaaattatttttgaatggctaatcatcatcttctttaccatcacaccgtctgcaccagctgtaactgaagacttcaattctaaactttcatcattacaaatagataacaacatggggaaacgattatggaatgagaagcttggcagatatgactttacattggcttatacattcttgctcaacgttggaagttcatccttagatcatagccactattcttcagaacatttttcaaatgtgcagagctttattaataagacaagagacttcatcagttggattatttggggccagactggaggatcttctactttcttgacccgttctattgatcttgcatttatacttttcaagcatgaccagtatggtgctgctgagcaattgcttatgattgcggaagcacatttactaaaggagaagacatcccaaagtattcaagatgatgatggtggatggtgcatacgtcatcatcttctaggatgttgcctacttgcccaggtgcaatgtggattacatgcaacccagaaggataaaaaagtttctgaggccattcgctgcttttttaggtcttcatctggaaatggtgcatctgaggctctgcagagtttatctgatgacttaggaattccatatcttggttttaatggttgtacatcaattgctgcatggaagcttcaatactatcaatgggcaatgcagttatttgaacgttatagcattagtgaaggtgcttgccagtttgctcttgctgcacttgagcaagttgatgaggctctatatatgaaagatgacaagtgcacaaacaactcagttaatgaatcagtgacaactatcaaaggacgactatgggcaaatgtttttatatttgtgttagaccttggtcgttattatgatgcgtattgtgcaataatttcaaatccagatgaggagagcaaatacatctgcttgagacgtttcataattgttctttatgaacaaggagctataaagattctttgcagtaataaacttccccttattggtttagtggagaaagtggagcaagagcttgcgtggaaggctgaacgatcagatatttctgcgaagccgaacttgtataagttgctttatgcatttcaattgcaccggcataattggcgacgagcagcaagttacatgtacttgtattcagctcgtttgagaactgaagcagctttgaaagatagtgtaggcagttccttgatgttgcaagagaggctgaatgcactctcttctgcagtcaatgcactgcatcttgttcatcctgcatatgcctggattgattcattggctgagggaagttatcttgtgaatgaatattatccaagtaagaaagctaaaagaaccccagatgaacattcagcagctgataatgatgctgagcctcaaggttggcagtcctctattgatattgaaaaacttgagaatgagtttgtgctaacttcagcagagtatatgctgtcactgaattttgactttgttttgaaaaaaggaaaacatggagctctatcagacttggctgatcttcttgtccaaaacaatttatatgatatggcttttacaatccttctcagatttttcaagggttcaggactgaagagatattactcggtctttctctttagggaactggaaagagtgttgtctgctatctcattgaaatgctgtcttgacaaagtggaatcctcttgggttgaggaacacagtcatttattgacctcatcaaagcatgagatggttgcccatggttcacctgctacagtttccacaactccacaaactgacagaaacagttgttgggcaacactcaagctttaccttgttcgtatcttctgctaccattag

SEQ ID NO: 116492 - DNA, 924 bp, Glycine max
  Peptide Sequence Number=SeqID_233270
atgggaaccggttcgaccttggccgggaaagaagttccaatcgtcggaagcgacgccgttcgctggatcgatctctccgttccatcttcgtccaacattgccgccgtcgacggcgtcgccgcccttcccaccaccgacgaccgcgcctcctgcttcgtcatcggagatcctcctacttatctaatctggagaattcacaaagctcaacctcagtctctcgagttgctcgaactcgccgcttcgaaagagtttccacgcgtgggactcagattcacgttccccgacgcgctctgccccttcgctttcatcggcaaaaatgagatttctggtgcttctagattcccttacttgctttacgtgttgactgtgtctggcgtggcttacctattgaaaattcgaaatgtttctgcgtatacgtccgtttctgttttccccgtggatgaacttttggaggttaatgtgcgtgattacattcccaatcacgccacggcgataaccaccgtgatggcaaccgttggaggtcttgttgttggcacgagtgatggttctgttttctgtttccagctgggtgtagttgaccctagtgctcccggtttcatgcatgagctgagagatgaagccggaatcagtcgcttgtggggtttaatatcacgggggaaaatggtgggtactgtacaagagttggtaattttggagttgcacgagaaaaagtttgtgtttgtgcttcatttggacgggacgttacggatttgggatcttgcatctcgtagcagggtttttagtaataacatggggactgtgacaatggcagcaggattccatgatttgactcaaaggtttatgaaatttatggaaactggccaagcactggctggctttgatgttattccagtgttctgggagaccttttattttagtgtctag

SEQ ID NO: 116493 - DNA, 1929 bp, Glycine max
  Peptide Sequence Number=SeqID_233271
atggttttgaaatcaatggttgcttccgcgagcgatctaagtctcgtgagtgttgcagggaaccctccccttgatttgaagaatcgggttttcggtagccgcgtcatcagcctcggatttcgtttcaacaaaggtagtaaatggaaggggaatgaaaggtttaactttaaggttcgtgcagctgtggaagtgggtgtggagagatcgaagagcaaggctttggagggtggttttgggttggatgtggtttcagaggcagagttaacggtgaagggttttgcggggttgaggaagaccaagctcgtgtgcactgttggtcctgcttgcagctctatggaggatcttgagaacttggctcttggaggcatgagtgttgccaggctcaacatgtgccatgggaccagggagtggcaccgtgatgtgattaggaagatcaagaagttgaatgaggagaaagggttctgtgtttctgtaatgattgacactgagggtagtcagattcatgttgttgatcatggagctccttcctccgttaaagttgaggaaggttcaaattgggtgtttactgctgaacattatgagggttctcgtccattcactgttcaaacgaactatagaggtttttctgaaggtaccgaagtgggtgatgaacttgtaattgatggtggaatggcatgctttgaagtcacagaaaagactggtaatgatttgcattgcaaatgcatagatgctggtcttttcctgcctggagccaaatttagtttttggagagatggaaagcttgtgagggggaataacaagctccccactctatcgacaaaggattgggctgacattgactttggtatagcagagggagttgatttttttgccttatcctttgtcaatcatgctgattctgttaaggatctaaagatgtacctctctacgaagtcaactaaatccattaaagttttggcaaagatagaaagcttagaatcccttcataaactggaggaaatagtgcaagcttctgatgggatcatggtggctcggggtgaccttggtgtcgaaataccacttgaacagattcctacagtccaagaggatataatttacgtatgcagacaattaaacaagccagtgattgtagcttctcagcttcttgagtcaatggtcgagtatccaacgccaacacgtgctgaggtagcagatgtttctgaagcagttcgacagtatgctgatgctttgatgttgtctggagagtcagctattggatcatatggacgaaaagctttggcagtcttggatatggctagcagtagaatggaatcatggagtcgggaggaaaatagacaaagtcttgttagccaccatcaacttggagaatcattgccagaatgcataactgagcaaatatgcaattgtgccgttgaaatggccaacaaccttggtgtggatgccatctttgtgtacacaaagtatggacacatggcatcgcttctatcgcgcaaccgcccgaatcctcccatctttgctttcaccaacgatgacagtacccgcatggctctgactttgcaatggggtgttgtgcccattctggttgatttgtccgatgatgctgaatctaacatctcaaagtctgtgcaacttatgaaatctagagggttgatcagccaaggagatgttgttctagtggtctcagatgttgctccgacacgtgcctctcctatggctttccagtctattcaggaattaaagaggagaggtatgacccctacatcattgcttgatgattacaaacaaagcgactatggacttgatgaagaggtgtatgtgaatgaagaagatagaggtttcccaaaaagaaaagctgtctcaaccaatgttgagaggagtttagacaatcagagggaacgatctatggcactgaacagtgaaggtcttgag

SEQ ID NO: 116494 - DNA, 666 bp, Glycine max
  Peptide Sequence Number=SeqID_233272
atgaggctcaacggtgaaatctcaagtggagaagaagaggagaaacaaacgggaacgacgacgttttcgtcgcagaaagtggtcgttggctacgctttaacgtccaagaagaaaaagagctttctgcagccaagtttcactggcctcgcacggaacagggggataaactttgttgctattgatctaaacaagccactgctagaacaaggtccttttgatattatcttgcataagttgtcaggggaggagtggtgtgagattattgagttcactacttcagtactatggcatggaaaacaattttcatataggttaaaagccaataatgctgcacaccaaatgcatccatttcctaaaaaggattataggcaaaaacatccagaggtaactgtccttgatcctccggatgcaatccaacatttacacaatcgccaatccatgctgcaagatgtggtggatctgaacttatctgattgtcatggcaaggttggtgttccacgtcagctagttatcccaaaagagaaagacccctctagtatcccttacgaaatcactaaggctgggatgaagttgccattagttgcaaaaccactagttgtggatggcactgcaaagtcacatgaactatttcttgcttatgatgaattctctctttcagaagcttga

SEQ ID NO: 116495 - DNA, 855 bp, Glycine max
  Peptide Sequence Number=SeqID_233273
atgtcaaataatccgcaatatccaggcttacagcctcttcggcctcccattgctggttcactggatcctccgcgcaattttgttccgcctatgcctgttcaatttcgccctgctgttcctacacaacagtctcagcagttcatttccatgccttctcaacattaccaacatcaacctgttggtccgggcggtgttcccctgattggtgttggaatacctccccaaaatcaacagccacaattttctcaaccaattcaacagttacccccgagacctagtccgcagttaccacccccatcacaggcaattccaatgccggttgctcgtccaaacatgcacatcccatctgaatcaatgatgcagcagtctgattctcaagcccattctcaagctcctaatgggtacacacctggtttaggtggtccgggaatgccactctcttcgtcatatacgtttgcaccatccacttatggtcaagtgcaggctaattttaattctactggccaattccaacctgttcctcaaattcatgctctcacgggttcttcatcccaaagcattactactggtgcaactcttcagagcaatggtggacaacctttggttacaactgttatgcctttggctaccattgcccagccacagctcactaagaatggccccacagattggattgagcatacctctgctaccggaagaacttattatgccaaaatttcagctgactcgagcgttggagtgcctttgcaagtacccaacctacctctgcagtgtcttagcctcactggaaaggaagaccactgtctgttcaacttggatctcggtcatcgagagccatacctcagtcaacgttag

SEQ ID NO: 116496 - DNA, 453 bp, Glycine max
  Peptide Sequence Number=SeqID_233274
atgccacccaggaaaaggtgtgctagtgagccagtttctgatgaggcttctactcaaccccaaaacatagccctgaggggttgtggacgtggtcgcgatcatggtcagggaagatgtggtaggggtggtggaatgccagaggttgagattcctagagctacacataggaacccaacactagctcagttaactgctaatatgcaaaatatgcaagaaatactactacaattagtttatgtggttggggaacgaagccaacaacaagcaaaacaacaacaaccaccactgattcaatccattgtggcagaggttcccttgagtgcattcacaaaacttaatccaccgactttaagcggctcaaatgttcatgaggatcctcagacctttgtagatgagcgaagggatgacatgagaccatgctccttgcaagaccagttggatcacctcttttag

SEQ ID NO: 116497 - DNA, 288 bp, Glycine max
  Peptide Sequence Number=SeqID_233275
atgattagaacgagaggtttaggtcatgcattagatacgggtataggtagaggtcggggtggacagaatgagcatcatgtagatgatgttccccgatggcataggtctcccgcatccgatgttccttcgatgactatggatgtacctgcaactggtgtagaggacgttgttacgggatcagttgctgatgatgctgagggattcttaggtagactgcaggacccatcaatgctcacttcttttgcagaacatgttgcacacaacatatgggctggagaggcattataa

SEQ ID NO: 116498 - DNA, 387 bp, Glycine max
  Peptide Sequence Number=SeqID_233276
atggtgtccttgaccaagaaaccaaactgtgatggttggagtcccggagaaggagaaaataggtctagtggaagccattttgacccacaaggtgaaaccctaagagagcaaaaaggaggagagaatagggttgtagcgttccaggtgacgaaactggaaactgagggctggaacggactcaggaggagccgatggagggaacgacggcggcgcggcgcaattttggcgccgagatggcggtgcgtcgcaactccgttgacgacgcgagttggacggctggctcgcgcttcccaaggtgagcctaaccctggctttgccggagaaatggccgtcggaaagtggcgacggtggcgacggcgggtgacacttgctctgatgccaacttga

SEQ ID NO: 116499 - DNA, 1467 bp, Glycine max
  Peptide Sequence Number=SeqID_233277
atgagagagtgcatctcgatccacattggtcaggctggtatccaggtcggaaatgcttgctgggagctctactgcctcgagcacggcatcgggcccgatgggcaaatgccaagtgacaagacagttggcggtggtgatgatgctttcaatactttcttcagcgagactggtgctggaaagcacgtgccacgtgcagtgtttgtagatcttgagcccactgttattgatgaggtgagaaccggaacttaccgccagcttttccacccagagcagctcatcagcggcaaagaagatgccgccaacaactttgcccgtggccattataccattgggaaagagattgttgatctgtgcttggaccgcatcagaaagcttgctgacaattgcactggactccaagggtttttggtcttcaatgccgttggtggaggaactggttctggacttggttcccttctcttggagcgtctctccgttgattatggcaagaaatcaaagcttggtttcacagtctacccctctcctcaggtgtccacctctgttgttgagccatacaacagtgtcctctccacccattctctcttggagcacaccgatgttgctgtcctcttggacaatgaagccatttatgacatctgcagacgctctctcgacattgagcgtcccacctacaccaacctcaaccgccttgtttctcaggtgatttcatctttgactgcttccttgaggtttgatggtgccctgaatgtggatgtgactgaattccagaccaacttggtcccataccctagaatccatttcatgctttcctcctatgcaccagttatctctgctgagaaggcctaccatgaacagctctcagtggcagaaattaccaacagtgcttttgagccatcgtccatgatggccaagtgtgatcctcgtcacggaaagtacatggcgtgttgcctgatgtaccgtggtgatgttgtgcccaaagatgtaaacgctgctgttgccaccatcaagaccaagaggaccattcagtttgtggattggtgccctactggtttcaagtgtggtattaactaccagccacctaccgttgttcctggaggcgaccttgccaaggtgcagagggcagtttgcatgatttcaaactccaccagtgtggctgaagtgtttggccgcattgatcacaagtttgatctcatgtatgccaagcgtgcttttgtccactggtacgtgggtgagggtatggaagaaggtgaattttctgaagcccgtgaggaccttgcagcccttgagaaggattatgaagaagtgggtgctgagtctgatgtgtaccagtaccgatgtggttttaatttggatgcattgcttttatgcttcgctgctcctcctgattttgctaaggcagtgggttatagcagcagggtggattcattagtggtacttctatggaatttaactgggcctaaaatttga

SEQ ID NO: 116500 - DNA, 1435 bp, Glycine max
  Peptide Sequence Number=SeqID_233278
ggtagatgcaacaacaaactggaaggagtatactagtcctgatggaagaaagtattactacaacaagatcacaaatgaatccaagtggtcaattcccgaggagctgaagttggcccgtgagcaagttgaaaaagcaattgtcagtggatctcgtcctgaagcattgctgaattcccatcctcaaccctctccgacaccttctgcaactgaagcaacacccaacacagataattcaactttacccagtcaaggagaaccatcaagtcctgtttcagttgctccagttgttactacatctataagtaatccacaatctgagatgccttctggaccatctctgtctacttctgcaaatgctataactggagcaaaagtggacgaacttgaggcacctgtaaatactgtcacaccatcagatacttgtgtgggaagtgataaagctgttgttactgatattaacactgctgtaacaccaatgaatgatgttaacaatgattcagctcaagatactctaggttctgcagacagagttcctgtagaagataaagaagatggtaaaaatgatttgataggagagaaaagtaatgatgtggctgcagaaacaaaggcagttgagccagaacctccagtttatgcaaataagatggctaaagatgcattcaaagcactcttggagtctgtaaatgttggatctgactggacttgggatcgggtaggcaaagcagtgtctatatttgaaaatgatgaacgtttcaaggctgttgaacgtgacagagatcgcagggatatgtttgaaagcttcttggaggaacttctaaacaaggaacgagcaaaggtacaggaggaacggaagcgaaatataatggaatacaggaagtttttggaatcttgtgactttataaaggctagtacacagtggcgaaaagttcaagatcgcttagaggctgatgaaagatgttctcgtcttgaaaaaattgatcgcttggaaatattccaggactatttacgtgatttagaaaaggaagaggaagagcagaagaagatacaaaaggaagaagtgagaaagacagaacgtaaaaaccgtgaggaattccgcaaattgatgggagaacatattgcttcaggcattcttacagcaaaaactcactggcgtgattattatacaaaggtgaaagatttacatgcttatgtagcagtggcgtcaaacacctcaggttcaactccaaaagacttgtttgaagatgttgctgaagagcttgagaaacaagtttctcagccaagtccagctgaaaaatatagcgtcctccatcagcttgttgatgttctagctgaaagctactgcagaatgagtgctgaagaaagtgctgtcttggattctgcggaaacactcccaccatatttatccaagataaggattcccaccaaagcggcataa

SEQ ID NO: 116501 - DNA, 237 bp, Glycine max
  Peptide Sequence Number=SeqID_233279
gctcggataagattagtgggtggaggatacgcgaacagcgctatgcaatcagttcgtggggctccagattcgatgcgctacgcaatcaattcgttgggctccagattcgatggtggaggatgcatgaatgacaatcaattcatggggctccggataagatttgagggtggaggatacacgaaaagcgctaggcaagcaattcgtggggctccagtctcgatggtggaggatgcatga

SEQ ID NO: 116502 - DNA, 537 bp, Glycine max
  Peptide Sequence Number=SeqID_233280
atggtgaacgcgctggacctggcgatgcgcttccacgccgagctgcctgccaaagagaaaccgcagtttaccgacggctatgaaggctttttccacctgcacactattaagggatcggtagagcacgccgagctgatgtacctgattcgcgattttgatgccgacagctacgaacagcgtaagcagctgttgcaggagattggccgccgcgtcagtaaaggtctgcaggctgagtgctccatcaaggtggagatcagcgacagctatcgcaatatgcgggagaaggtggaaccgcatccgcacatcattgagctggcgctgcaggcgatgcgcgactgcggtatcgagccgaacgtgaagccgatccgcggcggcaccgacggatcggcgctgtcatggaaaggactgccgtgtccgaatctatttaccggcggctacaactatcacggcaagcatgagtttgcgtcgctgaatgtgatgccgaagtcggttgaggtgattgtgcgcctggccgcgctcgcggcggagaagaagtag

SEQ ID NO: 116503 - DNA, 207 bp, Glycine max
  Peptide Sequence Number=SeqID_233281
atgcaattcaaggaaacaactaaatcaactcaacaagcactccaaagtgtagaaatccaagttggtgagatggcagaagaagtgactcaatttatgtccagacgagaaaaatactttgtagaggttgaagctcaagaggaaagccttgtaaaagagcatgagtcaagagaaaaagatgaggagaaagatgaggaacaagcacaataa

SEQ ID NO: 116504 - DNA, 477 bp, Glycine max
  Peptide Sequence Number=SeqID_233282
atggagcaagccaccatctttcttacgagttcaggatttctcaaaaacctgcttgatggggtagttcgtcttgactaccacttgatgactcgggaagtaaggcttgagtcgttgggccaagggaatgagtgggctgagctgataacttcgtcaattactgagagatacaagagcaagggtgctcttggccttgatcgactcaaagatggtagtgtggttatggtcttcttgaaagctagaaaggcttggatgctagcctacgttgagcttctgaacttcttgtatgttggttgggctatgcatcacccgtatgacagtgcatttgtcggggttagctttaatcccctgttccccgaagacttcttccttgtccgccacatgttggggtatgctttgaaacttgaaaactatgtcgtccacatgtacctcgacatttcatatgattttttgtttgaagactcagtccatcagtcgttg

SEQ ID NO: 116505 - DNA, 372 bp, Glycine max
  Peptide Sequence Number=SeqID_233283
atgcagccaggcggcggcttgctgttccggctttttccgcagccagtcgcgttgaaccgcgtcgaaacgcggatgctgctgcaggcgattttgccaggcgtagtagagcaggtaatgctgcaggaattggcggtcgcgcgcatcgaagtggcggctgagcagcggctcgcaggcgtcgatcgcctctgtcagcgcagacgccggggaggcatcggtcgccagcgcttgccgcaggcgcggggcgaaatcgccttcgacaaaccgcgggctgcagcgcagggcccgccgcagccagtggatgaggcacaggcgttggtagagcacgctgccccgcagttggtagccatggtcgggatcgacggcgatctccag

SEQ ID NO: 116506 - DNA, 738 bp, Glycine max
  Peptide Sequence Number=SeqID_233284
atgcaaggtgtcatatgtcttaaaacagttaagcttcttaaactcgtccttagcgtaggatcgggtcacaggtctagacacggaagacttctagtgtttgacgagctactagaacgcgtgaaggagaaggaggagaaggaagctaagaagcgtaaacgtcttgcagatgatttttttcatctgctacattctaccaaggactttactgtgtcttcaaagtgggaggactgtagaccacttgttgaagatagccaagagttcaggtctattggagatgagagcctttgcaaggaagtatttgaggagtacattgcacagctaaaagaagaggcaaaagagaatgagcggaaacgaaaagaggaaagggcaaagaaggaaaaagacagggaggaaagagaaagaaggaaagggaagcaaagaaaggaaaaagagggagggcgtgaaagagggaaagatgaggcacataagaaggataaagcagacagtgacagtatggagttaactgaaatccaaacctccaaagaaaacaaaaggtctgaagatgataatagaaaacaaagaaagaagcgtcaaagtcctgtgtatgaaatggataaagagaagactaagaagtcaagacgtcatgcatctggtcatgaatcagatgaaggacgacacaaaagacacaagagagaccaccgcagagaaggagatcttgaagatggggaatttggtgatgatcatgtggatagatggtag

SEQ ID NO: 116507 - DNA, 153 bp, Glycine max
  Peptide Sequence Number=SeqID_233285
atgacgaagctgccggaacaagctgggcaagcttctgacgtcgggacggcggcgcgtggaccacacgcgccggaaaacgtaaaatttagagtactttaccatcagagggatcccatcatccttccacccatcttcccaagacctaacctttga

SEQ ID NO: 116508 - DNA, 306 bp, Glycine max
  Peptide Sequence Number=SeqID_233286
atgtctaatgaagcctcattcaaacccaatttgaatgactgggatttagccaagagcatgggagtaacttgtcaaatccaggagggcatagtggtctcaaagctgacagacatggaagaaagggacaaggaggaggcaaaaagtgggcctaaagagaaatctgtgggatcaaatcaggcagctgagaaatgtaaatttgggaggtttatggtgatcccgaagaaggtagtagataagttggtgaaactacagagatggttcctgtggggtggagatacagagcagaagattgcttggattagctag

SEQ ID NO: 116509 - DNA, 333 bp, Glycine max
  Peptide Sequence Number=SeqID_233287
ttcttcgggatctctcatctgttcatcacacccaaacatccacctgtcccacagcatgacacatacgtggagccagatatccctgaggtcccagtggcaccagaagctggaccttcacatgcaccttctgatgtggagcagcctagacatgcagtggatgcatgccaagcgattgcagaaaggttggagcgtctgctcaacctaaggatattaactgtaggcacagaggtacatgagatcatggaagactgcatcaggatcgctaggggggtcacatcaaatggaaatgtttatgttagggcgcgacgaaggcggcgcacgaatcagtcatag

SEQ ID NO: 116510 - DNA, 225 bp, Glycine max
  Peptide Sequence Number=SeqID_233288
atgggttgttctcatcatcaagagcaaaggtgtgtgaccgttcttgttcaagatggcatctatgttaactttcaaggtgtctctggcctccttgagacgtttcagtttatgcaacagctccaaggtctttggacgataacagtctatatgattcaagacagttttatcctttcaagagctgcaaaagctcctcaagacaagtgtacgcttcattctgctgcctaa

SEQ ID NO: 116511 - DNA, 1050 bp, Glycine max
  Peptide Sequence Number=SeqID_233289
atggtgggtttttcccgccataaacaaaagaccattctttctctccctgaaattgcaacgcaaccgtttctgacgaagacaagaacgataacaaaattgaaatcgaattgggtgcgaagtgaaatgttgcaaaccctaggaggcgtaatccctcgcttcgtgagtcgctcatggctccgaaacctgacggtgcgtgcaatggcattctcttcctcctcctccgattatggagaccagtcacgtggtggccttccccgcttctactccgaaactcttcctccttccaaggcactttcttcctctttctttctgctcctttcacaactctttccacttagcttcatggagggtagtgttatacgcgtgcaaggtgatgaattctggcatatgacaaaagttttgaggttaaccaccaatgatagggtacagctcttcaatgggaaaggaagtctggtagaaggatgcatacagagcattgatcgaactggacttgattttgttgcattgaatgatttgatatcaatccctccacaaaatacacaattgcatgtatttgctggttttggtactctgaagggtggccgtgctgactggcttgtagagaaatgcacagaatttggagccaatagtgttactcctctattgactgaacattctccgtcaatctcagaaaatcgggtggacagattgaaacgtgtcattttagcagcatccaaacaaagtcaacgactgcatgaaatggtcttgaaacatcctatagagattgatgaccttttgcaccttattgcgcaatcaaagctatctcttgttgcaactgcgaaggcaactcctgttcttagtgcattggcatcgttggaaaaggaaactagtggcttaatcataattggaccagaaggagatttcactgagaaagaagtgagtatgatgatggaagcaggtgctacagctgttagtcttggacctcatcgtcttcgggttgaaactgccacgatagcacttttggcaactgtcatgttatggtctgactcacagcaaatttcagtctgttga

SEQ ID NO: 116512 - DNA, 378 bp, Glycine max
  Peptide Sequence Number=SeqID_233290
atgtatgggcccgtggccacttcaaattcagccacatctcgggctggattgccaaatgacagtggggactctgttgttacttttgatacttgttcgaggtggattgatggtatggctaaaattaccaatgcctacgacctttctgcaaggaaagttatccatacttttggagatattcataagggacacactgaagattatattgcacagaagaccctgcccgtaactctcaaatacatggacacactgaaaggatcaatggctgaaagtgtaatgccttgtcttttctcttttacagatccaacctatatgatccaagctattccaagcaggtctggtagtagcttgagtggattcttaacctggtggactccatga

SEQ ID NO: 116513 - DNA, 288 bp, Glycine max
  Peptide Sequence Number=SeqID_233291
atggagcctccaatctggatcaatccatcagcagtgaacaatggaaaaaggaagagcgtaccattgtcgggatcggaccaagggaaaaaaccgaaggaatcgtcgccggagatgttaccggagggggaggctttgggagcgaaatggagaagacgcggtgcggaagaaggagagaaagggaacgagttgttgaagaagaaggtcttggaaggagaacgggacggagcgaaagagaatctgaatgtggagaagcatattgcagcagcagaggtttccgccattggaacg

SEQ ID NO: 116514 - DNA, 855 bp, Glycine max
  Peptide Sequence Number=SeqID_233292
atggcatctgttaatttgtctcaaacaggtttgaaaagatgtgggaagagttgtagactcagatggcttaattatctcagaccaaaccttaagcatggggagttttctgaaggtgaagatagaataatctgcactctctttgctagcattggaagcaggtggtcaataatagcatctcagttgccaggaaggactgacaatgatatcaagaactattggaacaccaagcttaagaaaaaaatgatgggagtgaaaatgaacccttcagcactgaagaaacctcaccaagttaacctttcatccatgcttcaaaactcaacaccatcatcacccttcacctcattatccttcaaaaacaaccacaacaactcttactactaccaaccccatttgccctttacaggctccgagtccatgacatattcaagtcttctcagtgacaattattccacttttgagagccttcagaattaccaagttaataatagtggctttatgttaggatgtgaaacaagttgcagctcttcttcagatggaagttgcaacaacaatcagatcaatcatgtcaaggaagcagaacttggatttattggtgatggaaccttttgtgaccagataataggtggtggttttagttacctcaatagtggggtggaactggaagatactcaaaagttggtgccctccaatgctggtaaggttaatagtggggtgacagatgaagaaagtagattatggggagaaagtccattagagtatggtctagaagaaattaaacagctaattagcactagtagttgcaacaactttatgcttgatgacagcaagacaggggaaatggccatgtactactga

SEQ ID NO: 116515 - DNA, 858 bp, Glycine max
  Peptide Sequence Number=SeqID_233293
atgcctcctgctccattttctgatgaagtgtcaccatctcctctatttccatggcattacaataatcctctgcatgcagcttcacctggtccttcaccttcaacaagtgtgacagctccaatggtgaaggtgaaggtgtcggtgttcattgttgcggtggttggttcgtcgtctgcagcatacgagatcaagttgattcgtaagcttattgtggatcaagttgatccgtatacaactactttcatgcgtaacctttgcggatcatctctaacactattatggatcatctcattcctaacatttgtctactgcggatcaactcaaaggctatgtggatcatctacagctaacctatgtttattgcgaaacaacgaaaaggctatgcgacctatgtctagtggggatcaactcaaagcctatgcagatcaaaagaagccatacaaaatgcaccaccatgcgtgcaaaatcaatggggatgaagaagaacgacatagtggcatgaaggagaagggttgggctgctaaagaagtgctgaagaagaagaagaagaacgggcggaagaaggagaaaacgcagtcacagcgtgaaaatgggctactggggagggcttcattgaagggaactaagcgcttcgactacctcacacgtgattcgaaacatagctcttcaccgagggaaggcaaacttgttgacggagggcggccggggaagttcgagagagctcaagagggagtaaggctagttttttggttgcgcgcgacaatgttgttcttcgcgaggattgccaccaagacacattttaaggcatttttcaataaccgtcttagaatgtgcttcgtaaaatacatttttcagtag

SEQ ID NO: 116516 - DNA, 501 bp, Glycine max
  Peptide Sequence Number=SeqID_233294
atgcaccaccttcccaatcaaccgatcctcgaaggaggaacatgcagacaaaaacgcgacgaacgtatacccatccggctcaacaaaaacctgtgtcatctccgtaataaccctgagagaacaaccagcacgacccttacgcacaagcccgttaatcaccgtgttataagaaacagaatccctcacaggactttcatcaaagacctttcacgcattaccggcatccatttgcaaaagcgcgttgacaatgaagacattggactcaaatccactttttataaggtgggtatgaacctgatggccgagttttggaagcaaaagctaggcgcaggacttgaggaggaaggggaaggggaagagagagaaggctctgatgaagaggttgaagaggaagaggtcggggttggggatttgggtgaagggaaggtgggagtggcgaagaaggagatgtgtgatgtcatgaggaatgggtcgtggtggcgccctgtgaccaccatttga

SEQ ID NO: 116517 - DNA, 1029 bp, Glycine max
  Peptide Sequence Number=SeqID_233295
atgtcttcattgtcaacgcgcttttgcaaatggatgccgggtcgtgctggttgttctctcagggttattacggagatgacacaggtttttgttgagccggatgggtatacgttcgtcgcgtttttgtctgcatgttcctccttcgaggatcggttgattgggaaggtggtgcatgtgttggtgtataggaaattggattgtttaggtgggaatgtgttgttggtgaatgttgaggttgctagaaggttgtttgatcaaatgggggggagagatgtcgtttcttggactgctatgattagtggttactgtcatgctgggtgttttcaagaagcattggaattgtttgtgcagttggaggaattgaggatggaacctgacgaggtcgtggcagttgctcctctttctgcgtgtgcatggcttggtgcccttgagttgggaagaaggatccaccacaagtatgatggtgagagttggcagtgtggttaccacagaggattcgcttgtgctgttgtggatatgtatgccaagtgtggaagcatagacactgctttggatgtgtttgtcaacacaagcgatgatatgaaaactacttttctctataactccattgtgtctggccttgctcatcatggccgtggattaaagccagatgaggtcacatttgtagcacttttatgtgcttgtgggcatagtggtttggttgatgaaggaaagaggctgtttgagtccatgttgagtgagtatggtgttaatcatcagatggagcattatggctgtatgattgaccttcttagtagggctggtcatttgaatgaagcatatcgtttgattcaaaatatgctgttgaaggccaatgctgtgatatggagagcattgttgagtgcttgtaagcatgatcatggagtccgttatgtgatgctatctaatatgccagctctcatggaaaagaatgatgaagctgcaagtgtgagaaaggcaattgataatgttgtcatccagaagcctctggctggagctacgtggaaatga

SEQ ID NO: 116518 - DNA, 1179 bp, Glycine max
  Peptide Sequence Number=SeqID_233296
atggaaattaagtggagaaactatgacacgtgtcataatctggagctgtacattaatccaacggtccaaatgtcagcaaaggaaggtctcaattttgttcaacactctcagagcccttttctgctcccacgcatatgcataccgcacaaccacgatcacctttcgagtaatatggagatcacgagcagccataacagcggcagcatgatgtggtttttcaaagataagggctttgatgacaacagtgcacaaggaatgttccgaaagtgccggcgcctcgagggtgtgcaccaagaaagagcaagtgagaattgggactatttgagaagcattggcattgaggaaaggaagctaccctcaattgtttcaaaatgccccaaaattcttgcattggatctttatgagaagattgtgcccactgttgagtgtctcaggacattaggaacaaaacctaatgaggttgcttctgccatagccaaatttcctcacatactgtcgaacagcgtggaagagaagctttgtccccttttggcgttctttcagactctaggtatccctgaaaagcaaattgggaaaatgatactgctcaaccctaggcttgttagctacagcattgcaacgaagctgacggaaattgtgaacttccttgccaaccttggtctcaataaggatggaatgatcggaaaagttatagtcagagacccatatattatgggttatagtgtcgataagaggctccgccctacttcggagtttctcaagtcaatagggctgagtgaggcagatcttcaggcggtggctgtgaacttcccggcaatcttgagtagagatgtgaacaagcttttggtacccaattatgcatatctaaagaaacgtggatttgaagacagacagatagttgctttggtggttggttttcctcctatcctgatcaagagcatccaaaattcgttagaaccaagaatcaagtttttagtagatgtaatggggagacaagttgacgaagtcattgattatccttgcttctttcgtcatggtctgaagagaagaatagaaccacggtacaaacttctaaaggagaggagtttaaattgtagcttgagtgaaatgttggattgtaataggaagaagttcttcatgaaatttggcttgttagaagggcatgccttgagtaactag

SEQ ID NO: 116519 - DNA, 1893 bp, Glycine max
  Peptide Sequence Number=SeqID_233297
atggacagtgtgtgggtgtgctacttcccgagctgcaccatctttccctgtcgccagtgcaagctctctccaacgcaccttcttcaatcttctacctcaatctctcttctccgagtacgtgcttctcaaaccacaagagccataacaaggaaaagtcgaaggctgaaaagcgacgccgagatccgcaacgatatccgcgaattcctcaattcggttggcctcccggaggatcacattccctccaccaaagagcttctgctccacggatggaatgacttggcaaacattgtcagaaggagagggcataaacaaattcaggagcttcgaacaagaagctcattgaatgatgatgctgattttttgagtgctgaaactagcttagatgagggattggatgctgcaaatggttttgaagatcctttaacaggccagagtgagaaagtggacagtttggttgatgatattgaagctttgacagagattcttctaggaagtagttctggtagtttgtatgttgactctagttcaagtttaggtgaaggtactaacattgctgaagaagcctcaactaatattgtagaggatggtcttagtgaagttgaagatcatgctgaagtggtcaacgatgtgacggaggggaatttctacccaactgaattgactagtgtggataatgattatgatagttccatcatgcgtacagaaatttctggtgaattaccgtttgaggcagtgtcttctggaaattctgagtttgaggatagtctagtaggcaaaatggtgggagagataaccttgtcgttgacagaaagccattccaacacttcatgtaatgattccaatcttgacactgaagacaaagagtttagtcatttggaaccattagttggtttccctttggagcaaaaggacttgggtgcattagaaggtctgaatgacagcaaagatgatattgttgaggatgttacaacaacctctaaagtttctgttagggaaaatttatctggtgacaacaaacttgattcagttgttcattcagcggctgacagcaattctacaaatcttgacactttggccaacttgtctttgaaggaaaaggttgcaaattttattcagaatggagatttggatccagttgaagatcatgtctcttgcatttcaaatggggatggtcctcaagaaagcaaagagtatattgaatccaaacttgttgtgtatatgccaccaggtacccatcttcctgaagataataatgtcatggctcatgggaactcattgacatccaagcaagttgttccatctggagcattggatttggatcagcctctttgggatgatcacttgccacacgaagatgtaactactcatttcaacaaggacttggatactgaggctccaaaagtgccaaacgaaattgagataaatcatctcaagttcatgctgtatcagaaggagtcggaactgtcttggctgaaggaacagattgacaagaaaaagcttgctttgtctgtcttgcaaaccaaggcagaggcagaaatcagcaaagccagaaaacttatatctgaaaaagatgcagagttacacgttgctgaaggaagtctttcagaactcaaggaggttcagattgagttctgtggtgatggtgatgttgtggagctggctggtagcttcaacggttggcatcaccgaatagaactggatcctcaacaatcaactagtgctttagaccttgatggatcaaggagttccagatgttggtcaacgatgttgtggctttatcctggtgtatatgagatcaaatttgtcgttgatggcaaatggataacagatcctcaacgggagtcagtaacaaggggtcacatacgtaacaacattttaagagtagatagatga

SEQ ID NO: 116520 - DNA, 351 bp, Glycine max
  Peptide Sequence Number=SeqID_233298
atggcgacatgtgttgggactctagaagagtttctgatggtggtgttgggggttggtggttgggtggaggtggggcacggtggtgttgagtggctgactgcaggggtagttttgggtggtcttggaggcatggcaatgaaaccccatgcgtatccgtccaaatccgtcccgattttgataggaaatacccaagttgatcggacggggatacccatatccgacaagtacggggatggagtaaccaattttaactcatcggatatcgggggagtcgagatcggaaagggaaacaatacccgtctctgccccgttgccatgtctaatttaaagtgtgcacatgtagccaaataa

SEQ ID NO: 116521 - DNA, 303 bp, Glycine max
  Peptide Sequence Number=SeqID_233299
atggcggatggcagaacatggcaaaaggcccaaattccgccttataaacatgccactgtgccttatggtgccgccatggcaggcctcccttcacaaattagctatggcgacatggagcttccatttgaagtggaggatgtccccactaatgaccttgctttcaggagtcacatcagccataccatgattatttacaatatgcataaaccttgtgaggacatggaggagaaggctgaggcagatgttgaaccagttccagcagatcctgttaagcctggaaatgtagatgtcaagcaagattaa

SEQ ID NO: 116522 - DNA, 2133 bp, Glycine max
  Peptide Sequence Number=SeqID_233300
atggtttctgatagatcaaaatctgtgagatttcaagatgaacttgagacaaataagttaatggacaacaacaaagaaagtcacttgtcaatggtgtcctttaatgaagtgagtaatgataaacaaaagggtgggaaggatgcaataggcaacaagtcctctgaggatggaagagaactttcaagggtcttctctgaggattatgatgcagcagagattttggtattggatcctaggggacatagagtaaacacatggaacaaaattttcttagcggcgtgtttgctttcgttattcgtggatcctctattcttttacttaccagtggctaagaaagacaagtgcattgatatgtcagttggtcttgaagtgttcctcaccataatccgatcattgattgatgcattttacattattcagatttattttcggtttcaaaccgcttatattgctccttcctctcgtgtttctggtagaggagagcttatcatagactcttcaaaaattgcatcgaagtacatgcgaagagacttctggcttgatctaatggctgctcaaccacttccacaggtattgatttgggcagtaattccaaatctaaaagggtctcaaatgattgcttcaaggcatattttacgccttgcttccattttccagtacctcttgagattgtatcttatttatcctctatcatctgaaatcgtcaaggcaaatggggtaatgatggaaaaggcatgggctggggcagcatataatctgatgctctatatgctagctagtcatgttttaggatcctcttggtacctgttatcaattgaacgccagaatgaatgttggaagaaagtttgtacactgcagtacccacactgccagtatcgttatcttgattgtcaaagcatgggtgacccggataggattgcttggttaagatcaagtaatctctcaagtctatgtgatcaaagcagtgatttctttcaatttggcatctttgctgatgctctcaatttggaagttacggcctctaaattcttcaacaaatactgttactgtctctggtggggactaaggaatcttagctctgtgggacagaatctcttaactggcacacgtgttgcagagatcaattttgctgtgatcattgcagttcttggattggtgctttttgcattgcttataggcaatatgcaaacctacctgcaatccaccactacacggctagaagaatggagaataagaaggacagatacagaaagatggatgcatcacaggcagctcccccgttacctaaagcaaaacgtgcgacgtcatgaacaattcagatgggttgctactaggggagttgatgaggaaactattctcagagaccttcccatagatctaagacgtgacatcaaacgccacctttgcctcaatctagtccgacaaattaatgaggtaccactatttgatcaaatggatgaaaggatgctagatgcaatatgtgaaaggctgaaaccttctcttttcactccaggcgcttgtgtggttcgcgagggtgacctggtgaacgagatgcttttcattgttcgaggacgcctagattcttgcaccaccaacggtggcagaacaggtttcttcaacacctgcagacttggctctggtgacttctgtggtgaagagctcctgccatgggccttggaccctcgtccaacggtagtccttccttcatcaactcgcacggtgaaagccatcaccgaagtggaagcctttgcactcattgcaggggacttgaagtttgtggcagcacaattcagaaggctgcacagcaaacaactgaggcacacttttaggttccactcccaccagtggaggacttgggctgcgtgcttcatacaagcagcatggttcaggtataaaagaataaaggagacaagtgaactcaagagaaaggagaatctgatgatggcctttgttcctggaacaactggctctgaacatttctctgcacctcttcaggccccaaagggcacaatgtatgctgcaaaactagcttccagcccaaggaaaggtaggagcctaagatatgggcctgaacttgacattcttggttcattgaggaagccccttgaaccagactttactgatgatgagtga

SEQ ID NO: 116523 - DNA, 222 bp, Glycine max
  Peptide Sequence Number=SeqID_233301
atatcaagcatcgcacgcagtcagcgtcaggtcatgcatcaattggacaatctcaataatcttctcagggggagcttgggggagaagtctcgcccaacaagaaccaacagcgggaaaagcatcaccatgtcatcggattccatgggagcttgtgttatggcggtggtcacagttggttgtttggggatcttcttgatgaagggttttttgaacaaaaagtga

SEQ ID NO: 116524 - DNA, 729 bp, Glycine max
  Peptide Sequence Number=SeqID_233302
atgatggaaagggataatgttgaacaccatgacttcgttcaagtgttgcgtcctgtcaagacataccactttgatgatgcttgtgtgtacttcacaaaggatacgaatacttatgccttcatcactaggttgaagaaccttcccatcatcttccatgaaactacttattatctaacaaagatagatgaaagggacttcagagatcatgctaaagttgctggcaaagctgtggatgagaacattgttaatgaggtcatcattgatctcactaacactggtgtcatggatgagaactcaaaagcgtccaaggaagctcaagctgatgaggttataagccgacaacaggaacctatgttcaagaagtcagaaacctcacatgaagttatgtccaaggaaaaagatgtgcctgaagtagtgattgtctattccgcaagctcaagtcctattcccatcaagtatgcacctccaaacgatgtgaccagagatcaagttcaagatatgattagtcaagccatggacacttttgctgagcgacaaagacaagagaattactgttgtggcacccctgttgttgcaaattttattacaacactagttgaacgtccaactccatccattcagcaaccacctgctcttgatcaaccaccaacaagtgttccatttgtcgctgctaaacatacactatcagcaccaaaacatccttttccatcaccacaagttcaacagtga

SEQ ID NO: 116525 - DNA, 213 bp, Glycine max
  Peptide Sequence Number=SeqID_233303
atggtggtgatggagatgttcgacgatgttggggtcacatatttgagggagagaagaatgcgcgcaatgtttggtggtttgatggcggcgacgctagggtggtgtttggtagtggttgttatgggtttgggagaaagggatagaaaacgtcttttagcctttattaaatttaggccctcatcctttcaaaatagtaatcatcatctattttag

SEQ ID NO: 116526 - DNA, 225 bp, Glycine max
  Peptide Sequence Number=SeqID_233304
atggaagaagaatattccacaaataagccaccactattcaaaggcatcaaatacgattactggaaggaacatatgatagctcatttggagtttattcatatagacctctgggagattgtagaacatggcaactacatactactggacaatcagttgaatgaagtcccaaaaacctcttggacaaacactcaaagacaaaagtttccattgaaatctaaagcttga

SEQ ID NO: 116527 - DNA, 147 bp, Glycine max
  Peptide Sequence Number=SeqID_233305
atggacttcatggtttgggagtggaagatattccacattttaggtcagagtgagactacttcgaaacaggatggggtttctgcttcgaattcgaagaattttaattctgttgctactaagcttatctggtttgaagttaattgctga

SEQ ID NO: 116528 - DNA, 251 bp, Glycine max
  Peptide Sequence Number=SeqID_233306
ggtacatccacgtggttgttcaaagacaacaagggatggcacatcccttgtggatctttgctggtaaaggtttttacaaggttgaaaagaaatctcaaggaccgcaggttgcttggggactggatgtaggcacgggtgcagcccccaaaattccttgggttttgaaggtgcagcccccaaaattccttgggcttggtccttccttggataagagtgaaagccacaagatttggaagaaggctttcttttaa

SEQ ID NO: 116529 - DNA, 261 bp, Glycine max
  Peptide Sequence Number=SeqID_233307
atgaccggtttccatcggttttttggacgttttccacaaataaacattggtggcgactccgcacattttcttcctttggaagacgcactcgtgagcctcgcctcactcgcccgcaaaagggtaggttgcgacagttggcgactccactggggattgttttcacccacgggtttgagtaaaaaggggccatatacccgggtccatgggaatttaaggagtggaggtgaatctatggtcatgctaggtctccgacttgcttga

SEQ ID NO: 116530 - DNA, 147 bp, Glycine max
  Peptide Sequence Number=SeqID_233308
atgaatctggggatcccacagtcatgtggctccgcatgccaccagactcttgggtcacgcatttcgtttctaaacgaccatatagaggaaacactgggtccaacaaagataggagaaaatcactcaaagtgtatcaatctgacacag

SEQ ID NO: 116531 - DNA, 654 bp, Glycine max
  Peptide Sequence Number=SeqID_233309
atgccccgtcgccctctcctgctagcgctgttgctgctgcccagcctgtggcccgggctggctgccgcgcgcaccgtctaccgctgcgtgcagggcaacaccgtcagcctggccaccgcgccggaacccggttcacgctgtaccccgaaggaaatcgacgacaacgccatccagaccccgaacctgtggggcaacatgggcgtgttcagcggcgtgctgtacgagcgcgagcaggatggcgcgctggtctactccacccgcaacctgcccggctcgcgggtgttcctgaagttcaccatggccacgccgccgggcgagccggcccacgaaggcctgggcaaggtcggcaagccgcagctggcgcagcacgccaaacagttcagggccgcggccaaggctacgggcgtcgatgacgcgtggctgcgcgcgattgcccatgctgaaagcaacttcgatgcgctggcggtgtccagcaagggcgcacagggcgtgatgcagttgatgccggacaccgcgcaggagtacggcgtgaatgatccgttctcgccccagcagtcgatcgatggcggcgcccgctacatgcgcgcgctgctgcgtcgctacaacggtgatcggccgctggcggcggctgcgtacaacgccggcatcggcgcg

SEQ ID NO: 116532 - DNA, 534 bp, Glycine max
  Peptide Sequence Number=SeqID_233310
atgtttccaaaggattccttttgggataggtttccatatttcttgccgtgctttataatatcagcttttgcgtttgcatcaggaattgcttgcatttggcttccagagacccttcacaaccacaaaagtagcagtgagtccactaacagtgttgaagctttggaaatggaaagcaatgagactaacaacgataagatgatatctgcatcattgcaagagacccttcacaaccacaatggtggtagcattgagtccactatcaatgtcaaagctttggaaattggaagcaatgaagcaaacaaagacaagacgattcaaaaagataaaagcatcttccaaaattggcccttaatgtcatccatcattgtttactgtgttttttcactacatgatgttgcttaccaagaggtagtgttcttacttaatgatttttctattttgactctctctcttacttatactaatttactatccatttaccattctaggttttctcattgtgggctctcagtcccagaagattgggtggtctga

SEQ ID NO: 116533 - DNA, 1308 bp, Glycine max
  Peptide Sequence Number=SeqID_233311
atggaagaggaggcatttgaaaaaccattgttgaagagacagtatcatgagaactgtcctggttgtaaggtggatcaagccaaggagctcaaaaaggatgtttcctttagaaacctttcttatatatggttggcagtgttatgtggcacattgcctgtggcatcactctttccctttgtttatttcatggtgaaggattttaatattgcagaaacagaggaagacataagtacctatgctggatatgtgggatcagcaatgatgcttggaaggtctttgacgtccatattgtggggtatggtttctgaccgctatggtagaaaacctgttataattatagggattatcactgttgtcattttcaacacattatttggtcttagcacgaatatttggatggctgttagcatgagatttcttcttggaagtttaaatggtttacttggaccaataaaggcttatgctactgaaattttcagagaggaggagcaggctctaggactctcaacagtggttgctgcttggggagtaggtttagtcattggtcctgcattgggaggttatttggctcagccagtgttgaaatacccacatatatttccaaaggattccttttgggataggtttccatatttcttgccatgcttattagtatcagcttttgcatttgcatcagcaattgcttgcatttggcttccagagacccttcacaaccacaaagataggattgagtccactaaaaatgttgaagctttggaagttggaagcagtgaggcagacaaagacagaataatccaaagagataaaagcatcttccgaaattggcccttaatgtcatccatcattgtttactgtattttttcactacatgatgttgcttaccaggagattttctcattgtgggctctcagtcctttaaggttgggtggtctgaactttacaactgatgatgttggcaatgttcttgcaatatcaggtcttgctattctagtcttccagcttaccctgtaccgattggtgcaaaaagcttgtggacctgttgctctagttcgtatagcaggggtgttatccatacctctcttgcaatgttatcccctcatgacaatgttatcaggcttcacactggacatagtgatcaatattgcctccattctgaagaatgttttgattgaggcaattgctactagtttattcattctgcaaaataaagctgtggaacaacaccaaagggggacaaaaaatagtattgctatgactggtatgtcagcattcaaaacaattggtcctgctagtgccggtgcattgtaa

SEQ ID NO: 116534 - DNA, 570 bp, Glycine max
  Peptide Sequence Number=SeqID_233312
atgggattttatagacaaacacatttcctttgtaaccttctatctccaagaacagcacttgaacacaaactggtatacattaacaagaggccatatggtattgctattataatcttccagcttgccctgtacccatcagtgcagaaagcttttggacctgtcaatcttgctcgtttcgcaggggtgttatccatacctctcctgcaaagttatcccttcatgacaaagttgtcaggcttcacactacacctagtgatcattattgcctccattctgaagaatattttgacagagtcaattgcaactagtttattccttctgcaaaatagagctgtggaacaacatcaaagaggggcagctaatggttttgttatgacttgtatgtcagcattcaaaacagttggtcctgctagtggcggtgcaatattaacttggtcagaaaagcatatacattcttttttcctgccaggcacccatatagtcttccttgccctgaatgttgttgaaggacttggagtactgttgatgttcaaaccattcttgagtgtgaagaagaaaacaccatcatag

SEQ ID NO: 116535 - DNA, 651 bp, Glycine max
  Peptide Sequence Number=SeqID_233313
atgtgggaaaaacttgcttcaccttccatggtacaagtcccgaatgatgctgagctgcttgaagatatcattgatcatgtgttgaagaggttgaataagaaaccaattaataactcaaaaggacttcttggaattgacaaaccgattgcagatttagaatcattgttacgtcaagagtcaaaagatgtacgcgttattggaatttgggaagatgtgaaaattaacacaacaaatgggttacccaatgatattttgagaaggattggtcgtatgaagatttttattgttcttgatgatgtaaatgattatgatcaagtagaaaaattagttggaactcttgattggcttggatcaggtagtagaataattataacagccagagacaggcaaattcttcacaacaaagttgatgatatatatgagattggtagtttgagtattgatgaagcaggtgaactcttttgtctgaatgcctttaaccaaagtcctcttggagaggagtactgggactacttgctcctctcatattggatggtcgattatgccaaaggtgttcccttagttcttaaagttttaggtcaacttcttcgtggaaaggataaggaagtatggaaaagtcagctggacaaacttcaaaaaatgccaaactaa

SEQ ID NO: 116536 - DNA, 787 bp, Glycine max
  Peptide Sequence Number=SeqID_233314
atggggacgaggggttgcattagttacaatctcgttcttgctataaggcaacttggctaccctatgagaggggcaccactagaggaagagctcgcgcctgtcatttcacgaggtttcaataagaccaacatggagacgcttcggaaggtccgcaagacaggggaggtgttgcaaaagaaggacaaggaactcaggggcagtaacaatgggcccatcggtggctatcgtaaaaccactaaaagagaggaatttgaggcaccggaggaagacgaagaagtacaggcccttagggcggaactcgagcaagcccaaatagttaaagaaagggcttgtagggaagaacacggtcggaacaagttccgaggggctttgtggggtagcaacagcgagcttaaactccaaagagaggaaagggaccaatcacgagtagacagtttgatcttgaaagatgagttgaaggcttgctcgaggtccaagagaagtttgtctcagcggttatgcgagacagagaccaacatgttagctatcatcaccaagtaccaagaagaactaaatctagccacggtccatgagcatagggtagcggacgagtatgcccaagtgtacgtggaaaagaaggctagaggaagggtgatcgactcgttaaaccatgaggcaaccatgtggatggaccgatttgctcttaccttgaacgagagtcaagaacttccccgattgctagccaaggccaaagcagtggcggacacctactccgcccccgaggagatccacggacttctcgactatt

SEQ ID NO: 116537 - DNA, 256 bp, Glycine max
  Peptide Sequence Number=SeqID_233315
gcaggaggctgctactccagagagatcaccatatatttcacctaatccaccgtcgtcaatggtggttcaatattctcctcagcagctagtaaaccctcctacactagtgcatgagataccagcagacccatcaactccattactggagattccagaggaccctgccacaccagttctgggactgactaccactcctccagacactcctttgatatatttttcagatgaggagggcactcaagatcaggacacctag

SEQ ID NO: 116538 - DNA, 606 bp, Glycine max
  Peptide Sequence Number=SeqID_233316
atgaatccttcctttccttcaaaatcctttatgtatgttgttcttatcttttgctttcttggtgccaccagattgtatgcaagtgacccttatctaacactggattactatgcatcaagttgccccaccgtgtttgacattgttaggaaagaaatggaatgtgcagtgctttctgatccccgcaatgcagccatgatagttcggctacacttccatgactgctttgttcagggctgcgatggatcagttttgcttgatgacacaatcacacttaaaggtgagaaaaacgccgctaccaacatccactctttaaaaggcttgggaattgttgataagatcaagaacatagttgaatcagagtgccctggaattgtttcttgcgctgatattctcactattgcagccagagatgctgttattctggtaggtggaccttactgggatgttcctgtgggaaggaaggattctgtcactgcaaattttgatcttgccaacaccaatcttgccactccagatgagagccttctgtctatcattgccaagtttctttaccaaggactatctgtcacggatatggtagcccttgcagtatctatcatcatttaa

SEQ ID NO: 116539 - DNA, 192 bp, Glycine max
  Peptide Sequence Number=SeqID_233317
atggtgtttggtgatgagtttcgtggtggttcgcggcggttcagggaggtaggggaacaaagatgtagtgtatttgaaagtggtggaggtttcgccgcccttgccggctttggtgtcactacggcgacaacgacggtgacaaaagtagcaagtgctcgggtaggttgcagcggagttgagactgagaactga

SEQ ID NO: 116540 - DNA, 246 bp, Glycine max
  Peptide Sequence Number=SeqID_233318
atgggaataaaaacaaagaaaacaaagaggtacaactttgagaaggttaggctaaatgatgtgggagggtgtcaagcagtaactaaaggatgttggtgcaaagacaacattgaaaagggtctcacctctcactttgaagcaacctctaaatgttgtgatccaaaacctataaatgaggtggctaaactagtagagggaacactggatgatgagatgagggagatcatgaacaaagattttacttag

SEQ ID NO: 116541 - DNA, 137 bp, Glycine max
  Peptide Sequence Number=SeqID_233319
gattttgggagaaaggaggagggtcaagaaatcagagccaattgtgtgcttgtgttggtttctttctctccattgacactatttgcaatgttattgtctcttgcagagttattcccaagacactcatgcctcgagag

SEQ ID NO: 116542 - DNA, 387 bp, Glycine max
  Peptide Sequence Number=SeqID_233320
atgtcagcggtggttgctggttcctcctcttcaatgtctgccaccttcacgacaagaaggagccctttcttaaaaaactctcaaggttctcattccaaggcagtgacttcacctcaatgccagttatattatttttattattttggacggaaaaagaaactttattataggagagaagaaatacaagggaaaaaggggatgacatgccttaggactgaaaaagacaaggatgaggatgaggatgaagatgttcatctagctccagatagtgctgatgatgcacctagaactattcctcagcagggttcttctgaacaagtaaatgttgtgcccagtcgtccttctgctcatattgttggcattataaacaaaaattggcattcgtaa

SEQ ID NO: 116543 - DNA, 381 bp, Glycine max
  Peptide Sequence Number=SeqID_233321
atgttaactaataagtattgtggatctttggagccaatgcctatgcctgcagggagtagtggtattgcccatgccttgtttgtctccaaagaccgcagaattcccaacattcgaatccaaacccgtcaacttgagaaccttttggacaagaggattattgtggcagttgattcttgggatcgccagtctccatatccattaggccattatgtgggaactatttgggagataggtgatagagatactgaaatcaagctcttaagataccaacaggcctatgtcatctacaataaaatggaaaaattttcaagtgattggtgtaccaacatgtttggcccagctcgcagcacttacttgttggtgataggtgttagtggatga

SEQ ID NO: 116544 - DNA, 420 bp, Glycine max
  Peptide Sequence Number=SeqID_233322
atgattacatcaggtgtgaatcttacaaaggaacaacatggagaggtgaagcaagaaacaaagatggatgggacttcaacttccacaacagcacagaacacagatgacaagaagtcaaaaattggacatgacaacaatcaaaatattcaggataagtatattaaggcttattatgctgctttacttaaacaacaacacaaattggaagaagttgcaaaaaaacaattgtcaaacacatttgctgctgctaatccttctagcagtacttccaatcgtcaggttggcatgaaatcaaaatgtgaggaagacgatgatgatactgaatgggaggaggctccaattgcaggtagtgcaatctatactcactgtaatgtgtttgtgacattttctacaaatatggtgttgtgctgcaccaactga

SEQ ID NO: 116545 - DNA, 858 bp, Glycine max
  Peptide Sequence Number=SeqID_233323
atgaaacacgagttgaagcacgcaataaaattagagttatcccaaattgtatcacaacactcaccgccacttgaggcacctgatatacaagtcttagctgcacgtgtgagcatgaaggggagttgtgcgaaagctggcacaattccatcagttaaagagccttctgatgtgcatgtggatactatgggtttgtacgtagttcatgaccagtgtactcaactagtggcattgggaaaagtgtatgagagtgtgtccattatacacaatgtcccttatgcagatgatgtggttagggtaagtgttgtcaaagtttaccactgtgacgctcaagttcctttgcctacaccaaagattcaatttgtgagacaggccattggcacattcgttgggtggccgacacatctagtgaaagctgtacccaatgaggattcacaaaagggtatgtcgaaaagggttacatctgcaacaatggacaatacagtggctgcagttgatccattgggagaattagtgaagaacctttttgatgtttaccaaaagccaattcagttgccatgggatggggcaaaatttggaatacataatgtcaaagagggttttttcatcacgcacgcagatgtcaccgagataattttaggtgacaaatgtttgaacatatccatactacaattatcaacgatgttcatgaattattggagcacatgcttagattatggatcactgcatggtttccttgaacctcagtgtatacacaaggcaaaggacaaacgccaagaatgtgaacaatacattcaaacatgggtcaaggaatcacaaaaacaagtgtacctaggagcttatctgaatcaggcacattga

SEQ ID NO: 116546 - DNA, 1770 bp, Glycine max
  Peptide Sequence Number=SeqID_233324
atggctttcatgaggcttggatcaaaatctgatgcatttcatcgtgagggccaaacatggaattgcacaaccggacttccaagtgatgttactgttaaagtaggcgaaacatcattttttctccacaagttcccattgctttctagaagtggattactgaagaaactcatagctgacttcacaaacgaggaaggatcaaactgtgttttgcaacttgatgatgtgccaggtggagacaaaacattcgagctcgtgaccaagttttgctacagtgttaaaatagaagtcacagcatcaaatgtagttagtctaagatgtgcagcagagcacctacaaatgaatgaaacttatggtgaagggaacctaatagcaaggactgaggcctttctcaatgaagttttcagcaattggtcagactctataaaagctcttcaaacatgtgaggaagttaaatcttgtgcagaagagttacacattgtttcaagaggcattgattccttggccgtcaaggcatgttctaacccaaacatgtccaatagacatgtggaaggacaagatttctccaagaactcagctcaagacccggccttatggaatggaatttcttccgagaataaatcaccacctccgggtgatgattggtggtacgacgatttgtcttcgttaagcttacccttatataaaagagttattttatccattgaagcaaagggcatgaaacctgagaatgttgctggatccctcatatattatattaggaggtttatacccatgatgaataggcaaacaagcttcaatgataaaaatagtgccaatcaaggtacaaccactaatagtccaatttctgaagcagatcaaagggtattgctggaagaaattatgggcttgattcctaataagaaaggggtcacaccctccaagcatctgctcaggttgctccgcacagccacgatattacacgcaagtccatcaagcatagaaaacttggagaaaagaattggatcacaacttgaccaagctgagcttgtggatcttctcattccaaatatggggtactcggttgagactctctatgatatggactgcattcaaaggattattgatcactttatgtccatataccaggcttcaactgcatcaacttctccatgcataattgaagatgggccattgatagctggaactgatgcacttgcacctatgacaatggtggcaaatttgatagatgcatatcttgctgaggtggctgtagatgttaatttgaagtttcctaagtttcaggcccttgcttcagcaattccagattatgctaggccattggatgatgctttatatcatgcaatagatgtgtaccttaaggcacatccttggctcattaattcagagagagagcaattttgtagactcatgaactgccaaaagctctcattggaagcaagcactcatgcagcacaaaatgaaagattaccactcagagtgattgtgcaggtcctctttttcgaacaacttcgactccgaacatcaatctctggctggttgtatgtttcagccaatattgagaactcacaaaaccacagtggaaatcttggccttccaaagggtaatggcagtggtcaactagaccctacacaaggtgctgaaaacttgagggaccttgtctcagagctagagaaggaatgttcatgcatcaggagtgagattcagaagctggctaagacaaagaaaagttggagcattatcccaaaaatcttttgcagaaaaaattcctag

SEQ ID NO: 116547 - DNA, 423 bp, Glycine max
  Peptide Sequence Number=SeqID_233325
atggcagcctcgcacgtcctttataatcctccttccctttccaaaacttttattaatcactctttgaaccaaaaccctttccctcaaaacctaattctaccactaaaagctactattaaaccgcgggttcttagagtggttcactcccagaagatcattgctaacccctcacttcatgactccgataccaagactcattttcggcactatttcaccaagagtgaagatgggtttttgtattgtgagggccttaaagtgcatgaaattatggattctgttgaaagaacacatttctacttgtccagtaagcctgagattactagaaatgtggaagcttataaggacgccttggagtgtttgaggtctataattggttatgccatcaaggctgttatgaaagtgatgaagaacaaacaagaatag

SEQ ID NO: 116548 - DNA, 261 bp, Glycine max
  Peptide Sequence Number=SeqID_233326
atgtttttccttggagtaggtggcacgatacacactgttgcttatggagatgatgtactaagggtgtgtgttgacactgtatacgatggtgaagccattgtcccgttacccacttcagagattcaatatgtcagggacaccgtgaactcattcattggatggtccagacatctagtgaaacctttatcttataatccagtggaagtgtcgtgggaggcgagccaatttggacttcctgatattggggtgacaagtgtttaa

SEQ ID NO: 116549 - DNA, 747 bp, Glycine max
  Peptide Sequence Number=SeqID_233327
atgttttactacggattaatcctgatgtggatccacaggtccacccttatgttgcaacagggaataagaactccaaaatttggcataagaaatgagaagctgcaatggtttctagatgctgtgaaggagcatcctaatgagttaaagcttgtaggggcccactgccatcttgggtcaacaattaccaaggttgacattttcagggatgctgccattattatggtcaactacatcgaccaaatccaagctcagggttttcaagttgattacttaaatattggtggtggacttgggatagattatcaacattccggtgctgtccttcctacacccagagatctcattgacagtgaggacttgacctcagatattttatcttcccgtaatttatttgattatcatatcgaactggtttcccctgccccagcagatgctgagatagcaaagtttgatgttcttggtcctgtctgtgagtctgcagatttctttggaaaagatagacaacttccaactccagccaagtttcactttgcatggtactcttgtctggtcgttcatgatgctggtgcttattgtatgagtatggcatcaacctacaatttaaagatgcggcctcctgagtattgggtacgaaactgcgttttttcaatggctgatttcattggacaggcttctttaatgttgagggtagcttttagaggaatttgcattttgacaaccattaatgagagtgggatgggttactaa

SEQ ID NO: 116550 - DNA, 318 bp, Glycine max
  Peptide Sequence Number=SeqID_233328
atggatatctctaaagatactaacatccctgtaatattgggaaggccattcatgttgaccgcaagctgcgtagttgatatggggaagagaaagctggagctaggttttgaagatcaaaaaattgattttgatttgtttgttgaagacaagcctgctccagaacacaatgtctgcttacaggtaatggaaggaggtcaagaggttctgaaggcgttctctgaagaactcgctatgtgtgcttaccgtgctaagcgagttcatcctttgaggatgaacactcatcctcttgttgaactacctgtggctaagcgaggctga

SEQ ID NO: 116551 - DNA, 411 bp, Glycine max
  Peptide Sequence Number=SeqID_233329
atgtggttgccatgttgcaaaaacaggcgcaaacaaaacagatcgagctgtcattgcaagcgccacagccgggtgatcgtcgcagccgaccaggaccaaatgacccaggtgctggttaacctgctcatgaatgcgatccagatattgccggaaggtggccacatttcgctgcatctgggggcggatgcccaagaagcccatattgtggtcgcagatgatggtcccggtgtaccacccgcgcaacaaagccatttattcgaagccttctttacgcaacgtgcaggcggcgtaggcctggggttggccgtcgtgaaacaaatcatcgaagcccatgatggtacaatcagttatagcaccagcccttggcaaggtgcccaatttaatttatcacttcctttggtcactgcataa

SEQ ID NO: 116552 - DNA, 600 bp, Glycine max
  Peptide Sequence Number=SeqID_233330
atggcatccatcgaagaaatgcactactttgtagaagtggtgaaacacggcaatttcaccagcgcagcgcttgcattaggcatctccaagcaattggtgagccgccgcattattgcccttgaggctcgcttgggtgtgcgcttactgttgcgcaccacccgcaaactgtccccgactgaaaccggcaaagtctttttccagcgcgcgcaacagattctccaagccattcatgacgccgaactcgaaatcagcaaccgctcagacgaattacggggcttactcaagatttctgtgcccctgtcatatgccaacctccggctggccccggccctgactgcgtttatgcaaaaacatcctttggtcgaagtctggctggatgcagacaaccggcatgtcgacatggtgagtgaaggctatgatatggtgatccgcgtgacggaccagcccgaagagggaatggtcgcacgtaaattggaaaatgcagctatccgttactgttgcagcccggattatattgcccgctatggcataccagattcaccgcaggcgcgtggcaaacacacctgcatgacacaccgcaccagtgaatggctattataa

SEQ ID NO: 116553 - DNA, 567 bp, Glycine max
  Peptide Sequence Number=SeqID_233331
atgccggttgtctgcatccagccagacttcgaccaaaggatgtttttgcataaacgcagtcagggccggggccagccggagactttgccggtttcagtcggggacagtttgcgggtggtgcgcaacagtaagcgcacacccaagcgagcctcaagggcaataatgcggcggctcaccaattgcttggagatgcctaatgcaagcgctgcgctggtgaaattgccgtgtttcaccacttctacaaacggcctgggtaaggttgctaatcctgctggtaccattgcttatatccagagtgtaggcgcaccattgcctgaagtagcttatgcgattgccgtatttgtcgaactggtattggggattgccttgctggttggatttaaagcccgctgggccgctgccggtattgccgtgtttaccattgccgctgcctttttgttccacaacaatatggctgatcaaatgcagcagatcatgttcctgaaaaatttcaccatcgctggtggtttgttgatggtggtggcgtttggcgcaggcgcattcagcgtggataaccgtcgccgctaa

SEQ ID NO: 116554 - DNA, 1278 bp, Glycine max
  Peptide Sequence Number=SeqID_233332
cccaggcttcttgccgacgccggtgggcgcgtcgaccacgccgacgccgccacttttcgacagcgcacgcgacaccacgccgatcatctggctctgcgagcggcgggtggagaagccgggggtattggcctgcagcgtggtgtacgccttgcggatcgcgtccttcaaggcgtcatcaagcgtgcgcggagcggcgacggtttcggtcacgccgggaagtaccgtggctggatcaggccggtcattgtcgcatggccggccacgttcaccgccgctggcaccctgaacgggccagcgacgacgcctggcggcggtcacggtccggtggccggacctctcaggggccagatacgccgggcatggcccggcgcgaccggtcaggccgccgggatccaccacgccgatggcctcgaccatcgccagcgcgaaatgcagcacgccgaggatggcgcccatgcccgagatggcgctgaagttgccactgctgaccagccacatgggcaggatgcccgccgccaggccacccaggctggacagcagcaacagccccaggccgaccagggcgccggtgcgggtggcatcgcgcggtgcgccgatcacccagaccaggccgatgcacagcgcgatcaataccggcaggcgcacgccgaccatgctcagcacggtcaccatcaacgttgtgctgtccatcgatcagtcctcgccggccagcacggccgagccctggcgcagcgactggtagatctcgtcggtctgcgggcgcacgccatgccactgcaggaagctctcggccgcctgttcgaccagcatgcccaggccatccacggtattgcggcagttcgccgcacgcgcccaggccaggaaggcgatggcggcctcgccgtagttcaggtcgacggcggtggtcatcgaattgaccagcgacagcggcagcttgaactcgacgtcgcggtcgcggccggccgaggtggcattgacgatcagttcgaagtcgcccagatcacgcaggtcttcccagtagcggctgatcgcgcggcccggttcgcccatcgcgtcgatcagttcatcggcgcgttccggcgtgcggttgaccaccaccagctcggtgatgccggcatcgaggaaggccggggcgacgctgcgcgcggagccaccggcaccgatcagcagcatgcggcggccacgcaggtccaggccatgacggtcggtcaggtcacgcaccaggccgatgccatcggtggtgtcgccatgccagcggtcgcccttgcgcagcagcgt

SEQ ID NO: 116555 - DNA, 579 bp, Glycine max
  Peptide Sequence Number=SeqID_233333
atgggtgcagcagccgaaccgccaaaagcacccgactgcagctacgaccgtgcagcgatgctggcgatggaacctggccggttcgatcaggacatggaaggtggctggcgtccgttggccgaccgtggctgtacccgcgaagcggccgacctgctgtccgcctacggcgcactgtccaaagcggaaggcaatgtcatcatcacctggcacgagggccagctgcgcgcggagctggggcagaccgcgcaggcgattgcgctgatggaacgcagccacaagccagtaaacgggagcgacccgggttactggaatgcccacgtggacggcatggtcgcgttcctgcgccaggaccgcagcgccctgaagaaggctcgtgcgaggctggtcgcgataccgacgcccaccgcgatggcggagaacatcaaggacggccgctaccacttcaccaccgagggcgggcagcaggtgcagatgccgtggccgccgaacctggacgtgcttgatggactgctgcgctgcttcggcaaaccctacgtggaggcctatgggccaggctgccggaagccggaaggccgttga

SEQ ID NO: 116556 - DNA, 819 bp, Glycine max
  Peptide Sequence Number=SeqID_233334
atggcgcgctgggtcaccgccacccgcgacggcgacctggtgctgcacggctcgccggtgtcggccgcgcacgtgctgcgcaagctgctgtgggatgaagtggattcggtggtgatgacctcggcgacgctgaccggcggtggcgatttccaatcgctggcgatcgacaacggcattcccgaagaggccgagatggtttcgctgtcgtcgccgttcgacctgcccaaccaggccgagctgatcgtgccgaagttcccggtcacgccggatgaccgcgaaggccatccgcgcgaagtggcacgctacctcgacaccgagctggattgggccaagggctcgatggtgctgttcacctcgcgctggaagatggagaaggtggctggcctgatgtcggccgcgcgccgcaagcaggtgctggtgcagggcgagatgtccaagacacggctgatcgacgagcacctgcgccgtgtcgcggcgggtgagggctcggtgctgttcgggctgaattcgttcggcgaaggcctcgacctgccaggtgaggcctgcaccacggtggtgatcacccaggtgccgttcgcggtgccgaccgacccgcagaccgccaccctcagcgaatggttcgaggggcgcgggctgaatgcgttcaacctgatcgccattccgcacgcgctgcgcacgctgacccagttcgccggccgcctgatccgcacctccaccgacaccggccgcgtggtcatcctcgattcgcggctgctgacccgccgctacggcaagcgcatcatcgacgccctgccgccgttcaagcgcgtgattggttga

SEQ ID NO: 116557 - DNA, 417 bp, Glycine max
  Peptide Sequence Number=SeqID_233335
atgtccaaatcttgtggatttgggatgaccggccctctcgatgagtcgatttcttgctttctcataagggtggacccttgggtacttgtacctatcgcctttagaggactacacatcctcgccttcagagggctgcacgtcctcaccttgagaggactacacgtcctcgcctttagaggactacacgtcctcgccaacagagggctgcacgccctcaccttgagaggactacacgtcctcgccaacagagggctgcacgccctcaccttgagaggactacacgtcctcgccaacagagggctgcacgccctcaccctgaagaggactacacgtcctcgccaacagagggctgcacgccctcacctccaaaggactacacatcctcgccttgagagggctccacgccctcaccattag

SEQ ID NO: 116558 - DNA, 597 bp, Glycine max
  Peptide Sequence Number=SeqID_233336
atgaccctttcatcatggcagaacaagctaaacaggcagatggctactccacccagctctcttcctcctcctactgaagcagcatcacattcgttgtctaccttgaagcggacaagaaaagcactttcagccaacaaggacaatgtcgatgacactgtatgcgaaaatatgacattagcaaggagaaatgggcccatttttgtcagagccgcagagaccccttgtgggaggtatgatgtgcggaaaaatgcacaggccatccagaagcaaaacactgccccccacatgttgtctcgtgggggttatgaatatttagaaaagaagctgatggatgagaagacaaagaaaaaactggaggaagttgctcaatccgaaagcactgagaccgtgattgatcctccatctcccatcagacgacatgtgaagtggaagatggcccgcaccaagaaaactagccagatgacgtctgaggtagcaaaggaaattgatgagaagtttgattcgttggaggaacaggcatcacaaggttcctttgtcccccatggacgtcaggatgtcctgattgctgccattgggcgaccagaacaccctggtcgt

SEQ ID NO: 116559 - DNA, 174 bp, Glycine max
  Peptide Sequence Number=SeqID_233337
atgggtgtgttgtcaaacacaaaaaatatgaaccaacttttccctgccaagaggcaaggaaatcactgggtatggcacaagaaacttggacatgcaagctcgagcttaatctcaaaattgcaaagacatgaccttgtgagaggtttaccaagagtgtcatacaaagatgattaa

SEQ ID NO: 116560 - DNA, 150 bp, Glycine max
  Peptide Sequence Number=SeqID_233338
atgccaagttgccaaattattgttgaaatttatggtatggaggcttcagaagtaggacttgatcagttgctcaaatttgagagacaatgtgttctgccacaagacgacgcaaaatctttccggtggcagtcttgtgcaaagaatcagtaa

SEQ ID NO: 116561 - DNA, 312 bp, Glycine max
  Peptide Sequence Number=SeqID_233339
atgaagatcaatgtacacacatccaggtttcttccttcggagaatgttcctagagccaaggttcttaggtttggagggatgttggagtttcaacatactttcaatatttggcagtacttgggttttcctcttttgtcagggaaattgcttagtagagcaggcaaagtcacctttgcaaagtctgttcttagctctatgccaatatatattatgcacagtctttgtatttcggaagttttatttggggtgggaagactggtctttgggttaaatgggcaacaaccagcactacaaggagtagaggtggcctag

SEQ ID NO: 116562 - DNA, 141 bp, Glycine max
  Peptide Sequence Number=SeqID_233340
atggtggactgtctcctcgaggcgctcagtggaggattggcgagtattgtgttccggcattgtcgtgggggcagtttgttacaactaactattggcaaagtagtggaaccaacggtggggcctgatcgtgttcactcataa

SEQ ID NO: 116563 - DNA, 546 bp, Glycine max
  Peptide Sequence Number=SeqID_233341
atgtttgtgaaaatgttccctaagaagaacaaagcggtctctattctagtaatcaacaacgttgaaaatgcgaagaaagctttcctaaaacagtggttcattcctagaagatgggtgaacttcagaaatttgaaagaagatgggtctgatgtaaaagatttttttgattatgtaggatggactatttttcttgaaaaatttagtaccttgcattattgcccctatgccttattttggggaacaaaaaggccagacaaagtaagcatcagaggatgcgtaaatagggaggaggtgattatcttttctaaaagcattactgctacaagtgattgtttcaaggaggcattggtgttcgataaagactgggaggacataacctatgaaacggtggatataatgctttatgaaagaccacgcccaaaatctgttgacaagaagacaatgctcagtttcttaaggattgaatgctcaagtcaccaacctctcaatggtggtgaatgtttctacattactttaggtctttctagagttttcatgatagattag

SEQ ID NO: 116564 - DNA, 534 bp, Glycine max
  Peptide Sequence Number=SeqID_233342
atggaacccagcatgaaggtcatcattgtcaatgtgacctcgagtagcgatatcattgagtccattcttgatgttgttcatcgaggccatgttagcctcactgtcctcagttcctctggaacgatcatggaagtaaccctccataactcttcgcatggtgctggtgccctcccactttgcgggcccttcaccttgctctccctgaacggctcctacttatacaacaaccactacacccttcatcctggagccacccttgtccctcccttatcctttgggattagcttttccacctctcaagggcaagtctttggcggtgccattggcggtagagtcattgccggtaatgatgtcagcctttcaatttgcaccttcaagaaccctgtgatgtacaagtatgcctctagagacaaagaaaagaatgagggtaacaataataacaacaacaattataacaataactctaaagattttattggaagtagtgagttgttggggttcaacatgattagttgtggagtccgtgggtggtga

SEQ ID NO: 116565 - DNA, 403 bp, Glycine max
  Peptide Sequence Number=SeqID_233343
ggaaaagaaggagaagcttgccacccagctcgcccaggcaagctcagctcgccgaggcgagctaggttgcttcctccagaaggcaccgcctactggggaacttcctggaaggcccaagtttaacatgtggggttgtaacccaatagaaactccagtagaggtgaatttgaagtttgcaaaaggtgcgaatgaagcctcggttgatggaaccttatttatgagtgaccctaggcaatcacacttgctagctgctaaaaggatcatgaggtatctaaagggaacattgggatatggaatcattttccctcatcaaaccaaagaggatgataatctacatcttgtaacctatttagactcagattggtgtggagatttggttgataggaaaagcactatgggacag

SEQ ID NO: 116566 - DNA, 171 bp, Glycine max
  Peptide Sequence Number=SeqID_233344
atgtgggttgagggatcgacgaccgtccacaatgttcctttgggcaatgatcaagttaaggttggtgttgaggaagttcaaaatgctgatgctcgcgttccagtacccactcaagaggttcagttagtgagacaggaaaacatggaattgagggactggaaaaacttgtag

SEQ ID NO: 116567 - DNA, 303 bp, Glycine max
  Peptide Sequence Number=SeqID_233345
atgaaaacattcatcgttggtgagatcaccgcaacactagaagaggctgtcaacgacgttggaggaggaggggatggtgaagttgttgtggttgacaaaggcggccaagttgacaacggaggtgaggagcgagctgaagatgttttcgtacgcaaaatccagcgtaaacttggtctgggagtagacttgcacaagcatgatagagacaaagctaagaaaacagatgaggtggaggcaacagcaaaacagcccggtcgccaacacatgcgtaaacacaccgttgatgaagtcacccacacgtga

SEQ ID NO: 116568 - DNA, 268 bp, Glycine max
  Peptide Sequence Number=SeqID_233346
atggagaaagctttcccttctcaacctgacacttcacaccttccttgcttggtcgacacatctggtcaagtctttatcacagcagttgtgtctcctgcaaaaccacctccaaagcccgatgatccgctttatctgatgacattgaccatcccagagcttttctcgaggccttatcaggttagatgggatgccaccgtgttcggggtctttaatccagatttccccctctacataaagcacgaagacctctccgaaatcgcacacggtg

SEQ ID NO: 116569 - DNA, 1122 bp, Glycine max
  Peptide Sequence Number=SeqID_233347
atggttatagaaggatggtttcccctattagagatgctcaaattttggatgtattcattagagaattttgagtctcgcgagtatgacagtaattacgcaattagcacagcactaagcgtgccttggggcttcttcatgggccttcttcccgctaagcttgagctgaccgctgagcgagtggcggatagggagacagtggtgaggttggtggaggagggtgtgatagggatggcaacaatgtcagaggagggtgtgaagattttgggggcagtggtgaagagggaggttgggggcattgctgagggcgaggaagagtgcaacgacgacgctagtgactcagttgaggattctgcgatggtgggcaatggggctcgatggtgtggggagaatgaagggttcacgacaactactaccatggttgcttcctcaactacagtgaaggagattctctacttgcggcaccacgttgttatcatgtttcgtagcacacgattcaagattagccacaattcccttaacactaccaaacttgaccctgcaaaagtgatcaaagaggtcctctcaaaggctctcttttactatcatcctcttgcaggaaagctagtaagacatgctgatggaaaactaagaatcaactgcacctcccatcaaggaattccattcattgaggctatttgtaattgcaacctctcttctcttcattacctagatgtgggctggtctcacgctgtttgtgatggaactggtgtatctcagttcttacgagccgtggcagaaattgcaagaggaaaaaccgagccctctttgaaacttgtgagggaaagagagagactagttggcacgatcactattcaacccatgaaaaatcccatggacaatgcctctcttgcagtttcaccatttctgctaagcacagattttttggatgaatactataaggtggacagagagagcatagcaagactcaagatgagtttgacgaaagaaagtggcaatgaagaaagtactgagaaaaaagggttaacaaattttgaaaccctagctgcgtacatctggaggattctttgcccggtggatattacgggaatgccatcacgcaagcatttgttacgttacacatga

SEQ ID NO: 116570 - DNA, 403 bp, Glycine max
  Peptide Sequence Number=SeqID_233348
ggcccattggcagctccttgtattgtgcccaggtgacaatgtagtggtttggttttgttctttgcgaaagaggccggatgctgccatcaagggtgcagtaaacagtcatgttcaaacaggaaattacgagtgtggatactatgttatgcattggatatggtgcatcgtaactggtagattgaaggatgactggattcacggtggtggtgacaaggactacaaggaggtacccccacctcctttgtttgaacctgcagggggacacatcaaccaagctgtgaccttcagcagatcttattacaagcttgcaaaagattttgttgtttctgggactgcatctgagtctctgtatagtgcttctgaggcaatgtttaagcctgacatggtaggtcccaaagactaa

SEQ ID NO: 116571 - DNA, 348 bp, Glycine max
  Peptide Sequence Number=SeqID_233349
atggatttcaacgacagccccgtcttagaacttacgacagactacgacgaccatggggacaacaccgtcgtagacctaatcatgttctacgatggttgtctcctacagactgtcatagaatggccaaccattcaaagacggctacccgacagccccgtcgtagaactaaggaaggactatgacggccatggggacaacaccgtcgtagacataatcgggttctacgacgattgtctctataggaccgtcgtagacttgtcccaatactactacggtcttctcttaccgacgaccgtcgtaagagagggtcttaagactactacggtcttgatgaagcaccgtcattga

SEQ ID NO: 116572 - DNA, 960 bp, Glycine max
  Peptide Sequence Number=SeqID_233350
atgatttttgttgttgtgactaaattcctctgtgggggtttcacattagtagtgggcttgtcccacgctgtttgtgatggaactggggcatctcagttcttacccgcagtggctgaacttgcaagtggaaaaactaagccctctgtgaagcccgtgtgggaaagagagagactagtgggcacaattacaactcagcccttacaatatcccatgggcagtgcctgtgttgcagtttcaccatttctgccaaccacggatttttcgcatgaatgctctaaggtggacagtgagagcacagcaagactcaaaatgagtttaatggaagagagtggcaatgaagaatgcatgactaagaagaaagggttcacaacttttgaaaccctagctgcgtacatttggaggtcaagagcgagagccttgaaactgagctacgatggggaaactaatcatcaaactatgttgaacatcgttgtaggggtgagaccacacttgctggatcctttgccccgtggatattacggaaacaccattgtggaggcatatgttatgttaacagtgagggagccgaacgtaagagctcttttggaggttgtgaaactcatcagaaagagcaaaaaagttgctattaacagtaattatataagacacccaatcgacagtatggaaacgcccaaatcagtgaagtataattatgagagtggtgcaataacgattttgatggattggagacatttgggtttgttggaaaatgttgattttgggtggaaggagctagtcaatacgatgccatccccacgcgacatttatggatcaatgggtttgtgcacgatcttgcctcccagtaatttggatccttcaacgagtggaggagctagggtttacgtatctctacctagttctgccatgcccaagttcaaggaagagatgaaagctcttaccagtatcaaaaaaagctcttag

SEQ ID NO: 116573 - DNA, 477 bp, Glycine max
  Peptide Sequence Number=SeqID_233351
atgaaagcagagtggtgtcacaagcagagaatccccttcaaagcagaaacggttacagggaaacacaacggcaaagttaccaacaaagccgcattagaagccacgcgaataacggtgtcatttttggtcaacaagctcgagggaaatggaaatggaaaggaaaacaatgataacattaattttcctttgagtgttgaagacacaaacggcgtcgtttacgagcttcagttccttaatgtgggggagaattcaagcctacaggttaacgtcgtgacaatgatgacaacgaaggtgtttaacttgtcgggtgtgccaacacgtaggaggaggctggggaggaagacgtgtgtcttgagcgggttggtagggttggcgaagagtgggccaaagtggtcaaggagggacgcgctagcggcgatgttaaatttggtggttgttaactcgttggaaagtgtaccaatttgtcacaagcagtaa

SEQ ID NO: 116574 - DNA, 3735 bp, Glycine max
  Peptide Sequence Number=SeqID_233352
atgggacgaggacggccgaaaaaatcggtgtcaccgtcgccggaaaccccaaaccaaaacaccacaccaaagaagcataatcattgtgaagaagtgaatcatattgttggatcgtcgaatggatcttccaaaggcctaaagaacctggaatcgattgaagaacgtccccaatttgaaaacctatgtgaaaaggatggagaggaatcgaaacctgaatcggaggaaccacgaaggctgtgggtggatgtactgagtaataacagaaaccctgcaaatggtatggtcatcgaatatgttgcaccaaaaattgtcaatggcgacatcgagattgacatagaagaggaagatatagcttcagagatgaaattctgggagacaactttgattatgtatgtccttggaggcgaggttagtatgcatatggttaaacaattcatgatgaaaacttggcattttgttcaattaccgaatatgtactatcatgatgatggttatttccttcttaaatttcaatcgaaccaagatatggaattggtgttgatgagggggccatataccatcaggaacatgccaatgcttattagagaatggaaacctgattttaacctgaagcaagacatgctacggactcttcctatttgggtacaactccctcaactgccattgcatttatggggtggaaaaagcctaggcaaaattggaagtgctcttggaacacaattggttattgacgaaagtactgcaaataaacttcgggtctcgtatgcacggattctagtagaggcagatgtcacgccagaactgagaaacgaaattactataaaggacaatgaggggcggaggatcactcaaaaagtcgaatatgagtggaaaccaatgttttgtgataagtgccaaaagtttggccataaatgtggtgaagtaaagccaaggaagcaatggatacccaaacaaaaaccaccagagcaaaggataccagttgtaactattgtgccagacaaagtgacgccaactgagccaaaagaaaagcacccagatgatactcttgaggactggagcgtggttcccagtacaaggaaggatagaggaaaaacaaagcagaatgaaggaattccaccacctatcaattgcaagaatggttttgagacactaagaggttcgaatggccctttagtgattcgagactgtgtgaagaaatcaaaagctataaatattaggaaaaaactgaggttcaaaggtatgtatcttgataattatgttgatcatgataatgggcgtatttggctgtgctgggataacaatagaatagacctaaaatttgtccatagttctagccagttggtgcactgcggtgtgtatagtctggatgggatttttagatattggctcactctgatttatgcgttaaataagcttgagaatcgtagaattctatggaaggatattgtgactctgcatagccaccagcaaggtccatggtgcctgataggtgactataataatgttgcaaaagctcaagatcgcataggaggtaaaatggtgacggaagctgaatatactgatttttctgatatgcttgagcagactggtctggccgaaatgcatagtcaaggagactattttacttggtcaaataagcatgtagaaggcaccatttactcgagaattgatagactgcaacaccgcgatagggtaattctgaaaaaataccacttcaaattcattaatggaagtgtcgatctggatggttacaatgatgcggtctcggccagctggagagagccaatcacaggcagacctacgttcgtggctcaacttgatctatccatcgacctgatgaacagtaccaatattgctaaggtaaaaaagtacactgatgaacttatttactttcaggaacttgaggaaaatgttcttaggcagaaggcgaagattgattggctaaaattaggtgatggcaacaattcatttttctacgcaaccattaaatcgagggctactgctaaagggatgaacatgctaaggaagattgatggtacagtttgtgcaactcaggaagatattgagaatctggtcctggagttttatggtgagctgatggggaaaaaatctatcaatctgaagcatatagatgcagctgctatacgaagaggtgggcaattttcaatggagcaacggcagtttcttgttgccccagtcagtgatcaggaaatcctaaaagcgctgaatggtataggcgatttgaagtctcccggtatcgatggatacggggcaaaattctttaaatccagttgggatactatcaaagatgatatcaataatgcagttgtctctgtgaaagactatagaccgattgcaggatgcactatcttatataagattatctcaaaaatacttacaactaggcttggaaaagttttgaatagaattgtaagtccgtgtcaagcggcctttgttcctggacagcagatccataatcacattctgctggcctatgagcttataagagggtatgctaggaagaatggaaccccccgatgcatgattcaattaaaccttcagaaagcgtatgacatggtggactggtttgctctggaaactattctgctggaaataggtattcctaaacaatttgttaagtggattatgcttactatcacttccgtcacctataggtttaatatcaatggtaattacaccaaatgtatgaaagctaataggggcatacggcaaggggagcccttatccccgatgttgttcattattatcatggaatatctcaatagactcctccacaaaatgcaaaggaatcctgatttcaatcatcattccaaatgcgaaaagctaaatattactaatttggcctttgctgatgatgtcttgctttttgctagaggagattgcagatcagtagagatgttgatgcagaccttgaataccttctctgaaacaactggtttagtggtaaacccgagtaaatgcaatatttactttgggggggttgatgctcctacgaagactgatattatgaagctgacaggttttaaagaggggcccctcccttttaaatacttaggtgtacccttgactagtaagaagttgtctatttctcattatctcagtctaattgatagaataactggaaagtttaatcactggagtaataagttgttgagttatgcaggtggtgttgacaaaagtcgtaaaagtcctgtagcctggactaatgtctgcaggcctaggaaatacgggggtttgaatgttattcacctccaaacgtggaatcatgtcactatgatgaaactactttggagtcttagtgagaaggcagataatttgtggaaggataggggaaaattcagtatgaagacactgtatttgaagatgcgatgtgaaggctccaatgagggaccagaatcccatgatcaccttttctttggatgtagtgtccttggtgatgtgtggaaacaagtccttaagtggattcaggtaaagcatcatcctcaggaatggaatgaagagctaaaatggattattaggcacggtaaaggaaagggacataaggcctctattctgaagctggcagtgactgaaactgtctatggcatctggaaataccgcaatgctaagatttttgaagaaattcaagagtacgatggaaatgaaaaggtaaaagtgatgcaagctttgaacttggtccaagaaattgagatgcaaagaatgaaggaatcataa

SEQ ID NO: 116575 - DNA, 354 bp, Glycine max
  Peptide Sequence Number=SeqID_233353
atggtagatttttgtgtcttggtaggtactgatactacaggatgtgtgagaattccagcatcattctgtggtatttttggttttcgtccatcccatggggctgtatctaccattggagttcttccaaatgcacaaagcttagacactattggatggtttgctcgcgatccatctatcctgcatcgtgttggacatgttttacttcaattgaattcagtggagaccaaaaggtccagacatttcatatttgcagacgatctctttcagttatctaaaattcctacacagaatacaatatatgttattggtaaagctattgagaatatgtccgggtgtaagtttctggatctttga

SEQ ID NO: 116576 - DNA, 780 bp, Glycine max
  Peptide Sequence Number=SeqID_233354
gtcgactctagaggatcccctggcggcaccctgcagcggctgggccggctgcagcgcgagcagtgcgtgattccgtatgccgacgccggcaagacctgcagccacaagagcgactgcacgggccagtgcctggccggtcccgaggtggccgccggcagtgccgccaccgcgccgagcccacgctcggctgctgtggcatcagccgagcgtgggctcggctctacaacagcgcgcgcggcgctatgctggtgggccattccccgctgttgccggagcccccgcgtgagcaccccgatccaggacatttccctcaccaccatcgacggccagccgtcctcgcttgccgactaccagggcaagtacgaaggcctgcaggcgctgtatgcggaaaagcacgcgcagggcctggaagtgctgggcttccccgccaacaacttcctcggccaggagccgggcagcgaggcggagatccagcagttctgccagctcacctacgacgtcagtttcccgatgttctccaagatcagcgtggccggtgatgacacccacccgctgtaccagcagctgaccgccgcccagccgcagtcgatcggcgaaggcccgctgcgtgagcgcctggcgagcaaggagattccgatccacgcagcaccggcggtgctgtggaacttcgagaagttcctggttggccgcgacggcaaggtcatcgcgcgcttcgccccggacgtggctgccgatgacgcgcgtctgcgcgaagccatcgaggccgcgctggcggcctga

SEQ ID NO: 116577 - DNA, 324 bp, Glycine max
  Peptide Sequence Number=SeqID_233355
atggttttgcttttgctaggcagtaagcacaataactcagcaggtcgtcggaacagaagccgtcgccagaacggaacagagtcggaacgacgtcaccagaacgaaacggaggatgcaggcgtcgcaagtgtgcagagcagcaacggtgctagggttgaagatgatggagccccaatctgcttcaaagtagcggcgcgaaaaaccgctccagaacctgcgccgctccgccctgcgccaccgcgacatgaaaccgctctgctacagaggtgcccatcgcagatgggggccgctacgacctctattgactacataggtctttggtaa

SEQ ID NO: 116578 - DNA, 2289 bp, Glycine max
  Peptide Sequence Number=SeqID_233356
atgggcgggggtccccgcacgtaccccggaggcgtgtcgaagtgggtgtggaagcgcatgcaggcgaagaaggccaagcagcttatgaaggcgcgcctctgccgggagcggcagatatacgagatgcggaagcgggcggagctcaaggcggcggtgtcggagctggagcggccgtgggaggttgtcgagagagaggcgtcggcgtcggcgccgaacttgttctcaattggggcggatgagcaggtgaaggtgcttgctgacaggttccagaggccaggcgggtttgacttgtggagtgagagggatgggccggtgctgtttgagagccctgatgagctgccctctgctaggtttttccccaaaggggttgtgcatagtgtgaagccttataggagggttgatgggtatggattggtgaaggatgctgatggagatggggagatgggtttgttgaagggaaatgattttggtggaggtttgagggaattgggtgatgggggtttgagtggattggaggatgttgataggcttgaattggaagatgatgatgatggagaatgttcatcttctgatgtgagttatgggagtgatggtggattgagaaggaatgagaatggggggaggtttttgtctgatgatgttggtaggtctagcaatcgagggcgagggcaagggcaatcttctcgaaattatgggaggaatggagcggatggtgatggcagaatgaggaagaatgggaatgggagaaggtttttgtccaataatgttgatcggtctagcggtggagaacagtcttctcctttgaattatgggggggatggaatggatggtgatggtagattgaggaggaatgggaatgggaggagggttttgtctgatgaggatagtagcgatggaaagcggtcttctcatttgagttatgggaggaatggagtggatggtgatggtgatggtggattgagaaggaatgggagagggagaaggttaatgtcatctggtgatggagggcaatcttctcgtttgaattatgggaggaatggagcggatggcaatggtagattgagaaggaatgggaatgagaatggaaggaggattttgtctgatgatgatggtaggtctagtgatggagggcgatcttctcgtgtgcattatgggaggaggaatggattgaattttgatggaagaatgagaaggaatgagaatggaagtaagtatgttgtgcagggtgttgacggggctgatggtggagaaagtttgccccattcttcaagctctggaaggtatggagcaagttttgatggcagattgaggaatagtgggagtggaaggagggttttatccaaggatgttgatgggtctggtgatggcggattgaggagtaaggagaatggaaggaggtttatgtcaaagaatgttgatgggtctaatgggttgtattcagggggagctagttctgtcaggaaacagagagggggtaattccattggaggcagaagtcgaggaaagtatactaataggacttcagagtatgcctcaccaagaggtagagatgcaaattctgaagtttatgacatggatttgcaacaagatgggagttatgggttcaggaagaagcgtgagcaacctgattctacaaatgagctgatcaaggtggatgaaaagctaaaagcagctgaagctcttctggaaagcaagaaccttgaaataaaaaaaatcaatgaggagaaaagggcagcactggctgcacaatttgctgcagaagccacacttcgaagggttcatgctgcacagaaagacgatgaaatgcctcctattgaagctattattgcacccctggaggcagaactcaagcttgctaggatggaggtggcaaagctgcaggatgacaacagagcactggatcggctaaccaaatcgaaggaggctgctcttcttgaggctgagagaactgttcagattgctttggcaaatgcatccttggagaacaaaatcttggacaaaatcctttggcaaaaggttgctgaagttgaaaaactaactcaaactgttcgtgagcttgaagaggctgtcttggctggtggggctgctgctaatgctgtccgtgattaccagcgtaaagtgcaagagatgaatgaggaaaggaaaattttggagcgggaagtagctcgtgccaaagttactgcaaacagggttgcgactgtagttgcaaatgagtggaaagatgctaatgataaagtgatgccagtgaagcagtggctagaagaaagaaaatttttttcaggcatgtga

SEQ ID NO: 116579 - DNA, 168 bp, Glycine max
  Peptide Sequence Number=SeqID_233357
atgggctttgggagaatgagagatggttatggtgatgagggagtgggagtaacagagagggacaagattgaacagaacgtgatgtgtggaagtggaagtgttggttcaagtgcagtggagaagaaaatggacgaagaaagaaggaattacgaaactttggagtgttga

SEQ ID NO: 116580 - DNA, 699 bp, Glycine max
  Peptide Sequence Number=SeqID_233358
atggtggtcccaagcatgaagaaggtagtttttgtggtggtccctaacacgaagaagttcatgcgagttccaagtgtaattggggttgtgcacttatgcgagatcaaaatccattacggtttagggggtatgagtgatttggggtatggcttgtttgagcacgaattgggtagtgttggtgtgggttcaaattatgtacggatgaggttttctactgtaattcactcgatgggggcatgggaccttaaatatagtgttactagtgggattaaaatgtggtggaaaggaaaagatgttgattatgactccctagaagatttggtgacggatcaagacgcactggatttggaaaactatgctttggagcataagcatgaagctaagatttatatggtgcctggttatgataatgacttagagtatggtgtaaatgatgcttttgactgggactttggtctagataatggtcaatcatctgtgaagcagaaagcaaagaaaaaggtggctaatgaggatcctcttgagatgtctggtgacaatgaagtcgacccaccgcatgtgcatacccatcctaattttagggaaatgtatcatttagagactgtgtgcaagactaaggagtgtccatttcaagcatttgtatcaaaagtgggagaaacatctacctttcaaatgggagaaacattcctaactttatga

SEQ ID NO: 116581 - DNA, 942 bp, Glycine max
  Peptide Sequence Number=SeqID_233359
atggcttcacaagaagctttaagacaagctttttggatactattcggatatgtatccggaaatatgtatctggaggtatccaaggagtatcggtatttgacacaggctccagttgttttactaaggatactgtcaacaggatgcatgcttgttgaaatctttctttacaagccagagatatttcagaaagttcgcccacgttgtgaagcacctagacgtgacatgatctaccctacaaattacactccatgccgatatgtgaggatatcttgtttgcgtggaaatcccattgccattttctttgttcagctaataggagttcctgtggctggtcttgaacctgaatttcaaccggttgtaaattacttactgcctagtattttatctcacaaacaggatcctcatgatattcatctccagttgttgcaagacatgacaagtcggttgcttgtatttcttccacaactagagacagacctttccagctttccagatagtcctgaatctaatcttcgatttcttgccatgcttgctggtcctctttatcctattcttcatgtggtgaatgaaagcagagatgcaaaaattaaggtggatgagaaacataataggaaatatcagtttaagaatgaatgtgtttgggaggaagttggagtagcatcaattgacggcaaagcagagacttgttttgtagtagtggtttggtcacacgagaagtcgacccataaaagtcagacaacttcaaaacctccaggcaatatcactgaccttgatgtctccaaaagtagtcaactgtcaccaaccctaactgtttccactaactttgaggtcttcaaaggtccaattaaccctagaagtcatctccctttaggtctccaaagatccaaaagtgccttcataaagccctgtctatttatatctgaaactggaatctataattaa

SEQ ID NO: 116582 - DNA, 366 bp, Glycine max
  Peptide Sequence Number=SeqID_233360
atgcagaagctcataaatccagatactgagcaagatgtatcaaaacctcaagatgaagtaacatctcttttggaagataaatcaaatttggaactgtctagttctttcactttagttgattattcgaagcttttgggtgaggagttccagatgccagatgagcagtgggattgcagctatcttaatatattagatatgggggctgtggaagaagggatcttacatgttctttattcttgtgcatcacagtatgtacattgtttaacacactgcagtttacagcctgttctttgcagcaagttggcagagagatcttcggacttttgggctgcagtgccacttgtacaagctctgctgccaggttaa

SEQ ID NO: 116583 - DNA, 748 bp, Glycine max
  Peptide Sequence Number=SeqID_233361
agaaaagtccaaacttaaagaagatatcatagctcgtaggcaaaagaaactacttatgagacatgcccgtcaaaaacatttggaagaagcagctttacgggaagcagatcttctgcaagaacttgatagggagagaacagctgaaatggaaaaagagctggaaagacaaagattgctagaaatagagcgtgctaaaacaaaggaactgcgtcacaatcttgatatggagaaggagaggcaaacacagagagaacttcagcgtgaaatagagcaagcagaatcaggacttcgaccatctcggcgtgattttccatcctccactcacactagtcgacctagggatagattccgcgaaagagaaaacggaagatctggtaatgaagggagcacaagagctggcagtggaagcttacagtctgaaattccttccaccagttcatcaatggcacccttaccaactatagttctttctggatctcgaacgttgtctggacagctgcctactatcttacagtcacgtgacagacaggatgacactggcagcatgtatgaagaaaatgtcgatggaagcaaggattcaggggataccggcagcattggagatcctgagctagtatcagcatttgatggccagcctggtggatatggttctcaaaggcatagttcaagaggaagcaagtcgaggcaacttggagaacgtagagacagagacagcagacgtgaagggaagtgggaaaggaaacattaa

SEQ ID NO: 116584 - DNA, 309 bp, Glycine max
  Peptide Sequence Number=SeqID_233362
atgggggccggcgatgtgtccggtcggatgtggaacggtgagagccggtccgccgatcgactcgggacattgaccgacgcggattgcgatgacgtcatcatcgcgattgtggatggcagcgcgcgcccttggcgtgcctcggcacctgcgcgctcctggcgtcggcctgtgggctcccattcggcccgtcttggaacacggaccaaggagtctgacatgtgtgcgagtcaacgggcgagtaaacccgtaaggcgcaaggaagctgattggtgggatccccctgtgggttgcaccgccgaccgaccctga

SEQ ID NO: 116585 - DNA, 331 bp, Glycine max
  Peptide Sequence Number=SeqID_233363
gcggtgttgtcctttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtgacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 116586 - DNA, 135 bp, Glycine max
  Peptide Sequence Number=SeqID_233364
atgctttacggcacccttaccgaacgcgtactagagttagagtcaatgcggctacagttattgccgcaagtaccgccacagaagtggacccgactcacccatctagcgcataagtgcacgcttagcgctatttag

SEQ ID NO: 116587 - DNA, 397 bp, Glycine max
  Peptide Sequence Number=SeqID_233365
atggggagatgttggggagtcggagtcggggattggggagacaatacccgttcctgccctacctcattgccatgtctactcacagccacacttacccttgaagataaccaatcagttcatgtgcttatggagctgtgtgctggtggtgaactttttgacaggattattgccaagggccactacagtgaaagggctactgcttcaatatgtagccaggatgataagggacttctcaaggccatagattttggcttgtcagtcttcattgaagaagttggcagtgcttactatgttgctccagaagttctacatcgtagtcatgggaaggaagcaaatatatggagtgcgggagttatattgtatatcttacttagtggtgtacctccatcttgggcag

SEQ ID NO: 116588 - DNA, 240 bp, Glycine max
  Peptide Sequence Number=SeqID_233366
atggcaggtggggtttccgttggaaaaagggcaagtgggttggtgccaaaggccactttgaatgccgtggaggccatttcggctaataagaagtccaacaacaaccccattgttgttattgacaactatgacagcttcacctataatctctgccaggagttaagggaattggggaattgtagaagacctaaatccattctttttcatttgtgggatttcttcttgaatgatgttgattag

SEQ ID NO: 116589 - DNA, 783 bp, Glycine max
  Peptide Sequence Number=SeqID_233367
atgagcagcgcttatgtgaagtctcctccggtacagccacactcatctagtgccactttgattgtggctcgggttatgttggggcacggatgtgagcccggaatgggtttaggccgaaacaggaatggcatagcaagattggtggagttcgcgaagaatcgcggaaggttttggttgggttatgagcctacacgtgccgaaaaaaggaggatcgccttagaaaggaaggagagaagctcggctcagccacgagggctatccaacaatgagtcctgtgaaagtagtgataccaaggacccagatgttgattttgagaaactaataaatcaagccgagaaaggagaagatgaggattgggggcttcctccaaatttgaaaagaatggtggagcaagaagaaagggaagtgaagccacaccaagaggaaacaaaagttgtgaacttaggggtagacggagagagaaaagaggttaaggttggcacttgcatgtccgcaaacatccaagatgaattggtgactctattgcgagactaccaagaaatctttgcttggtcctaccaggatatgcctggtttgagctcggatatcgtgcagcacaaactacatctaaatcctgagtgttccccgataaagcaaaagctgaggagaatgaagctcgagatgtccctaaaaataaaagaagaagtgaaaaagcaattcaaagctagcttcttggccgttgctcggtacccagaatgggtcgccaacatcttgccagtccctaaaaaagatggaaaggtgtga

SEQ ID NO: 116590 - DNA, 331 bp, Glycine max
  Peptide Sequence Number=SeqID_233368
caaaataggggaggagcttgccacccagctcgcccaagcgagctcagctcgcccaagcgagctcagctcgcccaagcgagctcagctcgcccaggcgagccaggttgcttcctccagaagcaaccgccttctggaggaagaatctggaaggcatactcagagagattgtccatatcccaagaaggagcagagtggtgggtgcctgaatgaccaaactggacatccgaaggccacgggaagagtctttacccttaacggtgccgaggctttgaaatccaaagatctaatccaaggggtgagcttagctattatagggggtgtgtgtagctaa

SEQ ID NO: 116591 - DNA, 610 bp, Glycine max
  Peptide Sequence Number=SeqID_233369
gcctcacaaggttcctttgtcgcccatggacgtcaggatgtaccgactgctgccattaggcaactagaacaccctagtcgtgtgcgtgttgctggagccgatgtcatgatcaagcaatactttggaccgacttcaaggacctcctgcacgtcttcgtccatggctcccgaagacctggagcagctgacgcaaaaaatcagggaccaactggaggagtcgatcatagaaaaagttggtccttcagctgctcgtgtcagcataaaggagagttgtgttgatccctcagggaacgatccagacccaggtgactcagacaaatgcgggttacacgtcaaagaaaatcctcctcacctggttgccctaggaagactttatgaggggtccacaaccgttcacaacattcatttactccatgatcaagtcaaggttggtgttgaggaggttagagatgcaaatgctcccattcttatacccactgaagagggagctgtgggatcggtgaaacttgcagatagggcggatcatgatgtcgatgatcacctatatctgataacattgactatcccacaactttttctgaagtcgttgctgattatgtgggagctatcgt

SEQ ID NO: 116592 - DNA, 192 bp, Glycine max
  Peptide Sequence Number=SeqID_233370
atggcaccaaagaagaatgaaattgttggtattcctgtcatcaataacgttgaagacacaaagaagacctttctaaaagatttgttcatccctgggaagtgggtggactttcatagtctaagggaagaagggtttgatggaactgccagacaaaacgggatgagcattagaggcaccgtcaagaggtggtga

SEQ ID NO: 116593 - DNA, 546 bp, Glycine max
  Peptide Sequence Number=SeqID_233371
caagtccaatgacatgcagagataccatatggttattcgcaccttttgtcagctagaggcaagcgagcccgttgacacacagagactaacgtcgtcatctgcacctttgtcatctagagacggcaagtccgatgacatgcggagataccttatggttatccgcaccttttgtcagctagaggcaagtgagcccgttgacatgcagagactaacatcgtcatctgcacctttgtcatccagagacggcaagtctgatgacatgcggagataccttatgatgtcagcgtctttcggccgagacagcgaaaaagtctcatttgctatccgtcagactcaagggttcgcgtcttccggccgagactacgaaaaagtctcgtttgctatccgtcagactcaagggtctggtagcatactcaagggtccgactcaagggtccggtagcatgcagagataccttagggttatccacacctttcatcagctagaggcaagcgagcccattgacacgcaaagaccaatgtggtcatctgcacccttcccggagat

SEQ ID NO: 116594 - DNA, 288 bp, Glycine max
  Peptide Sequence Number=SeqID_233372
atgcgtctaccggggaaggagagtctgctgatgaaatctcccataaccataaatgaaattttggatgttagcatttcgtttctaaatgaccatttagaggaaacactgggttcgacaaaaatagaagaaatccactcaaagtgtatcaatctcgcacaggataaaagggatgccccacattatttccatgacacaaatgcaaaaatgatgatttggaaacttcatgcaaaactggtcatgcatgcacctatgcagacactcaagtgtcaaatttttatggtcatgtga

SEQ ID NO: 116595 - DNA, 369 bp, Glycine max
  Peptide Sequence Number=SeqID_233373
atggaatcaaccaatgtgaagaacaagtcaagtggaaaaagaaagatgtctagtgaggacacaagaagttactttgcatggaacttggaaatggagcgtgtgctaactaatgtgcttagagatcaaagaaatttggacaataaaggtgatggaaattggagagcagtaacatacagtactgcagctcaaattttttccaagcattttggagttcatctcatgcgagataatgttaagaaccattttaagctttggagaacatggtatgaaattgcgagtgacattcttattcaaagtggatttgactgggatagcacaaagtacatgattaccgttgaaaatgaaattgcatggaatgaatatgttaag

SEQ ID NO: 116596 - DNA, 171 bp, Glycine max
  Peptide Sequence Number=SeqID_233374
atgtctgacaacagagacttcttcatgctgaaattcactagaaatgctgatgatgaataccagacaattctgtataaccagagggatggtagtttcagaactttgttgtggtgcaacttcaagatttttaccaaaactttggtcatctcgaacgctttgtcagatgtttga

SEQ ID NO: 116597 - DNA, 198 bp, Glycine max
  Peptide Sequence Number=SeqID_233375
atgggtggtgcaatgaccttgttggatatccctggtgggggaaatatagtgtttttcatcaggaaaaatacttgtacttgggggcatgtcactcgatttagaactccattgagactcaggctgatcatcgtggagggggggggggagttgcctgtgcacgacagggtgacctcgccacttactgcccagttttcctaa

SEQ ID NO: 116598 - DNA, 153 bp, Glycine max
  Peptide Sequence Number=SeqID_233376
atggtggaattggtgtcggggatgctccggtggctctgggacatgatgttctatgtgccacagtggaggtggatgaacccttgcacttcttggatgattctaccatttggtgaagttattaaagattttgatcggctatctgttcttgtgtaa

SEQ ID NO: 116599 - DNA, 204 bp, Glycine max
  Peptide Sequence Number=SeqID_233377
atggataaaagcaaagaggttgcaactcctctagctacaaattgctaccttagtgtagatgaaaaagggaaactcagcgaccaaacaaacttgtggtaccctaaaggtgttgagatctctctagtgggatactcagattttgacttttctggatgcaaactagatgggaagagtacaagtggaacttgtcacttattggcctag

SEQ ID NO: 116600 - DNA, 516 bp, Glycine max
  Peptide Sequence Number=SeqID_233378
atgacaaagaagaagaacaagaggataaaaagcattaggcacagaaccacagaccccataatgaagaaggagaaggaaccagcaaagggtggtctttcagtaagaggaaaacgagttgcacattctccctcacctcctaatgctttaaaggaaactccttggttttttgaagaacactatgaggcttcaaacaagttcagttatgccaagaaggagatgattcaaccgatgttagtttggcgtggctcaaaattctacttgcataaggatactgagataatttctcctactctagtagggtgcttgctcatctcctactgcatgaactcctcaccctctatagtgggcacctatgaaggcaatactccgatgctcaagtcaggatcccccaatatgtctaggccaactagtaccttgatttgttgcctaagctcccttggtcttggccaagggggtgctcggctaaggccgaaggagttttcacccatgcccttgtacgggttgcatcccttatag

SEQ ID NO: 116601 - DNA, 870 bp, Glycine max
  Peptide Sequence Number=SeqID_233379
gagggctacacgccctcaccttcagagcactacacgtcctcgccttcagaggactgcacgtcctcgccatcaaaggactttacatcctcgccaacagagggctacatctcccaaccttcagaggaatacacgtcgtcaccattagagggctacgcgccctcgccttcagaggactacacgtcctcaccttcagagggctacacacccacgccgttagaggactacacgtcctcgccatcagaggactacacatcctcaccaacagagggctacatgtcctcacctttggaaggctacgcgccatcaccttcagagggctacacaccctcgctatcagaggacaacacgtactcgctgtcagatgactacacgtcctcgccaactgagggctacatgtcgtcaccttctgagggctacgtgccctcaccttcagagggctacacgccctcgccagggctacacaccctcgcctttaggggactatacgtcctcgccatcagagggctgcacgtcctcgccatcagagagctacacgtcctcaccttcatagggctacacgccctcaccttcagaggactacacgtccttgccttcagaggactgcacatcctcgccatcagaggaccacacgtcctcaccaacagagggctacatgtcctcaccttcagaggactacacgtcttcgccatcagaggattacacgtccttgccaatagagggctatatgtccttaccttctcagggctacacaccctcaccttcagaggactacgcgtcctcaccttcagagggctacacgccctcgcctttagaggactacgcgtgctcgccatcagagggctgcacgccctcaccattagaggattatag

SEQ ID NO: 116602 - DNA, 1050 bp, Glycine max
  Peptide Sequence Number=SeqID_233380
atggaaagcattgaaatggaggaagccgcattcggcatagacgaatccaacgatgacttgtgcagttcgatcctctctcgcttcgctaactccaccgacgaaacccaccaacacctctgcgccgtcatcggcgccatgtcgcaggagctcaaagacaacaaccaaccttccacacccttcgcctacttctgtgccgcacgcgtctctctcgacaaattcacctccgaacccaatcccccgagccacgtcatcgatgcgcttctcaccattctctctctcgccctccccagagtacccctcgagctgctcaagaagcagaattcgcagcagggagagccgttctcggagctccttcttcgagttctccgttctccgtcgtcggcgtccgagactgcgcttgtttccggattgaagtgcctctcgcgtctgttgatcgccagggaaagtgtagactggtctgacgtgtctcctttgttcaatgtattgttagggttccttactgattcgcgacctaaggtcagaaggcaatctcatttatgtcatcgtgatgtcttgttaaactttcaaaattcctcactactggcatctgcgagtgagggagtaacaaacctactcgaaaggtttattctgcttgttggtggagcaaaggcaaatgctggtgaaggagctaaggaggctcagcagattctgtatattcttgatgccttgaaagaatgtcttccttttttgtcacggaagtctaagaccagcgttcttaattacttcaaatatctcttggatctgcatcaacccttagtcacaaggcgcataacagatggtttgaattttctttgtcattatccaacatcagaagtttcccctgaagcactacttgagttgttaaactcattggctcgttctatcgaatcaaataagatgtctggagacagattgacatttactgcccgcttgcttgatgctggaatgaataaagtttattctcttaaccggcaaatatgtgttgttaagcttcccgttgtccttaacgctctcaaaggaaagatgttgtga

SEQ ID NO: 116603 - DNA, 618 bp, Glycine max
  Peptide Sequence Number=SeqID_233381
atgcaaacacaacgagttaacactctcgcacttttcctcttgttgttgctctctccgccacgccccgccgcatcaatgccaccacgagatccgctccggtcatcgtgcgcaaaggccaggtacccaactctctgcttccaaaccctctccaacttctcaaacctcgccacgaagcccttggacctagcccaagccgcgatcaaggttagcctggctcgcacgcgcaccctctccgtttacttcaagacgctgaatgccacgtcgtcgcgtttcgggaagaggcagcgagttgcggtgagtgactgcgtggagcagatatccgactcggtgactcagttgatcaacacgctcaacgagttgcagcacctccgcgccggaaccttccagtggcagatgagcaacgctcagacgtggaccagcgccgccctcaccaacggtgacacttgcctcagcggcttcaacgacggcggcgccaccgcggacggtgctaaaatcaagttggaggtgaagcgaaggatcaccgacgttgccatgctcaccagtaacgcgttgtatctcatcaatcgcctcggtgatgatagcgtgagtgggaagcctcgcactgatttcggaaactga

SEQ ID NO: 116604 - DNA, 1857 bp, Glycine max
  Peptide Sequence Number=SeqID_233382
atggaagatgtgcagaagcttcctgatgaagattttccatttaggaaacagctgcatgaatgcttcggatcagctcttgttgcaatggggcctgaaattctgctgtctcttatacctctaaatttggaagctgaagattcatctgatgcaaatgtctggctttttccaattctaaaacattatattgttggtgcacctttaaattattttacagaagaaattctgactatgattaagcgtgtaagggagaaggctcaaaagcttgagaagcaaggattgatggtgtcatcaaggaatgcagatgcacttgcatactctttgtggtctctgctgccttctttttgcaactatccttcagacactgctcaaaatttcatgaatctggagaaacatttacgtagtaagctgaaagaagaacctgatatctgtggaataatatgcactagtttgcaacttcttattcagcaaaacaatattgtggattctaaagacaagggttatatgggtgaagatatgtccaaagaacaaattctggttcattattcacagcaggttgcaagagacaatttatatgtgctgaagttatctgcaaggcattggttaaaagatctttccgaagtattccttaaatctagcaaagatgatggtggttgtttgcagcgtacgattggtgatgttgcttctatagctgataaagtagatgtacgcaatttattcaaggagaaaatgttgaagctttataaatgcacacgaaaggccagcaaagtaggcagttccaaaaattctcattctatgcagattgatgatgcatcaaacaatttgtccccatcaattttaagggcacagcttcttgatttggcagtttcactgttgcctggtttagacgctgaagatattgctctattatttgaagcaataaagccagcattgcaggatgctgaaggtgtcatgcagaagaaggcatacaaagtactttcgatcattctgaggagctcctccaatgattttgtttcatcaaagtttgaggagttgcgtcaaactatggttgaagttcttccgtgtcatttttctgccaaacgccatagacttgattgcctttacttcttaatagttcatgtctcaaagtccaaggctgatatggagcactggcgagacattttccttactgaaattatacttgctcttaaagaggctaataaaaaaaccaggaacagagcttatgatattcttgtcgaaattgcccgtgcatttgtggatgaagagagaggtgggaacagagaaagcttgaataatttttttcagatggttgctggacactttactggggaaactccacatctgataagtgcagcagccaaaggtttagcccgtttggcttatgagttctctgatcttgttttaactgccttcaaattgctcccaggcacacttactctcctgaggagtgataataaagagataatcaaggccaatcttggttttttgaaggtattagtagccaaatcacaagcagaaggcttgcagatgcacttgaaaagcatggtggagggtttgttgaagtggcaagacaactcaagaaatcattttaaggctaaggttaaacttcttttgggaatgcttgtcacaaagtgtgggcttgaggctgttaaagccgtcatgcctgaagaacacatgaaacttctttccaacatacgcaagatcaaggagcgaaaagagaggaatcgaagtgctaaatcggaagaaactagatctcatttttcaaaagcaaccacatccagtggcgctgatcaggggtgcccaaaaccactgagtaggatagtgggatggtcactatatggaaatttagaggcaaattaa

SEQ ID NO: 116605 - DNA, 625 bp, Glycine max
  Peptide Sequence Number=SeqID_233383
gacggtgcggctgctctgttgagccgcgccatggaatcgagagctccaagtgggccatttttggtaagcagaaactggcgatgcgggatgaaccggaagctgggttacggtgcccaactgcgcgctaacctagaccccacaaagggtgttggtcgattaagacagcagggacggtggtcatggaagtcgaaatccgctaaggagtgtgtaacaactcacctgccgaatcaactagccccgaaaatggatggcgctaaagcgcgcgacctatacccggccggcgcgagcccgggcggagcggtcgtcggtgcagatcttggtggtagtagcaaatattcaaatgagaactttgaaggccgaagaggggaaaggttccatgtgaacggcacttgcacatggcctgcccaccctggaaacggatcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacggggctcccagtcccgaacccgtcggctgtcggtggactgctcgagctgcttccgcggcgagagcgg

SEQ ID NO: 116606 - DNA, 354 bp, Glycine max
  Peptide Sequence Number=SeqID_233384
atggtccgcaccaagaaaattgggcaaatgacttctaaggaagctaaggaaattgctgaaaagattgcctcacagggttcctttgtcacccatggacgtcaggatgtactgactccaaggacctcccgcacgtcttcatccatggctcccgaagacctagagcagctgacacaacaaatcagggaccagctagaggagtcgatcatagaaaaacctgaggttggtccttcaactgctcgtgttagcacaaaggagagttgtgttaatccttcagggaacgatccagacacggtcaaggttggtgttgaggaagttagagatgcacattctcccattcctgtacccactaaagag

SEQ ID NO: 116607 - DNA, 708 bp, Glycine max
  Peptide Sequence Number=SeqID_233385
atgaaaacactgttacgtcagactctgttggcaacgctggttatcacggcggcaggcaccgcgtttgccgccaccccggcctcacacgattacgccgctgacttcagccacgtgcagcagatcaacgcgggcgtgctgaacaccggctatgtggacatcggtccgcgtgatggtcaggcggtgattttgctgcacggctggccgtacgatatccagagctatgctcaggtggcaccggcgctggcggcaaaagggtatcgggtgatcgtgccgtatctgcgcggcttcggcagcacgcgtttcctgtcggataaaacgccgcgtaacggccagccttcggcaatggcagcggacgtcgtggcgctgatggatgcgctcaatatcaaacaggccgtgctgggcggctttgactggggcgcacgcacggcggacatcgtcgcggccctatggccggaacgggtaaaatcgctggtgtcggtcagcggctatctgatcagtagccagcagttgggtaaaaaaccgctgccgccagaggccgaacagcagtggtggtatcagttctatttcgccactgagcgcggtcagcaggggtatgccgcccatacacacgactttgcgaaactgatctggcagcaggcatcgcccggctggaaattcagcgatgccacctttaatcagagcgccaaagcgctggataatccggatcag

SEQ ID NO: 116608 - DNA, 242 bp, Glycine max
  Peptide Sequence Number=SeqID_233386
cgagcattcgctaagcgcgacactcagtggctaagcacgaggaagaatctagaagaagatgagctgtcaggttcgctgagcgcaccgctccaggtcatcaagcgcaccgcttcagctcatccgctaagtgaaggagacatcctcaccgcttgtatgtttgcaatcttgcatcttgttcttctttatgttgtaaaggaggtttccggactatggaaagctaaatcctctattggatcttccct

SEQ ID NO: 116609 - DNA, 187 bp, Glycine max
  Peptide Sequence Number=SeqID_233387
atgaatgctctcctagaacctaagcttttgcatcctagaaaaaccatgaattgtttgcagcccagcctcattacaagcctagaaagtcctttggattcaaattatgaaaagataaagaataagaaggttgcagtagctggtgtctcgctaagcgaggcatatgcgcttagcgagcaacatccgctaa

SEQ ID NO: 116610 - DNA, 327 bp, Glycine max
  Peptide Sequence Number=SeqID_233388
atgtgtgcgagtcacgggcgagtaacccgtaaggcgcaaggaaagctgatttgtggggatccccctgtgggttgcaccgccgaccgacccctgatcttctgtgaaagggttcgagtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 116611 - DNA, 1083 bp, Glycine max
  Peptide Sequence Number=SeqID_233389
gaactacgtttgtcttggacaaacttgttcctcagtgtcaactcaggatgggttcctccttttcagcttgaatatgttttactgagctcctttggaataggtcctaactttccagaatggctaaaaaggcaaagttctgtgaagggtacattgccaagtgtgtctgcaaatgttaaagtgctgaatgttgccaataactcaatttccggaacaatttctccctttttatgtggaacggaaaatgctactgataagttaagtgtgcttgatttttcaaataatgtcttatatggtgatcttggtcactgttgggtgcattggcaagcattgacgacaaccgctttctctggatatattccttcaacactgcaaaattgctctacaatgaaattcattgacatgggcaataaccaactttctgacgcaataccagattggatgtgggaaatgcaatatctaatggttcttcgtctaagatccaacaatttcaatggcagcattactcaaaagatttgtcaactttcttcccttatagtgctggatcttggcaataacagcctgtcaggatccattccaaattgtttggatgacatgaagacaatggctggtgaagatgacttctttgccaaccctttaagttattcatatagctctgacttcagttataaccactacaaggaaactcttgtcttagttcccaaaggagatgagttagagtacagagacaatctgatattggtgagaatgattgatcttttaagtaataagctgtctggagcaattccatctgaaatttccaagctatctgctttgcggtttttgaacttgtctagaaatcatctgtctggagggataccaaatgacatgggaaaaatgaaattgttagaatcccttgatctctcactaaacaacatttcaggtcaaatccctcaaagcttatctgatttgtccttcctcagtgtcctgaatctatcatacaacaacttatcaggcagaattctcacgagcccccctcttcagagctttgaagaacttagctacactggaaatctggcgctttgtggtcctcgtgggatcctctag

SEQ ID NO: 116612 - DNA, 330 bp, Glycine max
  Peptide Sequence Number=SeqID_233390
atgggacaagtaggaagaaaagataaagaacttaggggaagaagcaatggtgtcataggcggctatcacaaatggtttaaacctagaacacaagggataacttggctccaaaagctaaagggtctgaatagggaagagagtgaagaggtgcaagctttgaaagctgagctaaaaaagacaagagtagagaatgagaagctgaaggtggcagtcactagagttaggaaagaatgtgataagctgaaagatatcaacatgaccgtggctgaagcgctagagtgggaaacaaaaaaagacagaaaggaagaatggagcaagaacaagttctga

SEQ ID NO: 116613 - DNA, 489 bp, Glycine max
  Peptide Sequence Number=SeqID_233391
atgacctatacaaaagacaagagtattgtaccaggcgaccaacgttttctttcaccctatctctatcatccaacaatcaacattgttgttgcattgggttttgctacttcctcggccaacaaggaaatcattgcttatactgtcccttcacaagtcgaagaggtggagagtttgaagaagaaagtagttgagtttgtcgaggaccttcagagtaccatcaattctaatactaagttgactactgaagtgaacactctaaaatctcaagttcaactttttgagaataaagagttaggatgggaggctaaggtaaagaaggcgaaaaactcggtgggcttgttagagaaggagctagaaaaattaaataaggttctaaatgatgtggagcaggctagaaatttcgaaagggtggctaaggtgaaggttgagaagcttgttgagttggcaaaaatgagtgtgatcaagaaacacagggtgatcaaaaaatga

SEQ ID NO: 116614 - DNA, 612 bp, Glycine max
  Peptide Sequence Number=SeqID_233392
atggcaaagggaaaggccaaggatgtcattaatgccaaaagggtagtaagctcattcgaggcatcctccaacaatcatgttgatggtcgactagcaaaattcatttggatacgaaaagccaagaggataaagtcttcgtcgttgaatctcgaagaaaatgagatcaagcttttatgggtgctcgacatcaagaaaatccttttttctgtgtatcaaacatcattttggaacctgcacgtcaccctcctatttggcaagtttacaaagggggtctttaggattttgaacatagcaccaacccggttataccctaacagttgggaactattgaaaccttttaaattttattctagttattatgtgcctacccttggttttttattgtttgcatcgttgttgtactcatcttggggtgaggtcgggtggttgtccatggtgagtaggatgaatgctcctatgcttactccttacgctacttcatataaaaattttaagacttcattcttcaaggtcttagttgttgccaatggaagaaaccatatgtttacaaatgacagtattatgatgactatggatgacccctttgattatcaaaccctttcacgagcttaa

SEQ ID NO: 116615 - DNA, 399 bp, Glycine max
  Peptide Sequence Number=SeqID_233393
atgaatcggaccttattggaaagggccagatgcatgctatccaattcaagattgaataggagtttctgggctgaggtagtcagcataatatgctatcttgtgaatcgttcaccatccactcccatagacttcaaggcccctattgaggtatggtctaacaaaccaactaaatactcaatgttgaagctatttggatgtttggtatactatcacataagtgaagtggcaactctggacatggagttagagcaactcgatgtcaaaattacctttctccctagaagattgaagaaagacattttgatgcaacaacctgaaggttttaaggtggtaggaaagaaaaattttgtctgtagattgaaaaggtctctttatgggttaaaacaaccatcaaggtaa

SEQ ID NO: 116616 - DNA, 231 bp, Glycine max
  Peptide Sequence Number=SeqID_233394
atgacacttatcaggggtgacatgggagtgacgtgtttcaagatcttggtttcgagaaggggatctaggttccgagagagtgatatgcgaggaaaggggttgatagggaaggttttgagtggggttgtgattggggcaattgcaattttaggggtggtggtacaacctacgatgttgccaacgaagaaggtggtgtgtatggagaagatagttgttgatgcagtcaattga

SEQ ID NO: 116617 - DNA, 663 bp, Glycine max
  Peptide Sequence Number=SeqID_233395
atgagggaagttatgccactgatggaacatcttgatgagctaaactttgttctgatggagctatgtgacattaatgacagaagaagaagaaagaaaaaggtggcaagaagagcaaagttgatcctaaggacatctataattactacaaataaccaagtcactagaagcgagattgtccaacaaaagcattggtttatgacatgtgagaagaagtctggtggtaacgtcctcatgggtaacgaagctccttgtatgtttatcggtatgggttctatacaaatcagaatgcatgatggtgttgttagaaaattgattgaagtttatcacattccagagcttaagaaaaatcttgtctctatgggtgccatggattcaaaagatttttcttgcaggcaaggcttacctggaaatcacaatgtggaacctcttcagttttgtgagcactatgtctttaggaaacaacatcagacaaagtttccaaaggttatgcacataacaaagaccatgttggactatgttcattttgaccactgggggccttcaagagttcaatcgttgggaggggcaaggtattttctctccatcactgatgattactctaggatgacatgggtattcatgaagaagaaaaaatctaaagctttcaattttttcaagccatga

SEQ ID NO: 116618 - DNA, 294 bp, Glycine max
  Peptide Sequence Number=SeqID_233396
atggtgtggagtctccaatcacctttcctccttctccattccattgtcattgatcttcaagaagcaaaggactccattgatgaagaagatccaaggcctacaagctttacatggagctacattagtggtggaaaggcaagaagaaaattggatgcttcatcctctccaacaagtagctctgatgctccatattggttttatgggtctccaaatacaggttcaaaaagacacaaatcaagcatagttagtgatggtagcttacttgagaagcttctatggaggctggctctttga

SEQ ID NO: 116619 - DNA, 640 bp, Glycine max
  Peptide Sequence Number=SeqID_233397
tagcatagacatcgccattgtaaaggagttttacgccaacctctatgaccccgaggataaatcacctaagtttgcactcctgaggcctgatcctcaggagttggctactaagctctgtatcccggggaggggatttgagcttaatgttgatgggcagccattgaagatattgaggaagaacatgaccactttagctcagacatggagtgttttttccttttctaacctcattcctacctcccacacatttgatgtcaccttgaacagagccaagttgatttatggcatcattatgaagatggatatgaatttggggtacctcatctcccaccagatctctctaattgcacaacatgatacatccagacttggattccctgccttgatcataactctctacaaggccagaggagtccagtcagattctagatccctggagaacttgagccctgccattaacttggcatatattaagaagaactgttggaatcttgatgatccaatagtgacatttagagggacaaggaaggccaggggtaggagatcagaggtccccactattcagcagcaccagagacaccaactccttcttcttccacagctccagtacctcccattcagactccagctattcctctag

SEQ ID NO: 116620 - DNA, 237 bp, Glycine max
  Peptide Sequence Number=SeqID_233398
atggatgttgaagaagatgctgagatccccttgattctgggtcggccattcattctgactgcaacttgtgttgtggacatagggaatgtcaacttggagatgagtgtggtggaccagaaaactaccttcagcttgtttgaggttaggacccgagccactccagacattccaccaacggcccctctaccagatgtctctcttctacctaccggccaaacttctctgtcttcttcttag

SEQ ID NO: 116621 - DNA, 798 bp, Glycine max
  Peptide Sequence Number=SeqID_233399
atgcagaagccaataacacccctaaggtttgaggaaaatgataataaaagagtggatgaagacatttggagtcctaaatttttgtcaaaggctgcaagtagaagatctaaaacaccaacactaaaatcaaggcctatgtcaaggcatggaagcaggcgatgcacaacaccaaactctctatcaataagttcttatagttctggtcgaaggagtgccaccaaaattgctgcatcatctcttaaaaggattatgagtagaaacggttccctggcttctttgccaaaaaatgagattttgaaaattgagatgaagcagggatggggaaaaggaagaaagattacatttgaaggagtaggtgatgagaaacctggatacctccctgttgatatagtattcttgattgatgaaataaaacaacctttgtttaggagagaaggcaatgatttggaaatatgtgttcagattcctctagtagatgcactaataggctgctccatatcaatccctctattaggaggggaaaatatgggtttgtcattcgagaataatgtcatatacccaggatatgagaaggttatcaaaggtcaaggaatgccaaaccccaaaaataatgggataaaaggtgatcttcatgtccaattcttcattgaattccccatagttgtatgcagatgcacgaatttgccacaaaacaagatagaggacaaagagagaatggatttcgtgcacttgagcttccatatgggggaggtcagggctgttgaaaaagaaagggaacttccatcagtgctccattga

SEQ ID NO: 116622 - DNA, 204 bp, Glycine max
  Peptide Sequence Number=SeqID_233400
atgaagaagcttaaagcaacaatgagtcctagtcctagtgagaagggtttgttggcatcatgcaaaacattgaggcacgtgaagcaagttcatgctcaaatcctcggtttaaaattggataattcaaacataagctccaagacacttataatttggtttgaagcatcgtcagtcccaatattcattgttggagactgttactga

SEQ ID NO: 116623 - DNA, 465 bp, Glycine max
  Peptide Sequence Number=SeqID_233401
atggaccctaagagaataaaggtcattcctgagtggcctactccatcaagtgttgagaaaagaatccctgagtttcaagaacctctggatttgaggtcaaatccttttttaggcattaagatcaatagagaaagatctaaaggcatttcaggtttgtctcaagaaacctatatcaataaagttttagagaggtttaacataaaagaatgttcgccgagtgtagctcccattgtgaagggtgatcgacttgaatttggtcaatgcttgaaaaatgaccttgagcgggaaaacttccttgaatccttcccaagtgataggagctcctggagttgccaaactccctttagcgttctttcgccaatgctctgtattagactccaacattatttgcactgcggcgaaaaaatgatggatcgttcctacgaaattcagataaccctatgtattgagggttcagaggcataa

SEQ ID NO: 116624 - DNA, 1228 bp, Glycine max
  Peptide Sequence Number=SeqID_233402
atgagttgtagggagggatttatgtcaccacaaacagagactaaagcaagtgttgggttcaaagctggtgttaaagattataaattgacttattatactcctgactatgaaaccaaagatactgatatcttggcagcattccgagtaactcctcaaccaggagttccgcctgaagaagcaggtgccgcggtagccgccgaatcttctactggtacatggacaactgtgtggaccgatgggcttaccagtcttgatcgttacaaagggcgatgctacggccttgaacctgttgctggggaagaaaatcaatatattgcttatgtagcttatcccttagacctttttgaagaaggttctgttactaacatgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaccatgtgaattcccaaccatttatgcgttggagagaccgtttcttattctgtgccgaagccatttttaaatcacaggctgaaacaggtgaaatcaaaggcatttacttgaatgcaactgcgggtacatgcgaagaaatgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtagatcgaagtcgcggtatttatttcactcaggattgggtttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcat

SEQ ID NO: 116625 - DNA, 275 bp, Glycine max
  Peptide Sequence Number=SeqID_233403
gttgcacggtctttactaacaagagtatcacacgtgtacatgtggtattcttggatgcatttcgtgacctcagccaaacaggaagctacgcatggggagctactgcactcgttcatatgtatgagaatttgaatgatgcgttaaagagaagcgctcgacaacttgcaggatatatcacacttttacagtgttggatctacgaacattttcctactgttgcttcttctattgttgctgaagattatcatgaaaggaaatcacgtgcttgttgttga

SEQ ID NO: 116626 - DNA, 954 bp, Glycine max
  Peptide Sequence Number=SeqID_233404
atggttagaaccagaggattgcattgggttttaggtaaagttttaggaagagctttaggtaagcaggcacttgtagctattacagaggatgttgagaatgtgggtaatgttgctgacgaggttcatgaggagcctcacaatctagtttcggatcatataggtgctgatacaaagagttttctaggcgggccccaagatacatcagaacatactgagttgaagttgccctctcataggaggaaggtagagaaatttggtaggcctgcacttgagattgaaggcatagtgactcctacaggattaagttctttgattacatgtttgttggagacaggtgataggggacttttatctgcttctgcagagagagtgccacacatcaatgtggcattcttggaagcatttcgtgatctcggccaatctggaggctattcatggggagcgattgcacttgttttcattcttggatctacgagcatttccctagaattacgttcattattgttgatgaggattaccattagaggaaaccatgtgcttgtcattggaaatcttgaaaggcattaccaatggggttcatctactgccaaacacctaccaaagagggtagtgtggcagtttggttatgttcagacaattcctccactccctactgctccatccttgtccacagaagagactgttgacaaatggcttcagttttttagaataccttgcactactatgccacaaccacctgcacttgcggctatcgatgcggacatgcctcgacatatagtggccacttgccaaaggatagcaaaaagtttggaacacatgatcaacatgaggatggtcactactggaactgatgcatacactttgactgagcactgtctaagattagccagggacaaaggagggatacatagaacagagatgatggtggatgacgatgaagacggttgcaattga

SEQ ID NO: 116627 - DNA, 573 bp, Glycine max
  Peptide Sequence Number=SeqID_233405
atggacatgaatctgggctacctcatctcccaccagatttctattattgcccagcataactcctctaggcttggatttccagccttaatcacagctttgtgtaaatctagaggggtcacatcagattccagatccttggaaagcctcagccctaccattaacatggcatatataaagaagaactgttggaatctagatgaccccttaattactttcagagggccacgtaaggcaaaggggaagaggtctgaggctcctccatcttctgacattcctccttctacaactctttccactactgttccatcttcttctactgtagctccatctgttccagctccagttcctgctccagctcctcctacaggaccatcttcttttccttcagagactttatttgccatgttgcagagccttcatagaggccagctaagaggccagccttctccttctagagggggtgaggcccctgcaacccaagagcctgtgccagcagaggagcctatgccagatgtagaggatgagcctgttcctcctgagccatttatctttgagattgatccagtcgcttag

SEQ ID NO: 116628 - DNA, 444 bp, Glycine max
  Peptide Sequence Number=SeqID_233406
atggcttcacttcaacaattcccttcactaggatcttcccatggcaaagggatttcaatgagttgtttgattgcagttctctttttttataccctattactgaagaagttcactcagacactgacattgcgtttgagtccattgttgttcaattgtatgatcctctactttctcacgcctatgttcaactacttcagaaggagcttaccaaaaccctcttttgcacaagcttttaagggtcatgcctttgctaagaatgaatctcacaaatggtctctgattggtgatttcttctacaagaaaccatctagatggaagcctcatcgctttcatatgactcctggtagcccacttaccatctcttctaacttcaaagactctggtgatgagttcttgaggaagtttgatgaagaagctgccaaacaaaagggaagaaaaatgtaa

SEQ ID NO: 116629 - DNA, 510 bp, Glycine max
  Peptide Sequence Number=SeqID_233407
atgactgcaaaagaaactaataagaaagcagctgaagaggctaccacatttgttgtggatggagagccagtgccagaggaagtcattattgatgaagatgatgtcaaacgcttagaggctatttatgaaccattaacttatgacaacatttccaatgtccaagaaggtctagaacataggaaagtgatacaagtcactgcagaacccatcagattgtcccctatctttgccactcttgataggcatctgacaagaatgttgtcctttggaatggaaaacatgaaacaaggtttagagaagcgaattggatattgggactcaggattccccgggattgatccttccttttatccaattttggacaacctacctgaagaggagcaacctgctcttagtgtctatgatgtagatggaccagccattcatatgcttcctcctcgacagactgctactcctaatcccaacaacattatctacatctacgaaccaagcacaatgtgtatcctttag

SEQ ID NO: 116630 - DNA, 237 bp, Glycine max
  Peptide Sequence Number=SeqID_233408
atgggggaggagcttgccacccagctcgcccaggcgagctcagctcgtccaggcgagctaagttgtctcctccagaacatatttgggatgtgtcaactttcttacttccttgctcccactccaacccagcttcacactactttcttgcttgaattgttggtggtccttcagttgtttattggattgttgctatgttttttggacatgctgctcatcatcacagtttggggagactaa

SEQ ID NO: 116631 - DNA, 1827 bp, Glycine max
  Peptide Sequence Number=SeqID_233409
aatgacaagtgggtgggaattacactttactacaacaatggaattggatccctgagtgcagagcagattcagaggatctctgcaaggttgaggcagtacggtaagattgaaggcaagaataccccaactaatccttctgctgctttgaaacttgatctagttgatcccattcacaccaccaagtattgtaacatctcttctattgcagggatctcttcggcatcatcttttgttgagatggttattgtgggacggatgcggaattatgggtatggttctatgcccatggagaaaagttttaggaagcagcaagaagagagtgaagctaggcccaagagaaagaaggcgatacccatctatttggaggactacaatattctcgatgcggttaggatattcgctgtaagagaactcattctgttaggattgttgggccatgcttcttggtcctcgaaaaccaagtgtaacattgggtgctttcattgcacaacaatggtggatgcaactcgttctaaagcttctgcagatcgcctggaagatgccattgtgaaactcacagcctctcagctctccatgaattcaaaaattgatgatcttcttcatcgcatgtcgcaacttgaagctaaccagcaacctccacagacacctccatcgtcctcgatcatgcaatttttcaagtatcactccacgcctaatcaggaatgcttgacaattgcttcattctatatggaaggatcatctctcgcgtggttccaatggatgcaccgtaatgcgcagctctcttcgtggtcagcgattctctatgctttgcactctcgttttgcttcatctacatataaggattccacatgttcgttgtgtaagcttcaacaatgttcatcggtaagcgcttatttgtccgaatttgagtctctggcaaatcgtatagtgggactaccagcaccatttgtgttgagttactttatttcggggttgagtcttgccattcgccaggaggtgcaagtcctacaacctatctccttggctcaagcagttgcttatgctcgcttacaggaggagaacctcctcgatgcacgcaggccacctacacatcgttttcaaccggccaccgcaacaaccatagccacacaatcaacttcagtcaaccccacgccaccactattacctactcctcaaagaacctcagctccctccattccttttaagagtttcacactagaagagctcgcggtccatcgtgagaagaggttatgcttccattgtgacgagaagttttctcaaggtcacaagtactcaccctcattgttaagagctcgcatcggaggccactcagcgcttgaaactttacatatgaaggggctcattgacaagcatcatgagatagctccacttcgaattactgtgggtagcgaagacgagatccgttgtcatcagctttgtacggcctggcttaaaaccctgggaccaatgctcacagattacacttcattgaacatgaagttcattacaagcgataagctagtcaaattgcatggtgactgcgagaaagacgtggaacctgactgctcaatatcagctggggatagcagtggccatgttggaataaaccacaacttggggtgggttggtgtggacccatataattcctcaacccatgccaacttctttgacaaaataaggccaagtgatcaagaaaccctggaagaagaagcagagaacattggtgctactaagatattagcttgtgttcatgtgcatctccgatctaatagtgtgctcggccggacaagcgttccagtgggactggccaaggcaaattggttttaa

SEQ ID NO: 116632 - DNA, 281 bp, Glycine max
  Peptide Sequence Number=SeqID_233410
ggatcgcgctcgcaggacacccagtagacccgaagaagtccaacagggtcttggagttgccagctctgattacgggcctctatcagttctacggagtgcctatcgtccccagcaaggtaggcgcagggcaagataccacagcagcctgcgaatggccgacagcgggccatagacgcaccgccgccacctccagttcacctcagctcatccacaaaaaggttagagcgtttcctatgacacatggccgaccaataggcgaccaagtccaaagccaaaggtag

SEQ ID NO: 116633 - DNA, 585 bp, Glycine max
  Peptide Sequence Number=SeqID_233411
atgagagggtccggctggcatccagcggccggcaggtggaggtggggagtttcctcgcgccggccgaacgtcagacgcttgcagagacacttgaaagcttgctcgccgccagcgatggcggcaaccgacgacgctaagggtctaggcaatgaagcaaagcagcaggtggggcacgaagtgcgtgaacgcggttgccgcagtgctggtgaccgggggactgatgccgtcgttggcctgggcccaggcggccgatcccaagccgtggcagctgaacatgggcaagggggtgacccagacctcgcgcctggcctgggaatcgaacaacctgtcgttgatcatctgcacggtgatcggcgtcatcgtgttcggggcgatggcctacgccatgttcaagttccgcaaatccaagggcgcggtcgccgccaccttcagccacaacaccaaggccgaggtgatctggacggtgatcccggtgatcatcctgatcgtgatggcctggccggccacggccaacctgatcaagatgtacgacacccgcgatgccgagatgacggtgaaggtcaccggctaccagtggatgtggaa

SEQ ID NO: 116634 - DNA, 727 bp, Glycine max
  Peptide Sequence Number=SeqID_233412
atggccgaacagctgccacaccttgcccagtccctgcgacaaagtgacgcactgcgcgtcgcagactccggccggcgccaccagcaggcgccaggtccgggcctccgggttccacgggtaggcttggccagtggccagggtcgggctccgctggcgcaggtccaccggcggcttcagcagttggccggcattacggtgcccggtgggctgccagccggagaagcgcagtacggcagccagtgccatcgccccgaagaacacggcaaacagcagcaccagggtccggcggccggagccgcgcgcctgcggggacgtagcagtgttcatgcggggcattttctcatggttgggtacgggatgccggtcgggccacggcgcgcctcctgcgccattccagcaccagcgccaccaccagcacggtcagggccaggccgaaccactgcacggcgtagcccaggtgacgctgcggtggcagcgtgttcggcaacaggtccagatcacgttcgtcgccgaagggcagcgccgggtccaggcgcagtacacgatcgggaagtgactgcacccccagcgcgcgggccaggccttcggccggcaatcggctggccagccagcggcccgcttcccccgtggcggagaatgcgggaccgagtgccaatccggccgacggcggcggcgccagcaacccacgtacggccaccggcgaaggggtgccggcacatccggcagg

SEQ ID NO: 116635 - DNA, 561 bp, Glycine max
  Peptide Sequence Number=SeqID_233413
atgtttgaggtagatcaggtgaaagttgttatatgggaatgtgatgaaaaaggttctaatgcttcatttatagcctttgttcctaaaaaggaggtgcctaatcatcttggagattatagaccaatatctcttattggtagcttgtataacattatagctaaagtattatctttgagattgaaacctcttttgagcaaaataattgatgaaactcaatcagcgtttgttggaggtaggaaaattctagacacaatggttgtggtgaatgaagctattcatgaagctaagttgaggggatgcgagggaaggggttgtggtgagagaggcggtcttaaggtgaacttccataaaagttcacttggagttgttaatgtgcaaagatactctttggatagatttgtagaggtgctgaattgtgggattctcactatcttgctcacttatcttggtgcactagtaggaattaatgctcgcaaaaaggacacttggaggatagtaatccaaaaaatgcaaaggaagctaactccctggaggctaaggcatctctcaattggaggatga

SEQ ID NO: 116636 - DNA, 387 bp, Glycine max
  Peptide Sequence Number=SeqID_233414
atggcaattggggcagagggaacaaatcctaacatctcaacttttggtgctgaccaatttgatgacttcaatcccaatgagaaagagctaaaggccttatttttcaactggtggatgtttatctcattcttgggtgcttcgattgccactttaggattgggtgcattcaagagaatttggggtggggacttgggcacaccaatatatcaccacaaagtaagcacaaccaaaactcctgcttgggacataatttcggtgccaattgcagccttcaggattagaaaactccaactcccaagtaacccctcggatctctatgagcacaacctccaacattatgttaatagtgggaaacgccaagtctatcccactccaactctgaggtga

SEQ ID NO: 116637 - DNA, 357 bp, Glycine max
  Peptide Sequence Number=SeqID_233415
atggtgaatgcaccctgccttcgttgcagttctcttgctcttcactcctcaatgcacacttcttcttcctctcactctcagagcctttcactttcttcactcacttgtcacctctcctgggatgatttgcgagtcccatcttccctttatttccctgcatatgcacaaggacatggaccaccaccaacggtgcaggagcggttccagggaaacagatatagcttgccaaattcaaggataatgattcaccaacagcttagtggaggtcaaggaggacaaactgacatagatatacagaaaatggaccaaattggtcctcagcagtatttaagttctgatgttttcaatcagaaatga

SEQ ID NO: 116638 - DNA, 195 bp, Glycine max
  Peptide Sequence Number=SeqID_233416
atggccatggtattgtcacaaatcaagcttgaactagaaaatcaccacgcacagatctgcacattaggtgcagtagctatcgagataaagaaaaacagagactattgctcgagaagaaaagaggaaaagcttatgaacaagaaagcaaagaaattgagcaagatgatcaaaacaagcttctgtcttattcattga

SEQ ID NO: 116639 - DNA, 225 bp, Glycine max
  Peptide Sequence Number=SeqID_233417
atgagcaaaaatgagaaaaactttacttacctcaccaacaacaacctacggcggacacgttaccggaagccacgacccaggaaatgtggaatcccacgacagagggcacgacggcagaggctaggtaaaagaaaggcaacaagaagaaaggcaacaacaaagggcaacaagaaggtaatggcagaggctactaacgttttgctgaggctactaacagcaaggtaa

SEQ ID NO: 116640 - DNA, 183 bp, Glycine max
  Peptide Sequence Number=SeqID_233418
atggaaagaaatcaaatgcaattgtcaaaggcaaaagagtgtcaaacatggttgcatgactctacttgtgcttatgaaggaacagaacaagcagcagaccagcaatgcaccgttggagacgtagcagcagaccagcaacctagcaattttcccttgtcggctgaggtgtcaccaatccgttag

SEQ ID NO: 116641 - DNA, 720 bp, Glycine max
  Peptide Sequence Number=SeqID_233419
ggcgtgcccgctaaagacattgctacgctgaacgccttgatgcgttgccagctgttcagtgtgccgtttgaaaacctggatgtacaagctgggaaagtagtgtccatcacccctgaggatattgtcgagaagattgtttatcagcatcgcggtggttattgttacgaagtcaatggtgtgtttgccatggccttacaggcgttgggctttgattatcaactggtggccgccaggccgatgttttacccggtaaggcggccaaaaacacatatggccatcgttgtgcacataaaccaacaggactggctgtgtgatctgggttttggtagttatgggattcgtgcaccaatgtctttagaggtgctggatagcgaagtcatgcaggatcacgattgcttcatgttgactgcaaccgatccagatgcatttttactcaaggccaaggttgatcaggcgtggcaaccgcaatttgcctttgatttgacgccgtgggaattgatagatttctatccggccaactatatgaactccacgcatcccgatgcaatttttgtacaaaagttgctggtggtgttgcatacgcaagcagggaggcatattttatttggtaataccttaaaaactattgccgatggtgtcgtggaaaaacgaattttatccgccgccaagcgtactgatacgcttaaaacattatttggtttgtcgcttgagcatttttaa

SEQ ID NO: 116642 - DNA, 273 bp, Glycine max
  Peptide Sequence Number=SeqID_233420
atggaggaaaaaatgactgaaggagagcaagcacttgtgaccaattgtggatgtcatgccaaattactacgaattgttctagtggcaacatcaatgctgcttcacgtggagcttgcaagcattggatcttcttcatcaatggagtcctttgcttctagaagatcaatggaagtggaatggagaaggaagaaagatgattggagatgccacttcaaggagaagatgagtcaagaacaagctcaccaccataggaagccatggataagagcttga

SEQ ID NO: 116643 - DNA, 183 bp, Glycine max
  Peptide Sequence Number=SeqID_233421
atgagtacgccaagatatcaacagaaagggaagcaagggaaagggagtcaagaacttccccgattgctagccaaggccaaagcaatggcggacatctactccgcccccgaggagatccacggacttctcagctattgtcagcatatgatagacttaatggaccatatgattagaaaccgctag

SEQ ID NO: 116644 - DNA, 591 bp, Glycine max
  Peptide Sequence Number=SeqID_233422
atgacattgaccatcccacagctttttctcaagccgttgcatgttttgtgtgatgctaccgtgtttggggtttataatgacaacttctccttgtacatgaagcatgaagatctatctgaaataacacatgatggtcaatgtatgagcatctttgttataccattgtggatttttgctttgaaaggatttgtcgatagtcaacaaagtaaatccaagcctgctgctagatggattgttgttaaatgtaataagaaaaaaggaagcactgagtgcaagtactacgtaatgtattggatgtcaatgctaatcttaggaagttttaagaataattgggaaatggtaattttttacttcaaaagacctgcagtacatgttgtagtagagaatgagcacacccaaccattactaataaactcgaaagccaaggagcaggatgaagacagagaagaagaaaatgataatgctgaagaaactaagaaacatgtgacttctattgtggtggcatataagttatttacaccatcagtaaaggtgagaaacccgtcaatatggaggaaaatagagattaagcagttcaataatctaaaatga

SEQ ID NO: 116645 - DNA, 279 bp, Glycine max
  Peptide Sequence Number=SeqID_233423
atgtgggttgaggtttgttcttctgttgctcatgttagcataaaggaaacttgtgtcaattcctcggggaaggacccagaaatggatgactcggaaaaatgtgggttatatgttgatgacaatcctcctcagctggttgtttttggaagagttcatgaggggtcgatgaccgtccacaatgttcctttgggcaatgatcaagttaaggaaaaacatggagttgagggaccgaaaaaacttgtagataggttgatcctaatgtcaatcccttatacttga

SEQ ID NO: 116646 - DNA, 285 bp, Glycine max
  Peptide Sequence Number=SeqID_233424
atggtacccagacaaccttctccattttctgcctctacaaagtcaccacccatgccgcctctgcttcccaaggtaaccaacctatcttcttcctctgctaagccaccatcaccagtagaaaccaagccacctccaccaacagcagaaaccacgccaccttctcttcccatggcagcttcccaccttctcgttaacaagcaccagacactctccttcgaccccctcttggctgccaatctccggtcccacttccataggggtagttatcattctagaagtagttaa

SEQ ID NO: 116647 - DNA, 144 bp, Glycine max
  Peptide Sequence Number=SeqID_233425
atggagatgcctattggtatgtcagctttggtcattctaacttcctttgttaatgttaatgttcaagtgcacgagattatgtgtcgtaaactctcattttggaaagaaatagtccatactcatctggagatttgcagctcatga

SEQ ID NO: 116648 - DNA, 411 bp, Glycine max
  Peptide Sequence Number=SeqID_233426
aatgataactgccataagtgggaccggagattggcagccaagagggggtcgaaggagagtgtctggtgcttgttaacgagaaggtgggaagctgccatgggaagggaaggtggcgtggtttctgctgttggtggaggtggcttggtttctactggtgatggtggcttagcagaggaagaagatgggttggttaccttgggaagcagaggcggcatgggtggtgactttgtagaggcagaaaatggagaaggttgtctgggtaccatggtattcaatatccggagaatgacatcaagtttggaagccatggaagtttgggctatagcgagtttggccatggcggcctcgaggcgatccacgcaggcggcggaaagtttagtgtccgccattgaagagcagaccaaatggtaa

SEQ ID NO: 116649 - DNA, 582 bp, Glycine max
  Peptide Sequence Number=SeqID_233427
atggaacaagaaggtggattatgtgatgggaaagaagttgatcagtttcatcaaccgtctggtagtaatgaggttgccattgctaatgaggatggtatttcatatggatcagagctcatagaggttgacaaaatggtgctctctgggatattttttggagacaggatgtccctaagttgcaggaatatctggaagaatttcagagagtttaggtatgtccattgctgtcgtttaaagcagttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggggatcaaaattgcggattgagcattataggggaccaatag

SEQ ID NO: 116650 - DNA, 120 bp, Glycine max
  Peptide Sequence Number=SeqID_233428
cgagtgacgttaatggaagaagaaaatctttgcaactaactacccacaagaatgaatggggacgatcaatttctatggatgtcaaagatgtcgaagagtactaccaagaatgcaatgcag

SEQ ID NO: 116651 - DNA, 174 bp, Glycine max
  Peptide Sequence Number=SeqID_233429
atggataaggagtacaatgtgatcgtgttgggcatgggtctcaaggagtgcatccacgtcgcatcgattcaggacgccaaagatcgcttctcgcagatcgactcaaacgtgacgccgacgagaaggccaagcttctactacacgccgaggagaggcgaaacgccgtgttattga

SEQ ID NO: 116652 - DNA, 138 bp, Glycine max
  Peptide Sequence Number=SeqID_233430
atgccacagcattatgtactgcaccggtttttgataatcgacgtagataccgtgacgtcgaaaaacgcttttgcagagatagttcatgaaccatctgggaagcttgtgaatgggttaaaaaaagtttatcaaagctaa

SEQ ID NO: 116653 - DNA, 585 bp, Glycine max
  Peptide Sequence Number=SeqID_233431
atggattcctcctcccaacactttccaccaccaacactcaccactgccaatcagcctctcatggccccacctaccaagaatccacgtggtaggccccgcggctcaaagaacaagcctaagtctacctccctcttaagccaaccagttgagccctctgtgaagcttgtcaccatcaatgttgctccaggtatggatgtcatcgagaccatccttgatgttgctcgtcgtgaccatgttagcctcatcattcttaatgcatctggcatgataaaaaatgcaactgtttgtgactcaccacaaggtgtccctaccttgctcattggacccttctccttgttctccctcactggcttctacttatacaacaaccagtacgcccttcacccaggagccacccctccccctccgttttcctttgggatcaagctgtgcgcatctcatggacaggtcttcaacggacttattggcggcagcgtcattgccggtgataatgtcagcctcatggtctccaccttcagagaaccaaatatttgcaaatttattcccgaaggaaaagaagtgaacaacaatgacaacaatgcataa

SEQ ID NO: 116654 - DNA, 213 bp, Glycine max
  Peptide Sequence Number=SeqID_233432
atgtggatcccatgtggaccaaagcaagtacaaacctcaatgcaagagcttgcttcaaaaggacttgcttctaagaatgttgcattttctatagcggtcacaactcatcaatgtagcatgctgagcattctaagacggccattggcaaccgtcgtagaatatgcgaccacttttgacaacttcctctacgatgacggtcgtaaaccgatgtag

SEQ ID NO: 116655 - DNA, 585 bp, Glycine max
  Peptide Sequence Number=SeqID_233433
atggattcctcctcccaaccctttccaccaccaacactcgccattgccaatcagcctctcatggccccacctaccaagaatccacgttgtaggcctcgcggctcaaagaacaagcctaagtctacctccctctcaggccaaccaattgagccctctgtgaagcttgtcaccatcaatgttgttccaggtatggatgtcatggagaccatccttgacgttgcgcatcgtgaccatgttagcgtcctcattctcaatgcatctggcacgataaaaaatgcgactgtttgtgactcaccacaaggtgtccctaccttgctcattggacccttctccatgctctccttcactggctactacttatacaataaccagtatgcccttcacccaggagccacccctccccctcctttttcctttgggatcaaactatgcacatctcatgggcaggtcttcaacggacttattggcggcagcgtcattgccggtgataatgtcagcctcatggtctccaccttcagagaaccaaatatttgcaaatttattcccgaaggaaaagaagggaacaacaatgacaacaatgcataa

SEQ ID NO: 116656 - DNA, 246 bp, Glycine max
  Peptide Sequence Number=SeqID_233434
atggcaacaacagttcgaatagcattgctgctttgtggtgtcatccaattgggttttttcaagtatctgcaggccttgagggaagtatcctatgccatgatcgatatgccaactgtattgcaattctcttcaacaactaagaatgcggacgaatttgcctcaagacttttagatattcattctaagatgctacagattaacaaaaaagagttgcgagggacaaagtggaagtattttagaacatga

SEQ ID NO: 116657 - DNA, 201 bp, Glycine max
  Peptide Sequence Number=SeqID_233435
atgtgcaatttcagttgggctaagcgcacatctaccgctaagcgcaacttcagcatgcttagcacgatagaagaatctggcagagcatcaatatcagggtcacgcgctaagcgtgagatcaaggcgctaagtgcaacagttgtcttcagccaggctcagtgcatgactggcgctaagctcaaatccacttactcgcgctaa

SEQ ID NO: 116658 - DNA, 1419 bp, Glycine max
  Peptide Sequence Number=SeqID_233436
aatatgaatactagtgagaatggtggttgtttgctcccgggtgatcgttatccagattggtggactttccacagtgaagattcttctgtgatttttgaaatccctcaagtgaacaaacgtaacttgaagacaatgatgtgccatgtccattattcttccccagtcaatatagcaacagatggcttgaaaaatttgttggtgataaatcacacaaagaccaccattcagctttacaagagtgatgcattagcttccttagaagacgaggagtggcaaagggtattatcaaatatagagcctggtaacaaagtggaaataattgttgtttttgggagcaggttaactattgttaacaagaccacgatttatctcatatatgagccaatgaatgaaaaaatggagcactgccatgcgccaaataagaatgtaattgtttttaatggtgatgaaaatgtatgtaatgacaggtcaatctctcaagtgaaattcaaggatgacgtaggattggtgcctattctccggttgctaaagaatgtcgtgcttggtgtcgacaccaatgttcaaaatgaagtgaactggaagaaagggaatcaacaattcacaaagcttttgatgctcaagaccagagtggaggtggtggtttctgagttctggcaaatcattttgagtctacacaagagcccgggaggtttcaaggattcatcaggactaatgggattgctttgttcaaatgaatattctggggaagacactgaagtatctaaacctgagcattttcagtatgcgcccttggtagaatggacaaggacatgctttgttggcccaaacttccaggaatctgaaagaattgagggttctggtgccgaggttttctggaaacatatctccaagagaatgttgctttgtccatgcaacccttgtgaagcactttgctgtaaactgaagctgaagatagatgatacagggcccattaagtatttcatgtgtaacaaagtgtcaaaggagcgaaatgaagttgtatggaaattctattggactcatggggatgatgtttttgttaaggggaaaaccatgcacttgatctttaatgatttatgggggctgcaaagctctcctgctgcatcagcgattccaacgatgccgccactagctctggcgagaatggtgctgacgtggctgggtgtcgccagcaccaattgcggtacaaggtatgtgtccagcgagacagctgctgactgggcaacccgccaataccaatggcgggacatttgcaacgtggatcagtcccgccattggttcttgcgagaccgacgtggactcatggttctgccctcacgccttcacacaccagctacaactagggttctgccttcacgccttcacacaccagctacagctagggcactgtttgcaggttag

SEQ ID NO: 116659 - DNA, 1386 bp, Glycine max
  Peptide Sequence Number=SeqID_233437
atgccgttttgggccccactcaagtcaagcctctccaccaagctcctcaacataaccgtctcctctctctgcaaagcgaagcaaatccccaatgccgaaacggcaatcgtcgacggcatacgactcggcgtgctccccgacgtggtcacctacaacaccctaatcgatgcgtactgtcgtttcgccacccttgatgtcgcttactccgttctcgcgcgaatgcacgacgccggcattccccctgacgttgtttcattcaataccctaatctccggcgctgtgagaaagtctctgttctcgaagtccctcgacctgttcgacgaaatgctcaaacgaggcatcaaccccgacgcatggagccacaacattctaatgaactgtttattccaattgggaaagcccgacgaggcgaatcgcgtttttaaagaaatcgtgcttcgcgacgaggtccaccccgctacatacaacattatgattaatggcttgtgcaagaacggttacgtagggaatgctttgagcttgttcaggaatttgcagaggcatggtttcgtgccgcaggttttgacgtacaacgcgcttattaacgggctctgcaaggcgaggaggctgaaggacgcgaggagagtgctgaaggagttcggagagaccggcaacgagcccaacgcggttacttataccaccgtcatgacgtgctgtttccggtgccggttattcgaggaagggttggagattttgtcggagatgagaagtttggggtttactttcgacggattcgcgtattgcacggtgatcgcggcgatgatcaagactggccggatgcaggaggccgaggagattgttgagatgatggtgagttccggcgtgaggccggatcttgtgtcgtataatactttgattaatctttattgcaggcaggggaggcttgatgatgctttgaggttgttggatgagattgagggggaaggcttggagtgtgatcagtatacacatactattattgttgatggattgtgtaaggctggtaattttgatggggctcagaggcatttgaattatatgaattcgttgggttttggatccaatttggttgcgtttaattgttttctcgatggtttggggaaggccgggcatattgatcatgctttgagattgtttgaggtgatggaggtgaaggattcttttacttatactatagtggtgcacaacctttgtagggcgaggcggttcctttgcgcatccaaggttttggtttcatgtttgaagtgtgggtatcaagtgttgagggccactcagcgggcggttattgttggtctccggagtattgggtatgcaaatgaggcgaggaaggttaagttgacgatcagattggcacagtttgtgccttga

SEQ ID NO: 116660 - DNA, 354 bp, Glycine max
  Peptide Sequence Number=SeqID_233438
atggtccaatgcaattccactgtaaatgtttatcaacatcttcctgctcttctctcgaccaaccaacaacatatttggacacctcctcccacaggttttgggaaatgtaacctagacgcaaaaattttcaacaactcactcccttttgggattgatatttgtattcgaggtgagcatggtcatttcatccaagtgaagatgtcctctttcaatggcattccaactctggctcaggcagaagcgtgggctctttaccatgctcttcaatggacttcacatctaggctaccaaaatgtgattttgaaagcgactggaagacaattgttgacaatcttgcttctccttctaatctga

SEQ ID NO: 116661 - DNA, 261 bp, Glycine max
  Peptide Sequence Number=SeqID_233439
atggagcataagcttcaaggctttgttaaaattgacagggatgattccagcctacctctggttacatctcctatcagacatgccacccagagttttgccaagtttagtgagaaacagatgtcaaacttccacaacagaaatttgagcacctttgcagttcagccttcatttctggcaagtcattttggatctagatgggataggaatgctctatcagatctaaatggcggtcaagtacattcttggggtgaaactccatga

SEQ ID NO: 116662 - DNA, 654 bp, Glycine max
  Peptide Sequence Number=SeqID_233440
atgagcttagatgactcatctatcagcttgggattggagaggatcagggagtgcagtggggcaatctcaaatgcttgcattttgcatactgatgaagtagtatctgagaagttgattctctctggaggcaaagcaggtcctaaagaaaaaatctctttggatgaattcaaagggtgtccccaagatgaagcagaagcaaacattcaaggaaaagagcatgagttgtcttatacagctcaggagcatagacccagagaaggtgtttcacaagaagaatttcaggattttcatatcagtaaaagaaagaggataaactggtggaagtgctttgtcaacatcaagaaaagtggtgaaggaaatgtaaggtccaaattgaatgcagggacaaataaaactcgaagaataaaggtgaagcagaataaaaagaggtgtttggagttcagtggcctataccttggacaagaggttagagcacacaatggcctagtctggaccatgaaatttagtccatgtggtcagtatttagcgagtggaggtgaagatggtgctattcgcatttggtgtgttacatcactggataaatccagtatttgtttcaccccacaagacagtactgctaaaagcaaagtggaatgtgacaactcttctccttag

SEQ ID NO: 116663 - DNA, 189 bp, Glycine max
  Peptide Sequence Number=SeqID_233441
atgaggccgaggcgcttccgaatcgcatccatggtcgattcctacatcgttcttcaccgttcttcgttcattgttcgtttgtcaaccgtggcgaatcccgtgcattttcctttcttggaagacgcaccctcaagcctcgccttgccctctcgccgaagggtaggttgcgatagttggcgactctattag

SEQ ID NO: 116664 - DNA, 348 bp, Glycine max
  Peptide Sequence Number=SeqID_233442
atgggtaaagtagaggagatacaagagaagatgaaggtcgacatggaggccattaaagagaaaatggccacaatgatggaggccatgatgagcgccaatgcggttgcaattgccgctaccagcgttgttgctaaggtgaacccgacgtccccattcggcatcaatgaatcatccaacctcaaatatggtaggcaaagatttgggaagtatgggatggcccccatgatgtgcaaattcaaaacgagcacgccttcccatcatatggcttggctcccaactatacaccacccaatgtggcatacactctcaatgaaaaatctcaataaactccactccgatactcattga

SEQ ID NO: 116665 - DNA, 144 bp, Glycine max
  Peptide Sequence Number=SeqID_233443
atgacaattgctgttggtctcccttctctttgcaaaacacctgataatctctcacagtgttctgttgaaggaagttcccagaaggaacagatgaaacggcctcagctaagaatagtgaatcttatatcgggaagagattgttag

SEQ ID NO: 116666 - DNA, 1089 bp, Glycine max
  Peptide Sequence Number=SeqID_233444
atggaagcacacaacccggacctgcgtgcggcggcactggcgctgcgcggcgtgcagggcgatgtgcagacggcggcgttgcgcccggccaccgagttgtcgatcggcaccagcaagatcagccccaagcatggcatcggctccggacgctggcaggacaagcgggtggacagcaccgtgggcctgagctggacctgggagcgcggtggcaagcgtgcgttgcgtatccgccaggccgatgcgctgctggaagtggccgggctggagatgctcgatgcgcggcgccgccagcaggtggcgctgcatgaaacctatttcgctctgaagggcgcacaggagcgggcgcagattgccgatgccaaccgccagagctcggccgagcagatggcggcggcggacaagcaggttgccaccggggcgatggcgccggtcgaccgcgcgcggctggcagtggacgacctggcggtggccgacgcggcgcgcgaggcgtcgctggatctgcgcgatgcgcagcatgcgttggggctgctgctcggccgcgacgacagccatgacctcagcgccgatgatccttggccggaggccagcagcgtggccagcgtgcgtgcgttcgatccgcagcagcgtgccgatctgcgcgcggcacgttcgcgcctggccgcggccgacgccggtgtggcactggcgcgcagtgagcgccaccgcgacatcgagttgggcgtggaggccgagcgcgagccggctgacatcagcggcgtcacgtggggtgtgtcattgaccattcacgctcggcggcccgtgctgcagcgcgaagcgcacgccgaactggaccagttgcaggccagcgcgcagtccgccgcgcagcgtcgcagcgactacgaaggactgcagtccgatgccgcacgcaaggcggtgcagggcattgaactggcctaccgccgcggcaccgccagcctgaccgatctgctggatgcgcgccgcagctggcgcgagttcgaggctgcgttgattgaagcgcgtgccgaccatgccattgctttggcgcgctgggaagcggccacatccattgctgaaggagagttccgatga

SEQ ID NO: 116667 - DNA, 1194 bp, Glycine max
  Peptide Sequence Number=SeqID_233445
atggttctctctggcacaacatactcaattttcctagagtctgaaaatcatatcaaatcggctacttttgtgtctaaaagttttgaagtgggaccaggaaaaattgcatcaaaagcactttacgatattgagtttccaaaaggtcatattggggtcaagagttttgatgccgaactagttgatgaagatgggaattctgtacctttgtatgaaacctatcttcatcattggtttgcaataaagtacaatgaaaatattaccatgtcaaggtacattgagcaatctcatgacattagtaaaggtatcaattacacaagaaatgatggtgcatgcagaggctttatgcttccacattattggggcttaggtggagaatcaagaggaacatcctcaaatcttccagacccttttgcggtagaatttggtaaccctacaaatattccacatggatttaaggaaaaatggttgttcgacatcctggctatcgatacacgtggtgcatatagtagaaaaggttgcacagaatgtagatgtgacctacttaatcttccaaaggacttttataatgtcacaagagacattaatgagcaaccattgtccctaaactataaaggaggacttttttgttgtaaagataacttacaatgcaaattaagaaagggttttcatggcccaacgagaaagctttcactgagatacaaaataaggtgggttgattgggatgaacaccaagtgccacttaagttttatatacttgatacaactgatcgtgtgagaacaaatggctcatcaacaattcatgattgccaggcagaatataccattccaagaattggtcacggtgactcccctcatgttaagaaagcaaacatcccaatgaaaaaaggtggttatcttatatatggcacttctcatatgcatactggtgttgtcaatgcaactctttatggacaggatggaagggttttatgtacttcaacaccaaaatatggaacgggaaaggaagcaggaaatgaaaaaggttacctagttggaatgtcaggttgttatcccaaaccgggctctgttgagattaaagatggtgaaattctaactctagaaacgagatatcaaaacaagtttcgtactggagctatgggatttttccatattcacttggcagaacaactaccaaacaaagatttaaaggtttaa

SEQ ID NO: 116668 - DNA, 1056 bp, Glycine max
  Peptide Sequence Number=SeqID_233446
atgtctgatgaatactgggtcaaagcaatgcaagaagagctagctatgtatcagaagaacgatgtatggaagcttgtagaactccccaaagaaaaatttgttgatgaagtaaagtgggtgttcagaaataagtttgatgaaacatgtaaggtagggaggaacaaggtgaaggttgtagccaaagattctaattgtccaaatatatatggacaatatcatattaattatggagaaaaggaatataggtttcttggttattatgatgcggattttgctgaagataaagtggaaagaaaaagcaccagtggaagatgtcactttattggtggatgcttggtctctaggaagagcaagaaacatgggacaataactctatccgcagatctctttctctttcttcaccctaaacacttaaccgacactataactcatcattatgttctttcactatcaaaaccttatgcaaactcttcaaattcactctcccataaacctctttgtaagctaacctcttttcctatcgaaaacccagaaactcctaaccctaacaatggacaagaaacacaaccaaccccaattttccaaatcgcacctcatttcacaaacaacccccctacatcttctagggatggttcccttgttcaaattaccagacctgcacctatgactatccttgctacacaagtcacaacgaaggacaaggaaccacgagcttatgttaaacacttctttgatatctactcatttgaaaatgttggctacatcatcaaagcccaactcatgttgtgtggcatccaccacttctttgaagaccccaaggtggtggtgactgaactcatcaaagagttttggaggacaatcaatttacaaacatgttgtgtagcccaactatggagcactactgagacaagacaaaaatctttcagtcaagagaacatttccaagatgagattggtagatgatggctccttcaaacaagttaccccagtggatgattccattcttgctaaacttcaacagaatttggactcaacactagacgggataatcagttag

SEQ ID NO: 116669 - DNA, 741 bp, Glycine max
  Peptide Sequence Number=SeqID_233447
atggacgatgaagttcagtatgaagaacgtccatccctcactcaccttgatcgctttcaacatcaaggttcgcccactgtagaccccaacctcactgctgaagacattgcaaaagaagaagaagacacctgccctccgtttacacaccaagattctcaagctgcttccaccactattgacttggatccaccaatagggattgaagttcttcctcaaccaaaatggaagcggcttcaccccaaggaatccaagccttcatctctcatgactcaaggcaagaatgtctacaagattccttctagggcctgtagagaaaaggttagctatgataaggacatcattgggtggtttcacaagattaacacacaacatattgatctatcatatgatgatttcctacccctttttctgtgtccaaagcacattcaactattcactcccatatctaagttcgtccccttagactatgggcatcaagctcttcccttgactaaggatgatatatacaatgttgggatgactatgatgcaatgcgggttaactgatcaatggccaagctatccttcaggtatccacattcgacggaccaccaccagtaagttcatgtctgatcacatagctctggcattgccaaccttggacttaagaaagaagaaaggcaaagtccctcctcagaataagtccatgccttatcaaggcctaaaagacaatgctgccttacgtccaattccttatgattag

SEQ ID NO: 116670 - DNA, 207 bp, Glycine max
  Peptide Sequence Number=SeqID_233448
atggagcttcataaagggccacatcatggcaatggtgcagtgatcctcactggatgtaaagctgagagattcatacttgaaaatgtaaagaatggaatgaagaaaaagaagtgcttaggagtgattgctgcagcaagttggaggaataagtgcaaacctcctatcatttatgctaaaacacactgcattatcccatcttcgcgatga

SEQ ID NO: 116671 - DNA, 231 bp, Glycine max
  Peptide Sequence Number=SeqID_233449
atggtccgtggcggcgatggccagcagcagcggtggtggaggatgatccctttctcttcttcgatgattatgccatttgaggaagttttagtgaatttcaatcggtggaatcgaaagatgagtgaaaatgaggaagactgggctttacgggacatgttctggagtagtaatccttctggtaatcaattacaggatgttgtaatcgattacaggctgcctgttcttgtgtaa

SEQ ID NO: 116672 - DNA, 465 bp, Glycine max
  Peptide Sequence Number=SeqID_233450
cagagaccaagtttggtcattctgcacccttgtatcatccagaggcggcgggcccgatgatacgcggagataccttacggttattcgcacccatttgtcatccagaggcggcgggcccgatgacaagcagagaccaagtttggtcattctgcacccttgtatcatccagaggcggcgggcccgatgatacgcggaaatacccgagtgaggctgacatagtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgagaaggcggttgcttctggaggaagcaaccctgctcgcctgggcgagctgagctcgcctgggcgagctgagctcgcctgggcga

SEQ ID NO: 116673 - DNA, 345 bp, Glycine max
  Peptide Sequence Number=SeqID_233451
atggctgatgcatatgaggttgtcaacttgatctgtgtaaagattaagcttgacaagaagttgcttcagaagttggagaccactccgaggatggttagagttgtgtttgatgatgatgagaagaaacaaatcactgattacaatgtcaagaactggctcaatgctcttaaagatgctgtatatgccgatgactacttggagagtcttgatttgaaagagattgcaatggagcatgtgtcatggaaagctccatcaacatctctagaagatggatctcacatatgcgtcaagttgatgttggaagagaacaatgatggtgaagaagtgtatgtgattcctacctag

SEQ ID NO: 116674 - DNA, 189 bp, Glycine max
  Peptide Sequence Number=SeqID_233452
atgtggaggatcatttgcggcaacatggggattcaaccatggataaagagggcaggagctaattctagctctgtgtgtgttctaaattctaattacatcaaaggaggtacagtgaacaacaccaaatctaattatgaggagctcaaagctattggcaattggcacaggattgaggaaaccatttcttaa

SEQ ID NO: 116675 - DNA, 249 bp, Glycine max
  Peptide Sequence Number=SeqID_233453
atgtgtagccttaagattagtaagagtggtgttgcgaaaagacttggtgtcacagatgtcttctgtgggaactatgtctatggtgaatggacacccccatgtgcatatacacctaacataacatgcgtatggatcattccattggcgtgtcgagtggctgaggcaacggaaataaaagagggtggaatcgttccctttctaaatcctgaaactgaaaggcttgatcaagggtttaacttacatggctaa

SEQ ID NO: 116676 - DNA, 3492 bp, Glycine max
  Peptide Sequence Number=SeqID_233454
atgaaggctccatccaacggttacttgcctaattctggcgaaggggaaaggaagactatgaattcagagttatggcatgcttgtgctggacctttggtttctttgcctcctgttggaagtcttgtggtttacttcccccaaggacacagtgaacaagttgcagcttccatgcaaaaggaggctgacttcataccaagttaccctaaccttccatccaagttgatttgcatgcttcacaatgttgcgttgcatgctgatcctgagactgacgaggtgtatgcacagatgacccttcaacctgtaaacaaatatgagaaagaagcaatactggcatcagacatcggtctcaaacaaaaccgtcaacccactgagttcttttgcaaaactcttacagctagtgacactagcactcatggtggattttctgtgccgcgtagagcagctgagaaaatattaccacctttggattattcaatgcaacctccagctcaggagcttgtagccaaggatttgcacgacaatacatgggcatttagacatatttatcggggacaaccaaagaggcatctattgactactggatggagtgtatttgtcagcactaaaagactgtttgccggagattctgttctttttatcagagatgaaaaacagcatcttcttttaggtataagacgtgctaatagacagcaaccagcactctcttcgtcggtgatatccagtgacagcatgcatattggcattcttgctgctgctgctcatgctgctgcaaataatagcccattcactatattttacaatccaagggctagcccctctgaatttgttgttccgttagccaagtataacaaagccatgtacactcaagtttctcttggaatgagatttagaatgatgtttgaaactgaggagtctggagtgcgtgggtatatggggacaatcactggtatcagtgacttggatcctgtccgttggaaaagctcacagtggcgcaatattcaggttggatgggatgaatcaacagctggtgaacgccccagaagagtttcaatctgggaaattgaaccagtggtgactcctttctacatttgtccacctccatttttcaggccaaagttcccccggcaaccaggaatgccagcctcgtttttaatatcatttttgaatggtacaacttataaaccctgcatgcattttattcttattcccatccttgtgcatgatgatgagtcagatatggaaaatgctttcaagagagctgtgccttggcttggagatgactttggcatgaaggatgcctcaagttcaatctttcctggtttcagtttaatgcagtggatgagcatgcagcagaataaccagctctctgctgctcaatcaggatgtttcccatccatgctttcatctaatacccttcagggtaaccttagcactgatgacccttccaagttattgagctttcaagctcctgtcctctctaccccaagtcttcaattaaacaaacctaatctaccaaatcaaatcaaccagttgcaacagtccccagtgtcatggcctcagcagcaacagttgcagcagcagcagcagcagcagcaacaacaacaacaacagcaacaacagcagcaacaacaacaacagcaacaacagcagcagctgcagtcattgttgcaaataccaatgaaccagctccagcagcagaggcaacagcagctgcctgaaccacaaaatctgccattgttgcagcaactgcctcagcatctaggacagcaacctcagaaacaacaacagtcaagtcaacatgctactattatgaataatggggtagttgcctctaaccaaattacaaatcagtttgcacaacaaccaatggcatatggtcagcttcagcaacaacagttactttcaggaggtatccaaccccagcaaggtatccagtcagccactaagaatacattcccattgacatccttaccacaagactcacaatttcagcaacagatagaccagcaagctagcctcttacagagacagcagcagcaacaacagacacaattgcaacaatctccactgcagttgttgcagcaaaacctgccacagagagcactacaacaaccgccagccactcaaatgttacagcaaaatccctcagagcaacaactccacctacaattgctacagaaattgcagcagcagcagcaacaacaacttctttccacgtccaccccacttttgcagtctcagcttctacaacaacaaaatactcaccaacaaaaccagcaatcactgcagcccctgctgcctatatctcagcatcagcctcaacaacttggcaataatgcattctcaacagagaagcttctcaacagcaacaacttctcttcatctcttacgcaatcgcaacagctttcaatgaaccagccccagaatacacagaaatcacataccatcactagagccccctctacactaactgatggagatgccccatcatgctcaacctctccatctactaacaactgccaggtgtctcctccgaacctcctgaaaagaaatcagcaaataccagccacattaggggggggtttgatagttgagcccactagtaatctgatacaggagcttcacagtaagcctgacacacagatcaaacaggagttgctcaatgtaaaaggacctgaccagttgaagtataaagggacaattactgatccgctggaagcttcttcttccggaacatcttactgtcttgatcctggtaatgtccagcagaacttgccactttccaacttctgcatggaaagggatgtccaatcacacccaagaaacagtttgccatttgactctaatctggatggtctaacccctgatactatgcttctaagggggtatgactcccaaaaagatcttcaaaatttgttgtctaactatgctagtgctccaagggacattgaaactgagctgtcaaccgctgatatcagctcacagtcgtttggagtgccaaacatgcctttcaagccaggttgctcaagtgatgttggcatcaatgatactggggttttaaataataataatggtttgcggaccaaccaaactccacgaatgcgaacatataccaaggttcaaaagcgtggctctgttggaagatgtattgatgttacccgttacaagggatatgacgaactccggcatgatttggctagaatgtttgggattgaagggcagctagaagatcctctaaggactgattggaaattagtatacgtggatcatgaaaatgacattcttcttgttggtgatgacccttgggatgaatttgtcagctgtgtccagagcataaagatattgtcatctgcagaagtgcagcaaatgagcttggatggggatttaggtggtaatgttccaatccccaatcaagcttgcagtgggacagacagtggcaatgcatggaggggacagtatgaagataactcagctgcctcctttaataggtaa

SEQ ID NO: 116677 - DNA, 411 bp, Glycine max
  Peptide Sequence Number=SeqID_233455
atgcacctttgccatatccacatctggtcacactcgttttccgccaattttcaaattcctcttgattctgaaccttatgttccaatcaagagatcttttttaattggtgctgctgtgatcgcttcttttggttaccgcaaagagcatgatggctcttggctgaaaaagggcgctcaacccactgatgaagaaggcaacctaccagttgaagataattccactcttcttcgaaggcttatggacaagtttgatggacttcagacttttgttggtgacaagtttgatgccatggaattgcaagtcgacatgcgactcgatgccatggaatcaaggatcaccaaagttgaagaagatgtctccttcatccgtacttgctttgatccaccaccaccgcctccatcatcgtcttag

SEQ ID NO: 116678 - DNA, 658 bp, Glycine max
  Peptide Sequence Number=SeqID_233456
atgtttggaagcaaaggcgagaaccttggcaagtcaagacgaataggccccgctcatggacatcctggcactcttgatcttcggggtgcgattgatgcttttctcgccttttacgatcgtaaggaaagcccagttgtcgctatcttagccgatttatatggcacattcgaccgaagatgtgagaagaatagtgcaaggatcgtttgctgtacaacgaccctctatgtatggttggtttcacacctttttcgccaagaggtgagacacgtttgcccgctagaaggccaccgctcatgcacagagaaaaaggaggcaaactgggaccgactcttagcaagcaaagaaggagcgtctgtcaattggttcccccgatggaaagaaggaagaaccgggattcttatttcgtgcggggaatttccaaatgttcccttgatggggacgaggggttgcattaattacaatctcgtcctcgccataagacaacttggctaccctatgagagaagcaccattagaggaaggtttcacaccttttattgcacgaggtttcaataacaccaacgcgggggtgcttcagagggttcgcaaggcatgggaaagggtgccaaagaaggacgaggaacttaggggaagtagcaacgggcccatcggcggttacc

SEQ ID NO: 116679 - DNA, 444 bp, Glycine max
  Peptide Sequence Number=SeqID_233457
gagaaatatcaacatcgtcgagatgaaatcttacaacattcgacagaggaagacacatctacacaggattcccctaaaactgctacttctgttaatgataatgaaatatatttgaatgttgttggaggtccaaattacaagggggaacgtgtatgggctaggtactttgagcaaaaggcaaataaggagaagacacttgaggaaaagatgttgcaaatgatggagaatcatgaccaccaaagtaaggagatgcgacaacagatgcaagaacaaaataagcaaattcgtcaacaaaatgagcaaatgcagtgtatactacaatacttgcatagccagtctatcataccaactcctagtctatcgcctaccatagcagatggaattgagcaccatgttaatgatgctcaggttgatcatcctcatgacatgggaaataatcattga

SEQ ID NO: 116680 - DNA, 731 bp, Glycine max
  Peptide Sequence Number=SeqID_233458
atgatgatgatgaacaatactattattccatggtcaaccattggcgttgtgattgcatggtacacttccaacataggggttcttcttctgaacaagtacttgctaagcaactacggctttaggttccccgtgttcctcaccacgtgtcacatgctggtgtgctcgctcttcagctacgttattgtttccgttacggaagctgttccgctgcagcgcgtgcggtccaggagccagttttggaggatcgtggcgctcggcgtcgttttctgcttctccgtcgtttgcgggaacgtgtcgctcaggtacattccggtgtcgtttaatcaggccatcggcgccaccacgccgttcttcaccgccgttttcgcttatgctgtcagcgccaagagggaggcttgggttacgtacgccacgctcttgcccgttgttgcgggcgtcgtcatagctagtgggagaaaagttgaattctatgaacctgctgctttatatggctccaatagcagtgatggtcttacttcctacaatattgttgatggagggaaatgtgattcagatcactatggatcttgccagaaaggatataagaattttttggttttaggaaatgcaaagggggcagttgctgtggtggtctcaattttgatattcaaaaaccccatttcaatgataggaatgcttggctatgcactcactatcattggagttatcttgtacagtgaaaccaagaagag

SEQ ID NO: 116681 - DNA, 433 bp, Glycine max
  Peptide Sequence Number=SeqID_233459
atggatgaggagtcttccttcgttgatgacttgttttgcatcattggaggtttacatggtgacagtatgctttacattgttgatttttgtcctgagattgatttggcttgttatatatttgtgactgatttcttagtgtgtactattcctttggatactgccaaagtgaggcttcagcttcaaaagcaagctgtagctggtgatgttgtctccttacctaaatataagggtatgctgggaacagttggaaccattgccagggaagaaggtctttcagcactctggaagggcattgtgccagggttacatcgtcaatgtttgtatggaggcttaagaattgggttatatgaacctgttaagactttctatgtggggaaagaccatgttggagatgttccattgtcaaagaaaattcttgctgcatttacaactg

SEQ ID NO: 116682 - DNA, 219 bp, Glycine max
  Peptide Sequence Number=SeqID_233460
atggggactttatccaagcttttgctaggaggcttggacattgttccattcaagaagctgaactgtgggcaatttggtatggtatgcgtatggctagtgaccaagggattcctaaagttctggtggaaactgactgtatggaggcagttagactcttggaggacgattgtcaacatgcaaatcagttctgggagctcctttatgagattcgaaatttaa

SEQ ID NO: 116683 - DNA, 483 bp, Glycine max
  Peptide Sequence Number=SeqID_233461
atggaagatccatcatttttcgatcgaatgatcagtcatctgagagcaacttgcatgcactatactggttatccaaaggaccttggaccatcacaggttattcattttacctccgagcgtgagtttgtcaatctccttcacgaaggtttccctgtggttgttgcatttaccatcagggggaactacacacggcatcttgacaaagtattagaagaatctgctgctgagttttatccaaatgtaaaatttatgcgtgttgaatgtccaaaatatcctgggttttgtataactcggcagaaaaaggagtatccatttgttgagatatttcacagtccaacacatgcagctaaccagggaagggtagctgatccaaacattactaagtacaacgtgaaggtcttgcctttcaactacgatgttagtgcttatggatttagagaattcttcaagcgacatggtatacgggcatcagatccaaagtag

SEQ ID NO: 116684 - DNA, 813 bp, Glycine max
  Peptide Sequence Number=SeqID_233462
atgtggatggaccgatttgctctcactttaaacgggagccaagaacttccccgattactggctaaggccaaagcaatggcggacgcgaaagacgccataactaagcgcgccccaaggcatccctattgcaccagatccaaatctaggatgatgggtgacctagaggaagtacaagaacagatgaaagccgacatgtcggctttgaaagaacaaatgtcttccatgatggacgacatgctggggatgaaacaactaatagagagtaacacggccaccgtcgctgccggaagcacactggggcatatcaataacccccatccggggtacaaccgaggtacttatccctacggtttacgacccaattacacaccaccagccatacatgaagatgtgggtcacgttcctcccctcatcctcgaagaggaacctcttcaacatcctgacggggtccacgagaatcctcgagagcatgctcagggagacgtcgactcctactccccgtttcccgctgaggggttggcacccaacacactacctcaacccaacatcacgggagagcctcgaagacacccaacgcaaccaatgtttctgtccatgggaggaccacccccgatagtggaagggaaggggaaactcgatctcatcgaagaaagattgagggctgatgaagggttcggcgattatccgtttgcagacatgactgacctatgcttggtgccggacgtcgtcatccctctgaagttcaaggtgcctgactttgataggtacaaagggacaacttgtcctaagaatcacctaaaaatgtactgctga

SEQ ID NO: 116685 - DNA, 300 bp, Glycine max
  Peptide Sequence Number=SeqID_233463
atggcattcttgggagagacaagcagtcagatagttgtgaactccacattaggttttatttttccaaatggatccattgttcacaacgacggtggtgtttcctttcaagcttccactctagttcccattcgagtacctaacggcattgctagaaccccagatggtattttaaacttacttgaaactactatgacccctactcatgatgccctgctatattacaatgggaggtggaacatgtcacgccaaaatgagtttgttggttactcgttcacaggaaaaaatcccaaaaacttttga

SEQ ID NO: 116686 - DNA, 186 bp, Glycine max
  Peptide Sequence Number=SeqID_233464
atgctctcgggaacggaagcttcgagcacactccagatatcttctaaaagatcccaacggtcagatcatggacaaccaacggttaacgaaggttgggcagcgtttttaccgaggcagcttcatgtagctttctctagaagcttcattaagaaggttcctccagaagcttcctcgtggcttctttga

SEQ ID NO: 116687 - DNA, 195 bp, Glycine max
  Peptide Sequence Number=SeqID_233465
atgaagcctgtggtggtggttgaattctggtctgaagcgggtgactgggctcaatctctgtttgacgttgagagaatgcgacctctgcagcaaggcacggaggctccgaccaacttcaagataccatcagagaatgagtttggggctggtgggcttcgctcgatcttggacgatacctccggacgaagtgcttga

SEQ ID NO: 116688 - DNA, 1419 bp, Glycine max
  Peptide Sequence Number=SeqID_233466
atggctgcacaagaaaacaacttccaagactacttgcctgtgatggccaacaagcttggtggggatggcctaattgatgaactgtgcaatgggttcgatcttttgaaggattctgataaaggggtcatcacttttgagagcctcaagaggaattcttacttgcttggtcttcagggtctcagtgatgaggatcttcgctccatggttttggaaggtgactttgatggtgacggtgcactcaaccagatggagttctgtgtcttgatgttcagactcagccctgaattgatggagggctcaaagatgtggcttgaacaagaactcatgctttatccttcaaacatgaatgtaaggaagcatggagacaatgctatgagtctaggaaaagaggcaatcccaggatcttggaagaactgggatgattcatcacctggggattttacttggggtatatctcttgaaggatttcctcaagtgattatgtggaagggatcaaaggagttttatcatggcagtcattggagtggtcttggattcagtggtgccctggaattgaaggcgaatccagttttcgagttcaagtttgtttccaacgaggatgaggtgtactacacatacagcctcaggaatgagtctttggtttcaaggattgttatgaaccaaaccatttccactcgccaaaggtacatatggattgagaaggctcaaagttggaggctttatgcatctgtgcctagagataactgtgacttctacaatctttgtggatcaaatgggaatcgtgtaatagaccgaccggggaactgggacattatggactggactcaagggtgttttctcactgaaaaatggaactgtgaggaaaggaggaaacatgggtttgccaaacttagtggcctgaaagctccagatacttcacattcttgggtcaatgagagtatgagtctcaatgagtgcagggaaaaaggcttggagaattgctcatgtaaagcatatgcaaattcagatgttagaggaggagggagtggtaacaacttgatggtagagaacaatgaagaaaacgtgaaagaagaccttgaacttcctttagttgaccttgctgcaattgtcaaagctactgatggcttctcaattaacaataagctgggagaaggtggatttggggctgtatacatgggtaccctagacgatggacatgaaattgctgtgaagaggctctcacaaagttctggacaaggctttaatgaatttaagaatgaagtcatattgattgccaaacttcagaatcggaacctagtcaagtttcttggtcgttgcattgaaggagaggagaagatggttatatatgaatacatgcctaacaaaagcctagaattctttatctttggttatgatctcttcacatcttatgcaatttaa

SEQ ID NO: 116689 - DNA, 183 bp, Glycine max
  Peptide Sequence Number=SeqID_233467
atgaagagaggaatgtggggtgggattttccaagaaggagagggcatagattcattgaagacaactaagcaacagagaggaacaaactcggtcagagacacacacggttttactttggtgtggactttcgtggaagttgtcaaaagggtagaatcgtcaactatccttttcgggtttgtgtaa

SEQ ID NO: 116690 - DNA, 522 bp, Glycine max
  Peptide Sequence Number=SeqID_233468
atggctagaactttttggggagatcagatcgaaggaaacacaaggagggtggtaggaacatacggttatatggcatctgaatatgccatttatggtctattctcagtgaaatctgatgtcttcagctttggtgtactaatgctggagatagtaagtggaaagaagaataggggattttcccattcaaacaacggcataaaccttattggacaaggatggagattttggagagaaagcagacctctggacttgattgattcatgcatggagaattcatcggttctattggaagcattgtgttgcatccatattggtcttctatgtgtccaacagaatcctgaggatagaccaagtatgtcaactgtggtagtgatgttgagcagtgagagtgccttgcctcaacctaaggagcctcctttctttttgaagaatgacaaattttgtcttgaagcagattcctctaccaagcacaagttttcttccaccaatgatataagtgttaccatgttagagcctcggtag

SEQ ID NO: 116691 - DNA, 2313 bp, Glycine max
  Peptide Sequence Number=SeqID_233469
atggaaggttttaccttgcttctgttctgccttgccttgctgaatagtatagcagctgccactgtgagagaaactattagcacattgcaatcaatcaatgatgaccagatcatagtttcacctggcaaaacctatgcacttggattcttcagtccaggcaattcgaagaaccgttacgtgggaatttggtataatgagatcccaacacagactgtagtatgggttgccaacagagacaaccctcttgcagactcatcaggggttttgaagctcaatgaaactggagctctagtccttctcaaccataacaagagcgttgtctggtcttccaacgcatcgaagccagcgcggtatccggttgcgaagcttttggattctggaaatctcgttgtgcaggacggaaacgacaccagtgaaacaaaagatttattgtggcaaagttttgattatccgggggacacgatcttgccgggacagaagtttggaagaaatctagttacgggcctgaatcgattcatgtcatcatggaacagcactgatgatccatcacaaggggaatatagttatcaaattgatattagcggatatccgcagctcgttttaagagaaggcgctttcaaaagatatcgttttggatcgtggaatggtattcagtttagtggggcacctcagctgaagcaaaataattttactagatttagttttgtttctgatgaggaagagttgtattttagatttgagcagaccaacaagttcgtttttcataggatgcagttatcaacagatggatatatcctgggggattattggaatactgaagaaaaagtttggagcttgcatgggaaaattcctgtggatgactgtgattactatgacaaatgtggagcctatgctagctgtaatataaacaatgtccctccgtgtaattgcttggacggattcgtatccaaaacggatgatatatacggtggttgtgtcaggagaacttcacttagttgtcatggagacgggtttttgaagctttcagggttgaaattaccagacacagagagatcctggtttaatagaagtattagccttgaggattgcaggacattgtgcatgaacaattgctcctgtacagcttatgcagccttggacgtcagtaaagggccaactgggtgtttactctggtttgatgatctggttgacataagagatttcactgatgttgatgaagatatatatataagggtggctgggacagaaataggaaagatgaaagacaaactagaaagggatgcaagtgtaatatatgagcacgagaaggatgatctagagttacccatgtttgagtggtctacaattacttgtgcaaccaataacttttcacctgacaacaaactaggggaaggtggttttggatcagtttataagggtatcctggacgatggaggagaaatagctgtcaagaggctctcaaagaattcgagccaaggactacaagagttcaaaaatgaagttatgcatattgcaaagcttcagcacaggaatttagtgaggctactggggtactgcattcaagcagaagaaagactgcttgtttatgaatttatggccaacaaaagcttggattccttcatatttgatgaaaacaagagcatgttactagattggccaaggcggtcgctaattatcaatggggttgctcggggtcttctttatcttcatcaagattcaaggcatagaatagttcacagagatctcaaagccgggaatgttttgttagatagtgaaatgaacccaaagatctcggactttggactggctagaagctttggaggaaacgaaatcgaagcaactacaaagcatgtagttggaacctatggctatctgcctccagagtatataattgatggagcttattcaacaaagtcagatgttttcagcttcggtgtgttgatattggagatagtgagtgggaagagaaataaagggttctgtcatcaagataatcttctggcacatgtatggaggctatttactgaaggcaaatgctctgaaatagttgatgcaacaataatagactcactcaatttacctgaagtgctaagaacaattcacgtgggactactgtgtgtgcaactaagtccagacgacaggccgaacatgtcatctgtggttctcatgctgagcagtgaatctgaactgcctcagccaaacttgcctggattctttacaagtacaagtatggctggcgatagttcttcatcaagcagttataaacaatacacaaataatgacatgacagtaagcataatgtctgctagatag

SEQ ID NO: 116692 - DNA, 189 bp, Glycine max
  Peptide Sequence Number=SeqID_233470
atgggcaagttcaagcttagcgcacaatctcgctcaatgcgcaatacaggcttagtgcaagaagacccacaaggaagcctagatgcacgcttagcacgaaagtccgtgctaagcgcgatgttagcgtggaaaggtaatgcattaaaaaatggttattttctaaagaattggggaaggatatctgaataa

SEQ ID NO: 116693 - DNA, 947 bp, Glycine max
  Peptide Sequence Number=SeqID_233471
ggataacgccgtcagtttccttaccggtgttacgtctgattgatgaattgcaacgactcacacgggcagatccgcttgccgatacgctgccagcgcaaggccttcattttacttttttgcctctgactttaccgctgtataacgtcaacgagcctttaccagcgaaagcggcgcaactgaccacgatctggcaggaatttgctgcgaaaaaaatcgttatccgggatctgcgcttagtggcgttgcccagtcagttattgcttgcgggtatacctgatacgcctgcgattgccatgcgtcagtcattctgcgacaaggttctggattcagactggaaaaaagaattgctgatgcggcatggcaacagcccattgccggcaccattctggcacagcacgttactgcgctacagcgctgagtttttacccgcagttttgcgtcaattcttttatgaacgtcaggacatcaatttcggtgcggtggcgggagaattgatgctggcgaaggctaactacaactggacgaatgcgcataatcatgattatgttaaatatggtattccgtcaggtatcgcagtccttcagtttcgccctttacgcctcttagcaggcccacaactcattccaccacggcgatactatgtgaaaacttatcccaccggtccgtttgatggacaccacggagatatcctggtgcgcatcaatgcgcaccctacaacagactgtccgctgccccctcacgctgtcgttaggtttcgcccttcacgcctcttacaaggcccacaacgcattccaccacggcgacactatgtgaaaacttatcccaccggtccgtttgatggacaccactgcgttatcctggtgcgcatcaatgcgcaccctacaactgaatacccggttagcttcgccctcggtgcttcaactatctctttagctcatccacaatga

SEQ ID NO: 116694 - DNA, 895 bp, Glycine max
  Peptide Sequence Number=SeqID_233472
gcggcaccagggcgtcgaggatgcggtcttcggcggcatcctcggcctgggtgcgcacgcggcgcatttccagttcgcgggtctgcttgatggagtattcggtcaggtcgcggatgatggtgtcgacgtcgcggccgacgtagcccacctcggtgaacttggtggcctcgatcttgatgaacggcgcgttggccagcttggccaggcggcgcgcgatctcggtcttgcccacgccggtggggccgatcatcaggatgttcttggggtggatctcgtggcgcagcggctcggccacctgctggcggcgccagcggttgcgcagggccaccgccaccgcgcgcttggcgcggttctggccgacgatgtacttgtcgagttcggagacgatctctccgggcgtcatgttggatgcggacatgagggcggatccttgaagcagggctgggctgggagacgggccgcggcgccccggacgggcgccgcgaggttggcgtcagtcgcccagcgtctcgatgacgtggttctggttggtgtagatgcagaggtcgccggcgatctcgagcgattgcttgacgatggtctcgggcgccagctcggtattgcgcagcagcgccagcgcggcggactgggcataggcgccgcccgagccgatggcggccaggccgtgctcgggttcgagcacgtcgccgttgccggtcagcaccagcgtgtgctcggcgtcggccacgatcagcatggcttcgagccggcgcaggacgcggtcggtgcgccagtcgcgggtcagttcgaccgccgcgcgcatcaggttgccctggtgtttctcgagcttggcttcgaaacgctcctgcagcgtgaacgcgtcggcggtggcgccggcgaagccggccaggatctt

SEQ ID NO: 116695 - DNA, 366 bp, Glycine max
  Peptide Sequence Number=SeqID_233473
gcggtgttgtccttgctgaggtgttgttggctgattcacgattcactcgaccggatatgggttttcacccaacaaaactcaatttcgtgcctagcgatgcggatgaggcgccacccgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 116696 - DNA, 1017 bp, Glycine max
  Peptide Sequence Number=SeqID_233474
atggcctctgatcagcacaacatgctccatgaggaaggaggaggcaaatcaacatgttccaggagccggaggagcaatggaaagggtccaaagaagccaccccagagaggcttaggcgtggctcagttggaaaggttgaggcttcaagagtcttggaagaagatgagtgaagggtcttcttcaggaggaggagtgctacaagtgccactaccaacactccatgatcactatcatcagcaacaacaactttttcagtgccaccctcctcatcctccagtgtttgcagcaagtggaggtgttcctgtgaggcatggtgcaccatcaccaccaacaccaaaccttggctttcagtactttcagtatcctcaacaacaacaagtgatgatcaatggcagcaacaacagtactattggtgggggttggatgcttcctaacagggtcgattcttttggatctgtgtctccacttttggttggaacccctcttgagacctcaaaagagctctcttcaattccaaatctccattctcagcatgagtgttttgatttttgcctcaagaaaacacgtttcaatgagtacaatgaaaaaggatcatcaaatgcaaggagagagagggctttggagatagggcccaatggcaatggccatgattttctcggattcatgccccaatcttctgccccaagctttgttggggaaaccagagatttctataacaaactggtctatcatgatgctgctgctgctagtgcttacacttgttctactcccaatcttgatgagtgtgtggaggttgttgctgttcacaggaggggaaactcagggtgtggcagggttttcatggaatatgagtttttcccaggaaaagatggcagtggcactacttccaaggagctagaattgccctcaataggttcagtttctgtaggtggtggtgaagcttcttctatcactgttgcagcctatggagattctgcttctaattatgttgatttgtctctgaggctttctcgctag

SEQ ID NO: 116697 - DNA, 585 bp, Glycine max
  Peptide Sequence Number=SeqID_233475
atgagtgcagccagcagagcttggattgtggcatcaagcattggagcagtggaggcattgaaggatcaattgggggtgtgcaggtggaaccatgcattgaggtcactgcagcagcatgccaagagcaacattagatcctacactcaggccaaaaccttgtcttctgctacttctgctgctgtctccaataaggtcaagaggaccaaggaggagtccatgaggaaagtcatggacttgagctgttgggcgggaaatgcacccattgggaatgcaccccgtcactgtccaagcgggaaatgcaccctgaagttggctgaagttgatgacgtggcaattccacaaaacactatttataccctcgagttggctgaagttgatgctgcagttgaagctcgtaagaagcctcctgtggaagagatgaatgggttcagggaggaagatcgtcttattcgaatcacaccccatagtcacgaatgctatggttctgatgaccgtattgttctacttactgtggctactgggggtcaccacgctgctttcacagcgtattgggaccctcccaacaagggcattccgacacttcat

SEQ ID NO: 116698 - DNA, 207 bp, Glycine max
  Peptide Sequence Number=SeqID_233476
atgggtgtcaagttcctcgaagcgattatgcaaaggtcgcatcccaacaaacagatggtctctgtgtgccatcagactcgatcgtctctggatggcgaaaagggtcagtatgacagagattgtggggcggccgacaaaagcgagactcttgcttctaagtatcctcaatttgtgatgaggaactcagacctacgtagttctggataa

SEQ ID NO: 116699 - DNA, 334 bp, Glycine max
  Peptide Sequence Number=SeqID_233477
atggggtgtgttatgaataaagcttctcccataggtgttattatcttgaaggcaataataccaaagagccatttgaagaatttgtccaagcaagcaactttcaataggcctacagcaactcctttggaagtcaccttaaatggggcattgaggaccaaggcggacaatcgtggagtagatgtcacggtagcattctacgaagctggtttggttactgactgccctagaggggaaaacaaagggcatgttctatctaatgactatgttgttagaaaacttgaaaagctctgcactgtcaaagaccaccctgctaagaagacagtgttaggaactg

SEQ ID NO: 116700 - DNA, 171 bp, Glycine max
  Peptide Sequence Number=SeqID_233478
atgaatattggtctgtgtaaggagtttaatgctaaaaccacaggctgttttggcctttcggggtggaagagaataaaggaaaaagaaaaccaggggcgttgcacccactgtttggagcagaatccacacggttccttgtcttatacaagactcactgtacacgctgtttaa

SEQ ID NO: 116701 - DNA, 1032 bp, Glycine max
  Peptide Sequence Number=SeqID_233479
atgatcacattaacaggccaaatacagcgtttcattttgtctgatctgacaaatagttggcagcttttctacaccggccctgcggatcggtgtgataattatgccatttgtggtgtgaattctaattgtgatgtcaataactctccaacatgtgaatgccttcagggttttattccaaaatctctagaaaaatggaattcacaaaattggacagatggatgtgttaggaaagttaatttggattgtggcaatagtgatggctttctgaagtatcagggaatgaagttaccggacacatcaatctcatggtttgataggagcatgaaccttgaggaatgtgagaatatctgtctgagaaacagctcctgctcaacatatgcaaatttagacgtcagagatggtggaagtggatgcttgctttggtttaacaacattgtggatgtgagaaaactaacttctggaggacaagacttttacataagagtggcagcttcagaattaggtgctgatactttattttcatctgccttcctgattttggcttttccacttaaacacacaatttttcgggcacatgttataaatttcatccttgttgcaggaattcttgttggttgtattgtgttcattgtggtcatgataatattgggagtggccatacttaggatgaaaaagcttgagaagccagttgaagctagaaaaagtttgctgaattgggctcagtgcttccaaattatttgtgggattgctcgaggacttctctatcttcatgaagattctagattaaggattatccacagagatctcaaaacaagcaatattcttctagatgaaagcatgaatccaaaaatatcagactttggtcttgctagaacatttggaggagatgaagttgaaggccaaacaaagagagtagtgggaacttatggttatatttctccagagtacgctgctcgtgggaatttctctgtgaagtctgatgtcttcagttttggtgttattcttctgcatatttttcattatttgacatga

SEQ ID NO: 116702 - DNA, 282 bp, Glycine max
  Peptide Sequence Number=SeqID_233480
atgagggagttgagtttccaaaggagagatcttgaagggcttcctcaaaagatccactcatatatatgcgtcagaatcaccttctttgcattggagaagaaaaaaacattgtcgtcgtcggagaaagaacaatggtgggcgacgaagaaaacaatcatatatacacaaattaatttgtgtgaaactaataaaacgtttgactttgaccctctaacctacaactggtacggtacggtggtggctccgttcgacagaacacaatcgtcggggttgttgaaatag

SEQ ID NO: 116703 - DNA, 2481 bp, Glycine max
  Peptide Sequence Number=SeqID_233481
atggatagctatgaggtgatgatagtgtggttctctctcttattctccctcatccccagcatcagtactagactgagtagtatcactctagatcaacccttacaccacaatgaaaccctggtttcagcatctggaacctttgaagcagggttcttcagcactggaagttctcagagacaatacttttgcatatgttacaagaatatatcacctagaacaattgtgtgggtggccaacagaaacaccccattagataataacttcactggagttttcaaagtcagtgatgaggggaatcttgttgtacttgatggcattggtgcaagtgtttggtcttccaatgcatcaaccacttctcagaagcctattgtgcagctcttggactccggcaaccttgttgtgaaagacggcggaacaaatagtccagagaaggttgtgtggcaaagctttgattttcctggtgacactttgcttcctgggatgaaactcagaagcagtcttgtgacaggtgcacatagttctctgacatcgtggagggacacagaagatcctgctctgggggaatattctatgtatatcgatcctcgtggttttcctcagagagtgactacaaagggagggacttggttgtatagagctggttcatggaatggttatcaattttcaggtgttccttggcagctgttgcataatttcttcaattactattttgtgttaaccccaaaggaagtgtattatgagtatgaactcttggagccttcggttgttacaaggtttgtgatcaaccaagaagggcttggtcaacgtttcacttggtcagagaggacacagagttgggagcttttcgcctccggccccagggatcagtgtgagaactatggcttgtgtggtgcaaattctgtttgtaaaattaatagctaccccatatgtgaatgcttggagggatttctcccaaagttcgaggaaaagtggagatcattggattggtctgatgggtgtgttcggggaacgaaactgggttgtgacgatggagatggatttgttaagtatgaaggaatgagattgccagacacgtcttcgtcctggtttgacacaagcatgagccttgatgaatgtgagagtgtgtgtttgaaaaactgctcttgcacagcatacacaagcttagatatcagaggtgacgggagtggctgcttgctttggtttggtaacattgtggatatgggaaaacatgtctcccaaggacaagagatttacatacgaatggctgcttcagagctagaccaaacttggcataaaaggcacgctagcaccaagcttgtggtgattttggcaacaatcgctacgttcatcgtaggcttaatattaggatcagtcatatacatacggagaaaactagggaaaccagcttattatctgtctgcttccatatcaggaaagacaaatataatcgaccagatgcatcactctataaaacatgagaagaaagacatcgacttaccaacccttgatttatcaaccattgataatgcaaccagtaatttctctgccagtaacatattgggagaaggtggatttggaccagtttacaagggtgtgctggcaaatggacaagagattgctgttaagaggctttccaaaaattctggacaaggattagatgagttcagaaatgaagttgtgttgattgccaatcttcagcaccggaatcttgtaaagattcttgggtgttgtattcaagatgatgagagaatcttgatctatgaattcatgcctaacaggagcttggatctttacatttttgatcgaacaagaaagaaattattggattggaacaaacgcttccaaattataagtggcattgctagagggcttctgtatcttcatcatgattctagactaaggatcattcacagagatatcaaaacaagcaatattcttcttgataatgatatgaatccaaagatatcagactttggactagcaaggatgcttgttggcgatcacaccaaagccaatacaaaaagagtagttggaactcatggttacatgcctcctgagtatgcagtgtatggatctttttcagtgaaatcagatgtctttagctttggtgttattgtactagagatagttagtgggaggaagaacacaaaatttcttgatccactcaatcaacttaaccttattgggcatgcatggagattgtggagtgaagggaggactttggaactgattgatgaatcactggacgattcaatcattgaaagtgaagtgttgaaaattgttcacgtgggactcttgtgtgttcaagagagaccagaggacaggcccaacatgtcaagtgtggttctaatgctgaatggtgacagaccattgcccaggcccaagctccccgctttttatccacaccaagaagatttttcttcatccagcaagtgtgaattcagctcaaatgagttgtccatcactttagaggcaagatag

SEQ ID NO: 116704 - DNA, 528 bp, Glycine max
  Peptide Sequence Number=SeqID_233482
atgaatcccaaaatttctgactttggccttgctcgcacattatggggagatcaagtagatgctaacaccaacaagattgctgggacatatggatacatgcctcctgaatatgctgtacatgggcatttctcaatgaaatccgatgtctttagttttggtgtcatggtgttagaaatagtaagtgggaagaaaaacagagatttttctgacccaaatcactgtctgaatcttcttggacatgcatggagactatggactgaaggaaggcctacaaacttgatggatgcatttttaggcgaaagatgcacttcatctgaagttattcgatgtatacatgtaggcttgttatgtgtgcaacagagaccaaatgataggcctgacatgtcagctgtggttctaatgctgaatggtgaaaaatcgttgccacagccaaaggctcctggcttttacaatggaagggacaaagcagatttgtttggaccattttctaacaatgatgcttccctaacggttttagaggcaagataa

SEQ ID NO: 116705 - DNA, 201 bp, Glycine max
  Peptide Sequence Number=SeqID_233483
atgccttacaaagaaatggctctgagaaagctttccgcaaagagatccaggaaggacgccgcggctgagggaccaatgccgctcccgagtttgacagccatcgtttcaggagcgctgagcaccagcagcgtttcgaggccatcaaaggatggtcattccaccgagagagacgtgtccaactcagggacgatgaatacatag

SEQ ID NO: 116706 - DNA, 1389 bp, Glycine max
  Peptide Sequence Number=SeqID_233484
atgcaaaacttgagaacacaatggttttggttttttctgttctgttgtatatcaagaacctccacttcactagatagtatagctccaaatcaatccatcagtgatggagagacattaatttcacatgaaaaaacctttgaacttggattcttcagccctggaagctcaaagagcagatacttgggtatttggtactacaacataaatcctcgaacaatggtttgggttgccaacagagaagcaccactcaacactacatcaggagttctaaaactcagtgatcaaggtcttgttcttgttaatggaacaaataacattgtgtggtcttccaacatgtcaaccacagcagagacagagaacacaattgcgcagctattagactcaggaaaccttgttgtgaaagatgggaatagtgagtatgagcactatctttggcagagttttgatcatccatgtgatacattattgcctggaatgaagcttggttggaatctagagaagggagaagaattgtttctatcatcatggaaaagtgctgatgatcctagtcatggggagtactctttcaaaatagaccccagaggatgtccacaagcagttctgtggaaaggaaccaatttaagcaatagatttgggccatggaatggcctttacttttcagggtctttaattgattcacaaagtccaggtgtcaaagttgatttcgttttgaataaaaaagagatatattatcagttccaggttctaaataaatctctttcctacagattttgggtgacccctaataggaatgccttggtttccctttgggaaagtcaaatcagcgattggctgattctctattctcaaccatcattcccatgtgaatattatgggaggtgtggtgcaaatagcatttgcaatgcgggcaatcctagatgtacatgcttggatggattttttagacacatgaattcgtccaaggattgcgttcgaaccattcgtttgacttgcaacaaagacaggtttaggaagtatacaggaatggttcttcctgacacatcttcatcttggtataataaaaacatggttttagaggaatgtgcggaaatgtgtctgcaaaactgttcatgtacggcatatgcaaatttggatataagtggtggaggaagtggctgcttgctttggtatcatgatctcattgacttgaggcattacccacaagctcaaggggggcaagacatttatatacgatactctgattcagagctagatcacagtcagaaaaatggattgagcaagagcaagattgcatccatcgtgactggctcaaccacgttcgtcgtgtctatgatactcggattggtcatatggttatggaaaaggaaagtcgaaatggaaggtgggtaa

SEQ ID NO: 116707 - DNA, 246 bp, Glycine max
  Peptide Sequence Number=SeqID_233485
atggccgggacgccacagtgccagttggagatgtattttccctctgctttctttgacatcatgattcacttgattgtgcatctggtcagagaaatcaaatgttgtgatcctgtttatttgtggtggatggacccggttgagcgatacataaagatcttaaaagggtatacaatgaatctatatcgtctagaagcatctattgttaagaggtacattgcagaagaagccattgaattttgttcataa

SEQ ID NO: 116708 - DNA, 984 bp, Glycine max
  Peptide Sequence Number=SeqID_233486
atggaagggatgaaaaaaatatttcatcaaagtcgtcacaactctaaactaaggaaggaagagccggacttaccagcatttgacttgcctttcattgctaaagccactgataacttctcagacgctaacaaactaggagaaggtggttttggaccagtgtacaagggtactctaatagatggacaagacatagttgtgaaacggctttcaaacacctccggtcagggtatggaagaatttaaaaatgaagttgcactgattgccagacttcaacaccgtaatcttgtgaagcttcatgatgaaattagaagcaaaatattggattggagtaagcgattccatattattggtggcattgctcgagggctagtgtatcttcatcgagactctagattgagtattattcaccgagatttgaaagccagcaatattctactggatgaaaatatgaattctaaaatatcagactttggccttgctcgcacattatggggagatcaagtagatgctaacactaacaagattgcctggacatatggatacatgcctaccgaatatgctgtacatgggcatttctcaatgaaatccgatgtctttagttttggtgtcatggtgttagaaatagtaagtgggaagaaaaacagagatttttctgatccagaacactttctaaatcttcttggacatgcatggagactctggactgaaggaaggccaacagacctgatggatgcatttttatgtgaaagatgcacttcttctgaagttattcgatgtatacatgtaggtttgctatgtgtgcaacaaagaccagaagataggcctgatatgtcagctgtggttctgatgttgaatggtgataaattgttgccacagccaaaggtgcctggtttttaccacggaagtgacaaagcatatttgtctggaaagttcaaatcattctcttacaatgatgtttccctaacagttttaggagcaagataa

SEQ ID NO: 116709 - DNA, 225 bp, Glycine max
  Peptide Sequence Number=SeqID_233487
atggaggaaacgaaagtctcgcgctccgtcttgagaagttctataatctccaaaaaatggcctctagcagtgagtgtctatactgaggggatcgctcagacttgcattattgcactttgcaatggtaagcgtggcaaccctctatatgatgatgatgataggggtggtggtcctggtgaaagctcacacaccaagcaccattactcccaaagtccacaactttaa

SEQ ID NO: 116710 - DNA, 140 bp, Glycine max
  Peptide Sequence Number=SeqID_233488
ttgagatcaaaagtgagtccacaaataagagcttcaaggtcaacgaacaccggctgaaaccattcctcataaatccttccttggtggatgtagtggtggaggagacctccttacttcaccctacttctcttccgccatga

SEQ ID NO: 116711 - DNA, 153 bp, Glycine max
  Peptide Sequence Number=SeqID_233489
gaaattctcaagtacggttctaaggaaaggaattgactcacctattccgaccgaggagaacaggccattcgacagggagactcggaagttgcggagtcttggtttaatcaagccgctgaatattggaaacaaagctatagcccctaacccctg

SEQ ID NO: 116712 - DNA, 1104 bp, Glycine max
  Peptide Sequence Number=SeqID_233490
atggcccacaaattatgttttgaagcacttgatcaaagtttaagagatattatcacagataaatcaaagtcaaatcaaatatttggaggcaaagttatagtatttggtggagatttttgccaaatactaccagtcatcccaagaggaatgcgctcagacattgtaaatgtagcaatcaattcatcctatctacgggattcgtgtgaaatattaaccttgacaaaaaacatgcgcttacacagcaatctagaatcagttgatgaacaagaaactgccacatttgctaaatggattctagacattggagatggaattatagatgatgaaaatgatggttatgataaaattcaaattcctgctcatctactcattactcaatatgatgatccaatgagtgctatagtcaaatcaacattcccagacttagatcagcaccataataatcctgaattctttaaatcaaaggcaatactggctttaacaaatgaaacggtagaacaaatcaatgattacgtgctatccttcattccaggtgaccacatggaatatctaagctctgattccattgataaatcagaaaccagtgagaattcgtatttccaatcaattactactgaattccttaattcattgaaaacatccggtttgccaactcattctatcaaacttaaaattggaagtcctataatgttgttaagaaacctcgaccaaaatcaaggtctatgtaacgatactagattagtggtaacaaagatggcaaaacatgtaattgtagctgaaattatcttaggtaaaaacattggcctggctatttatattccaagaatgtcaatgtctccttcacaatcaccctggccgtttaaactattaagaagacaatttccgattatgctatcttatgcaatgacaataaacaagtcacagggacaatcactatccatggttggactttatttgccgaaaccggtattcactcatggccaattatatgttgcattgtcaagggtcaactcagcaaaaggattaaaaattctgattcatgatgatgagcagaaaagcatgaattccaccaccaaagaagtgttcagaaacattaaaacttaa

SEQ ID NO: 116713 - DNA, 117 bp, Glycine max
  Peptide Sequence Number=SeqID_233491
atgacgctctttatctttccgggagggtaccaatatgttcatgggaaatccaattcgccggaaagggcaccggatcgtcaacctaaagtactaaaccacgatccctcattaggctag

SEQ ID NO: 116714 - DNA, 453 bp, Glycine max
  misc_feature (361)..(361): n is a, c, g, or t
  Peptide Sequence Number=SeqID_233492
atgcccagtgggcccgaagaagtccaacagggccctggggttccagctctggttacgggcctctgtcagtcctacagggtgcccgttcccccaacgaggtcatgccatcgtgacatagagaagtccaacagggccctggggtttccagctctggttacgggcctctgtagtcctttagggtgcccgttccccccggcaaggtcacgtcatcatgacatagggatcgcgcctgcaagacacccagtggacccgaagaagtccaacagggtcttggagttgtcaagctctaattacgggcaggcgcagggcgaaacaccacagcagcctggggatggccagcagcgggcaacagacgcaccgncatcacctttagagttcacctcagctcatccacaaaaagccatcaagcgtccagctcaagacgttaaagaagtgctactaggaggcaaccta

SEQ ID NO: 116715 - DNA, 704 bp, Glycine max
  Peptide Sequence Number=SeqID_233493
atgcgccgcccgctggccgctgtcttcctggtcctgatgaccgcatgcgggcccgccgagcgggcccgttccctttcccccgacgtgtcgcggctgccgccggggcaggtagcctacctgccgccgggcgagacgctgcgcaacggctatccggtgtcgccggcgccgctgcgcgcggagctggctcgcggcgtcgtcatcatgacgcgccaggtcagccaggccgagtatgcggcctgtgtccgcgccggcgcctgcaagccgctggatcccggcttccgggacctggatgcgccggacctgcccgcgatcggcctgagctggagcgacgcctcggcctacgccgcctggctgtcggaccgcagcgggcagcgctggcgcctgccgacgtatgccgaatgggtctatgcggccggcgacgcctaccgcgaggaaacgccgctgcccgcctcggacgccgatccggcgcagcgctggctggccgagtacgacgcgcagacccggcgcggccaggaagccaccgaggtgcgcccgttcggcgcctatggcaccaatgccaccgggctgatggacatggcgggcagcgtgtgggaatggaccgatgactgctacacgcggcgcatcctggcgctcacgcagggcggccaggcggggacagccggccctgacaacagcaccgaccgcaactgcggcatactcgtcac

SEQ ID NO: 116716 - DNA, 714 bp, Glycine max
  Peptide Sequence Number=SeqID_233494
atgagatatcggagttttgatttgcaccaacttttgtctcactttagtaagcatgggaacaaatcaaaccggcaagaggtctaccaagtcaaggtcaaaagcctagataccaccagcatcaaggaattagggcggttgatggaacccctccaaatgcaaaccttccgcaagacttacggaaagatcttagagttgaccatagcagaggtgtccatagaagccattgtatcacttacccaatactacgaccagcctttgaggtgcttcacattcggagacttccaattagtaccaaccattgaagaatttgaggaaattataggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatggtttgatctatttgacacatttgaccgaaggtgcgaaaagagtagcacacggatcatctgttgcttacccgccctctgtgtttggttggttttgcacttgttccaacaagacacaagacatccatgtccgctcctga

SEQ ID NO: 116717 - DNA, 735 bp, Glycine max
  Peptide Sequence Number=SeqID_233495
atgatgaaattgagcgaatacgtgagctacgatgcgctgggattggccgaattggtgcggcgtggcgaggtcagcgcagcggcgctgcaacaggcggcgcgggccgccgtcgaggcggtgaacccggcgattaacgcggtggtggaacactgggagcagccgccggaacaagacgacgggcctttgtcgggcgtgcctttcctgatcaaggacatcgccatcagcatggcaggcaagcgcgttgagctgggcagccggttggcgcagggcagcgtcgccgccgccgacagccatctgatgagtaatatccgccgggccgggctggtgacctttggccgcaccagcacgccggaaatggcgttcagcaccaccaccgaggccgtgctttacggtgccacgcgcaacccctggaacctggatttcagcgccggtggatccagcggtggcgccggtgcggcggttgccgccggtatggtgcccatcgctcacgccaccgacgccgccggctcgattcgcgtaccggcttcgtcaaacggggtatttggtctcaagcctacgcgcggtcgggtgccgcatggcccggtgatggatgaggtcttcaacggctttggcgtccagctggggctcagccgcacggtgcgtgacagcgccgcgttgctggatgcgatgcagcgtcctcacgttggcgagccgtattcacggcgccgccggcgcacagctggttatcgcaggtga

SEQ ID NO: 116718 - DNA, 564 bp, Glycine max
  Peptide Sequence Number=SeqID_233496
atgtcttgcctagtgatcataactccgatcttcccctgccgaagtgtcaactggtgtatgccacctaccaggcaccttctagactcggataagtctaacagggccctggggtttccggcattgatcacgagcctctgccaatcatttggggttcctgtcactcctagtaaggtgatccgaccgccgatcacccgagccttcattgagaagtattgcacgcctaggcaggcgcagggtgatgcaccgcaggctgcaaacgcaccgccaccacctcatcaggctgatcccactgggtcattaggcatggagcgttatctacagcacttggtgcagatacatgagtgtctctaccagctcagcctcagtcagcagggccagggttttattccttttgcgtgtcctactccagatcagtttagggctgaggtcgcatggcccagagattggcctgaggcccaagcaggggaggcgcctgcagaagctcccggcgatgcagaggaggcccgcatggatgaggagatgacgaacttgctcggtttcttgagagggaccggagccacgtga

SEQ ID NO: 116719 - DNA, 312 bp, Glycine max
  Peptide Sequence Number=SeqID_233497
atggaaaccgacgtatatatcaaaaagtataaaacctgtgattataggttgaaatcattcaaagctacagtcatacagaaaaaaagcactaatatatattcagatctagtgttgcagaaattgatgaagctggcatttggagagagagagggagagaaaacatgtcaacgaaagacagagagggagagcattggttggagagatcagacaaagatagcacagattaagattgagatgctgatgaatgaatccttgaattcacatgcagtggaatgtaatatgatgcccaacacagatatatcagcttactaa

SEQ ID NO: 116720 - DNA, 900 bp, Glycine max
  Peptide Sequence Number=SeqID_233498
ccaacgtcggccgcctggccaacatggtcaaggaaatgagcgaaaaggtgcagttcctgttcgtcagccacaacaaggcgacgatggaggccgcgcaccagttgtcgggcgtgaccatgcgcgagccgggcgtcagccgcctggtcagcgtggacctggaagaagccgcgcgattggcgggcgcggcctgacccggagaacctatcgaatgtccgacacggcactgttgcgcatcggcatcctggccgccggcctgctgttgatcgccgcgatcttcctgtttggccgtccgaagaagaagccccagggccgccgcgtggaaagcgcggaaccgaacagcggcgagcgccgcgagccggtgctgggcgaagacggcgtcaccgtggccgatggccgcgtcgaaccgggcatgggcacggaaggtgagcaggccgaactcggcctgggcgaaaccgatccgggcgccagcgacctcggcaagcgcgccacccaggacttcgacaagatcgtctcgctacatcgtggtggcggccgaaaagaccggcctggtgttcggccacatgaacgtgttccaccgcctggtggaggccaccccgagcgcggcccgatcttctcgatggccagcatcatgaagccgggcagcttcgacatggccaatatccgtgccatggagaccccggccatcgccttcttcctgaccctgccggcgccgctgaccgcgctggatgcctgggagaaaatgctgccgaccgtgcagcgcatggccgagctgctggatggcgttgtgctggatgacagccgcaacgccctggggcgccagcgcatcgcgcacatccgtgacgagctgcgcgcctatgaccgtcagcaccaggctccgccgttgaccaagaccccgcgctg

SEQ ID NO: 116721 - DNA, 324 bp, Glycine max
  Peptide Sequence Number=SeqID_233499
tcggaaccgccaagaaacgtaagcaatttacatggtgatgaagaagatgatgatgatgattatcttgtgtctaactcatacattgaagagtctttagacgaagatgatagtgttgaccgtatatctgatacaaacgatgaagtaaccgacatgattcaaccaaaggaattcaaaatccattttggaatgatgctttgcattataacaatatcaactggagtcatcctgatgaggaggacatttgcggtttggagatgccatcgagttttaatgttgggcaagaattatatgttggcatggattttgatagtaaagatgtggtaa

SEQ ID NO: 116722 - DNA, 222 bp, Glycine max
  Peptide Sequence Number=SeqID_233500
atgagtctcagcctgcagagccagggctttacttcttttccgtgctctactccggaccagttcaaggcagaagtcgcatggcctggagattggcctgaggcccaggcaggagagtcaccagcaggggcaccagcagaggctcccgacgaggcagatgaggcccgcgagggcgaagagatgaccgatttacttgatttcttaggagggagcgatgccacatga

SEQ ID NO: 116723 - DNA, 106 bp, Glycine max
  Peptide Sequence Number=SeqID_233501
atgccaacgtcatcacgtcggcttggtgactcctcacccgaatcttactccctacaccctgccactgtcattctgctcccacgaacaaggttcttgatcatcacag

SEQ ID NO: 116724 - DNA, 738 bp, Glycine max
  Peptide Sequence Number=SeqID_233502
atgtctttggactcctcatcaaaccacccaattattcctgacttgtattgcagtgaagtaacaagcgaagtgattcacttggattccgatgatgaggctatgaagttgaatgttctatggggagactctgatcatgatgatagtgatgaaagcattctattgagcttgttagaatccgaacacgaccaagtgcaggaacaaacaaagtccctaggacaacaacttcgcaaaaaaacatggctgattaatgctcgagaagaggccataaattggatcctaaaggtgcatgcttactacagtttcaaacccgagacagcatatctttctgtagattacttcaatcgttttctcttgtcacacaccttgacgccagataaagcatggcctctgcagctgttatcagtggcttgtcttgctctagcagcaaaaatggaagaaagaaaagtgccacttcttttggacctgcaagtgatcgagtcaaggttcttgtttaagcccaaaacagttcagaggatggagcttttggttatggccagtctcaagtggcgattgcgcactataaccccttttgattttgttcaccttttcattgccaagcttccgtgctctgcttccacatggagagatttaagttacattgtttctcgtgtctccgatgttatcatcagaacatgtctaggtatcaaaaccttgtacccttataagtctctatctacttgcaatatctttttcttgtag

SEQ ID NO: 116725 - DNA, 537 bp, Glycine max
  Peptide Sequence Number=SeqID_233503
atggggaattgccaagctgcggaagcggctacggttgtgattcagcatcctgggaacaagatcgagagggtttattggtcgctaagcgcacacgaggttatgaactcgaatcctggtcactatgttgcgcttgtcgtgtcctcgcccacgcttatggccgagaatggcacgccgatgaagcagcttaagcttctccgaccagacgatactttgcatattggccaggtttatcgcttgatcagcttcgaagatgtgttgaaggagtttgcttccaagaaatgtggtaaacttgggaaattgctcaaggagacgggtagtcatgggattcagatgaagcacaaggactctagagctctaaatcctagccggaattccaaatctgaattcggttccattaaggtcgaacaggagattcaacgaatggggaacaatggcaggagcaacaacaacaataaaaaaggtgttggaaggcctttcgttggtagtggtggtcaatggaggccagccttgcagagcattgcagaaattggaacttga

SEQ ID NO: 116726 - DNA, 348 bp, Glycine max
  Peptide Sequence Number=SeqID_233504
atgtaccctgaggttcaaaagaaccctagggccttcttcagcagctctaccccaatcctcttggagcctcttgctcatggctctagtgactgttcccttcctagggaggattgcatcatgaaccctccagtacttatgcctccagtgcctgggaggcctctcatcctgtacatgacggtgttggatgagtcaatgggatgcatgctagggcagcatgacgattccgaaaaaagagaatgggctatctattacttgagcaaaaagttcacggcctgtgagatgaactattctctactggaaaggacatgttgtgctttgctatgttcatcccatcgtctaagacagtaa

SEQ ID NO: 116727 - DNA, 355 bp, Glycine max
  Peptide Sequence Number=SeqID_233505
gcatttgactgaaacaagtatgcgagcggggaattccgatatctatggattcctcgagccacagtccattcagaggtctgggcactcgcagtttgagactgaaagttacataaagagttggaaaaaaagttcaaaacgcgatgtctaccttagagcctatctaaataggtcagacaactaccttaaggggataattaacagacaaaaaggaagtactaagtgcggctattatgtcatgcactggatgttcaccatcattttaggaagttttaggaataactgggaagcgaccattacagccagagagattaaaggcactgcggatccagtgggcacagtattatctctgagttag

SEQ ID NO: 116728 - DNA, 314 bp, Glycine max
  Peptide Sequence Number=SeqID_233506
tcaagcgatcttttgccattggtgctggtgcagtaactttatttggttatagtaaggatcgtgatggacaatggctaaagaaggacacgctacctctgcaagacgagcgtactctctctcctcctcctcagcgggatgattcctcagcccttatgaatgaagttctttcggaattaaggggcctccgcacctatgttggcgaacgctttgattccttggatggtcgctttgaaggcatggatacccgcatcacccaacttgaagaggatgtgacttatcttcgtcggtgctttgatcttccaccactgtcttag

SEQ ID NO: 116729 - DNA, 402 bp, Glycine max
  Peptide Sequence Number=SeqID_233507
atggctccattgccgtcactccaaaatggtcaagtgactaaatcaaacacaacatacactctgagggagttcccagaaagatttacaaaagataggataaggttgcatgaattatcacctctttcaaaaggacgtccacatttaccaaatttcacgacaaaggttgtatggatcttgtcgcaacatgcccttttgcgggcgagcgagcgagactcacgggtgcgctttccaaaggaggaaagatgtgcggagtcgccaccaacgtttatttgtggaaaacgtcggaaaaaccgaaggaaaccggtcaaaatgaaaattctaagttcgggagttgtatttacgtttgaggaaggtattagcacctctcacgtttgtctcaaaggacaacaacctattttttag

SEQ ID NO: 116730 - DNA, 543 bp, Glycine max
  Peptide Sequence Number=SeqID_233508
atggctctgaagaaactctccatgaagaggtctagaagagacgccacaggagaagaatccagtgccgacccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcaaacgttggacaccgctagtgactcccatggctaagtttgaccctgagatagtcctagagttctatgctagtgcttggcccacggaggagggagttcgggacatgcgttcgtgggtaaggggtcagtggattccctttgatgtagattccctcagccagttccagggtgacccgctagttttggaggaaggccacaagtgtgagttcagccagaagaggaaccgggccaacgatttcgataaggaagccatcgcccagctgtttgcataccggggcaggatttcgcccggaccgttgcagggaggcgggtgcggatcatgcacaccagcatga

SEQ ID NO: 116731 - DNA, 174 bp, Glycine max
  Peptide Sequence Number=SeqID_233509
atggcaacacctaacgccccatttgctccgcaatggaatgagttttctgcagagactgagcaagcagaagcggggagacaacgcgggggcagaagaaatcctgatcgtcaagcgcgaagatgggatcgaccatgttgcacatcctcacgacatcacggacaccataatgactaa

SEQ ID NO: 116732 - DNA, 438 bp, Glycine max
  Peptide Sequence Number=SeqID_233510
atgtccaaagacaaggtcgtcgacattgcccgcaatatggccaagttcgctcgcagtttgggttgcgatgacgtcgagttcagtcctgaagatgctagaaggtcagatagggagtttttttatgaaattcttggagaagttattaaggtcgaggccaccacgctcaacatacctgacactgttggtataaccaagtccagtgaatttggaaagttgattgctgatattcaagctaataaccccggaattgaaaatgttattatttccacccactgccagaatgatcttggactttctactgcaaacactatagaggcagggagagtgaattctgagtttgtgtgctcttggatgcttttagggtgcgcgtgctggtgcaaggcaactggaggtgacggattaatgggattggtgaaagggctagaaatgcctccctag

SEQ ID NO: 116733 - DNA, 318 bp, Glycine max
  Peptide Sequence Number=SeqID_233511
atggatggtcctggggctggcaaacacatccaagctggtgccaagaaggttattattatcactgctcctgcaaagggtgttgatatcccaacttatgttgttggagtaaatgaaagggactacactcatgagatctctaacattataagctctagaaaacagatgcaccaagctgtatgtgtgagcaaaaaggtaaaaaccatgataagaagccaaactcaagctaacataaaatggacaaatttggcaaggaagctacaatttgagaagttcaatagacatgcagcagctattgaggttctcgacattactgtttag

SEQ ID NO: 116734 - DNA, 210 bp, Glycine max
  Peptide Sequence Number=SeqID_233512
atggagaagggtacgagagagggggaagacaagaggacgaagagggaattagagttagggttagggttgaagaggaaggggcagagagggagagaatgggaaagggatagaagaagtggggatactgtggatgcgcctgttgtgaagaatgacttccattcttctgagagtttcagtgccacagagagagaatcacatgggttagtttag

SEQ ID NO: 116735 - DNA, 468 bp, Glycine max
  Peptide Sequence Number=SeqID_233513
atgacaaagcagaaagaaagaaggaaagagagcaagctgagcaggtacatgaaggcaccgttaaggttcctgaagaaggccagggacatgtacgtctacggcatgatcgagtgctccggccagttatcctatgtggaggcctccatgggatgcccgaccggccagctctgcacgctccccagaagcttcagcgtcggctcggccacccgatccgccgccagcgacgaggatttcgaggagctcgtgagggccgcgtcgctccggagctacggcggccgcgtcgtgttcggtgatgctgctgcggcggcggtggagatgaaaatgcctcggagtcgcagcgtggggattggaaggatcgacgaggacaaagtgtgtgagtttggagatgatgggatcaaggttagacctaatgcttatccaagaagtaaaagctacgctgcatgtagagacggagcagggctgttttag

SEQ ID NO: 116736 - DNA, 375 bp, Glycine max
  Peptide Sequence Number=SeqID_233514
atgacaccacccactatgcaccctctagacccggataagtctaatagggccctggggttttcggcattgatcacgggcctttgccagtcattcagggttcccgtcagccctagtaagtattgcacgcctaggcaggcgcagggtgatgcacctcagaccgcagacacaccgccaccacctcatcaggccgatcccgctgggtcactgggcgtggagcgttatctacaggacttggttaggggcagaaatttttggcgttatggctctcagttatttcgtcaccgttttgtttttgtgacttactatttcgcgcatttaccttgtggttccgctggcagggagattgaccggccaaatggtgtttcgctcgaatga

SEQ ID NO: 116737 - DNA, 599 bp, Glycine max
  Peptide Sequence Number=SeqID_233515
aacagcaaaaggcagctggtggtgagcttcggttgctgggtaaaaggaatgcagacaaccgagtatgcattgctgaggtaggagcaataccacctcttgtagatctattgtcttcttcagaccctcaaactcaggagcatgctgttacagcgcttctcaatctttccatcaacgagagtaataaaggaactatagtaaatgttggagccataccggatattgtagatgtactgaaaaatggcaacatggaggctagagaaaatgcagctgcaactctctttagtttatcggttctagacgagaacaaggtgcaaataggtgcagctggagctatccctgctctaataaagttactttgtgaaggtactcctacaggtaagaaggatgttgctactgctatcttcaacctatctatttatcagggaaataaagcaaaagctgtaaaagctggtatagtagccccactgatacaatttctgaaggatgctgggggtggaatggtagatgaagcactagctattatggaaatccttgctagccaccatgaaggcagggtagcgatcggtcaggctgatcgaggccgtacccgaatcaaataa

SEQ ID NO: 116738 - DNA, 219 bp, Glycine max
  Peptide Sequence Number=SeqID_233516
atggcttggttcagtgttgtttggacaaagatcaacatcacaccaccggttgaggttttgcttaatacacaaccacaatcagtcaactacttgaaaaggaaatgtgattatgtcaaggataacttcaacaagttggtagaaataaataccaaggttgatcctgataatttctttaggaatgaacaaagcatccctatgctatcatatcagaaattatga

SEQ ID NO: 116739 - DNA, 531 bp, Glycine max
  Peptide Sequence Number=SeqID_233517
atgaggaacaagatcaaaaaccccaacgtcatggttactcccttgttctcagttcgcccccttgtcgtggacaaccaccgtgcaaccctattcgttgctatcatgggcgagatctccttcatcctcgtttgcaagaccacgtcaccacaacgcgtgaccacaacacctcctcttgtggccatgaaccaccacaagtctactctttctcaaatgtcgagcctttcatcagggatgccaaaaaggctttcccaatttaggagtttgattagggttttgagggtttggtctttggagagtaaaatggagagtaaaaggaagagggagataactcttactatcatgaaatgcaaaaaaaagaacagggaaaaagcaatgaaaaaaagaaggaaacttgaaattgacaacggtggtgatgaaagctctggaccgacactggtaatgagaacctacggctccagacgacagtcacgagcacaagcacacatagtcacgaccaacagtgataggcgatggcgacgaccacaactttga

SEQ ID NO: 116740 - DNA, 456 bp, Glycine max
  Peptide Sequence Number=SeqID_233518
atgattgagagaatacggttccatggcctaccgttagaagatcttgtgctccatctgaggaagttcttaaaactcacaaacacggtgaagagccccaccaatgctcttgactacatcaaattggctgccttcccattctcattaaggggaaaggctaaagattggcctcgtgacttgccaaggggaaacctcatgcataaactaactgatgcaacaatggagattattgaggttatggtctccaatgcttacaatggtgtgggtgacaaagatttctcaggaaatccacttgagttcatcaagtggaagctaattcatctgattcttctcttcaacaaaagatggatatgttggccaaaagatggagattatgatgaaagctcaagtgtagatgatgacacccattcccccacctcttgtctgcgaagagtgtacgaagacataacatatggttag

SEQ ID NO: 116741 - DNA, 1050 bp, Glycine max
  Peptide Sequence Number=SeqID_233519
atggtttccttcagccacaggatgcggcgcacgccctcatcccagcaccgccattggcacctcgccgctctcgaccaggcccggcaggtgctcggcgtagaagccgctctgcatgctcaggtccaggccggcggtgaacgccttggcggtggcatcgcggtcgtcggcggcatagccgtgcgcgaccagttccatgtcggcggtgtagtcggaaatcaccacgcccgggaacttccattcgccgcgcaggatgtcggtcagcagttcggcgttggcactggccggcacgccgttgatgtcgttgaacgaggacatcacggtgatcgcgccggcatcgaaagcggccttgaacggcggcagatgcacgtcgcgcagggtctgcggcgagatgtccaccatgttgtattccatgccggccatcaccgcgccgtaggcggcgaagtgcttcggcgtggccagcagcgaatcggcggcgcgcaggtcgctgccctggaagccgcgcacgcgggcggcggcgaacgcacagcccagcaccacgtcctcaccggcaccttcggcgccacggccccagcgctggtcgcgggcgatgtccacggccggggcataggtccagtgcaggccggcagcggtggcttcgatggcggtggcgcgcgcggtgcgctcggccaggtccggttcgaagctggcggcctcgcccagcgggatcgggaacacggtacgcatgccgtggatgacgtcggcagccaggatcaccgggatgcccaggcggctttcctcggtggcgacctgctggatgcggcggcccagttcggcgccgacaccattgaacagggacccgaccttgccctcgcgcacctgctgcagcacctggtcggcattgcgcacgttggcttccgggttcacgtccggggcgaacgggcggaccatgtctgcgaagacacccagctggccgaccttttcctcgacggtcatctgggcaatgagggattcgatgcgatcggaggccaccggcagtccttgatgaaaacgtttacaagcccggcattctag

SEQ ID NO: 116742 - DNA, 342 bp, Glycine max
  Peptide Sequence Number=SeqID_233520
atggatgggattctcatttctagtgtggtgttgttggctgattcacgattcactcgaccggatatgggttttcacccaacaaaactcaatttcgtgcctagcgatgcggatgaggcgcccctcgatgtttccatttgcctgcatgcctttggtattgtggggtgtgacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 116743 - DNA, 598 bp, Glycine max
  Peptide Sequence Number=SeqID_233521
atggccgatgccagcatctggtttgatttcctgaatacccacgcgccggataccgcgtatgggttctaccgccgggcgggccggaacggacaagctctattctgcgataagcgtcagcggctccgctacgcttattgcgctggtgttgctccccttctctccacagtcttctgctgcaagctggccgtttttagtcggctcctgcgccttactggtggtgtacaccgtgctggtggcgaagacctatcaggtctccgatatgagtcaaacctacccgctgatgcgcggcaccgccccactgctggtggcgctgatcagcgtcctggcgctcggcgatcgtctctcctggctggcctgtcccgtacgagggatctggctggcgctactgagcgcctgtttgatctccggatatacgctggtggacggcaccggggtgcggctctcggacactgcgctgggctacacgctgtggacctcctttatgaccggtttttgcctgctgagctgggcgatggtggcgcgtcggcgttgagcctttggctacctgcgtctgcgctggacacaggggctgctcgggcggcgtcggtaccatgggctc

SEQ ID NO: 116744 - DNA, 290 bp, Glycine max
  Peptide Sequence Number=SeqID_233522
ttattcccccgactgctccgatagaattcccaaacgtcagagagacggagaagagattgaagcctccacttgtactgtcttcatgcgattcctttttctccatccacgaatattacctagcaaatcccaacggtgaaagaaaaggctacaatgcgaaaggtatttctctcagcttaaacatgatatcaaaattcccaacggttaggtggcctgcgggaaaaagagagggttttgggagaagagagaagaaacgaaattgtgaggcagaggagactgaagagtcagtctga

SEQ ID NO: 116745 - DNA, 279 bp, Glycine max
  Peptide Sequence Number=SeqID_233523
atgaactcaagcttcgaagggccgaaagggatgagtcgagggtggaaaagactagaggataagcatgtgaaggtatcagctctgcaagtagaaatggaagcaagggagagggtgataaaatcattgcatggggaagctgtgaaatggatggatagattcgctctcactttgaatgggggttgtcgcaacctacccttcggcgggagggcgacgcgtgactcgcgggatgcgtgttccatgaaaggaatacgcgcggagtcgccaccaacgtttatttga

SEQ ID NO: 116746 - DNA, 561 bp, Glycine max
  Peptide Sequence Number=SeqID_233524
atgaaatggcagcggccacccaccatttcagatttgttgcatggtctgaatcaccggctccgggcacactcatcgctctccctccttgacagcgtcatggcattcaatccggaagaagcgcaagaagccttcgaacagtttctgatcatcatggacgatcagattgaatggctgatcgagcaggcgcagcagcgcggcgtcgacctagacggtagcctggagagccttgatcgcctcgaaaccctgtacacgttgatggccgcaacgttatcgaaggacgagcaagctgccttgagagttgtgtttgcacgatatcttggggaaaccgtgtgtcagcatcacggcggcaaatggactctcccactggatgatcccaaggacatcagtttcaacatgccggttatcgtggggcattcatcctgcccgtggctggagttcaatcccatccacacgatgcgagcctattcacttcggcccaagcccggaatgatccaaagcgtcgttgcgcacagtattgctccacggattctggatcttagcgatctggtggaagaggactga

SEQ ID NO: 116747 - DNA, 219 bp, Glycine max
  Peptide Sequence Number=SeqID_233525
atggcgtggatctactgtccgggcagtggcatgatccaccgatcccgatcatggaagaccgatggccatcgccctgatcgcactcctgctgatcgagaccgtccttctgatggcctgggtggccggttatttcagctggggcatcaccgtgttcaacgaacgcatcgcggcgtcaccggccatgcaggcccggctctcgctgggcagcctggaacgtga

SEQ ID NO: 116748 - DNA, 138 bp, Glycine max
  Peptide Sequence Number=SeqID_233526
atgtgtaaatggaagggtcgagcccgttggtctccaggaactgaaggaaagcgtccggtagtggcgcctttgtcgcgtgttcttcttccatggaaagctcaagtcaggttcggtggtaagaaggtggagaaaatgtaa

SEQ ID NO: 116749 - DNA, 660 bp, Glycine max
  Peptide Sequence Number=SeqID_233527
atgctggaaacctgctatcagcggctggagcagcctgacagctgggcgcagttcctgcaacgctgcgttgaagagaactccggtgccgcggcggaactctatctggcagacattctggagcagcagcaggggccggaagcggcacagctctacattaaccgtcagctgcagcgtcatcccaccatgcgcgtgttccatcgtctgatggatttccacctgcatgaggcagaagatggccgcgccaaagagagtctgatggtgctgcgcgacatggttggcgaacagattcgtactaaaccgcgctaccgctgccagaagtgcggcttcaccgcgcatgcgctttactggcactgcccatcgtgccgtgcctggtcttccgttaaaccgattcgcggactcgacggccaagaaattatcatccacgcatcagcactgtgcatcacctcgtcaatcagcaaggcaatcgccgtcgcaacgttgtcgtggcagggttgcacgggtagaatgcttgccgtttgtccatcgcgcctgcgggtgccagcctctgaggaaacgttatgcctgttactcactcaccgattctggtggcactcgactatcatgatctcaatagcgcactgcagttcgttgaccgtatcgatccgggccagtgccgtctga

SEQ ID NO: 116750 - DNA, 351 bp, Glycine max
  Peptide Sequence Number=SeqID_233528
atgagcgcggttgacgttgaggtccaaggtgtaagaggtaaaggcgaggttgaagtaattgaggacgttccacgtctgggcgaggacggtgaggtattggcagtaggtggtcagctgctccccctttggaatgatgacgggggtctccaagaaggcattcaacgcctgagtgttgaatttaatgaccttaccccacacccgacactattttttagagctgtcctccggtgtggggtccagctccacgttcctcttgggaagactgttttggaggtgaacattgtctcggtatcgaagacaagcgacctcagagacaaaacaggaggaatcccatgtgggttccccctttga

SEQ ID NO: 116751 - DNA, 153 bp, Glycine max
  Peptide Sequence Number=SeqID_233529
atgcgttctataaaattgggaagtgggttgatcacaagaaatgaagacgatgagggtcctctatctccttggttcaaaggaacaaggtcatcccctgaagttataccttgcatacaagaaagaaacaactacaacaaaggttatcaaggttaa

SEQ ID NO: 116752 - DNA, 168 bp, Glycine max
  Peptide Sequence Number=SeqID_233530
atggtttttaattttgatcgagaccaacaaactacacgactaatagtgtccgccatttcgagtacagtggttgttaatctcaaagccaccggtgctgattctatcctgaagctatccaaattcaagtggttgttcatctcagagccactggcgatgctcctattctga

SEQ ID NO: 116753 - DNA, 429 bp, Glycine max
  Peptide Sequence Number=SeqID_233531
atggaacaacaatctccaagtcacaatttgttccaaacaaatgtgacttatgtgatatccttggtaggaaaaggtcagggtttaaggtggtacctggactgtgaatgcttacaacacatgacaagagaaaggtctatgtttctaaacctaaagccacatgaaggaggagcagtttcctttggaggcataggtaagggaaagatctctggtatagaaaaattcatccatgttaaattcaatgatggattaatgtctaataggaagctatcagatcttgaggatgactttgcaaatatgaaaataggatcgtatgtatctcctaaagaaaaagagattaaacagtctaaggaaatccttcctcagattaaagaatcctcttatcataaaccacaaatgaaggactggaagtttgtccaccatcatccataa

SEQ ID NO: 116754 - DNA, 309 bp, Glycine max
  Peptide Sequence Number=SeqID_233532
atgaaggaagatgccaaaatttttatcttagcaggcaagttatctgatgaaattccaaatgaagtcattatggaatatctaaagacattgtctattgaggaagagcagagattaagaatgttcggatggaagaaccagagagatttcaatttgcaggagaacttgcagcataaattatctctagatgctactaaaaggcaagctgaaatatatgttgccattgttcctaacaacatggactctactgaaagggaaactcttgaagagggcatgcttcaatcagtcattaaagcatctcttatggaataa

SEQ ID NO: 116755 - DNA, 303 bp, Glycine max
  Peptide Sequence Number=SeqID_233533
atgtgcaaagcgcgacttgaatggaagcctcacacgctaatgaaaggtgttttttggcgcgtttatgggtggatgatgatgccgtcatcgacgttgaacatatcgggtcagtgtgaagttgcttatgggatcatcgattacaaagaggaaacattgtctggtaagactgacacacataacatattcacgaacaaacaatcatataaaaaacgtatgaggttccatcttcaatcaaagtctctgatccgcatagaggaatacactactgagtgttggcgtaggatcaatggtctgcaacagtaa

SEQ ID NO: 116756 - DNA, 228 bp, Glycine max
  Peptide Sequence Number=SeqID_233534
atggttacttccatacttcaacttgacttgatgaaccttttcgtaaaagcacgagcttggttcaaccccataacccagggaatggcaattttgatcgccaatacttcaacaacatttcatagggatgaaagactcgggaatacgcatgctatggaaaataaatgggtttatgatcccaacatggttggctcatggtacctaacacatgcaactaagaatgcatcatga

SEQ ID NO: 116757 - DNA, 255 bp, Glycine max
  Peptide Sequence Number=SeqID_233535
atgggtgaagtagaggaggtacaagagaagataaaggctgacatggaggccatgaaagagcaaatgggcacgatgatggaggccatgatgatcatgaagaagataatggaagccagtgcggttgcagttgccgctaccagcactattgctaaggtgaacccgatgcccccatctggcctcaaccaaatgaatcatccaacctcagctatggtaggcaaaggtttgggaagtatgggcggcccccatgatgtgtaa

SEQ ID NO: 116758 - DNA, 219 bp, Glycine max
  Peptide Sequence Number=SeqID_233536
atggtgtggttgcaacaactgatgatggtgaccatatgggtgcaacaacaagagatggtgtggctgcaacaactgaggatggtgatggtgtggatgatgtcaatgcttctttttgtgacaatacttttattacataatgtgacttcttcggctttgctttctccttctctttattaccacgagaggatgggagttgggatggatcacaacctccaataa

SEQ ID NO: 116759 - DNA, 384 bp, Glycine max
  Peptide Sequence Number=SeqID_233537
atggatgcaagatatgaacaatttgatccatttatcgttgcacataaagcaaggaaagtgtactacatcccgttagcaactctaacggataaacgtggttggtgtgttggaatcaaaacaaagccaaggggtttcatagaatctgatgatgtggaagatgatgtgccttaccaagaaggttcaccttcacataccaataaagtcaatgaagtcgaaggtatttttggattacacgatgttgaaggtgatgctaaagaactagatgtgcctgaagaaccaccacaacatgttcaagtacaagaagaagaagaagaattggtagaaaacaatcaagatgaggaattaaaagatgactttgatgtctcaagctctgaagaagattag

SEQ ID NO: 116760 - DNA, 396 bp, Glycine max
  Peptide Sequence Number=SeqID_233538
atggagctagattatggttttgactttgaggactgcttcccttcgatgattgcgcggttgggcgcggaagggttcatcggggagctttgcaacgggttccggttgctcatggatgtgaacatggggctcataacatttgagagcttgaagatgagcactaacttgcttggtttggaggtgagggatgatgagttgttgtgcatgcttatggaaggtgatttggatggagatggggctcttaaccagatggagttttgcattctcatgtttaggttgagtccgtgcttgatggatatgcaaggtatgaaaaatactcaactaagggatagccattccacgtttccttcgctatttcttgtcttttaccttccaaatgtcaagggagctgagagttaa

SEQ ID NO: 116761 - DNA, 741 bp, Glycine max
  Peptide Sequence Number=SeqID_233539
atgccttggggacagaacagatccgttgaagtaataaggttattttcacttgagccgtcatggtgggaagcctcaaagacgctgaagatggtggaaggatattacggagattccaaagaagtgtggggattggttttcagaaagcataaagtagaagttggcactggggaagatgtaagatgggtcggtaggagggagagtcttgggaatgggccttcaactggagacgccaatggttctcttgggagataccactgcatggttgaggattttatgagacctgtacaagggtcgaggagagtgaaaagacacttggttatggaattggagcatgctgaaatatctcaggatttcttcaagcaactatggaaggtaccagcaccgtcgaaagtacttgtcttcgcttggaggtgcgctcataacagagtgcaaactaagaaggaacttcgatgtcaacatcatatgcaggagacttcccacttattttttgcttgtaatttttcctacaagcaagaaatgggaaaaaggctctctgggttatatggttggctgttctatggtcactatggctggcaagaaatgatatctgcttcaattaatggctgtaaacttctccctgaacaggttctggatctagcaaagatgagaccgcggagctggttgaagggtaaaatgaactccttctctagctctatgtatgagtggacggtgctaccgaacctatgcttgaaaggtttataa

SEQ ID NO: 116762 - DNA, 291 bp, Glycine max
  Peptide Sequence Number=SeqID_233540
atggttggctcatggtacctaacacatgcaactaagaatgcaaggaaaatgcaaggatcaagcatgagtaaacatgataataaaagacacgagagcccggaaaatcatctcttcttacttgcgcattcgggggcgcagtgccctatgtgtgcagttaagaaggtgatatggaccttccggcttcccgtgacaaaagacgagaccaacatacaacgtatgcgagacgacatgatgcagatgcacaaaagcaaaatagagggatgtacacagcatgacaatatcctcaaataa

SEQ ID NO: 116763 - DNA, 997 bp, Glycine max
  Peptide Sequence Number=SeqID_233541
gctagatcctcaagagttgatagcccggttatgtatccctgggaggggatttgagcttaatgctgatggcttgcctctgaagatcttgaggaagaatcttaccactatggcccagacctggagtgttttatctttctctaacctagccttgacatcccatacttctgatattactctagatagggctaggttgatctacgagcttatcatgaagatggatatgaacttaggatccctaatctcaggtcagatttctcttattgcccagcatgactcctcaaggctaggttttccagcccttatcactgccctgtgcaaggcccgaggagtcacatcagattctctgacctttgagtcacttagcccagccattaatttgacttatattaagaagaattgttggaacttggatgacccttcagtcatttttccagggacccataaatccagggctagaggatctaaggctctatccatttcatctccccctgatactactgctccctctacttcagctccagctacttctattcttccttcaccactgatagctccagttcctctagcttcctccactccgagctcagatcctatcatgactatgctgaagagcctgcatcagggccaactcctgatcatgcagagcttgcaggatgtggcctggccaggagtccaaccttctcctctgggagggggtgaggcctctgcagcccagaagcctcagcctgatcaggaggatgacagtttagagtcctcagagccttctgcacctaagccatcaccattcactttcgacattgatccagtcattatgcaggaggatgatgcagcagttaccccacaggtgactccacagcctccatcagagccttccaagtcagtactggacatgtcttctcagcctgagccatctgtaccagagccagaccagcatctttctcaggattcaccatctgtaccagcactagacctgaatgagcatgcagaggatcattaa

SEQ ID NO: 116764 - DNA, 344 bp, Glycine max
  Peptide Sequence Number=SeqID_233542
acaagagagggtacatctcttgtggatcagttcaagtggagggtacatccacttggttgttcaaagagaacaagggagtgtacatcccttgtggatctttggcttgtaaaggattttacaaggttgaaagaaatctcaagaacctcaggccacttgatccaacagtgccaaaaatggatgtcgtgctaagcgagctcaatttgcttagcgagtgtcattcactaagtgaggcatcagcgcgcttagtagataggaggaatttggaagggaatctactatgcaagccctcactcaactcgttatcagctcactcagcgagtcatttgtcaccttcccaggcttag

SEQ ID NO: 116765 - DNA, 156 bp, Glycine max
  Peptide Sequence Number=SeqID_233543
atggcagaaatcaccaagggatggaagcgaatggaggataggatcgcgactgaccaagcgccaccccttcccggcgctaaaccagcagagaacgtcgctgcaaggcagcccagtatcctttgcgttcgtagtttcttttactattgtttattttaa

SEQ ID NO: 116766 - DNA, 498 bp, Glycine max
  Peptide Sequence Number=SeqID_233544
atggcgcagctgcatcacgccgtcgccgatcaggcgtgcgacctcatcccatacgggtttaatctcctgttccgagaacgtcatggcctacctcggaagcataaaaaacaagccatcagtatttcttctggtttttacgctcaatacttgcggtgtcgaaaagcaggagaaaacatcatgaactgggtcgaaacctttacggagtactaccgcctgagccgcacggggagaggcgcgcttggcctatttgcgggagttgctggagccgatcgcgccgcggcggcggtgagcagggcgccggcgtttggccggcgtcgtttcgcgggattaaccgaaggctatcgccgcccagcgcaacagcagcaacgccaggcagatcagcagcagcaccaccaccattctactgagcttggcgcccatgcgttttgttgccacgttgtttcccctttagctgaaataccatccaccggcgaggatgatgaggaaaagcgtcactaa

SEQ ID NO: 116767 - DNA, 184 bp, Glycine max
  Peptide Sequence Number=SeqID_233545
tcttttgcgtcgggaatgttgcactttctcaaatggtgaatatgtgaagtctggtgtagcggaactggagaaatggatagtcaatgcaacagaggaggtaatacatcagaagaggaagaaatctttggaagagattcggctagatctttgtccggcgaagcaccttacttgggaattgggataa

SEQ ID NO: 116768 - DNA, 237 bp, Glycine max
  Peptide Sequence Number=SeqID_233546
atgttaagaacaggagggagagcaggggatcaggactcaggagttcatataggtagcaggggtgctgtgaacactggggatcagggatataacagcctgcatatgagggagaaggcaataaagaagagagagaaaattagttggagagggaaggcagtggaagggaataaggaaaggcataaaaacattcctttttggcgttcacattatctcaaagccagtataacaggaaaataa

SEQ ID NO: 116769 - DNA, 1722 bp, Glycine max
  Peptide Sequence Number=SeqID_233547
atggagacaaatctaaaagtgtttatggcagcttttctactgagaaagctctatattttcagtagaaagctctcaaaagttcagaggagacttattacatatcttcacatgggtattgttggatttgacattgaaggtgacaagctcacaagagtacatgatcttgttgaacaaatggaggagttcttgtttgtgagggttgtgaggatcagagacttgccaccaaacattgactactatgtggaagtcatggttggagacttgattgcatcgacccttttgttcatatcccccgaatggaaccaagtgtttgcttttcagaaagaaaagatctcagatgagtcagtctcaattttcttgaaggacaagagactagccaagagcatgcctgaagcattcttagctcaggtgagattcagcattgatgatgttccaacacgtgtgccgcaagaatcttcaacattggcaccccaatggtacaagctagagggtccaaatgggagactagttagaggagagatcatgctgtgtttgtggatgggaacccaggaagatgaatcttttcctaatgcttggtgttcaaatgcaacaacggtgagtggtgatgatattgtctacactcgttccaaggtatatatctcaccaacactctggtaccttagagtcaatgtgattcaagcacagggcatggaattggaattggttggggaatcagatttgttttttgtccaagttgatttggggggccaacacctgagaaccaagctttccaagggtccaaatccgctatggaatgaggatttggtatttgttgcacaagagccattcagtgaaacacttgtcctcagtgtgaagaaactgacacctgacaaaaaaataacattggggaagcattggcttcatttgaaagatgtgaacaagagactagaagaggaggaagtggatagcaaatggtataatcttggtaggcttactgatagcagatggtataacaatcttggtaggcctaaaattcctgacaacacaagggaggtggagtatgttggtaagatcaatgcaaggatttcattggatggtgcatatcatgttatggatgagcctagtgagtattgcagtgatttcagaccctcatccaaggaactttggagttccagcattggcgtgttggaggtagggatccaaaaagcaacagctttggtgccaatgaagagtggaggaactagaactgatgcttattgtgtggctaagtatggccccaaatgggcgcgaacaaggaccgttgttaatagcctctcaccaaagtggaatgagcaacatgcttgggaggtttatgatccattcacagtgatcactattgcagtgtttgacaacaaccagttagatgctggaagtagagctagaggagaaaaggatgctactatgggaaaaataaggattcggttgtccacacttgaaaatgacaaagtctatgcactttcctatccccttgtaggtgtgaatccttctggggtgaagaagatgggagaaatccatttggcagtgaggttttcttggtcattcaggtgtccaattaagatgtatgaatactatatgtcacctttgcttcccttacaccaccatgtcttcccattgttaccttcacaacttcatgctttaagaaaccaacctgctcaaatcatagcacagaggttgagcagggcagaaccgccattaagggaagag

SEQ ID NO: 116770 - DNA, 528 bp, Glycine max
  Peptide Sequence Number=SeqID_233548
atggcactcccttgttctgcttcagttccactgacaacactaacatcccctcttctcttcatgttcaggaaaaggtttggagaagaagttgatcaagattttatttacattattgccgtggatcggatactccaattggaagacattcaggaggatggcatatgggtcacctcttcagattacaaaaatgctcaacccgatcctcttcgggactctgcacacaacttagtcactgaaatcaacaccaacaatatggaagacattactcgcttttgcaatgtctacgttgatttggatttcctgcatataagcttgtttggagggcattctactgatgaagttcacaagaacagaaggctcaatttcccggaatctaggatgcctaagatagtatgtgatccaaatgaagatgatagctcttgcaggaacagtaactgtcacaaggaaaccaacactacaaaacagcaaaaatactgttgtagctcttcgatccctccaagtgacaagagcttgcagcttctctcctaa

SEQ ID NO: 116771 - DNA, 1695 bp, Glycine max
  Peptide Sequence Number=SeqID_233549
atgcttctatgtcacagtgatctttcagataatcagctctctggcttcattcctgaagaacttagtcagcttcagaacatgatatccttgagacttgaaaacaacaaattaactggcgatgtggcgtcactttcaagttgtcttagtctctctctacttaatgtgtcctataacaaactatttggtgttatccccacgagtaacaactttaccaggtttccccctgacagtttcattggaaaccctggtctttgtggtaattggctgaatttgccatgccatggtgctcgtccttcagagcgagttacattatctaaggctgccattcttggaattactttgggtgcccttgtgattcttcttatggtattggtggcagcttgccgaccacacagcccctctccttttcctgatggatcatttgacaaaccaattaatttctcccctccaaagctagtgattcttcatatgaatatggcactacatgtgtatgaagatatcatgaggatgactgaaaacctaagtgagaagtatatcattggatatggtgcatcaagtacagtttataaatgtgttcttaagaattgtaagccggtggctatcaagaggatctattctcactatccccaatgtattaaagaatttgaaactgaactcgagactgttggcagcatcaagcaccggaatttggtcagtctccaaggctactccttgtccccatatggccatctcctgttttatgactacatggaaaatggcagtctatgggatcttcttcatgacatgcatggaaccctttatttagaaggacctaccaagaagaaaaagcttgactgggagctgcgtctaaaaatagcacttggagcagcacaaggacttgcttatctacaccatgattgctgtcctagaatcatccacagggatgtgaaatcatctaacattatattagatgcagactttgagcctcatctcactgattttggcattgccaaaagtctctgcccctcgaagtcccatacttctacttacataatgggcacaattggctacatagaccctgagtatgctagaacttcgcatctcactgagaagtctgatgtgtacagttatggtattgttttactcgagttgctaactggaaggaaagctgttgacaatgaatccaacctccaccatcttattttgtccaaggcagcaaccaatgctgtgatggaaacagttgatcccgacattactgccacatgcaaggacctaggagctgtaaaaaaggtttatcagcttgctctattatgcacaaagaggcagccagctgataggccaacaatgcacgaagtgacacgtgtactcggaagtctcgtgccatcaagcatcccaccaaagcaactagctgacctaccacctgcttcaaatccatctgccaaagtgccatgctacgtggatgagtatgcaaacctcaaaaccccacacttagtaaactgcccctcaatgagcacttcagatgctcaactcttcctcaagtttggagaagtaatctctcaaaacagtgagaaagatatgtatcatcatcatcatcacaatttgaaaggtgaagtaaacccaattcttattcttgtttgctggctttggatcagttatctgtccgaatgctggcagtattcagaaaagagtgtatacacattacctcttttaggataa

SEQ ID NO: 116772 - DNA, 1160 bp, Glycine max
  Peptide Sequence Number=SeqID_233550
atggcatttcgatttggagtccttattcttgctttgctaatttgtttgagtgtcaattctgtggaatctgatgatgttgtcaaagttgtcaatttccacattgttagaatgaattatgttacttcttttactgatgtcaaagttgtcaattttcagcatggagcaacgttgttagagataaagaagtcattcagggatgtggataatgttctctatgattggactgattcaccatcatcagattattgtgcctggagagggatagcatgtgataatgtcaccttcaatgttgttgcactcaatctttcagggttgaatcttgatggtgaaatttcacctgcaatagggaaacttcacagtttggtctctattgacctcagagaaaacaggttatcagggcagataccggatgagattggtgactgttcttctttaaagaacctggacttatcatttaatgaaattagaggggatataccattttctatttctaagttgaaacagatggagaatctgattttgaagaacaaccagttgattggaccaattccttcaactttgtctcaaattcctgatttgaagattcttgatgtgagaaacaatagcctgacaggaagtattccagagaacataggcaattgtactgccttccaggtcttggatttatcctacaaccaattaactggagagataccattcaatattggattcttgcaagtagcaactttgtcgttgcaaggcaataaactctctggacatattccatcagtgatcggtctcatgcaagcacttgctgtcctgtacttgcatggaaacaagctgacgggcttcatccccccagagcttggaaatatgtcaaagcttcactatttggaactgaatgataaccatttaagtggacatatcccacctgagcttggaaagcttactgatctgtttgacttaaatgttgctaacaacaatctcaaggggccaattcctagtaatcttagctcatgtaaaaatctcaacagcctcaatgtgcatggaaacaaattgaatggatcaattcccccttctttgcagagcttggagagtatgacctctttgaatctttcttccaacaatcttcagggtgcaattccaattgaactgtcacggattggtaatttggatacatt

SEQ ID NO: 116773 - DNA, 537 bp, Glycine max
  Peptide Sequence Number=SeqID_233551
atggtggttgacgtctgtcaatgtttttgtggcggctggcaatcccgccacttgcccttaacggtagaattgattgaaacaaagacggcttctaccgtgtggtcaagtgtttcaaatgatttaccgtggacaaattttttaacaccgttagattcacctcagtatacagtatatggtggacctgctgcactaaattttttttttctccctccctcaatttcaactgtgaacaacactgttacaaggaagccgaactcaaaaatcgagacggtggcgtttaggggtcgaggaaactcgatgacatacagatccgttctgtacgctgttgggttacagatccgccactcacatcgtcagggtccaaatttgtcgtgcatgctgacggcgcccagatctgttactcacgccaccgacggtagagggagaagcaaattgtgggtcaacaaggcggtcgttgcacttgacgtcgatgtagatccgacagcgagggaggctggtaccgtagaacttgccgaggccaaagacaacactctctga

SEQ ID NO: 116774 - DNA, 449 bp, Glycine max
  Peptide Sequence Number=SeqID_233552
atgaggtggctgtcaccaccattgtgtagattagtggacggtgatgctggtgatgggtcaccagagctctggcggcggacagcagaaaatgcaccacaaaaggcgaaatattgctggaaagagggacaacaagcagaaaagtccactagaatgtggaaacagtcactgaagacgggagacaagcagaaaggtccaccggggacagcacggtaccgtgaaaaagaggagagggagaccaaatggatgctggaagaagtcatcaagggagatctcatactaaataagattcctgaaatgatggcttttaattgtgctgaatgcgttactgctgttggccactacaagaaactcagcaacacattatctgatagaggtggaactagcccgtctaatgatcctttacaagggattggaggtcatatgacaaggtccaagactaagaggatgaa

SEQ ID NO: 116775 - DNA, 279 bp, Glycine max
  Peptide Sequence Number=SeqID_233553
atgaaggtgccatcctttttcatccgcaagttagttacccaggtgttttcattcatcaatattacactcttcaacagatcttcatttttcagtcttcttttgcgtcgggaatgttgcactttctcaaatggtgaatatgtgaagtctggtgtagcggaactggagaaatggatagtcaatgcaacagaggaggtaatacatcaaaagaggaagaaatctttggaagagattcggcaagatctttgtccggtgaagcaccttacttgggaattgggataa

SEQ ID NO: 116776 - DNA, 870 bp, Glycine max
  Peptide Sequence Number=SeqID_233554
atggcttctttgggtactacggacaccgtctccgcaacaacacgtgccgatcacttgaccactaaggctatggacattccaaataaagactggccagttggtggcaacaaagccaagaaagtttactccaatgatgtacatcgtctctacagtgtgataaccactatgttgtccaccaaacttgagaatatggatatgcaaacttatcttggtaaactcgaccgtttgattgctgactataacaatattctattggctcctactgtttctacttatgacatggttagtgaacagttaccttgtctctccactccacatgtttttggtcattcctctacctctgcctcttctacggattcctccgcccttgtctcacactcatctcatggcagagggcatgccgactgccacaacaaagcccgagaccaatcaaaatcaacgaatgttgcccaggtcactaatcctacccccattgaggatactaagtctagtaatcctgtagccactgtctctcagtcgtcctctcttggacctaggatacttgactccgatgcctctgatcatatgaaagatggctctcagatcaaagtttgtggcagtggtcaaacccacccacttcctaacctccctttgaattctgtcttgtttgttcctagttgtcctttcaatttgatttccattagcaaagattggcgtaccgaatggacgattggagcaggacatgagtctgggggattgtatcatcttcaaccaccgattgcctgtgtatccattgcttttgccgatcttgctcatcaacgttttggtcatcccagcttggagaagctgcgtcctttaggtgctagtctctctacacttaagtcattatag

SEQ ID NO: 116777 - DNA, 1296 bp, Glycine max
  Peptide Sequence Number=SeqID_233555
atgtatcgatccaggcctcacttctctctcatctcttcccaaacctcaccctgcctctcgtcgtttcgctccacctcttctcaaacgtcactgctacctctgtcttctcttgtgactgttgctatttactccactgattgcgcctggttactctgttatgatgataaagcggcaactgagaaaattttgcaaaagctcaagcttgagaattttcagttgggtaggaccaaagtatttctcagggctggccaaattggcattttggactcaagacgtgctgaagttttagacaatgctgcaaagtacattcagcgccgactgaggacatttattgctcacagggatttcatcttagccagagctgctgcattttctcttcaggcatgctgcaggggatacattgctcgaaagatatatgctgctaaaagggagacagcagcggctatctctattcagaaatatattcgcatgtggcttgtgaggcatgcttacttcaagctctatttttctgctattatcatacaatcccatgttcgaggttttgtgactcgccaaagattattacatggaaaggaacatagagctgctacttttattcaggcctattggaggatgtccaaggttaggtcatctttccgacgacatcaagcttcaattgtggcaatacaatgcctttggcggtgtagacaagcaaaaagagagctacgtagacttaaacaagaggcaaatgaagctggtgccctccgtttagccaagaataaattggagaagcaattggaagagctcacatggcgtttgcatcttgaaaagaaaatgagggtttctaatgaagaggctaagaaaatagagattttcaaacttcaaaagatgttagaagctctgaatcttgaattggatgcagctaagttggcaaaaattaatgagtgcaacaagaatgctgttctacaaaatcaatttgaattgtcagtaaaggaaaagtccgctttaaaaagagagctagttgcagtggatgaattacgaaaggaaaatgctctattaaaggtttcattgggtgcatttgaaaagaagtgcacaaccttagagcttgagcttatgaatgctcaaaaaggccgggatgaaaccatggagaaactgagagagtctgaacagaagtgctctcaacttgagcaaaatgtgaaacggcttgaggaaaagctattgagtttagaggatgaaaatcatgttcttcgtcagaaagccttaagtacccctcttcttaagagtaaccgtccaagttttgccaagtcaatatcagaa

SEQ ID NO: 116778 - DNA, 744 bp, Glycine max
  Peptide Sequence Number=SeqID_233556
atggccagagctttacttatagtcatcccttctttccgttatcaggaagccatatttcgtgtcttagcggcaattttacatttgggaaacattgaattttctcctggaaaagagcatgactcgtcggtaataaaggatgaaaaatcaagatttcatatgcagatggctgctgatcttttcatttgtgatgtagacctactgctggcaacattgtgtactcgttcaatacaaactcgtgaaggaagtattgtcaaggcccttgattgcaatgctgctattgctggccgtgatgctttggcaaaaactgtatatgcccgtttatttgattggcttgttgctaagatcaataggtctgttgggcaagatatcaattccaagatacagattggagttttggatatttatggttttgaatgctttaaggataatagttttgagcaattctgcatcaattttgcaaacgaaaagcttcagcaacattttaacgagcatgtattcaagatggagcaggaagagtatggcaaagaagagattaactggagttacattgaattcgtagataaccaagatgtttcggatttaattgaaaaggttagagatacggaaattgcaagatctgtattagaaggaagctactcagttagtcagaaatatgtcaaaaccattttgtctgatcctatgccccaagtcttggatttaaaaggatttcagaaaatgaaaagagagaaaatatcagatttctga

SEQ ID NO: 116779 - protein, 81 aa, Glycine max
  Coding DNA Sequence Number=SeqID_1
  Gene Ontology: Mol. function=motor activity; Cellular component =myosin complex; Biological process=establishment of meiotic spindle localization
  Homolog annotation: Hit_ID=Q1SMP7; Match level="QueryCoverage=96%, HitCoverage=6%, E-value=2e-35, Identity=94%"; Hit description=IQ calmodulin-binding region; Myosin head, motor region; AAA ATPase
MEQYKGAPLGELSPHVFAVADASYRAMMNEGKSQSILVSGESGAGKTETTKLIMQYLTFVGGRAAGDERTVEQQVLEVNYS

SEQ ID NO: 116780 - protein, 90 aa, Glycine max
  Coding DNA Sequence Number=SeqID_2
MDILIPLPLRWSYYLILSVNGHHMWSLDDLTLKAMGLQLLLHVDPSNGNLDVLIGEKGFLVCTGDGLNGCGVGVEVASLSDELESSADGS

SEQ ID NO: 116781 - protein, 105 aa, Glycine max
  Coding DNA Sequence Number=SeqID_3
  Gene Ontology: Mol. function=motor activity; Cellular component =myosin complex
  Homolog annotation: Hit_ID=Q1SMP8; Match level="QueryCoverage=84%, HitCoverage=96%, E-value=1e-31, Identity=72%"; Hit description =Myosin S1, N-terminal
  Pfam annotation: Domain name=Myosin_N; Domain location=6-47; Score =18.5; E_value=0.017; Accession=PF02736.9; Description=Myosin N -terminal SH3-like domain
MSLRHGSKVWLEDRDSAWLAAEVLDSDGNRLLLVTDSGKKVYASPEKLLPRDADEEEHGGFEDMTRLAYLNEPGVLFNLRRRYALNDIYLLDIELRLTSSLGFDC

SEQ ID NO: 116782 - protein, 122 aa, Glycine max
  Coding DNA Sequence Number=SeqID_4
  Gene Ontology: Mol. function=unfolded protein binding; Biological process=cellular protein metabolic process
  Homolog annotation: Hit_ID=Q70EL6; Match level="QueryCoverage=93%, HitCoverage=25%, E-value=2e-17, Identity=50%"; Hit description =Cytosolic chaperonin delta-subunit
  Subcellular localization annotation: CTP_CleavageSite=39; ConfidenceScore=5.49e-01
MVGPLVVWISLTKLSPLTSSVSSTRLASLMMKRMLSTVRGSRIMEYWLKTTKGGAGGFHEGVMVEELDGNNHGVEDVDNLHDDLPKGNEDDNGVDILGEEETVALLEECTDNGNHSGFMIGL

SEQ ID NO: 116783 - protein, 139 aa, Glycine max
  Coding DNA Sequence Number=SeqID_5
MDKYCPVSRDNLDRCENCKSFKLVKQAWTSVVQTTYVKLFGVDMLLVLQARSVQHMHSTLAYMSLVEWVKKRLSHEVLKRSFNALSATKESGRASSSKSHAKREISVLSATIVFSQAQRMTGAKREGGTKLNVANSESI

SEQ ID NO: 116784 - protein, 45 aa, Glycine max
  Coding DNA Sequence Number=SeqID_6
MASSGWCRFLVYPFKIFMYHSTGIKDFGTYDIEEKAQPSYGKPEC

SEQ ID NO: 116785 - protein, 55 aa, Glycine max
  Coding DNA Sequence Number=SeqID_7
MARTKKTRQMTSEAAKEIVDKIEQASQGSFIAHGCQDVLIAAIGQPEHPGRVHAA

SEQ ID NO: 116786 - protein, 127 aa, Glycine max
  Coding DNA Sequence Number=SeqID_8
  Gene Ontology: Mol. function=amino acid-polyamine transporter activity; Cellular component=integral to membrane; Biological process=amino acid transport
  Homolog annotation: Hit_ID=Q1SJF1; Match level="QueryCoverage=92%, HitCoverage=19%, E-value=3e-39, Identity=65%"; Hit description=Amino acid/polyamine transporter I
MTSSLCFWAAHLAGPKWGPFSSWCCAWLETIWLIVGIRTQRIFTWQLMLFMVGKGICGITHVAKYNPTLNWHNKGGGYFAPKWLFLCMYIGLTVIWATLNTFALEVIALIDIVSIWWQVVLLPCIHF

SEQ ID NO: 116787 - protein, 178 aa, Glycine max
  Coding DNA Sequence Number=SeqID_9
  Gene Ontology: Mol. function=cysteine-tRNA ligase activity; Biological process=cysteinyl-tRNA aminoacylation
  Homolog annotation: Hit_ID=Q1SJF1; Match level="QueryCoverage=36%, HitCoverage=12%, E-value=1e-27, Identity=90%"; Hit description=Amino acid/polyamine transporter I
MASGPIVGDDGAKEKQRYTESKVYTRKAFKGLKNKGNTSMDSAEKRLNELGYKQELRREMTMFKTLAISFSTMTLFTGITPLYGSSLQYAGPATLVWGWIVPLQDCKDVVSPLLQGETKKNEKVPQINETAKECIKKLNVEFQTKMSNDLQTPVILTGALQEALKFVNASLKMLKKRA

SEQ ID NO: 116788 - protein, 131 aa, Glycine max
  Coding DNA Sequence Number=SeqID_10
  Homolog annotation: Hit_ID=Q1RVI1; Match level="QueryCoverage=43%, HitCoverage=19%, E-value=7e-09, Identity=54%"; Hit description=RNA -directed DNA polymerase (EC 2.7.7.49) (Clone AmLi2)-garden snapdragon
RNVLDGILIANEVVEEAKKGRKDSMVFKVYFEKACYLVSRNFLYYMVGRLQFFQRWIRRFKVVWVLDDEDMTKSKGKDPLEGLGGPMTRARARKAKEAVQQVLSILFEYKFKFQGEKSKVVSCIMAQMEED

SEQ ID NO: 116789 - protein, 208 aa, Glycine max
  Coding DNA Sequence Number=SeqID_11
MTRSTGDVKRATQEFFVVHWLSMCGWFHTLFSKKVGPSIRYKVTARRKNQDSIFMRRMSKCSLDGTRGCINYNPVLAIRQLGYPMRGVPSDESITPFIARGFGDHNARDRELRGSSNGIIGGYHKWLKGLDWLPNLKTVREDEVKASEESDEVQALKAELERARVVEEKFKSIAIKESSRVKGMISEEVKGIITGQRHDLEGRAKGLP

SEQ ID NO: 116790 - protein, 92 aa, Glycine max
  Coding DNA Sequence Number=SeqID_12
MVRTKKTGQMTSEAAKEIVEKIEQASQGSFVPHGRQDVLTVAIGRPEHPSRVRAAGAGVTIKKYFESAPHTSRISSSMAPKELEQLTHQIRD

SEQ ID NO: 116791 - protein, 250 aa, Glycine max
  Coding DNA Sequence Number=SeqID_13
  Gene Ontology: Mol. function=nucleic acid binding
  Homolog annotation: Hit_ID=Q1T493; Match level="QueryCoverage=86%, HitCoverage=41%, E-value=6e-31, Identity=34%"; Hit description =Nucleic acid-binding, OB-fold, subgroup
  Pfam annotation: Domain name=DUF223; Domain location=39-135; Score =3.1; E_value=0.0015; Accession=PF02721.5; Description=Domain of unknown function DUF223
MARIPDKIKSIDGSKETLKLAVRITDLLFVGTPNKSEQVEMVFVDSEGDQIHAVCKSDHLKSWKADLKENSTYVMHNFKVVKNDGQFRVCEHEYKLFFIGVTVVREADLHELPFKEFRFVEFANVVAGNFVAGLLVDIIGVVDQVVFRRVSSKNTRVVFRMKDLSGEILSCTLWENYCMQFLSYLNERGNDGSMVIILAHAKIKDAQGKCDILFTDLGTHLISFGVAIFGIYRKLSSFSEQFLQGVKTID

SEQ ID NO: 116792 - protein, 184 aa, Glycine max
  Coding DNA Sequence Number=SeqID_14
  Gene Ontology: Mol. function=DNA binding
  Homolog annotation: Hit_ID=Q1SDS1; Match level="QueryCoverage=77%, HitCoverage=25%, E-value=6e-14, Identity=35%"; Hit description=IMP dehydrogenase/GMP reductase
MGWLEYQGNVWKQKQESWQVAIDAFLAFHDRKESSVVAILADLYDTFDRRCEKNSARIICCTPALYVWLVSHLFRQEVRHACPLEGHRSCTEKKKASWDRLLASKERASVNWFPQWKEGRTGILISCRGFPNFLLMGTRGCINYNPILAIRQLGYPMRGAPLEEGLTPIIARGFNSTNAGALQK

SEQ ID NO: 116793 - protein, 91 aa, Glycine max
  Coding DNA Sequence Number=SeqID_15
MTNAGMICPLQCHEEMHDAIKEYARGLSATAHHQKKGKLYMRLHCHQASRRPSMTTDQPPLLMAHIGPGVGPNISICVRGVGVMCVQKKYF

SEQ ID NO: 116794 - protein, 126 aa, Glycine max
  Coding DNA Sequence Number=SeqID_16
MDDMLLCVYATRPHVQRAKHHLRQNFKMVDPSQDYRVDKATLNSHYSQEGETMDESFSSFCGSRIINYQMCNQLAWASKFLQNEVISLLGRAQLAWESSARLSELPSTQMLHFAINRRGKAEVKGP

SEQ ID NO: 116795 - protein, 46 aa, Glycine max
  Coding DNA Sequence Number=SeqID_17
MDTDVTDEKKEIPNDKGKSKDVFQRKGFEKPMSSRLKKTESQDPIE

SEQ ID NO: 116796 - protein, 538 aa, Glycine max
  Coding DNA Sequence Number=SeqID_18
  Gene Ontology: Mol. function=zinc ion binding
  Homolog annotation: Hit_ID=Q338Y6; Match level="QueryCoverage=65%, HitCoverage=85%, E-value=4e-60, Identity=35%"; Hit description =Expressed protein
  Pfam annotation: Domain name=DUF641; Domain location=112-245; Score =161.1; E_value=2.8e-45; Accession=PF04859.3; Description=Plant protein of unknown function (DUF641)
MDGSSAKPPQISEMFQKFALAFKTKTFEFFSEEENNNASPLFDDIDGFSLLDSTEEIIPDQKVVVIKPDPDPSNNSSPPPLLPQPQSPPPPPPPQIIPPPPPPESREPETPPPPLTSAQIREMTHALVSSVFAAVSAFEASYFQLQSAHVPFVEEHVTSADKVLVSHLQRLSELKRFYSNSEPCGFPLGLRLEAEVEENQSKLRTLGTVSNRLQWELEQKHDEVVALRAKLDEIHRGNVNLSKKLCARALNPSSDVLLTVKVFDSLLLDASRATHRFTKILIGLMRKAGWDLGLAANAVHPNVDYAKKGHNQYALLSYVCLGMFHGFDSLNFGMEEPVVLNGHGSDLEDRDGCLKQLLEHVSSNPMDLLGIHPGCKFSRFCEHKYERLIHPSIESSIFVNLEEKEAVLNSWRSLSMFYETFVGMASAVWTLHKLSYAFNPAVEIFQVERGVEFSMIYMEDVTKRLTWPNKGRAKVGFSVLPGFKIGRVVIQSQVYIRFLLKSWALSSDASTICRRYMNPVDGSGVVRFCQNLFKDAWA

SEQ ID NO: 116797 - protein, 108 aa, Glycine max
  Coding DNA Sequence Number=SeqID_19
  Gene Ontology: Mol. function=aspartic-type endopeptidase activity; Biological process=proteolysis
MVSDLCGKPSNSQGVIGLDVLVSSRRPTMFPVISLQANFNMLLGREWIHGVGAVPSAVHQKIFFWNEDGKLKMVEADQSSYGIYAAFASKGDQAMQELLHSKSKIHSL

SEQ ID NO: 116798 - protein, 70 aa, Glycine max
  Coding DNA Sequence Number=SeqID_20
MAIVAIKIREVATTTVEKKEKMDDNAIKEKGKEMDAYAIEIDIDAIEVKKEKMDIDAIKEKGKEMDIDAI

SEQ ID NO: 116799 - protein, 181 aa, Glycine max
  Coding DNA Sequence Number=SeqID_21
  Gene Ontology: Mol. function=DNA binding; Biological process=DNA integration
MSIFYDDIGSPREASPKSEEVVNNKPQEEPSLQQHHLPKECKAPKDLSIDNIIRDIERGLYQMDVKSVFLNRYIEKEVYVSQPPDFEDRKNANHKIDHGTFLYQTKYCKELLKKFKMDKSKEDETPMATNCYLSADENGKSIGQTKYRDSQLVDIFTKPLARDRFYHLHNNLDILRESNLT

SEQ ID NO: 116800 - protein, 111 aa, Glycine max
  Coding DNA Sequence Number=SeqID_22
CSVEKLPNNEVFSPPLARRAQYKRACLVEQEIVTGRLANLDALSARSDKGFAGRHMIAGHKDKPAQLPPKGTCGYDLDHKGNGDGHLFNWKVEGGHLIVPSVGIDRNLEEG

SEQ ID NO: 116801 - protein, 112 aa, Glycine max
  Coding DNA Sequence Number=SeqID_23
  Subcellular localization annotation: CTP_CleavageSite=64; ConfidenceScore=5.26e-01
MFAHSIKGCRPLGRACGVLIPSPCVNTTPEPFNLKVRRSRLFRFFRRFPQINVGGDSARIPFVEHASRESRVALPPKGRLRQRVYPLSLLFLNDKGRKIRLCAFTTQLAIML

SEQ ID NO: 116802 - protein, 311 aa, Glycine max
  Coding DNA Sequence Number=SeqID_24
MAKFDPEIVLEFYANAWPTEEGVRDMRSWVRGSVDPVRCRRYQPAPGISDGIGRGPGMRVWPEEKPGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLQHLVRQQAANHRAHVRTHDCLYQMSLSMQSQGFAPFSCPTPDQFRAEVAWPGDWPEAQAGEAPPEAPGDGEKPTRMRRWLICLTSWEGVET

SEQ ID NO: 116803 - protein, 302 aa, Glycine max
  Coding DNA Sequence Number=SeqID_25
MRSWVRVQWIPFDADAISQFLGYPLVLEEGQECEYGQRRNRSDGFDEEAIAHLLCIPGQDFARTAAGRRVRIMRTNMTTLTQMWMTLLLSNIQPSDHNSDLPLPKCQLVYAILTRMSIHVAQLIADAIYLFAGMAPTRHPLDPDKSNRALGFPALITGLCQSFGVPVAPSKVIRPSITRAFIEKYYTQRQAQGDAPQAADAPPPHQVDPAGSFDTEQYLRHLVRQQAANHRAHPAEPGFTSFPCPTPDQFRAEVAWPGDWPEARAREAPAEEPAEAPDEADEAREDEEMADLLDFLGGSGAT

SEQ ID NO: 116804 - protein, 210 aa, Glycine max
  Coding DNA Sequence Number=SeqID_26
  Gene Ontology: Mol. function=phosphoric monoester hydrolase activity; Biological process=dephosphorylation
  Homolog annotation: Hit_ID=Q05918; Match level="QueryCoverage=73%, HitCoverage=51%, E-value=2e-52, Identity=77%"; Hit description =Tyrosine-protein phosphatase precursor
MKHRSTELALALMLSLPLAVTAVAADAPQAAAAKPTAVANVKPVAADAQRVIPLQGAWNVRTFAGLQGRHGPIPADAFVRTADLGRLTDADRDALAAAGVKLDIDLRTADEEAQSPDLLARDDRFDYQRISLMGTEKMDLQKMMSSFPDSLGEAYVQWLGHSQPQFKQVFQRIAAQQDGAVLFHCTAGKDRTGIIAGLLLDLAGVPKAEI

SEQ ID NO: 116805 - protein, 143 aa, Glycine max
  Coding DNA Sequence Number=SeqID_27
MTLCSKTWLRYHLPRLISVLDLARPESLKDYASFKAQSEDQNNEPPIPRSLRDCDEKITEDRNDASSIGACRPRIFFINGFFCFLENEWQRNGERKRERRRHFKEKMSLEEAHHHRRPWIRAWRKKEMNEGRGREEHKILCSK

SEQ ID NO: 116806 - protein, 61 aa, Glycine max
  Coding DNA Sequence Number=SeqID_28
MSSVSKYDKKDARECGAMEFGMRMRRLELWVEWDEDAKTRALGGMVGDVCDIGREVPSTMS

SEQ ID NO: 116807 - protein, 282 aa, Glycine max
  Coding DNA Sequence Number=SeqID_29
  Gene Ontology: Mol. function=nucleic acid binding; Cellular component= membrane; Biological process=DNA integration
  Homolog annotation: Hit_ID=Q1RWP6; Match level="QueryCoverage=50%, HitCoverage=15%, E-value=6e-28, Identity=37%"; Hit description=Zinc finger, CCHC-type; Polynucleotidyl transferase, Ribonuclease H fold
  Pfam annotation: Domain name=TIR; Domain location=14-126; Score=24.4; E_value=2.7e-07; Accession=PF01582.10; Description=TIR domain
MALTPGAFRLWWEVFLSFRGNDTRNTIMKGLYESYRGAWGSHVTGRRGIGAWGRDKAGDDDYASSRWCLDELTKICQIRRLVLPVFYRVDLSHVRHQKGPFEADFASHELSCGKNEVSKWREAFKKVGGVSGFDLIGYIDGTNPYPASNHHDFQYWKHQDQLILYSIVSYVDQNVITLLGKAIINALLDNKDLIIHTLNGLGAEYKEVSTTLRTREKSFDFEELHDLLSNFESYLKRDDINNDTSFVATAHATHKGKQPYHEKSYNPNHGSTSNRSTSLNFS

SEQ ID NO: 116808 - protein, 259 aa, Glycine max
  Coding DNA Sequence Number=SeqID_30
  Gene Ontology: Mol. function=cysteine-type endopeptidase activity; Cellular component=vacuole; Biological process=proteolysis
  Homolog annotation: Hit_ID=Q1KK73; Match level="QueryCoverage=87%, HitCoverage=70%, E-value=2e-87, Identity=65%"; Hit description =Cysteine protease
  Pfam annotation: Domain name=Inhibitor_I29; Domain location=9-65; Score=61.1; E_value=3.7e-15; Accession=PF08246.2; Description =Cathepsin propeptide inhibitor domain (
  Pfam annotation: Domain name=Peptidase_C1; Domain location=91-259; Score=67.4; E_value=4.7e-17; Accession=PF00112.13; Description =Papain family cysteine protease
  Pfam module annotation: Pfam domain module=Inhibitor_I29::Peptidase _C1; Domain location=9-65::91-259
MQSRHALSFACFACHHDKRYHSIDEIRNGFQIFSDNLKLIRSTNRRSLTYMLGVNHFADWTWEEFTRHKLGAPQNCSATLKGNHRLTDVVLPDEKDWRKEAQLVHWRQLTRRPLGKNISLSEQQLVDCVGAFNNFGCNDGLPSKAFEYIKYNGGLDTEEAYPYTGKDGVYKFAAKNVAIQVIDSINITLGAEDELKQAVAFVRPVSVAFEVSKDFQFYNNGVYTNTICGSMPMGGPGGRPGFGRGSGGYGAPTSSNFPS

SEQ ID NO: 116809 - protein, 149 aa, Glycine max
  Coding DNA Sequence Number=SeqID_31
MVVILPKEHLVVWFCSLHNRPDNYLKGIINSALKGLDDAPQPKSKAPARWIVVKCNRQKGSTECGYYVMHWMSTIILGTFRNNWEAELLCKRYDGYNHHPVAASEFHATTSDSDSSSVIDLNHNEGEVKGNGSRIFDLDLNHPPPHEIA

SEQ ID NO: 116810 - protein, 98 aa, Glycine max
  Coding DNA Sequence Number=SeqID_32
MEDVRPLWQHINETEIFAHPIVREYVPPSPNSEITFSAYSTYDLATHTGFLLPICLIDWTSILEDYTGGVSDEVKDPYKDVSDPRETSEIQEDPSKDS

SEQ ID NO: 116811 - protein, 98 aa, Glycine max
  Coding DNA Sequence Number=SeqID_33
MSNEELKLQDPRCRIQCPDILPENTGVAAQCISQDKMSNEALKLQDPRCRIRYFQEEDRSHPAQVVAAQKRTLLFKHEGCTSFVPSPGLKSYLVSFGT

SEQ ID NO: 116812 - protein, 108 aa, Glycine max
  Coding DNA Sequence Number=SeqID_34
MVFRTNCHVLKPKILELKGVIVGVVLSINHNIDIPNMNRDYMPGVMDVKANVLKQGKTLLVQWDDDYDGGQESLDKLKTYNLSQKNWPTFSAIYESGSPIYATDDEDE

SEQ ID NO: 116813 - protein, 251 aa, Glycine max
  Coding DNA Sequence Number=SeqID_35
  Gene Ontology: Mol. function=RNA-directed DNA polymerase activity; Biological process=RNA-dependent DNA replication
MGKRGHSGGIWVFSFRRNVKWTCFVIYASSTPTARVAFWDHLSVLSVSIIGPWSLLGQFNEIISPSKVVGGSFHASKAILMINMMTSYGLLYMETMGGSFTWRKDTQNGGHIRQKLDRVLVNPKWHISFPQALVETLPLHNFDHNPMLLSYFKSHSKKLRSFQFQGTWMSHPDYSPLVRNTWQDAKGSIPYKLGRIQMKSKEFNEKVFRNIFRNKKKLESHIKGVHQQLEWRQDHSLIMLEKIFKVNIIIS

SEQ ID NO: 116814 - protein, 117 aa, Glycine max
  Coding DNA Sequence Number=SeqID_36
  Gene Ontology: Mol. function=RNA-directed DNA polymerase activity; Biological process=RNA-dependent DNA replication
  Homolog annotation: Hit_ID=Q1S4N5; Match level="QueryCoverage=80%, HitCoverage=18%, E-value=6e-27, Identity=58%"; Hit description =Peptidase M, neutral zinc metallopeptidases, zinc-binding site
MVADTFNSGSINPSLDDTLIVTIPKVDNPSSMKDFKPISLCNVAFKIVYKVLVNMIMPFLDTIIRPFESSFIPKTGTMDNVVITQEIAHHMHKKKESSLINSRESSSEPMGTYKNFK

SEQ ID NO: 116815 - protein, 107 aa, Glycine max
  Coding DNA Sequence Number=SeqID_37
  Subcellular localization annotation: CTP_CleavageSite=60; ConfidenceScore=5.49e-01
MLPQAAGAPPPPSSGWPGWGIWHGAVFSAFGSPAGGQPPSTSCRAQGFASFSCPTPDQFRAEVAWPGDWPEAQAGEAPPEAPGDGEEAHEDEEMADLLDFLGGSGDT

SEQ ID NO: 116816 - protein, 61 aa, Glycine max
  Coding DNA Sequence Number=SeqID_38
PFAKRKPRAKRIFGHVLSREPLRTELEEEAVLRACDEFVSDCEVLEEASQSWRAKSSVGSS

SEQ ID NO: 116817 - protein, 519 aa, Glycine max
  Coding DNA Sequence Number=SeqID_39
  Gene Ontology: Mol. function=sugar binding
  Homolog annotation: Hit_ID=Q8Y118; Match level="QueryCoverage=93%, HitCoverage=39%, E-value=3e-55, Identity=31%"; Hit description =Putative curculin-like (Mannose-binding) lectin protein
RAGDALLRDFYGQEVVRYSATKPATRIYETNVVEATSYHSVKRLTAAGKPGDLAVQVDTPYVSIVPTSTAETPVSDVLAGMGTISQVPSGPAGSLGQNFNASFAAGVPVSRYLGTGLVVGAIRVVAGSVELTDDGTGGLASAVATPWSGTVDYQGGVVALTHASGVGSTSISITASPAGSIPMQGFTDEIEVTQNNQGMVWLFQLTPLPAPGTVVVGYRALGRWIRLTDNGRGRLIGKPGQGTGTINYQTGSVVVTAGALPDLKSSIISNWGTPIIAEARVGDAAILPPALRFVLGEGSAVPETVQLTLRVGGSNVVVTDNGNGGLLIGGQVRGQISYSTGEISLRPLSLPDADSQLSIAYDWGQPLHAAPQPVPDAAGIVSFTLPQGPVRQGTVLLDWLVSVRRDRDDLSSAPQAMRVIAKDDGAGNLVGVSVGDTAFSTVLGAVNYSTGAVSLQAGKFMVRQVSYPVYEIRSGRLKVVGYERLDVLAQLSAGSIVSAGWMLAGEAAQSAQGGHAAAC

SEQ ID NO: 116818 - protein, 143 aa, Glycine max
  Coding DNA Sequence Number=SeqID_40
  Gene Ontology: Mol. function=site-specific DNA-methyltransferase (adenine-specific) activity; Biological process=DNA methylation
  Homolog annotation: Hit_ID=Q3QZK0; Match level="QueryCoverage=98%, HitCoverage=53%, E-value=4e-44, Identity=60%"; Hit description=N6 adenine-specific DNA methyltransferase, D12 class
EQSFGVVTAGGPRLNVLRIEEELSAVHLRLANTVIECLPWQECVRRYDRPGTLFYLDPPYWETEGYGVEFPFAEYEAMAELMRTSAGRFVVSINDHPEIREVFAGFDLVPLQLDYTIGGGQGRGKKFGELIIKSWDDSQATLL

SEQ ID NO: 116819 - protein, 100 aa, Glycine max
  Coding DNA Sequence Number=SeqID_41
  Gene Ontology: Mol. function=nucleic acid binding; Biological process= DNA integration
  Homolog annotation: Hit_ID=Q1SUE2; Match level="QueryCoverage=47%, HitCoverage=6%, E-value=4e-11, Identity=64%"; Hit description =Integrase, catalytic region
MAMREELNQHKRNEAWDLVPKPASHKSIGTKWVFRNKLDESDIITNPKEPHLTVVKRIIKYLNGITNVGLWYPKGCKVDRKSTSGTCHMLLEVVVVKVFG

SEQ ID NO: 116820 - protein, 66 aa, Glycine max
  Coding DNA Sequence Number=SeqID_42
MTIRRKHRVRLKIEENHSECINLTQGEDAHSHPRSRFMVSWDFGSRLVEWLDMIYVRVLVWPAVQG

SEQ ID NO: 116821 - protein, 106 aa, Glycine max
  Coding DNA Sequence Number=SeqID_43
MTICISRELPLFIFERLVISWASHIHRSQKSWLLEFSNNFHVDEDMTKSKGKDPLEGLGGPMTRARARKAKEALQQVLSILFEYKPKFQGEKSKVVSCIMAQMEED

SEQ ID NO: 116822 - protein, 67 aa, Glycine max
  Coding DNA Sequence Number=SeqID_44
MSSVIYVFKRGDEKEVQRSKGPKLRERREKKKEEEKKKLNRRRIATANNFYIVLRSFFVLRPVNACL

SEQ ID NO: 116823 - protein, 275 aa, Glycine max
  Coding DNA Sequence Number=SeqID_45
MKAMKEQMTTMMEAMMSMKKIMEVNVVVVASTSVVAEVREAKSWEVWGPHFVQVQNKHAFPPYGLPPNHTPPNVAHALDENVDNSAPIPVESQQPQFDHAHVSQPMGETHEVPHHNLVDFEPYLRYATEGQAVGGVPLPNTLEDPQFHPQPQPLHFAERLRAIEEGGDYAFVDTVELCLVPNIVIPPRFKVPDFDKYKGTTCPKNHLKVYCRKMGAYAKDEKLLMHFFQESLTGTVVTWYTNLEPSRVHSWKDLMVAFVRQYQYNSDMVPDRMQL

SEQ ID NO: 116824 - protein, 311 aa, Glycine max
  Coding DNA Sequence Number=SeqID_46
  Gene Ontology: Mol. function=DNA binding; Cellular component=beta -galactosidase complex; Biological process=DNA integration
  Homolog annotation: Hit_ID=Q1SDN3; Match level="QueryCoverage=90%, HitCoverage=23%, E-value=1e-86, Identity=54%"; Hit description =Polynucleotidyl transferase, Ribonuclease H fold
MLVATPRVIFTRRRTFEFRLTLLSKVLTGNDLTEITHITQLHDNVFKIKDLGDLRFFLGFEVARSKRGINICQRKYTIDILHDTCMIGSKPISTPIDYCTRLHQKSETPLSDTDASDYRRLVGRLIYLTNSRPSITFVLQNLSSGVFFGTPRLKAFSDSDWARCLDTRCSITGFVVYFGSSLISMKSKKQVIVSRSSSETEYRAMASVTCELQWLTYLLEDFGIQFNRPALLYCDNRSTLHIAANTVFHERTKHIEIDCHIVREKIQFGLLKLLPIASANQLADIYTKALPPGAFEFLNYNQGISNIHSPA

SEQ ID NO: 116825 - protein, 81 aa, Glycine max
  Coding DNA Sequence Number=SeqID_47
MATFRWKKCLGSGTRLDKLDKNMSSGKEAPRPNHTNVNSTTFCPGTCRDWPDCDRGCKFRGYQIGMHLRPTSKLLPQLLQI

SEQ ID NO: 116826 - protein, 156 aa, Glycine max
  Coding DNA Sequence Number=SeqID_48
  Homolog annotation: Hit_ID=Q00M75; Match level="QueryCoverage=25%, HitCoverage=7%, E-value=2e-09, Identity=72%"; Hit description=PPR -repeat containing protein
MGEGYCTQSYPCRCKEAVSGFEPMTNKSPRHNFTAAPGFALTEYKVVCWNWVLTIHVNSNKWNGRSSNSNQRGRGPLGQRNADISRFPIKTCKDGPTYHAHKRASARIFNVVTKYLESSLIPNRRSLCRFKMLNNYFEVSTRLGGGGALIYAISNL

SEQ ID NO: 116827 - protein, 83 aa, Glycine max
  Coding DNA Sequence Number=SeqID_49
MAMFYCSPMVGAKCTYQDSELAHVRVDVAKDKGVDPAKQRTLTLKEPSTNSVERELRVLVDRGFYGDITILANNQQLVDKSSL

SEQ ID NO: 116828 - protein, 158 aa, Glycine max
  Coding DNA Sequence Number=SeqID_50
  Homolog annotation: Hit_ID=Q9FGR0; Match level="QueryCoverage=63%, HitCoverage=7%, E-value=7e-21, Identity=51%"; Hit description =Probable cleavage and polyadenylation specificity factor 160 kDa subunit
MKKERGDGNGYFDGRDYKDSKASAQILMCAPLSTGIGTSTSKWTKAKPVVAHEFEGGPSDAVEEGTAVGVGGGLGRLVPLEADDIDFEDNDDEVGEGADVVARAGGPLDVDVIGLEKDEVRARVGEEPDGAIIDAGGALHHLVRRETHGGRNSVSVCP

SEQ ID NO: 116829 - protein, 223 aa, Glycine max
  Coding DNA Sequence Number=SeqID_51
  Gene Ontology: Mol. function=aminoacyl-tRNA ligase activity; Cellular component=cytoplasm; Biological process=tRNA aminoacylation for protein translation
  Homolog annotation: Hit_ID=Q9M1R2; Match level="QueryCoverage=43%, HitCoverage=16%, E-value=1e-25, Identity=58%"; Hit description =Multifunctional aminoacyl-tRNA ligase-like protein
  Subcellular localization annotation: CTP_CleavageSite=78; ConfidenceScore=5.52e-01
MKRFMLPRNPLMDAVELPSSPSPTPTTSSTKPRPSSRKHKPSKENDTPSFITPSPAKLKSPLPPRPPSSNPLKRKLTAVDAVTNNSLPAPSDSGIKVIVKMRSLSSDKDEGDPTIHKVLVCDNFSSVVVNTEMVEYYDISSCYILRPWSMAIWEIMQSCFNFENNVLEFFDPEVKKMKIKTCYFPLFVSPEILQKEKDHVEDFAPEVKVCESVGPCNVDYSIS

SEQ ID NO: 116830 - protein, 103 aa, Glycine max
  Coding DNA Sequence Number=SeqID_52
  Homolog annotation: Hit_ID=Q84VH5; Match level="QueryCoverage=75%, HitCoverage=11%, E-value=8e-31, Identity=86%"; Hit description =Envelope-like protein
MIPGQAPVPEKLVPKRQQGVKISENPSLATSPREVDPEMDKKIHSIVSSILKKASVPDADEDVPTSSTPNDYVPDAPLDNISFHSIGNVERWKFVLDKWPQIS

SEQ ID NO: 116831 - protein, 100 aa, Glycine max
  Coding DNA Sequence Number=SeqID_53
MVDITLTKVHQPPFLREYDSNATCACHGEAPGRCIEHCRALKRKVQGLIDAGWLKFEENHVIFNFHRKWVQAIGQFAQATYAPELGTSKTVGGGVQKTFD

SEQ ID NO: 116832 - protein, 124 aa, Glycine max
  Coding DNA Sequence Number=SeqID_54
  Pfam annotation: Domain name=Transposase_23; Domain location=40-107; Score=-17.8; E_value=0.1; Accession=PF03017.5; Description=TNP1ENSPM transposase
MQSQRLALPPEPEVGPSATCANTKESCVDPSGNDPDTGDLDKYRLYIEENPPCLVALGRVYEGSIIVHNIPLLHDQVKVGVEEVRDAYASIPVPTEEVKLVGQALNTFFALPTHLVKGLSEQEK

SEQ ID NO: 116833 - protein, 518 aa, Glycine max
  Coding DNA Sequence Number=SeqID_55
  Homolog annotation: Hit_ID=Q1IPM6; Match level="QueryCoverage=56%, HitCoverage=92%, E-value=5e-35, Identity=28%"; Hit description =Hypothetical protein precursor
HPRLDGSTVVLVFAEEAADTGLETTAQWRADPGRLPAIQPPAQPVLLRRIPGADAHAAQRCCRHVHHVVTHVAESSQDRPVVQGAVERVPRIAACQPSAQATMARVPMAHQEIKVARCIRQLRKRRRDRSSAAEPVAPVHFPVRTGIVGERLLPPRLLAVDVMPAEPHVDGASVDPVGAAEAACIALENATHGGFDTGRVAAIDPPDRPHGRHRIECTHAQAPVRARRQRHDVVIDGAESAQGEPDRTGTGEGLPTGIADQALLQALVPDLPVALQPFPIFAVAGQGPPGGQDGGRCRGGQSGQELPSIHVLIRYRRCLHRCGHEGGLTTQISGLRLSHTYGDPTPASVACRHPCLRGGGAAGQLRACRRGARYQCGIGELPRAAAGGPDRHLPVPAPRSARGTDGGGCQRRPGGHPGIRCTARQLHARRRHGCGATAPVCTAHAGHQLVDAAAGHLPRPPPAARAGTGPVGSAAGSGRRSLRCRHPQWPGWMARSSGNSFVSQRVHTVVCAGAAASG

SEQ ID NO: 116834 - protein, 107 aa, Glycine max
  Coding DNA Sequence Number=SeqID_56
ISAYHGCRMTKLGLCLPTDTTVSEWQRGADNHKVSPRIMGISAYHGCRMTKLGLCLSSDSTVSEWQKGADNRKNDQTWSLLVICSGRQKGADNRKGADNRKGADNRK

SEQ ID NO: 116835 - protein, 61 aa, Glycine max
  Coding DNA Sequence Number=SeqID_57
MALACDFCKETTHGVFWVRIGSEIPLAIYTLGMMAKYLDVLEIPGGVHVQFLVPQNALSMH

SEQ ID NO: 116836 - protein, 92 aa, Glycine max
  Coding DNA Sequence Number=SeqID_58
MIDAASGGALGDMTPVEARNLIEKMASNSQQFSARNDAIVLRGVHEVATDSSLSTQNKKLEGKLDALVNPVTQLAMNQKSTPVARVCAIWSQ

SEQ ID NO: 116837 - protein, 461 aa, Glycine max
  Coding DNA Sequence Number=SeqID_59
  Gene Ontology: Mol. function=N-acetylglucosamine kinase activity; Biological process=N-acetylglucosamine metabolic process
  Homolog annotation: Hit_ID=Q2K3Z6; Match level="QueryCoverage=57%, HitCoverage=78%, E-value=9e-49, Identity=42%"; Hit description =Putative transcriptional regulator protein, ROK family
  Pfam annotation: Domain name=BPD_transp_1; Domain location=1-194; Score=141.7; E_value=2e-39; Accession=PF00528.12; Description =Binding-protein-dependent transport s
  Pfam annotation: Domain name=ROK; Domain location=175-362; Score =90.6; E_value=4.9e-24; Accession=PF00480.10; Description=ROK family
  Pfam module annotation: Pfam domain module=BPD_transp_1::ROK; Domain location=1-194::175-362
LSVAISMPIGIPLGIISGLAGRKIDALIMWLMDIIFAFPGIVLAILIVSVLGEGLTNMLIAISLFSIPVYARLSRNLTLGLKNMEYIEAAHMLGVRYPRIITHYILRNAIGPLIVQSTLTAGAVVLSAASLSFLGLGVQPPMPEWGTMMSDGRNFLGLNIYVSLFPGLAILITVLGFNLLGDGLRDDRLTLLDQQKIPATDWQAFCARVSEMIAGQHNHFSSQAAVAISTAGIVAPQTGEMFASNIPAFHRRNLARELGEVLQRPVIAHNDADCFALAEALAGSGKGHKVVFGAILGSGVGGGLVADGRIITGQNGLTGEWGHGPITLTEVTLAHRRVRVPRQACPCGQTGCLDTYGGARGLETLHQVLHAESASSVEIIARWQQAEARAQQTIEAWLQLVSEPLAYTINITGASRVAVGGGLASVTPLIAALNDAVQRCVLRSTAHALVVPGEFAHQGGM

SEQ ID NO: 116838 - protein, 156 aa, Glycine max
  Coding DNA Sequence Number=SeqID_60
MAQASEEDLILMWLFLIGRQIDWAHLVRYQIQKALRANAPLLYPQLVTLFLRHFQIPLDDEPFVQVKRSFAIGAGAWLKKDMQPLQDECTPSLPPQRDDSLALMNEVLSELRGLRTYVGERFDSLDGRFEGMDTHITQLEEDVSYLRRCFDLPPPS

SEQ ID NO: 116839 - protein, 187 aa, Glycine max
  Coding DNA Sequence Number=SeqID_61
  Homolog annotation: Hit_ID=Q1H419; Match level="QueryCoverage=90%, HitCoverage=40%, E-value=3e-27, Identity=41%"; Hit description =ErfK/YbiS/YcfS/YnhG
MYNIGMRSLRKYCYIAFVSAALLPWNATAVNHEALTARLFVQNKSTSPVERMLVQTLQSIKEGRLQQALDYVDQLLAISPNFALAHLIHGDLLSAKARILNNFGDANVADTTRIQDFKEEAEIRIRNYFDRNRGLTQPNMLVELSEKQSHVLFVDTARSRLYVYEKGEGDVLKYTADYYVTIGKNGI

SEQ ID NO: 116840 - protein, 238 aa, Glycine max
  Coding DNA Sequence Number=SeqID_62
MAKFDPEVVLEFYANAWPTEEGVRDMRSWVRGQWIPFDVDALSQFLGDPLVLEEGQECEFSQRRNKADGFNEEAIAQLLCTLGQDFARTAAGRRVRIMHTSMTTLTQIWMRLLLSNVLPSDHNSDLPLLKCQLVYAILTRMSVHVAPLIADAIYLFEGMPPTRHPLDPDKSNRALGFPALITGLCQSFGYCTPRQAQGDAPQAADAPPPPHQADPAGSLGMERYLQPLVSQQAANHRG

SEQ ID NO: 116841 - protein, 168 aa, Glycine max
  Coding DNA Sequence Number=SeqID_63
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P31174; Match level="QueryCoverage=57%, HitCoverage=62%, E-value=3e-54, Identity=100%"; Hit description =NAD(P)H-quinone oxidoreductase chain J, chloroplast (EC 1.6.5.-) (NAD(P)H dehydrogenase, chain J)
  Pfam annotation: Domain name=Complex1_30kDa; Domain location=96-164; Score=129.6; E_value=8.6e-36; Accession=PF00329.9; Description =Respiratory-chain NADH dehydrogenase,
  Pfam annotation: Domain name=Oxidored_q6; Domain location=1-70; Score= 73.7; E_value=5.9e-19; Accession=PF01058.12; Description=NADH ubiquinone oxidoreductase, 20 Kd
  Pfam module annotation: Pfam domain module=Complex1_30kDa::Oxidored _q6; Domain location=96-164::1-70
MAPSLVRLYEQMPEPKYVIAMGACTITGGMFSTDSYSTVRGVDKLIPVDVYLPGCPPKPEAIIDAITKLPPGGLLASVYHLTRLEYGIDQPEEVCIKIFVARKNPRIPSIFWVWKSADFQEKESYDMLGISYDNHPRLRRILMPESWIGWPLRKDYIAPNFYEIQDAH

SEQ ID NO: 116842 - protein, 295 aa, Glycine max
  Coding DNA Sequence Number=SeqID_64
  Gene Ontology: Mol. function=hydrolase activity, acting on ester bonds; Biological process=lipid metabolic process
  Homolog annotation: Hit_ID=Q59A99; Match level="QueryCoverage=44%, HitCoverage=25%, E-value=5e-19, Identity=38%"; Hit description =Putative outer membrane protein
MRMDMAFAAGVGSQAGNMYFERLLPDADAMKTYFAYSTTQNHTFFSFALGNNDALGWATNGGVEDGPTSTLTSTALFTTLLGNYVTTLTAGGQKGVLATIPDVTATPYFTTVTRAALLAAVNATNPPTPVTNIYIATKSGPRAATDQDYFVLPFSSMGLLGKPNEAQIPYGLHPLNPVEDKYVLDVSETATVVQRINEYNAAIKAAADSKGLALADVHGFLNNVKGGVRINGLAVSAKYITGNAFSLDGIHLTPIGNALMANIFISAINSKYGSKIPQVDVAKYRGVKLPDTVTK

SEQ ID NO: 116843 - protein, 146 aa, Glycine max
  Coding DNA Sequence Number=SeqID_65
MAEPSKKRKGTSSRSQQCGGSQETPIPSSIPLGIIVFIRGTAYTSLFYDLTQLPSEGVPFEGALIDDWKFDFSVHDARRLVCTNQADMNGRLLADSLAFESRILHYLIVRILLPRSSNLAQVSEEDLIVMWAFHKGLQIYWAHLVR

SEQ ID NO: 116844 - protein, 102 aa, Glycine max
  Coding DNA Sequence Number=SeqID_66
MIVNQQVKVAKDQVQIKLKWDEGKNRKRKEEQPLMVKKECKEVSVSSKRLTKMESHFAIKKNFKETSLLKQPSHLLLCKRTLVSTAKPLELEAIPQVKDHFA

SEQ ID NO: 116845 - protein, 111 aa, Glycine max
  Coding DNA Sequence Number=SeqID_67
  Subcellular localization annotation: CTP_CleavageSite=48; ConfidenceScore=5.36e-01
TTSFPVFPTFSSNKRWWRLRAFFFLGRRIRESRVAFPPKAMSLGLELPCDSVWTRLGSFLTNGTTLDLRVEERVDAILPRKGPVTRAMSKRLQEDWARAVEEGPRVLMNLR

SEQ ID NO: 116846 - protein, 389 aa, Glycine max
  Coding DNA Sequence Number=SeqID_68
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=5e-48, Identity=29%"; Hit description= UPI00006A17C9 related cluster
SFFHGLFPSGWHLLSPLLLCLPLHLHDGKSPLKDLIEAQRSSLHRSPTSKLPSHVLAFIGLHALTFRGLRVLTFRGLHALAFTGLHVLAFVGIHALTFRGLHVLTFIGLPALAFRGLHVLVFRGPHALALRELHVLHFRLLRALTFTGLHALTFEGIHAPTFRGLHSINYRGLHVLGFRGLHVLTFRGLHVHGFRGLHILTIRGLHILASRGLHVLTFRGLHVLTFRRPHALAFVGLHALTLRGLHVVAFIGVHALSFKELHVLLFRGLVGLQVLTFRALLVLAFRGLHVLTFRGLHILAFRGPHAFAFRGLQVLPFRGPHALAFVGLQAVTFRGQHVFAFIRLHALSFRGLHVLPIRGPRVLTFRGLHVLGFRGLHVLTFRGLHALAL

SEQ ID NO: 116847 - protein, 359 aa, Glycine max
  Coding DNA Sequence Number=SeqID_69
  Gene Ontology: Mol. function=aspartic-type endopeptidase activity; Biological process=proteolysis
  Homolog annotation: Hit_ID=Q8H6Q8; Match level="QueryCoverage=98%, HitCoverage=48%, E-value=5e-23, Identity=29%"; Hit description=CTV.20
MAIPFKTKDVNEEVTSRDIKSLMEQANYTNKYLQALGETIKTKVVPKQKSIEEASLSVPIEKPLFKPFKVSDKAKRKIRELRKTKSLIEGVGDNHSELLNKISSLLKVIPDTPQASENTSKMVTRSTSKLINVINEDSDQNLDNTTEIGSVSEKNINPLNSKHWKTPSKLYYQRPTAPDLLLEERGENNFKIFSANNIYEWNIDAQTEYNIMNTLQHMTMVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAVFPDP

SEQ ID NO: 116848 - protein, 53 aa, Glycine max
  Coding DNA Sequence Number=SeqID_70
MRLSPTVALSAHQALSKQPNAGAKRGVKHEGAETVTRAKPGYVPRARSNRSTG

SEQ ID NO: 116849 - protein, 109 aa, Glycine max
  Coding DNA Sequence Number=SeqID_71
MTAHTAKSISSKLEVSVLQSEAYVRSENHALSEALSLLSELGESEGEFEKYLMLSASSAPLARRLSLPTLCAPSSLSGFSLTRNKCENGAQRAFEDRKPFLRLKLEKPK

SEQ ID NO: 116850 - protein, 100 aa, Glycine max
  Coding DNA Sequence Number=SeqID_72
MLQSIHRGLCLVMQSMHDSAQHRPFISMDEFMAQVAWPGVQPSPLGGGEASAAQEPQPEPEVAREATPETTPQVSHATSFVVEVSEGEKGAEDTNYAANL

SEQ ID NO: 116851 - protein, 530 aa, Glycine max
  Coding DNA Sequence Number=SeqID_73
  Gene Ontology: Mol. function=serine-type endopeptidase inhibitor activity
  Homolog annotation: Hit_ID=Q1SPG0; Match level="QueryCoverage=36%, HitCoverage=48%, E-value=4e-56, Identity=52%"; Hit description=Zinc finger, SWIM-type
  Pfam annotation: Domain name=FAR1; Domain location=119-264; Score= -44.7; E_value=0.0022; Accession=PF03101.5; Description=FAR1 family
  Pfam annotation: Domain name=zf-CCHC; Domain location=480-497; Score =16.1; E_value=0.0022; Accession=PF00098.13; Description=Zinc knuckle
  Pfam module annotation: Pfam domain module=FAR1::zf-CCHC; Domain location=119-264::480-497
MVIFLCLTMVIFLWSLLLVMHIITSKMYGYLREVFDILKSVACMENTEEEQDADFVNAENESVPNCPLLCTQGLNEFVNAIGDTDVDEDEDEFEEKPSVYISGDEVDRFSFGDLEATYLFYYWYARINGFSLRKSKVVKNCKGEKTQQTFLCSRQGVREDKGRWEVKEFSDEHNHKLLPPECSKNKFLCPFVIFSGVNNHNQTVIFATALVSDETEQKYVLLLEQFVDAMKGKAPVSVTTDGDLAMKNAIKSAFPYVHHRLCVWHLICNANSNVHILGFMKSFKKCMLGDFEVGKFENLWDEMVNEFGLHESRWIADMHNKRHMWATSYIKGSFFAGISTTSREGFHSHLGKFVSSKIGLFEFVEQFQRWSKSARKCIRERFKDGSMNWDSSLVARHVQLHFIFREVASLSYRDNDDYNHIVNLLIEELAKLRLTQGGNDDSEAVDNDAVNVLVEDPTVVRTKGCGPNLESLSRRSKRNIKCRNCGDHGHNKRSCVSASKNTQGDGTLNWGIHVITCKGCRKDIIDSSCK

SEQ ID NO: 116852 - protein, 344 aa, Glycine max
  Coding DNA Sequence Number=SeqID_74
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=84%, HitCoverage=21%, E-value=5e-95, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTDLGKLSYFLGIEFEQSNKGILMHQRKYILEILERFNMLQCNPVDTPVEANLKLGSCEQETKVDNTMFRQLVGCLRFLCHSRPEISFGVGLVSRYMKSPRQSHLVAAKRILIYLKGTLNHGVLFPTHLPNQKEDGILHLVAYSDSDWCGDQVDRRSTMGYVFFLGEAPFSWSSKKQDVVALSTCEAEYIAACSAACQGLWIQTLIQDLELKTEGAIKIMVDNKSAINLAKNPVSHGRSKHIETKYHFLGDQVSKEKIKLQHCGTNLQVADILTKPLKIERFKSLRDKMNVEMWTLSCICLLNAAIIHRYDWMMMEHVFVTDLIGVMNERQVRMSVAMALYGRA

SEQ ID NO: 116853 - protein, 739 aa, Glycine max
  Coding DNA Sequence Number=SeqID_75
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=64%, E-value=3e-94, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=418-575; Score =148.9; E_value=1.3e-41; Accession=PF00665.16; Description=Integrase core domain
  Pfam annotation: Domain name=zf-CCHC; Domain location=253-270; Score =30.3; E_value=6.9e-06; Accession=PF00098.13; Description=Zinc knuckle
  Pfam module annotation: Pfam domain module=rve::zf-CCHC; Domain location=418-575::253-270
MGSTNGNFPANLPILEGKNWNKWSVQMKVIFAYQEVQEVVDEGYPALVEDATEAQRAVHRENKKKDNKALFFIHQCIDNAHFEKIASAKTSHEAWKILEKCNEGADQLKKVRLQTLRRQYELMQMNVTEKILRTLIPKFDHVVVAIEESKNLATLKVEELQGSLEAYEQRMLERQSDRSQDQALQAQTWKKGGLSGKKGNRGRGRSREYRSNHGSFGKQSQNNEENDQSESSSRRGGSQNWQGGKKKVDRRFLRCFNCNKLGHFSSECKAPADSRGKFSNEANLVSEKLDQDEEPVTLMMMTKERSSNSGIWYIDSGCTNHMTGHKEWLVNLDLSKKSRVRFADDRHITAEGIGDVYVKKKDGKDVVITEVLYVPGLKSNLISMGWLLVMASQIWSPKLQEFESSEFKRNGVRNDSNKASLKDVCGPIDTVSLGGNKYFVSFIDEISRKLWVYLLKAKSEFFSVFKVFKSMAEKQSGKYIKVLRTDGGDEFCSHEMENFCTENGILHEIVAPYTPQHNGIAERRNRTILNMVRSMLKGKNMSHTFWGEAIMTAAYVLNLCPTKKLGSKVPEEIWTGKKPSVKHLKVFGCLCHKHIPDQKRKKLDYKSESMVFIGYSSTGAYKLSGSKVAEIDLDLDQTASDLDNGEELGEELNLPLAPSVESNAPQNERPRRHAEVPARLHDYELFQDFEIGNDGELIHMTLLADVSPVSFDEAIVNETWRKAMKEELVSIEKNETWEL

SEQ ID NO: 116854 - protein, 118 aa, Glycine max
  Coding DNA Sequence Number=SeqID_76
MSTGADEGRYKGHKGADDNNDESNDEYEEVDGVVLHPYSLRINNLNLIIPMPMSLNAWQKHMKLPKTTLWPVSGFIQDIPLKGMHFLVSSCRMLRGASVLTTTLTLTFCDGRRVSCYN

SEQ ID NO: 116855 - protein, 256 aa, Glycine max
  Coding DNA Sequence Number=SeqID_77
  Gene Ontology: Mol. function=DNA binding; Cellular component =membrane; Biological process=DNA integration
  Homolog annotation: Hit_ID=Q1SH28; Match level="QueryCoverage=95%, HitCoverage=32%, E-value=1e-50, Identity=40%"; Hit description =Integrase, catalytic region
MKSTKPSQVCKLQRSLYGLKHASRQWYGQLSTFLVAYGFKQSTTDYSLFTLKRKNSFTALLVYIDDIFLSGNDLSVISHITKLLDAYDTFKIKELGNLKYFLGFEVARGTSSINICQRNFSIYLGSSLISWKSKKQATVSRSSSEVEYRALATVTYEIQWLTHLLHDFGIIHKPALVFYDNKPALHIVTNPVFHERTKHIEIDRHLVHDRLLSGLIKLLPIDSTQQLVDVYTKALAPGAFHFICSKLGMNDIHSLA

SEQ ID NO: 116856 - protein, 170 aa, Glycine max
  Coding DNA Sequence Number=SeqID_78
  Gene Ontology: Mol. function=RNA binding; Cellular component =cytoplasm; Biological process=regulation of transcription
  Homolog annotation: Hit_ID=Q9LU22; Match level="QueryCoverage=53%, HitCoverage=31%, E-value=3e-22, Identity=46%"; Hit description =Arabidopsis thaliana genomic DNA, chromosome 3, P1 clone: MYA6
MGRKGRERERLMRETGRDLEVSRLMRFLREIKGLRFLSRSMAWSRPRSRIGLTVPSKMVRRVRMRDALDLGIDKSIFIKPRTFHLIVLMLKLWNKDQIKTASEVLQSISSKVMEALDDQPLSIRLKGLECMKDSLAKARVLYSKRLALHTIVMNTRHRKSCYSIPSDFCS

SEQ ID NO: 116857 - protein, 95 aa, Glycine max
  Coding DNA Sequence Number=SeqID_79
MSGFTRNSPQISASPHQLDLAPYASEPYHAQWNAPGLLHDKHTLRLSRILGEMEVNEPWLGLWLPLNYQVDMGARKNAMSNATNEKHGCMRMMYS

SEQ ID NO: 116858 - protein, 421 aa, Glycine max
  Coding DNA Sequence Number=SeqID_80
  Homolog annotation: Hit_ID=Q1SDS1; Match level="QueryCoverage=41%, HitCoverage=33%, E-value=9e-16, Identity=32%"; Hit description=IMP dehydrogenase/GMP reductase
MLADLYDTFDRRCEKSSTRICCTPALYVCLVSHLFLQEVRHACPLEGRRSCTEKGGANWDQLLANKEGASINWFPRWKEGRTGVLISCGGFPNVPLMGTRGCISYNPVLAIRQLGYPMRGAPLEDELTPIISRGFNKTNVETLQKVRKAWEMLQKKDKELRGSNNGPIGGYRKWLRAHVQGLDWLPSFRTAKKEEVEAPEEDEEVQALRTELEQAPTVKERFKSAALKIRKENAELRDINTATTKALEQETKRARREEHGRNKFQGALWGSNSELKLQREERDQSRVDSLILKDELKVCSRYKRNLSQRLCETKTNTLAIISKYQEELNLATAHEHKVADEYAQVYAEKEARGRVIDALHQEATIWMDRFVFTLNGSQELPQLLAKAKAMADTYSAPEEIHEFLNYCQHMIDLMAHIIRNR

SEQ ID NO: 116859 - protein, 193 aa, Glycine max
  Coding DNA Sequence Number=SeqID_81
  Homolog annotation: Hit_ID=Q1S1N3; Match level="QueryCoverage=40%, HitCoverage=24%, E-value=6e-12, Identity=45%"; Hit description =Calcineurin-like phosphoesterase family protein, related
  Pfam annotation: Domain name=DUF1723; Domain location=27-76; Score =58.3; E_value=2.5e-14; Accession=PF08330.1; Description=Protein of unknown function (DUF1723)
MSSPYPIIEPLLGQSRFSVVAKLEQLKIDDALVIVLVKRWRPESHTFHLLVGECTITLGDVSLQLGLHVDDRLVISPTYYDWEEMFAVVIYNSRHVSSKMFAYMENIIITSSSLCNMHAVYLPQSPTNNIELCPLCQKRSGQSCTNHNQRPITHSRKQVAAEWRRRRVERRRHFKEKMSQEEAHHHRKPWIRA

SEQ ID NO: 116860 - protein, 127 aa, Glycine max
  Coding DNA Sequence Number=SeqID_82
  Gene Ontology: Mol. function=nucleic acid binding; Biological process= apoptosis
MTIVVVGVPTLIAHIKSIEGYTTTYRKEWLTKKVIEDIYDNWERSYHDLPRLLQVMHQFHLGMVMEKETLSMPPQRGQPVEGFLMFHHLFWCFRLCINGFQYCKPIVQVNGTWLHGEYKGTLLVAVA

SEQ ID NO: 116861 - protein, 180 aa, Glycine max
  Coding DNA Sequence Number=SeqID_83
MIGGLPSLAFLWSWLFAFFLATWLRPEAMVGAFQSQYLELLLDSGMGTSFDFYYEYPSRSVMGIGLLKPLWNYMNCFLLFFFISRTKKLVLYATFFGVWRRYGLTVEDFNLAHRIVQPIFRTTMYYMDSLNLTVVDHIHLAKSKLYIFFPIKTWRKSYLLLADLMESHTKLSEKYNCIRI

SEQ ID NO: 116862 - protein, 155 aa, Glycine max
  Coding DNA Sequence Number=SeqID_84
  Gene Ontology: Mol. function=nucleic acid binding; Biological process= DNA integration
  Homolog annotation: Hit_ID=Q1RSG2; Match level="QueryCoverage=94%, HitCoverage=14%, E-value=1e-41, Identity=48%"; Hit description =Integrase, catalytic region; Zinc finger, CCHC-type
MDMMRCMLKAKQMPKEFWAEVVVVAAYILNGCLTKSVRDKTPEEAWSGRRPSIRHLRVFGYITYAYVLDQLKKKLDDKGMWDWSTRSQKKLVVTFDNYEENEKQLDLTPDEPKSSRRPQRKPQLLVRLHACIMFNDNDPSNKEIINFLFLQIVSR

SEQ ID NO: 116863 - protein, 111 aa, Glycine max
  Coding DNA Sequence Number=SeqID_85
  Homolog annotation: Hit_ID=Q1RSG2; Match level="QueryCoverage=73%, HitCoverage=6%, E-value=1e-21, Identity=59%"; Hit description =Integrase, catalytic region; Zinc finger, CCHC-type
MNMNYNIVWSGPKLDGKLDFYYWKTLMATHLRAHNIWNFVETGLAEEASDTARRRDQLVYHRFNKELIDYSIFSIIINAKTAKGVKTWVYFMKQKSEACEAFKMFKAFLEK

SEQ ID NO: 116864 - protein, 124 aa, Glycine max
  Coding DNA Sequence Number=SeqID_86
MDRSMIDVASRGALTAIAARQLISNMAANYQQFGTRMDATSKAVANEVSVSMRINQGYMVSGPDHPTDTCPTLQEMEHVVDVYTMQSGQPFKHQQQQYNPYSNIYNLDWRYHPDLRYGAGQQQQ

SEQ ID NO: 116865 - protein, 60 aa, Glycine max
  Coding DNA Sequence Number=SeqID_87
MEERLGFAFEIALERNGISNSHFALIKMGAGEGVVAGGGNIGHLEVIVNYLMMMATKMVL

SEQ ID NO: 116866 - protein, 245 aa, Glycine max
  Coding DNA Sequence Number=SeqID_88
MVHEPSNDTERFFNKYVEARYYANLKKEIYTERRIELKEDEFLEEQQWLNKERSTKKEQEEMVDEMVELLCLPNRHFNVGVKTKRLHKVGMTSLAQFQTAFMLDNIVPNSHELDMPMKRDQFLYPILKDLYIDIGQILSHEMFTMAKKRATHLASSYPFPSQEEVLVAIGWPTLLGDQSSEGQKGDETVNGIGARAGDVAKVATTIAINDEGVPQGNNNRNDVAKDTIKGVTTEDKMEEEFAIEE

SEQ ID NO: 116867 - protein, 156 aa, Glycine max
  Coding DNA Sequence Number=SeqID_89
  Gene Ontology: Mol. function=RNA-directed DNA polymerase activity; Biological process=RNA-dependent DNA replication
MKYGTFVVSVPNCPDHISDGNNPHIIQLWGTSSGGKREHMQYGTSVKISVKLMFQPSPNCLGKGAIKKQAIKGIQGLQIIFAQGIALLAKYRKSKACLKLKVLESEGFQTGKSLVGTKGMAVFCISVAKIGAFWTNQEAQDHWSSCFKYVQEWMLG

SEQ ID NO: 116868 - protein, 129 aa, Glycine max
  Coding DNA Sequence Number=SeqID_90
  Gene Ontology: Mol. function=structural constituent of ribosome; Cellular component=ribonucleoprotein complex; Biological process =translation
  Homolog annotation: Hit_ID=P49208; Match level="QueryCoverage=62%, HitCoverage=38%, E-value=3e-33, Identity=87%"; Hit description=50S ribosomal protein L1, chloroplast precursor
  Pfam annotation: Domain name=Ribosomal_L1; Domain location=21-128; Score=-7.1; E_value=1.1e-08; Accession=PF00687.11; Description =Ribosomal protein L1pL10e family
MSVLYFDARTGPSIYSSLVIVSLCMILKDSEGVALLFLALCVKCESFRKEAKVKSFWDGEKFDEAKNAGADLVGGEDLIEQIKAGFMEFDKLIASPDMMPKVASLGKILGPRGLMPNPKAGTVTPNIPQ

SEQ ID NO: 116869 - protein, 61 aa, Glycine max
  Coding DNA Sequence Number=SeqID_91
MCLTQILDSVLWSPMSQRLGVAMVGVESHTGYLKFISVFYQATMVDATVYEFVEFEISQIG

SEQ ID NO: 116870 - protein, 182 aa, Glycine max
  Coding DNA Sequence Number=SeqID_92
MSSRGKETIPLLRILSIKAHVQGLDWLPSLRTAKREEVEAPEEDEEALEQETKRVRREEHGRDKFRGALWGSNSELKRRREERDQSRVHSMVFKEELATCSRSKKSLAQHLEATEQSMLAIIGQYKEELNQSLTHEQKLVEDFAQAYAEKEARGRVIDALHQEATMSMDRFALTLNGSQDLP

SEQ ID NO: 116871 - protein, 126 aa, Glycine max
  Coding DNA Sequence Number=SeqID_93
  Homolog annotation: Hit_ID=Q93X76; Match level="QueryCoverage=38%, HitCoverage=10%, E-value=9e-17, Identity=75%"; Hit description =Putative carboxyl-terminal proteinase
  Pfam annotation: Domain name=DUF239; Domain location=1-115; Score= -32.5; E_value=4e-06; Accession=PF03080.5; Description=Arabidopsis proteins of unknown function
MQSDSYRATGCYNLLCAGFIQTNSRIAIGAAISPVSSYDGNQYDITILIWKLLFPLVRVNFELGVIMVIAVSFGKPVVPAALMNRPTRGERRFAYWALAECILAYYVGTDEGVSEVLHVAEKKGCT

SEQ ID NO: 116872 - protein, 59 aa, Glycine max
  Coding DNA Sequence Number=SeqID_94
MALGVMATRPGELLLQPKLFGGPGKPEASLGEPGFRKRPKITLFPSLFGIFHILYRNVE

SEQ ID NO: 116873 - protein, 193 aa, Glycine max
  Coding DNA Sequence Number=SeqID_95
  Homolog annotation: Hit_ID=Q5BN14; Match level="QueryCoverage=24%, HitCoverage=13%, E-value=8e-07, Identity=63%"; Hit description =Pyruvate decarboxylase 1
MASYGVASPFFFLLPHSTAIRPQEAKESIDKEDPRPTSSTWSYIIIYKAIVINHIKQGKKGLIRKNSLTKLMNFRSYTKSIFEVMDVKDLTIAHVKSHLQNQLEPPSDQAKKHMHRWSKTFESMRDNWDLEASNGLKTPQLLTKSIPSMMQMSRKFSLYAPAMALSTLRSPTVNNDSDGGECDGGGGGDGDDS

SEQ ID NO: 116874 - protein, 500 aa, Glycine max
  Coding DNA Sequence Number=SeqID_96
  Gene Ontology: Mol. function=transferase activity, transferring hexosyl groups; Cellular component=integral to membrane; Biological process=carbohydrate biosynthetic process
  Homolog annotation: Hit_ID=Q75IZ5; Match level="QueryCoverage=93%, HitCoverage=86%, E-value=0.0, Identity=67%"; Hit description =Putative glycosyltransferase protein
  Pfam annotation: Domain name=Glyco_transf_8; Domain location=120-475; Score=290.5; E_value=3.1e-84; Accession=PF01501.10; Description =Glycosyl transferase family 8
MVLLFCAPYDRMTVMLQEKNAIVEHIAKRYNFTEEILSATSFSRQLAEQMVLAKAYVIIAKEHNNLHLAWELSSKIRSCQLLLSKAAMTGERLTMEEAEPIIKSLSSLIFKAQDVHYDIATTIATMKSHIQALEERANTATVQSTVFAQISAEALPKSLHCFNVKLMADWLKMPSLQKREHESRISPRLTDNNLYHFCIFSDNVLATSVVINSTVMNADHPKQLVFHIVTDGINYGAMQAWFFSSDFKGATLEVQNIEEFYWLNESYSPIVKQLHIPESRSFYFGPYQGANVEPKLQNPKFLSLLNHLRFYIPEIYPLLEKVVFLDDDVVVQKDLTPLFSLDLHGNVNGAVETCLEAFHRYYKYLNFSNSIISSKFDPQACGWALGMNVFDLFSWRKANVTARYHYWQEQNADETLWKLGTLPPALLSFYGLTEPLDRRWHVLGLGYDLNIDNRLIESAAVIHFNGNMKPWLKLAIGRYKPLWHKYINQSHPHLQDCAAG

SEQ ID NO: 116875 - protein, 69 aa, Glycine max
  Coding DNA Sequence Number=SeqID_97
MDSSKSLYKLIKFDGATCKEGVPKRKGKVRDKSGQGSIASEVQYEHNRCYESPIAVASKGVKLRKAIEV

SEQ ID NO: 116876 - protein, 110 aa, Glycine max
  Coding DNA Sequence Number=SeqID_98
MAKIHHQAWPTKTYHPMKHIPHTYFQNNSKAPKFLKGKGNIGSKGLSRELIQGRLIWLEAYKNKMPKSSPNMHVKQEVSTRVKPRLLCKQSMGKNTPNKIDDDGSNSHQG

SEQ ID NO: 116877 - protein, 285 aa, Glycine max
  Coding DNA Sequence Number=SeqID_99
  Homolog annotation: Hit_ID=Q1RUD8; Match level="QueryCoverage=45%, HitCoverage=30%, E-value=4e-10, Identity=33%"; Hit description=IMP dehydrogenase/GMP reductase
MEPIASLSQYYDLPLRCFTFEDFQLVPTVKEFEEILGCPLGGWKPYLFSRFYPSTTRVAKYQGSVWRKGQRPWQIKANGLSFIDILALLIFGVVLFPNMEGLVDLAAIDAFLAFHHGKESPVIAILAMYDTFDWGCPSIRYKVTARAIEKGKANWDQLLASMEGRLLIGSLARRKEESGFYLHAKDVPSEECHQMKASRLSSHGVSVTTMRGYSKEFARHEMRREERTESLGEAVQALKAELERARVVEEKFKSIAIKLKPWNEEVKGIITGQRHDLEGRANGLP

SEQ ID NO: 116878 - protein, 124 aa, Glycine max
  Coding DNA Sequence Number=SeqID_100
MRKIPKGRGKRVISSVREAEEGVGHSSLRGSREKSERRRKKKEEKNEAKALPNCDCNQLLHRSSFVICASSSPSSIISNLFSSCKTFLFGFSNIFPRINIGGDSRVFSFLEDAIFISPRSPAEG

SEQ ID NO: 116879 - protein, 140 aa, Glycine max
  Coding DNA Sequence Number=SeqID_101
  Homolog annotation: Hit_ID=Q5XM22; Match level="QueryCoverage=36%, HitCoverage=29%, E-value=5e-12, Identity=65%"; Hit description =Resistance-like protein HAAS-2
MVRTRGLGHHLGIVIGRVLGIENNRDSNEAPQQRRPTASARRQWEVIVVAEDVHHMGIIVWNGEECLELKFSSHGRKVQKFRRPAAKIEGKCDVGHWTVVARAYLLHLLGCILFANKSATHVHMVVLDAFRDLSQSGSYA

SEQ ID NO: 116880 - protein, 77 aa, Glycine max
  Coding DNA Sequence Number=SeqID_102
MRLAQPQDPVRHPSIVQDDTYVKPYMPQYTVAAIAMEEALAHAPSDVEQPRHAVEAFQVIAKRLERLLNLRIVTVGT

SEQ ID NO: 116881 - protein, 92 aa, Glycine max
  Coding DNA Sequence Number=SeqID_103
  Homolog annotation: Hit_ID=Q1STZ2; Match level="QueryCoverage=95%, HitCoverage=19%, E-value=6e-08, Identity=32%"; Hit description=IMP dehydrogenase/GMP reductase
MDKIPRRDMVSFLPEGIPGSLQTLPLWVLIGSPQRRSTSKAGRNIGRGRQWPPWRPLPWLGPRSYHKLCERLVAGADPSTILTLSDWRLLGS

SEQ ID NO: 116882 - protein, 141 aa, Glycine max
  Coding DNA Sequence Number=SeqID_104
MEGLVDLVAIDAFLAYHHKSRPTCPLQGHRLCTEKGKANWEQLLASVVGASINWFTHWKEGRTRVLSLCQGFPNVPLMGVATYPFGGRATRGSLVRLPRKENAQSRHQRLFEENVRKIRKVWSTNFKFERFGSCFYARGRY

SEQ ID NO: 116883 - protein, 61 aa, Glycine max
  Coding DNA Sequence Number=SeqID_105
MKNDEERRRIFTKSLTETSRKRYGSTLAWMRKEGGGCRPARPGERCFHQKAPPSVGTLLKA

SEQ ID NO: 116884 - protein, 84 aa, Glycine max
  Coding DNA Sequence Number=SeqID_106
MVVRTFRQPGANELIDAQRLTSSSAPFVIQGQRVGWQAEIPYGRPHLSSTEANEFDGFYSRRPETFKPDDARDSSLRGGDDQVR

SEQ ID NO: 116885 - protein, 44 aa, Glycine max
  Coding DNA Sequence Number=SeqID_107
MWRPVKVMLSCAPTMWDRHRLKGALKPGDTQGLHFEEFVRASPS

SEQ ID NO: 116886 - protein, 55 aa, Glycine max
  Coding DNA Sequence Number=SeqID_108
MDAWGAAIPAVSMSNGVLEILGCLPVALLDCSELDAGQRSIDHGPSIHSCPSPST

SEQ ID NO: 116887 - protein, 71 aa, Glycine max
  Coding DNA Sequence Number=SeqID_109
MGNANSNFEIWPSRVFLKLDCFFWRKQPSLPGRAGLKGVVLRVPDPPGDVFQLFWVKKIVSVKKIQAEVLP

SEQ ID NO: 116888 - protein, 36 aa, Glycine max
  Coding DNA Sequence Number=SeqID_110
MEWPTCMDEYEKLVIRMSNPRCIGHRFNLLFCIPRV

SEQ ID NO: 116889 - protein, 111 aa, Glycine max
  Coding DNA Sequence Number=SeqID_111
MVTNDNMDDILFLMEEKLYRKRPKQRHGPTSSKDDTSSNSDSEKDLTIYKKDYEDYFGSEKATMQTYVVVKSPLHFEASFTPLVPKQTMTTAKSQEQPTTPKPTNDEQQLA

SEQ ID NO: 116890 - protein, 121 aa, Glycine max
  Coding DNA Sequence Number=SeqID_112
MFKSKGKDPLEGLGGPMTRARARKAKEALQQVLSILFEYKPKFQGEKSKVVSGSLLKSAVKLLYKLNHFINKDKLSFIQKIRVYLFYLSESDSPKFLSDSRTPWLYQRTFTTFVCCPRWKE

SEQ ID NO: 116891 - protein, 146 aa, Glycine max
  Coding DNA Sequence Number=SeqID_113
  Gene Ontology: Mol. function=RNA-directed DNA polymerase activity; Biological process=DNA integration
  Homolog annotation: Hit_ID=Q1SD84; Match level="QueryCoverage=50%, HitCoverage=4%, E-value=9e-25, Identity=79%"; Hit description =Integrase, catalytic region
KTTTLIVYVYDIILTGDDAVELARLKKNLAAEFEIKDLGSLRYFLGMEVARSKRGIVVSQETYILDLLEEMGMSDYLCAYLHAMSLINPSFAYYTPVATYPSAGGRRVTRGMRVPRKEYARSRQQRLFEEDVGKTGKDAIYELLSE

SEQ ID NO: 116892 - protein, 219 aa, Glycine max
  Coding DNA Sequence Number=SeqID_114
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=3e-23, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPLHESISCFLIRVPLGQHALTFRGPNILIFRGLHVLTFIVLHALALRGLHALAFRGLHVLTVRVLYVLTFRGLHVLTLRGLHTLAFRGLHALRGLHVLAFRGLHILTFRGLYAFAFVGLGVLKFRGLHVLAIRGLHVLAFKGLYALAFIGLHVPTLRGLHALAFRGLHALTVRGLHVLAFRGLHVLTFRGLHAFAFVGLGILKFRGLHVLAFKGAI

SEQ ID NO: 116893 - protein, 197 aa, Glycine max
  Coding DNA Sequence Number=SeqID_115
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPVAYLSRLQRILPAARWELRFKASRRANPPHE

SEQ ID NO: 116894 - protein, 149 aa, Glycine max
  Coding DNA Sequence Number=SeqID_116
  Homolog annotation: Hit_ID=Q6CQE5; Match level="QueryCoverage=28%, HitCoverage=39%, E-value=3e-08, Identity=67%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRTLKRESKSA

SEQ ID NO: 116895 - protein, 128 aa, Glycine max
  Coding DNA Sequence Number=SeqID_117
  Subcellular localization annotation: CTP_CleavageSite=25; ConfidenceScore=5.35e-01
MKAKILENVLIMSRLLRSFSRISFRSNSSTSSSSRNTNLLNDQDNQTQEVAPKHNLFDEEVRFEDINQNMDDWNIPEIPQDQLYVPETIKDKHNFDYIIKTVENNIPLGQDIGEEFHLLSKNSIYEHS

SEQ ID NO: 116896 - protein, 203 aa, Glycine max
  Coding DNA Sequence Number=SeqID_118
MLSFSQMQPQIQSQMQSQGLALPLEPEVGPSTARVSTKESCVDPSGNDPNMGDLEGLYVEENPSCLVALGRLYEGSTTVHNIPLCHDQVKVGVKEIRDADTLIHVPTEEFQLVGQTLNTFVASPTHLVKHLSEQVKKRLSHEVLKRASTDKRSFSALSATEESGRASISRPHAKCEISALSAGVVFSQAQRTTGAKLKSTYAC

SEQ ID NO: 116897 - protein, 277 aa, Glycine max
  Coding DNA Sequence Number=SeqID_119
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=86%, HitCoverage=87%, E-value=4e-74, Identity=54%"; Hit description =Putative dioscorin class A
  Pfam annotation: Domain name=Carb_anhydrase; Domain location=44-272; Score=72.8; E_value=1.1e-18; Accession=PF00194.11; Description =Eukaryotic-type carbonic anhydrase
MKHQGKLRVFLPNMIILVTILLHSTTWISAQEVEDESEFDYIKGSEKGPSHWGELKKEWETCKSGKMQSPIDLSSHRVRVVPKLGELKKYYTPQNATIKNRGHDIELKWEDAGSININGTEFFLHQCHWHSPSEHTINGRRYDLELHMVHESKNIKGKTKFAVVGLFYKIGRPDPVLKKLSKFIKTMVYGEEKNIGVFDPSKIKLGGKKYYRYMGSLTVPPCTEGVIWTINKKIRTVSRAQVKLLREAVHDHAEKNARPIQPINRRGIQLYAQKRKE

SEQ ID NO: 116898 - protein, 57 aa, Glycine max
  Coding DNA Sequence Number=SeqID_120
MKVCENVRGFMWASGMTRIAPEIKESRKVQRKCREEGINRRIREANRKSVHLQHNLE

SEQ ID NO: 116899 - protein, 284 aa, Glycine max
  Coding DNA Sequence Number=SeqID_121
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-45, Identity=31%"; Hit description= UPI00006A17C9 related cluster
RGLHVLTFKGLHVLAFKGLHTLTFRGLHVHAFRGLHALTLRSLHVLAFRGLHILAFKGLQALTFKGLNVLAFRGLHALAYRGLHVLTFRGLHDLAFRGLHVLAFRGLHALTLRGLHALKFRELHVLAFRGLHVLAFRGLHVLTFRGLQTLTFRGQQVVAFRLLHVLAFRGLHVLPSRGLQVLTFRGLHVLAFRGLHALTFRGLHVLAFRGLYVLTFKGLHVLTFRGLQVLTFRGLHALTFRGLHVLAFRGLHVLAFRGLHVLTFRGLHVLAFKGLHTLTFRGLH

SEQ ID NO: 116900 - protein, 42 aa, Glycine max
  Coding DNA Sequence Number=SeqID_122
MYRGPRGSFGVEGRSKVGPCDHTSTNASDPIRTPQLSVLGRE

SEQ ID NO: 116901 - protein, 299 aa, Glycine max
  Coding DNA Sequence Number=SeqID_123
  Homolog annotation: Hit_ID=Q2IMJ3; Match level="QueryCoverage=75%, HitCoverage=29%, E-value=3e-09, Identity=31%"; Hit description=LigA
MTTIQTAAQIAAETAALKQQTTELNRNCTALKARGSELAKTATAGAKNTAVTKLGTAEKAKATQALDRNARAIRSEAVEQTLADMRKTGALLGVDSEVGRMRVETEIGRFSGESDDDKVSLLAGASRLDKLRAQMKMSAYIQSLANPDAAANEEKRQKQEALDQALNDGTLSQHKYDKERRGLGLVKRDGDFMLDVNDKLLESARNGASKIQDILGTKVYDFVADKFDKLGLSFLNNVAKMVTSAASAKLMETLLGNSFMEGKGGVGGWIGKAGSFLSDLFSGGGGISVGSSFVSGGTA

SEQ ID NO: 116902 - protein, 248 aa, Glycine max
  Coding DNA Sequence Number=SeqID_124
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-38, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=72; ConfidenceScore=5.73e-01
VRAVSPTKVRTCSPLMARACSPLKVRTCGPLKVSACSPTKARASSPLKARTCSPLEVRACSPLMVRTCSPLKARTCSPLEVRACSPLMVRTCSPLKARTFSPLKVRTCSPLKARMCSPLKVRACSPTKARAGSPLKARTCSPLEVRACSPLMVRTCSPLKARTCSPLKARTCSPLKVRACSPTKVRTCSPLMARACNPLKVRTCSPLMARACSPLKVRTRSPLMARACSLLKVRTCSPLKVRTHSPLK

SEQ ID NO: 116903 - protein, 39 aa, Glycine max
  Coding DNA Sequence Number=SeqID_125
MNHGTDRKGFQPTSARKDDRSRFRKEASPDDADRTFPYR

SEQ ID NO: 116904 - protein, 227 aa, Glycine max
  Coding DNA Sequence Number=SeqID_126
  Gene Ontology: Mol. function=DNA binding; Cellular component=nucleus; Biological process=regulation of transcription, DNA-dependent
  Homolog annotation: Hit_ID=Q9SCP1; Match level="QueryCoverage=97%, HitCoverage=97%, E-value=5e-42, Identity=42%"; Hit description=MYB27 protein
  Pfam annotation: Domain name=Myb_DNA-binding; Domain location=59-104; Score=51.9; E_value=2.1e-12; Accession=PF00249.21; Description=Myb -like DNA-binding domain
  Pfam annotation: Domain name=Myb_DNA-binding; Domain location=6-53; Score=41.2; E_value=3.5e-09; Accession=PF00249.21; Description=Myb -like DNA-binding domain
  Pfam module annotation: Pfam domain module=Myb_DNA-binding::Myb_DNA -binding; Domain location=59-104::6-53
GENLRKGTWLQEEDEQLTSFVARLGERRWDSLAKVAGLKRSGKSCRLRWMNYLRPNLKHGHFSVEEEQLIVQLQQELGNKWAKIARKLPGRTDNEIKNYWKTHLRKRAQAQQGDFKYKLEIATQEVNQKSIDMDSKNCKHGNVWCQDSEWETKDSSSTDTLSLSDWELRSSPYETRILDWIAELQNGYGENELEQDCNSTGTCNYYPQEFDEGCDSWDYSGSLWDMN

SEQ ID NO: 116905 - protein, 477 aa, Glycine max
  Coding DNA Sequence Number=SeqID_127
  Gene Ontology: Mol. function=pectate lyase activity; Cellular component=anchored to membrane
  Homolog annotation: Hit_ID=Q9SCP2; Match level="QueryCoverage=96%, HitCoverage=96%, E-value=1e-175, Identity=65%"; Hit description =Probable pectate lyase 12 precursor
  Pfam annotation: Domain name=Pec_lyase_C; Domain location=150-335; Score=302.2; E_value=9.8e-88; Accession=PF00544.9; Description =Pectate lyase
MLQTTCIILFSVVAIFLPHGTAMLNLTLPGQHPDPEAVAREVHRKVNASMARREMLGVSEKEVASCLTGNPIDDCWKCDPDWANNRQRLADCAIGFGQNAKGGKGGQFYIVTDSSDEDPVNPKPGTLRYAVIQNEPLWIVFPSNMMIKLSQELIFNSYKTIDGRGADVHIVGGGCITLQYISNVIIHNIHIHHCHPSGNANVRSSPEHYGYRTESDGDGISIFGSRDIWIDHCTLSRCKDGLIDAVMGSSAITISNNHFSHHNDVMLLGHSDHYLPDSGMQVTIGFNHFGEGLVQRMPRCRRGYIHVVNNDFTRWEMYAIGGSAGPTINSQGNRYTAPEDPYAKQVTKRLDAGEGEWSGWNWRSEGDVLLNGAFFVASGAVAEPNYQNAYSTQPKNVDRISLLTMSAGVLGVARDNNLGMWIRGPNDGTVYFSDSGPEYTDEMSRSTMPLLPSRILILVSALLCFLGHTTTLTTLPN

SEQ ID NO: 116906 - protein, 271 aa, Glycine max
  Coding DNA Sequence Number=SeqID_128
  Gene Ontology: Mol. function=pectate lyase activity; Cellular component=anchored to membrane; Biological process=cell wall modification
  Homolog annotation: Hit_ID=Q9SCP2; Match level="QueryCoverage=85%, HitCoverage=48%, E-value=1e-105, Identity=75%"; Hit description =Probable pectate lyase 12 precursor
MKHHRIEVANWVVLLRLLYDLRSIRVQIQESKYVKVATAFAIVGSSDPHSQIIVPSNAENTGGHSEKRNAIHVLRLGAVGVLIVRFSNCSRSNEERAIQQNIPFGPPIPPAPLPFSGIQPLRNLLRVRILRRGVAVSLAVNGGSRTAADGVHLPSCEVIVHHVDVTSSATRHALDEALPEVVEANGHLHAGVWEVVVAVAQEHHVIVVGEVVVGDRDSAGTHHCIDQAVLAPGEGAVVDPNVTRAEDGDPVAVRLRAVPIMFRARPHVSVA

SEQ ID NO: 116907 - protein, 868 aa, Glycine max
  Coding DNA Sequence Number=SeqID_129
  Gene Ontology: Mol. function=identical protein binding; Cellular component=integral to membrane; Biological process=protein transport
  Homolog annotation: Hit_ID=Q3T8Z5; Match level="QueryCoverage=84%, HitCoverage=99%, E-value=0.0, Identity=70%"; Hit description =Autophagy protein 9
  Pfam annotation: Domain name=APG9; Domain location=197-580; Score =737.5; E_value=8.5e-219; Accession=PF04109.6; Description=Autophagy protein Apg9
MFNRPRGARAFNVLNWKHQGESSVTTGLLQDVPPEIELSDYRRIPSPGSESPSDLLNGESLNVEPIADLDFFFERLYCYYCEKGLWCIIIKWIVELLSLGFTICFSGFFLLYVDWNGLRNAKCGMDAVESGRKPCDLAKEALHEHPLTPFTLGKAIIVGYLGIFSIYWIFCFLRFFVQLKDTLDIRQFYYNDLCVTDNEIQTMPWATILEKVVLVQSSRQLCVVKDLSAHDMVMRLMRKENYLIGMLNKGVLSFPISLWVPGAGPSVKAGTNRTRYRLILPKTLEWTLNWCILQSMFDRNFCVRRDFVSNPKTLKKRLMVVGIVMLLLSPFLVIFMLVYLFLGHAEQFYNHPSTASSRRWSNLSRWVFREFNEVDHLFRHRINSSVLHATNYIKQFPSPIISIIAKFISFVSGGFAAILIIIAFLEESLLEGHIFGRNLFWYAAVFGTITAIRRASITDELLVIDPEGAMSMVVEHTHYMPKRWRGKESTEMVRIEFETLFQYSGMMLLEEMASIFLTPYLLLLVVPKRVDDILQFIADFTVDVEGVGHVCSFSVFNFQEHGNSNYGSPFNAPHSQRSSQGKLEKSFLSFQSSYPSWEPNAQGKQFLQNLRTFRDQNLAGHVSRHEFPPLRLWRGSPNMGSNGDRNRFASREMPFSTFATGNHLGSLWLIESRNQNNHPYLLDWYYTSQPHDATTQRHIQADDPFEVTEHQSPDWMPSILVQNEQHGHEEYINEYCDERVTSHLGASTSAPIFRESLIQDQHSIDMPLTTRSHWWARSHSQSGHGQTSFFEPPDFNHQPVYNYHEKFSDRGSEDHDQEQHLHWGDYHQVVSSTAHVDDLDAGKFNLLFDDVYSSTPQNSTVNPSTATF

SEQ ID NO: 116908 - protein, 270 aa, Glycine max
  Coding DNA Sequence Number=SeqID_130
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=82%, HitCoverage=46%, E-value=1e-71, Identity=62%"; Hit description =Serine/threonine protein phosphatase 2A 57 kDa regulatory subunit B' beta isoform
MQYGFQILPLPWVLRVKQIEQLENKGVVDVPFRDFRIGVGGNHVSEEKLVDELKVGPRRVQGRFLLFGIGGFLACVFVRRRREAPKNVDGDHSDHLFLAVLAYLAGAGLDEVHEVHERLALDFFLPNVLQRVGEVEDVAAHVELPEEEVLPFRDGRVAERRHRLDGAAGGEREGGQGDEIHDDIGGGRRRSAEVGGGVRLRSRITGVGLGGLLVPAFHDFLEHPVAENESFREARVEEVFIEEQEEKKSGPETVRAMDPSEESSESMPEN

SEQ ID NO: 116909 - protein, 501 aa, Glycine max
  Coding DNA Sequence Number=SeqID_131
  Gene Ontology: Mol. function=binding; Cellular component=kinesin complex; Biological process=protein amino acid phosphorylation
  Homolog annotation: Hit_ID=Q8VZQ8; Match level="QueryCoverage=98%, HitCoverage=79%, E-value=0.0, Identity=68%"; Hit description =Putative kinesin light chain
  Pfam annotation: Domain name=TPR_1; Domain location=150-183; Score =1.4; E_value=3.7; Accession=PF00515.18; Description=Tetratricopeptide repeat
  Pfam annotation: Domain name=TPR_1; Domain location=192-225; Score =4.9; E_value=1.4; Accession=PF00515.18; Description=Tetratricopeptide repeat
  Pfam annotation: Domain name=TPR_1; Domain location=354-387; Score =10.1; E_value=0.33; Accession=PF00515.18; Description=Tetratricopepti de repeat
  Pfam annotation: Domain name=TPR_1; Domain location=395-428; Score =8.8; E_value=0.47; Accession=PF00515.18; Description=Tetratricopeptid e repeat
  Pfam annotation: Domain name=TPR_1; Domain location=437-470; Score =6.2; E_value=0.97; Accession=PF00515.18; Description=Tetratricopeptid e repeat
  Pfam annotation: Domain name=TPR_2; Domain location=101-134; Score =5.6; E_value=7.3; Accession=PF07719.7; Description=Tetratricopeptide repeat
  Pfam annotation: Domain name=TPR_2; Domain location=150-183; Score =1.8; E_value=20; Accession=PF07719.7; Description=Tetratricopeptide repeat
  Pfam annotation: Domain name=TPR_2; Domain location=192-225; Score =11.6; E_value=1.5; Accession=PF07719.7; Description=Tetratricopeptide repeat
  Pfam annotation: Domain name=TPR_2; Domain location=234-267; Score =0.1; E_value=32; Accession=PF07719.7; Description=Tetratricopeptide repeat
  Pfam annotation: Domain name=TPR_2; Domain location=274-307; Score =4.6; E_value=9.5; Accession=PF07719.7; Description=Tetratricopeptide repeat
  Pfam annotation: Domain name=TPR_2; Domain location=312-345; Score =3.7; E_value=12; Accession=PF07719.7; Description=Tetratricopeptide repeat
  Pfam annotation: Domain name=TPR_2; Domain location=354-387; Score =13.5; E_value=0.78; Accession=PF07719.7; Description=Tetratricopeptid e repeat
  Pfam annotation: Domain name=TPR_2; Domain location=395-428; Score =10.3; E_value=2.1; Accession=PF07719.7; Description=Tetratricopeptide repeat
  Pfam annotation: Domain name=TPR_2; Domain location=437-470; Score =12.1; E_value=1.3; Accession=PF07719.7; Description=Tetratricopeptide repeat
  Pfam annotation: Domain name=TPR_2; Domain location=54-88; Score=1.0; E_value=25; Accession=PF07719.7; Description=Tetratricopeptide repeat
  Pfam module annotation: Pfam domain module=TPR_1::TPR_1::TPR_1::TPR _1::TPR_1::TPR_2::TPR_2::TPR_2::TPR_2::TPR_2::TPR_2::TPR_2::TPR _2::TPR_2::TPR_2; Domain location=150-183::192-225::354-387::395 -428::437-470::101-134::...
  Pfam module annotation: Domain location=150-183::192-225::234 -267::274-307::312-345::354-387::395-428::437-470::54-88
METLVQKSSPIPSRQRKIMEKSQLDEAFESAETTEEMLKVFSNMEGVFDERELGLASLKIGLKLDHEGEDPEKALSFANRALKALEKDNNNNNFPSSLPVAMCLQLLGSVSFSLKRFSDSLGYLNRANRVLGRLQDEGGVSVDDVRPVLHAVQLELSNVKNAVGRREEALENLRKCLEIKEMTFEEDSGELGKGNRDLAEAYVAVLNFKEALPYCLKALEIHMKRLGMNSVEVAHDRKLLGIVYSGLEEHEKALEQNVLAQRILKNWNLNADLLRAEIDAANMMIALGRYDEAVGTLKGVVQQTEKDSETQALVLVSMAKALCNQEKFVDCKRCLEVSLGILDKRERICPVEVAEAYSEISMQYETMNEFETAISLLKRTLALLEKQPQEQHSEGSVSARIGWLLLLTGKVQQAIPYLESAAERLKDSFGPKHFGVGYIYNNLGAAYLELDRPQSAAQMFAVAKDIMDTSLGPHHADTIEACQNLSKAYGEMGRYGWFLLV

SEQ ID NO: 116910 - protein, 337 aa, Glycine max
  Coding DNA Sequence Number=SeqID_132
  Gene Ontology: Mol. function=metal ion binding; Cellular component =integral to membrane; Biological process=ubiquitin cycle
  Homolog annotation: Hit_ID=Q9LSW9; Match level="QueryCoverage=89%, HitCoverage=94%, E-value=2e-50, Identity=36%"; Hit description=RING -H2 finger protein ATL5K
  Pfam annotation: Domain name=C1_4; Domain location=131-175; Score= -10.1; E_value=0.043; Accession=PF07975.2; Description=TFIIH C1-like domain
  Pfam annotation: Domain name=PHD; Domain location=131-176; Score=3.7; E_value=0.024; Accession=PF00628.19; Description=PHD-finger
  Pfam annotation: Domain name=zf-C3HC4; Domain location=132-173; Score= 36.5; E_value=9e-08; Accession=PF00097.15; Description=Zinc finger, C3HC4 type (RING finger)
  Pfam module annotation: Pfam domain module=C1_4::PHD::zf-C3HC4; Domain location=131-175::131-176::132-173
MALNKNHSYNNKLGNEALPPIKTQAGTLQHPPQPASSDYAFPIFVIVVLSILATVLLLLSYFTFLTKYCSNWRQVNPMRWISILRARHEEDPFIAFSPAMWNRGLDESIIREIPTFQFIKGEEGEDQSVYGCVVCLTEFKEQDVLKVLPNCNHAFHLDCIDIWLQTNSNCPLCRSSISGNTHCPLDHIIAPSSSPQDSQLLSNMGSDEDFVVIELGGESGAVIPPVQQERNDSRGSLAHRNHTTRKCHHVSIMGDECIDIRKKDDQFLIQPIRRSFSMDSAHDRQTYLDAQVIIQQNRLQNEASASEDCNSRCRRAFFPFCYGKGSKNAVLPLENDV

SEQ ID NO: 116911 - protein, 87 aa, Glycine max
  Coding DNA Sequence Number=SeqID_133
  Homolog annotation: Hit_ID=Q8VZQ8; Match level="QueryCoverage=68%, HitCoverage=9%, E-value=1e-10, Identity=54%"; Hit description =Putative kinesin light chain
MECTSMFLSLIFLCCLCGDYVLAIEFQQQVVDAWESHGASAEDELREGQRLLDQLKKKARDASANELHMKALPNELPMKALPLPHKS

SEQ ID NO: 116912 - protein, 509 aa, Glycine max
  Coding DNA Sequence Number=SeqID_134
  Homolog annotation: Hit_ID=Q535K6; Match level="QueryCoverage=95%, HitCoverage=88%, E-value=1e-159, Identity=53%"; Hit description =Nitrate and chloride transporter
  Pfam annotation: Domain name=MFS_1; Domain location=58-476; Score= -39.5; E_value=0.02; Accession=PF07690.6; Description=Major Facilitator Superfamily
  Pfam annotation: Domain name=Nodulin-like; Domain location=1-235; Score=386.2; E_value=5.1e-113; Accession=PF06813.4; Description =Nodulin-like
  Pfam module annotation: Pfam domain module=MFS_1::Nodulin-like; Domain location=58-476::1-235
MAVSGATYMFGLYSNEVKTSLGYDQSTLNLISFFKDLGANLGIFSGLINEISPPWVILAMGATMNFIGYFMIWLSVTSRIAKPQVWQMCLYFYIGANSQSFANTGALVNCVKSFPRSRGSVIGLLKGYVGLSGAIFTQFYHAFYGDDSKALIFLIGWLPAAISFVFLPTVRVLSITPQPKEIKVFYQLLYISLGVAGFLMVLIIIQNKLSFTRVEYIGDGMVVLLLLLLPLGVVFSEEFKLWKNQNQNQTFTNHAGAASVVELPQPEEAHAVAPTHSERKNNNSCLKNVFKPPKRGEDYTIFQALFSIDMLILFIATVFGVGGTLTALDNLGQIGNSLGYPRKSLTTFVSLVSIWNYLGRASSGFASEYLLTKYKFPRPLLLTLVMLLSCVGHILIAFVASPVGSYILNVKVTGYLYDKEALKQLGVKGLIRQKGKDLTCVGVQCYRMAFLIITASTLVGCVVSFILVLRTRNFYKGDIYEKFRVLELDTGESLPTFGSTSGTTTTTNR

SEQ ID NO: 116913 - protein, 88 aa, Glycine max
  Coding DNA Sequence Number=SeqID_135
  Subcellular localization annotation: CTP_CleavageSite=34; ConfidenceScore=5.06e-01
MCMLQALLNPSTLGFNLKPQPTNEAFVNSARRIASSTLDSYLGRHHEHPATLPVYFSVIVSPPPFSRFWSLVTLFVCVSVTIPIVPNG

SEQ ID NO: 116914 - protein, 67 aa, Glycine max
  Coding DNA Sequence Number=SeqID_136
MTVIIMITIILVKVLVVWLGQNGGGGGYSGDGMVTVKMKVMIAMIVTTVTMMFGGDGDDGMVVMVEC

SEQ ID NO: 116915 - protein, 220 aa, Glycine max
  Coding DNA Sequence Number=SeqID_137
  Gene Ontology: Mol. function=transcription factor activity; Cellular component=nucleus; Biological process=regulation of transcription, DNA-dependent
  Homolog annotation: Hit_ID=Q8LDC8; Match level="QueryCoverage=96%, HitCoverage=98%, E-value=4e-35, Identity=40%"; Hit description =Ethylene-responsive transcription factor 1B
  Pfam annotation: Domain name=AP2; Domain location=75-140; Score =139.6; E_value=8.7e-39; Accession=PF00847.10; Description=AP2 domain
MTPPFFQNPASDWNMLQQEPSEILFDSMSSNNAVLDPIQDSLSFDMVDFSTTPTEGYHNEAKKLVVKSELQNNKERSYIGVRKRPWGKFAAEIRDTTRNGARVWLGTFDSAEAAALAYDQAAFTMRGDNAVLNFPVKTVKESLQEIQYSCSNGSSPALALKERHCIQRKLSLKGRKCKAKETSSSEDPTPSVLVFEDLGADYLEQLLSISDQSARPSYFS

SEQ ID NO: 116916 - protein, 213 aa, Glycine max
  Coding DNA Sequence Number=SeqID_138
  Gene Ontology: Mol. function=transcription factor activity; Cellular component=nucleus; Biological process=regulation of transcription, DNA-dependent
  Homolog annotation: Hit_ID=Q8LDC8; Match level="QueryCoverage=96%, HitCoverage=95%, E-value=2e-35, Identity=42%"; Hit description =Ethylene-responsive transcription factor 1B
  Pfam annotation: Domain name=AP2; Domain location=73-138; Score =140.4; E_value=4.8e-39; Accession=PF00847.10; Description=AP2 domain
MPTNSPLFHQNPDWNMLQEPSEILFDSFSSNPVRDTVHDLLSFDMVDFSTPPTEGNHNKTKQLVVKSEVQNKERSYIGVRKRPWGKFAAEIRDTTRNGTRVWLGTFESAEAAALAYDQAAFSMRGHDAVLNFPVKRVKESLLEIQYGCSKGCSPALAIKERHYIRRKLSSKARKCRENKQESEAPTPSVVVLEDLGVEYLEQLLSISDQSVSL

SEQ ID NO: 116917 - protein, 72 aa, Glycine max
  Coding DNA Sequence Number=SeqID_139
MRKELTGVKDNNEHINMNKNGEMKNERNATKLQQMVRIELSLVGGEAASIREDLWVEEEGERKAVGEQNGGG

SEQ ID NO: 116918 - protein, 105 aa, Glycine max
  Coding DNA Sequence Number=SeqID_140
  Subcellular localization annotation: CTP_CleavageSite=58; ConfidenceScore=5.11e-01
MVSKHPNNGFPQNLRGSKHPNVINKLFLYRDDVNATVCNGFVAAADTNNTFNNISFMRAALEVNEPRFWFKHENAVMKVGDKVNLEVGDGTSKGYGNNPIRSHPL

SEQ ID NO: 116919 - protein, 216 aa, Glycine max
  Coding DNA Sequence Number=SeqID_141
  Gene Ontology: Mol. function=transcription factor activity; Cellular component=nucleus; Biological process=regulation of transcription, DNA-dependent
  Homolog annotation: Hit_ID=Q5Y836; Match level="QueryCoverage=92%, HitCoverage=82%, E-value=3e-32, Identity=41%"; Hit description=ERF transcription factor 5
  Pfam annotation: Domain name=AP2; Domain location=73-138; Score =144.6; E_value=2.6e-40; Accession=PF00847.10; Description=AP2 domain
MPSMSSPFFQNPDWNMSQDPYEILFDSLPRNDVLDPLHDSLSFDMVDNFSMAPKGNHSKAKQVVVKSEVQNKERSYTGVRKRPWGKYAAEIRDTTRNGTRVWLGTFDTAEAAALAYDQAAFSMRGHNAVLNFPIKRVKDSLQEIQYSCCNGSSPALALKERHCIQRKFSSKAKKCKGKGTSEDPTQSVVVLEDLGVDYLEQLLSVSDQSESPSYWP

SEQ ID NO: 116920 - protein, 374 aa, Glycine max
  Coding DNA Sequence Number=SeqID_142
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=Q1RV57; Match level="QueryCoverage=99%, HitCoverage=78%, E-value=9e-86, Identity=41%"; Hit description =ENSANGP00000004406, related
RIPKVKYAVKKIILRTLKLLFWGILLQGGYSHAPDDLSYGVDMRFIRWCGILQRIALVYCVVALIETYTTKLRPSTLKPGHLSIFTAYRWQWLGGFVAFVIYMVTIFSLYVPDWSFVDYNSDKPKRYTVECGMRGHLGPACNAVGYVDRQVWGVNHLYSQPVWTRLKACTLSSPAEGPLRKNAPAWCRAPFEPEGFLSSVLAILSGTIGIHYGHVLIHFKGHFERLKQWLSMGFVLLTLGLILHFTDAIPINKQLYSFSYVCFTAGAAGIVFSVFYLLIDVWGLRTPFLFLEWIGMNAMLVFVMAAQGIFAAFVNGWYYKDPDNSLVYWIQNHVFTNVWHSERLGTLLYVIFAEITFWGVVAGILHKLGIYWKL

SEQ ID NO: 116921 - protein, 124 aa, Glycine max
  Coding DNA Sequence Number=SeqID_143
  Gene Ontology: Mol. function=amino acid binding; Biological process =metabolic process
  Homolog annotation: Hit_ID=Q9SJM1; Match level="QueryCoverage=98%, HitCoverage=30%, E-value=9e-44, Identity=70%"; Hit description =Expressed protein
MQQALPIVTTEIQKKDIRRLRRLQVRSIIRDSRGRGERRARLNEPLLQQTPPRPLFPNHPENYVAPFPIRRHIFIYVEAEEQYDATQIATQTGFVGAIDSEESWVAIFFWRAYDHYVVVQYTHQ

SEQ ID NO: 116922 - protein, 81 aa, Glycine max
  Coding DNA Sequence Number=SeqID_144
GVARPGELTCTFFLKLIDFRRRLYTGMTRVRGPKLLMLRQPLRKDDDLLVVTLASFCVRPQVSESRKQRGVANLDRVVVLP

SEQ ID NO: 116923 - protein, 237 aa, Glycine max
  Coding DNA Sequence Number=SeqID_145
  Gene Ontology: Mol. function=signal transducer activity; Cellular component=membrane; Biological process=signal transduction
  Homolog annotation: Hit_ID=Q0X6T8; Match level="QueryCoverage=33%, HitCoverage=14%, E-value=7e-12, Identity=46%"; Hit description =Histidine kinase, HAMP region:chemotaxis sensory transducer
MGALRQIVVAIRHLACRIAKCMGTFAHLAHDLRQPHIHAQQRLHQFTHLIARYRTDTVIELAAGNGIRQFARLGDGTVNRADQQPAGDQRQTQTQQQDGDQAIACQQVVAVALLPGRLRMLPHQRIQLVNVLLQQLATAAQAGFNDHQCGGRVTAFQQLTGFMQRTLPAVEMGQEALAQRFGLRIKRQLLPGMAIGVDLLTVLRNARQAFFHFTAVGPVAQRIEQGSGLLLHHAVQA

SEQ ID NO: 116924 - protein, 142 aa, Glycine max
  Coding DNA Sequence Number=SeqID_146
SKTAEGKAAISSFHQFPDESLSETLERPQTKQLLDASAGGKIKLKTSEEATELIENMSANDYAILRDRVHQPTKKSLLELSSHDALLAQNKLLSRKLEILTETLGCSICGEAHETDQCIPIEEKTQEVHYMGNQQRQGYTQG

SEQ ID NO: 116925 - protein, 603 aa, Glycine max
  Coding DNA Sequence Number=SeqID_147
  Gene Ontology: Mol. function=triacylglycerol lipase activity; Biological process=lipid metabolic process
  Homolog annotation: Hit_ID=UPI000034EE73; Match level="QueryCoverage =84%, HitCoverage=92%, E-value=1e-172, Identity=60%"; Hit description= triacylglycerol lipase
  Pfam annotation: Domain name=Lipase_3; Domain location=278-415; Score= 106.3; E_value=9.1e-29; Accession=PF01764.16; Description=Lipase (class 3)
MCHRLIYLYQLSSLKRTIENLFTCRVYIIYAKELFKEAQSSVFNRTFCVVNLVMGQCSNREKPHWNYTHSVSNQLQLQRSRADKVEDKLKEEQETQRISFKSEVKKADGNDGISKYCSDDEDSSDSKWKLELAWLTKALEPALQFCRWALPTGNEIGNKPPPSIRSLTEIIACIQRSKIGIQDWSLSDLTIGLYLIYLRQASTHPFEDIKGIPILSESIVQDLIYHIELAKGAYRDNPCSISRNSMLRESNVKKFVKNSSVMRPAYYIGVDTRKKLVILGIRGTHTFYDLITDILSSSDGEVTYEGYSTHFGTAESARWFLRHEIEIIRKCLEKHEGFKLRLVGHSLGGAIASLLAIMIHRKSSKELGFSPDIVSAVGYGTPPCVSRELAESCSGYVSTVVMQDDIIPRLSVASLARLRNEIVQTDWMSVIEKEDWKSITDLVTNAKEVVSSVQDVARKLADYTNFRGNKSLAVGTTDKELPVATEAPLPSEAAKETSGVTKVAGTKTAVIEELFIPGTVYYLKRNLGSQIDAGKDFFTLYKREPGEHFQKVIFSGNFITDHRCDSHYYALRDVLKGVPWCGKEGGALQFFSLCGGVSNSTVD

SEQ ID NO: 116926 - protein, 80 aa, Glycine max
  Coding DNA Sequence Number=SeqID_148
MAFASFLGRVLFASVFILSAYQQLRICVSDFISLSRDIILKLEHEIIHCGFGAVDGLVALLVLTFHVNLETKVNNQVLPI

SEQ ID NO: 116927 - protein, 128 aa, Glycine max
  Coding DNA Sequence Number=SeqID_149
  Homolog annotation: Hit_ID=P93384; Match level="QueryCoverage=44%, HitCoverage=36%, E-value=3e-16, Identity=70%"; Hit description =Nicotiana tabacum ORF
  Pfam annotation: Domain name=HR_lesion; Domain location=1-110; Score =84.0; E_value=4.6e-22; Accession=PF05514.2; Description=HR-like lesion-inducing
MSQLGHGINGYKYLPLSLRFIGAGSYQIWGSQQLKFLIAGAIALKGLGGVLFIFGSSFGALLLLLHQLIATPIHYDFYNYDSEDKEFTQLFIKFTQNMALFGAVLFFIGMKNSIPKRVPKKAPKTKTY

SEQ ID NO: 116928 - protein, 295 aa, Glycine max
  Coding DNA Sequence Number=SeqID_150
  Gene Ontology: Mol. function=oxidoreductase activity; Cellular component=proton-transporting two-sector ATPase complex; Biological process=ethylene biosynthetic process
  Homolog annotation: Hit_ID=Q1SH48; Match level="QueryCoverage=94%, HitCoverage=72%, E-value=1e-74, Identity=49%"; Hit description=H+ -transporting two-sector ATPase, alpha/beta subunit, central region; 2OG-Fe(II) oxygenase
  Pfam annotation: Domain name=2OG-FeII_Oxy; Domain location=223-295; Score=57.6; E_value=4.1e-14; Accession=PF03171.10; Description=2OG -Fe(II) oxygenase superfamily
MEVVGFDKEGAGYDRAKEVKEFEDTKAGVKGLVDFGILKLPRFLIHPPESLPSSPTSSNNTTSTLQVPVIDFAGYDDDDDESCCRRLKIVREIREASEKWGFFQMVNHGVPVSVMDEMLRVIREFHEQSKEVKKEWYSRDPKVRVRYFCNGDLLVAKVANWRDTIMFHFQEGPLGPEAYPLVCREAVIQYMEHMFKLREILSQLLSEALGLKRDYLKNRECMKGETVVCHYYPPCPEPDLTLGATKHSDPSCLTILLQDTMGGLQVFHENQWVHIKPMPGALVANIGDFMQCVAK

SEQ ID NO: 116929 - protein, 747 aa, Glycine max
  Coding DNA Sequence Number=SeqID_151
  Gene Ontology: Mol. function=binding; Cellular component =intracellular; Biological process=metabolic process
  Homolog annotation: Hit_ID=Q6ETD1; Match level="QueryCoverage=97%, HitCoverage=95%, E-value=0.0, Identity=52%"; Hit description =Putative pentatricopeptide (PPR) repeat-containing protein-like protein
  Pfam annotation: Domain name=PPR; Domain location=107-140; Score =18.8; E_value=0.019; Accession=PF01535.11; Description=PPR repeat
  Pfam annotation: Domain name=PPR; Domain location=178-212; Score=8.2; E_value=0.8; Accession=PF01535.11; Description=PPR repeat
  Pfam annotation: Domain name=PPR; Domain location=240-274; Score =39.1; E_value=1.5e-08; Accession=PF01535.11; Description=PPR repeat
  Pfam annotation: Domain name=PPR; Domain location=341-375; Score =50.1; E_value=7.6e-12; Accession=PF01535.11; Description=PPR repeat
  Pfam annotation: Domain name=PPR; Domain location=442-476; Score =42.6; E_value=1.4e-09; Accession=PF01535.11; Description=PPR repeat
  Pfam annotation: Domain name=PPR; Domain location=45-79; Score=13.0; E_value=0.21; Accession=PF01535.11; Description=PPR repeat
  Pfam annotation: Domain name=PPR; Domain location=477-511; Score =14.4; E_value=0.15; Accession=PF01535.11; Description=PPR repeat
  Pfam annotation: Domain name=PPR; Domain location=513-547; Score =18.4; E_value=0.026; Accession=PF01535.11; Description=PPR repeat
  Pfam annotation: Domain name=PPR; Domain location=579-613; Score =10.7; E_value=0.41; Accession=PF01535.11; Description=PPR repeat
  Pfam module annotation: Pfam domain module=PPR::PPR::PPR::PPR::PPR::PP R::PPR::PPR::PPR; Domain location=107-140::178-212::240-274::341 -375::442-476::45-79::477-511::513-547::579-613
MCLHVSKQFNSMSLSNHYCELLKHCRDTKKIHCHIIKAFRNPEIFLLNNLVSAYAKFDRITYARRVFDQMPQRNLYSWNTLLSSYSKLACLPEMERVFHAMPTRDMVSWNSLISAYAGRGFLLQSVKAYNLMLYNGPFNLNRIALSTMLILASKQGCVHLGLQVHGHVVKFGFQSYVFVGSPLVDMYSKTGLVFCARQAFDEMPEKNVVMYNTLIAGLMRCSRIEDSRQLFYDMQEKDSISWTAMIAGFTQNGLDREAIDLFREMRLENLEMDQYTFGSVLTACGGVMALQEGKQVHAYIIRTDYQDNIFVGSALVDMYCKCKSIKSAETVFRKMNCKNVVSWTAMLVGYGQNGYSEEAVKIFCDMQNNGIEPDDFTLGSVISSCANLASLEEGAQFHCRALVSGLISFITVSNALVTLYGKCGSIEDSHRLFSEMSYVDEVSWTALVSGYAQFGKANETLRLFESMLAHGFKPDKVTFIGVLSACSRAGLVQKGNQIFESMIKEHRIIPIEDHYTCMIDLFSRAGRLEEARKFINKMPFSPDAIGWASLLSSCRFHRNMEIGKWAAESLLKLEPHNTASYILLSSIYAAKGKWEEVANLRKGMRDKGLRKEPGCSWIKYKNQVHIFSADDQSNPFSDQIYSELEKLNYKMVQEGYVPDMNSVLHDVDDSEKIKMLNHHSEKLAIAFGLIFIPPGLPIRVVKNLRVCGDCHNATKYISKITQREILVRDAARFHLFKDGRCSCGDFW

SEQ ID NO: 116930 - protein, 331 aa, Glycine max
  Coding DNA Sequence Number=SeqID_152
  Homolog annotation: Hit_ID=Q337A7; Match level="QueryCoverage=82%, HitCoverage=67%, E-value=4e-74, Identity=50%"; Hit description=HIT zinc finger family protein, expressed
MAATFFIEDRMRKLTKKRRNNCRELEEFLLQIVMETGRCQSVPPSLVPTQEISFDDLSLEEKKRFHIAIAYGELSKMIKPWDPWWSKPSARNICLSKEGTQLVQPIPDQELLDDDIGSDEFSKVPLGPETPLPPLSRLSSKEPSPLLTVHLVDILYSYCFTLRLYNGDWRSDALGSVMVVLSVSSVLGQGAQPETVLEALSHCLEQVCCPAYRHIGGLQFGLGVIDDVISLLGLGTPALVCALRDMHWCIQEGEKEAKSERPRKSQRGGTRSAIKLAERKIYFIMCWVHEQPEEVWSSLAAIVRAEKTSAMEFQQINRSEDLNNKTEAKGK

SEQ ID NO: 116931 - protein, 49 aa, Glycine max
  Coding DNA Sequence Number=SeqID_153
MACRYIDSQAEQACHIRKLLSSTNHREVTTVVTSSIHPRLPVDECKRLP

SEQ ID NO: 116932 - protein, 370 aa, Glycine max
  Coding DNA Sequence Number=SeqID_154
  Gene Ontology: Mol. function=carboxypeptidase activity; Cellular component=membrane; Biological process=auxin mediated signaling pathway
  Homolog annotation: Hit_ID=Q10RR0; Match level="QueryCoverage=96%, HitCoverage=97%, E-value=5e-97, Identity=47%"; Hit description =Integral membrane protein DUF6 containing protein, expressed
  Pfam annotation: Domain name=DUF6; Domain location=196-325; Score =57.3; E_value=4.9e-14; Accession=PF00892.11; Description=Integral membrane protein DUF6
  Pfam annotation: Domain name=DUF6; Domain location=26-159; Score =38.3; E_value=2.7e-08; Accession=PF00892.11; Description=Integral membrane protein DUF6
  Pfam annotation: Domain name=TPT; Domain location=187-325; Score= -25.7; E_value=0.018; Accession=PF03151.7; Description=Triose -phosphate Transporter family
  Pfam module annotation: Pfam domain module=DUF6::DUF6::TPT; Domain location=196-325::26-159::187-325
MSNNECAFGVVYVKFKPHLLMVLVQLVLSFLYFLVEASLNKGMNPHVFVTYRHAVGGIVVLPFAYIRERKTWPKLTLTMFVELFFLSLFGISLTLNMFFESLKYTTPSFVASMINTISPLTFIIAVGLRLEVVDVKKPRGMARVFGTVLSLIGALIMTLYKGHTIQSLRGAPFNVRGKLVHNNWIKGSILSVASCISWSLWYILQAIIVKKYPAQLSLTAWINCMGAAQSAAFTVLVQRKPTAWFITSTVELCCIFYAGVICGGFVIFGQFWTAEQKGPVFVSMFNPLGTILVAILAYFVFGEQLHTGSLLGVVIVIIGLYLLLWGKESDGDYKSQQSFPTHVEQKEYRTQIKTSAEEEVPQRSVSHATN

SEQ ID NO: 116933 - protein, 72 aa, Glycine max
  Coding DNA Sequence Number=SeqID_155
MDPVLSDPQRPLVGEQNLMVEKTKKKLEEAAQSESTEGVIDPSSPIKRHVKWKMACTKKTGQMCWIEWPQNN

SEQ ID NO: 116934 - protein, 298 aa, Glycine max
  Coding DNA Sequence Number=SeqID_156
  Homolog annotation: Hit_ID=Q6K1G6; Match level="QueryCoverage=99%, HitCoverage=36%, E-value=1e-134, Identity=81%"; Hit description=Gp24
TATKYVLKLDGWIQKNKGLAETIGIVAGGALALIGVIGGIGLVAWPVVMGINAIIAAAGVMGTALTVAGSAIVTALGAITWPIVAVGAAIVAGALLIRKYWEPISAFFSGVIEGIMSAFAPVGEMFAPLAPIFDGLGEKLRGVWQWFKDLIAPVKATQETLDSCKNAGVIFGQALASALMAPLNVFNKLRSGVDWLLEKLGIINKESDSLDQTAAKTNAATQGNSYIPATSTYGGYQAYQPVTAPAGRSYIDQSKSEYNITLPGGVAPGHQLDRQLRDTLEQIEREKRARQRASMSHD

SEQ ID NO: 116935 - protein, 225 aa, Glycine max
  Coding DNA Sequence Number=SeqID_157
  Gene Ontology: Mol. function=nucleoside-triphosphatase activity; Cellular component=chloroplast
  Homolog annotation: Hit_ID=Q2PMM5; Match level="QueryCoverage=99%, HitCoverage=9%, E-value=1e-118, Identity=94%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPK

SEQ ID NO: 116936 - protein, 196 aa, Glycine max
  Coding DNA Sequence Number=SeqID_158
  Homolog annotation: Hit_ID=Q84VH5; Match level="QueryCoverage=80%, HitCoverage=27%, E-value=3e-78, Identity=82%"; Hit description =Envelope-like protein
EITAKQVQHWPKKGKLSAGKLSVKYAILHRIGAANWVPTNHTSTIATESFAVKLPIAFPTVLCGIMLSQHPNMLNYTDSVMKRESPLSLHYKLFEGTHVPDIVSTSGKAASGAVSKDALIAELKDTCKVLEATIKATTEKKMELERLIKRLSESGIDDGEAAEEEEEAAEDEEEAAEEEEDAAEDTESDDDSEATS

SEQ ID NO: 116937 - protein, 134 aa, Glycine max
  Coding DNA Sequence Number=SeqID_159
MIMRSQDIYSSQDEATTSPSYSESEEAKGEESSEEIYPQEEGQPLMVKEECTEVSVSPKRLAKKETHFAIKTNIKETSLLRQPLHLLFYKKTLVSTATPLGFEVIPQVKELLDEGLVRKSLNPCALLVPKIGTH

SEQ ID NO: 116938 - protein, 106 aa, Glycine max
  Coding DNA Sequence Number=SeqID_160
  Subcellular localization annotation: CTP_CleavageSite=58; ConfidenceScore=5.32e-01
KDPQGMYPPLFTLNNLVDVPSARTNPQEMYPLLFFVTTTQVDVPSTCTTKDVPSNVLRQSSQAGEGRHKRIQAVSPSLFGKRENRDTKRIQVVSPWRILFGKGRME

SEQ ID NO: 116939 - protein, 83 aa, Glycine max
  Coding DNA Sequence Number=SeqID_161
MMIWKERAKLVMATARTTFLNEKLYTVPKFQQTLLTTTKDPTVMWLRMPPDSWVTVTKSGVVDKSRAFAPTYPQFCDEELRPT

SEQ ID NO: 116940 - protein, 95 aa, Glycine max
  Coding DNA Sequence Number=SeqID_162
MVETSHIDTKRGVKDKAPNTLPMKGLFVTKLESNEAHGLEIYPKAHENPRAFPWISSPIYLESSTQCPYGVGLHHVLSRTSESDQFPLLNDPNKA

SEQ ID NO: 116941 - protein, 144 aa, Glycine max
  Coding DNA Sequence Number=SeqID_163
  Homolog annotation: Hit_ID=O04892; Match level="QueryCoverage=48%, HitCoverage=13%, E-value=1e-23, Identity=76%"; Hit description =Cytochrome P450 like_TBP
RGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 116942 - protein, 151 aa, Glycine max
  Coding DNA Sequence Number=SeqID_164
  Gene Ontology: Cellular component=integral to membrane; Biological process=cytochrome complex assembly
  Homolog annotation: Hit_ID=Q8ABC4; Match level="QueryCoverage=86%, HitCoverage=19%, E-value=2e-11, Identity=33%"; Hit description =Thiol:disulfide interchange protein dsbD
MESGWHIYSKDLPEDTGIPTEYKVSGKNIELIGKFQEVGKKHEEFSEAFGGTIVFYSNSAGFKQKFKLKDPAKPADVTSEITYQTCDDRVCLAPNTLEFNQKVTPKGATEEVALETNTETSKDSAVTVVADSAKHEVTVTESSHLDPKKLK

SEQ ID NO: 116943 - protein, 161 aa, Glycine max
  Coding DNA Sequence Number=SeqID_165
GPQFRPQPLPLHFAVGRVPPTMVEREKLDHIKERLRVIEGGGDHAFADIAELYLVPDIIIPLKFKVSDFDKFKGTTCPKNHLKLYCRKMGAYAKDEKLLMHFFQESLTRAAVTWIEVGLKRGKFDYPALINEKPGENREDEKEEGTHVVTAIPTWPNFPPA

SEQ ID NO: 116944 - protein, 403 aa, Glycine max
  Coding DNA Sequence Number=SeqID_166
  Homolog annotation: Hit_ID=Q8PBH3; Match level="QueryCoverage=34%, HitCoverage=48%, E-value=4e-66, Identity=71%"; Hit description =UvrABC system protein A
  Pfam annotation: Domain name=DUF24; Domain location=6-86; Score=6.5; E_value=1.1e-05; Accession=PF01638.8; Description=Transcriptional regulator
MDGRDRVVAERGDTTLGELRIDLAPVTAKTLTARLRDMQLKGMITRHERDTSPPSIEYALTALGAQLLPAIHAIARVGNALKFEEPERCCSARRAADSLRQRCALAGMRIHPHHHHVAVGVQLRVVLLVDDAMADGHAAVAQALDEQLDQDVVGPHDRQPVVDVGRGHHRCDAVGHRHAFNAQHPAHARFLQIGNVLGVVDVAHAVHVTPAHADRDAGQDLVFAAHQASFFFLLAVAVLLDLPVLLEATAFFAGFSGFTLRGGRASGLLATAAGCSGRALVEGSMRARNWPVYDCGQAATSSGVPVTRIVPPRWPPSGPRSTIQSAVLITSRLCSITTTVLPSSRSLCSTPSSASMSWKCRPVVGSSRMYRVRPVSRRDSSLDSFTRCASPSDSVVALWPSLM

SEQ ID NO: 116945 - protein, 303 aa, Glycine max
  Coding DNA Sequence Number=SeqID_167
  Gene Ontology: Mol. function=transporter activity; Cellular component= outer membrane-bounded periplasmic space; Biological process=transport
  Homolog annotation: Hit_ID=Q6D583; Match level="QueryCoverage=90%, HitCoverage=88%, E-value=2e-94, Identity=62%"; Hit description=ABC transporter, substrate binding protein
  Pfam annotation: Domain name=SBP_bac_3; Domain location=57-284; Score= 103.7; E_value=5.5e-28; Accession=PF00497.10; Description=Bacterial extracellular solute-binding proteins, family 3
MKQVIIVALAGAVLAAPATGAQQLDASHNETPITMAANPQAIAKIPAGFHFVHPGYLTVATSANNSPPIGLWASDNKTLIGSDPDIARLLADSLGLKLRLVPAAWEDWPLGITAGRYDVAMFNIAVTEERKQKFDFATYRADNHAFAVKADSKISAIRRREDVAGKRIIVGSGTNQERILLSWDEKNRAQGLAPVQPIYLNDDASATLALLSGRADASFGPQAMAAWKVASRGQTKIVGHGPFRAWVAVTTKKGNGLDVALQQAINGAIAGGQYHQVLARWGEEGEAVEISQVNPPGIVYQEN

SEQ ID NO: 116946 - protein, 320 aa, Glycine max
  Coding DNA Sequence Number=SeqID_168
  Gene Ontology: Mol. function=two-component sensor activity; Cellular component=membrane; Biological process=two-component signal transduction system (phosphorelay)
  Homolog annotation: Hit_ID=UPI0000690503; Match level="QueryCoverage =75%, HitCoverage=45%, E-value=4e-51, Identity=42%"; Hit description =diguanylate cyclase/phosphodiesterase (GGDEF &  EAL domains) with GAF sensor
  Pfam annotation: Domain name=EAL; Domain location=29-270; Score =321.2; E_value=1.9e-93; Accession=PF00563.11; Description=EAL domain
EAVFTVFNCAVPVTALLSTVFTYGGNYSATDLIKRELASAIERQQLELYYQPQVDGDKNLIGFEALLRWKHPEKGFISPEVFIPVAEKSGLIIDIGKWVLERMLQQIVEWDRVLRLPPLVFSINISPLQLMHRDFTHDTLLTLSHYKIRPERLKFEITETTFIYDQQRIGDVINHFSQLGIKWAIDDFGVGYSSLKSLSDFAIDDIKIDKSLIMHIFENESAAIVVQKTIELSRAMGLNVLAEGIESEEYFEHLRNKGCHLFQGYHFCPPAARRRSIAVDKKSRVNRASLHFLSQCAAMRTLRKPERAVGSPFMVTTPHA

SEQ ID NO: 116947 - protein, 90 aa, Glycine max
  Coding DNA Sequence Number=SeqID_169
  Gene Ontology: Mol. function=nucleic acid binding
MIIVGQNIGNFLGQYLIYDDKQNSSRWMSYKRIRVVIDINKPLKCTKKIRKEGGDATIVKFKYERLHAFCHFCGFLGHNEDYCRKLSYSR

SEQ ID NO: 116948 - protein, 353 aa, Glycine max
  Coding DNA Sequence Number=SeqID_170
  Gene Ontology: Mol. function=nucleoside-triphosphatase activity; Cellular component=mitochondrion; Biological process=ATP-dependent proteolysis
  Homolog annotation: Hit_ID=O64948; Match level="QueryCoverage=99%, HitCoverage=34%, E-value=1e-115, Identity=63%"; Hit description=Lon protease homolog 1, mitochondrial precursor
  Pfam annotation: Domain name=Lon_C; Domain location=89-343; Score =302.4; E_value=8.2e-88; Accession=PF05362.3; Description=Lon protease (S16) C-terminal proteolytic domain
MVKLVIQRYTREAGVRNLERNLAALARAAAVIVLEQEQVVPLNKGMQGLATPLVENRLADGTEVEMEVIPMGVNSRDISSTFRIASPLVVDETMLEKVLGPPRFDGREAAERVATPGVSVGLVWTAFGGEVQFVEATAMVGKGELHLTGQLGDVIKESAQIALTWLQMSGMGGEANIAVFVETSQRVNAWLAHMGAGVIECGGMLGSNCKVRARATDLRLAATEGFNILEGRDVHIHFPAGAVPKDGPSAGVTLVTALVSLFSQQRVRSDTAMTGEMTLRGLVLPVGGVKDKILAAHRYGIKRVILPERNLKDLVEVPSSVLSNLEVLLAKRVEDVLEHAFDGGCPWRQHSKL

SEQ ID NO: 116949 - protein, 82 aa, Glycine max
  Coding DNA Sequence Number=SeqID_171
MGSENKEAPGGELNNSSPSPSSSHAWKSRIVIPTLLAGVAGAGAGLISKHRRTLGLATVCSNYAVNFTIVTGCYCVLRVLNP

SEQ ID NO: 116950 - protein, 267 aa, Glycine max
  Coding DNA Sequence Number=SeqID_172
  Gene Ontology: Mol. function=enzyme inhibitor activity
  Homolog annotation: Hit_ID=Q9FFW0; Match level="QueryCoverage=96%, HitCoverage=64%, E-value=5e-18, Identity=37%"; Hit description =Arabidopsis thaliana genomic DNA, chromosome 5, P1 clone:MBB18
  Pfam annotation: Domain name=PMEI; Domain location=138-266; Score =53.6; E_value=6.6e-13; Accession=PF04043.6; Description=Plant invertasepectin methylesterase inhibitor
  Pfam annotation: Domain name=PMEI; Domain location=3-130; Score=54.9; E_value=2.6e-13; Accession=PF04043.6; Description=Plant invertasepectin methylesterase inhibitor
  Pfam module annotation: Pfam domain module=PMEI::PMEI; Domain location=138-266::3-130
MEASKIDPILEYDFCVAFLSNKWHTPPSNLKDFVVTSIQQTKSNATNMVSIISNFLKNKSFDPYVKDCLRTCFDLYSDSVSALDNAVVAFKNKDFDTASTKVSVSLDSPVACQASFLRLISFFFLIALPLGRSSTTLNVPKDIINQTCQKCANQSIILSYKLCSTSLPTVPVSHSANLEGLALVAMELALENVTSTLAIIEKLLDSTSLDNSALGCLADCLELYSDAAWTILNSVGVFLSGNYDVTRIWMSSVMEAASTCQQGFTER

SEQ ID NO: 116951 - protein, 63 aa, Glycine max
  Coding DNA Sequence Number=SeqID_173
  Gene Ontology: Mol. function=nucleotide binding; Cellular component =membrane; Biological process=small GTPase mediated signal transduction
  Homolog annotation: Hit_ID=Q40525; Match level="QueryCoverage=60%, HitCoverage=18%, E-value=1e-14, Identity=100%"; Hit description=Nt -rab6 protein
MAPVSALAKYKLVFLGDQSVGKTSIITRFMYDKFDNTYQLQGRKWHIGEKQKTDSDSSVARVL

SEQ ID NO: 116952 - protein, 173 aa, Glycine max
  Coding DNA Sequence Number=SeqID_174
  Gene Ontology: Mol. function=nucleotide binding; Cellular component =membrane; Biological process=small GTPase mediated signal transduction
  Homolog annotation: Hit_ID=Q40525; Match level="QueryCoverage=99%, HitCoverage=69%, E-value=9e-58, Identity=70%"; Hit description=Nt -rab6 protein
  Pfam annotation: Domain name=Ras; Domain location=1-139; Score=50.8; E_value=4.4e-13; Accession=PF00071.12; Description=Ras family
DTAGQERFRSLIPSYIRDSSVAVIVYDVARTGTSQEVAFSNSPKHFDGQFLIVQHSCDIGRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSGSHDSQPQSGGCSC

SEQ ID NO: 116953 - protein, 251 aa, Glycine max
  Coding DNA Sequence Number=SeqID_175
  Gene Ontology: Cellular component=extracellular region; Biological process=sexual reproduction
  Homolog annotation: Hit_ID=Q850K7; Match level="QueryCoverage=90%, HitCoverage=89%, E-value=1e-86, Identity=66%"; Hit description =Expansin-like B1 precursor
  Pfam annotation: Domain name=DPBB_1; Domain location=59-137; Score =76.7; E_value=7.5e-20; Accession=PF03330.8; Description=Rare lipoprotein A (RlpA)-like double
  Pfam annotation: Domain name=Pollen_allerg_1; Domain location=149 -229; Score=18.0; E_value=7.8e-05; Accession=PF01357.11; Description =Pollen allergen
  Pfam module annotation: Pfam domain module=DPBB_1::Pollen_allerg_1; Domain location=59-137::149-229
MALSLLYPLLLATFLFMQTLADTSFVQSRAAFYPNSQENGTDVGACEFGSFGATVNGGDVSAASNLYRNGVGCGACYQVRCSNSALCSDNGVTVVITDSGSGHNTDFILSQRAFGRMALNTDAAASLLALGVLDIQYRRVSCSYPNKNITVKIHESSNNPHYLAFVIWFQQGSRDITAVQLCETQNFVCKLLDRSHGAVWTTTAPPSGPLTLRMLFSPEEEGEETWVVPVNNIPQDWKAGQTYDLGVQVDQ

SEQ ID NO: 116954 - protein, 44 aa, Glycine max
  Coding DNA Sequence Number=SeqID_176
  Homolog annotation: Hit_ID=Q8S7E5; Match level="QueryCoverage=88%, HitCoverage=6%, E-value=2e-08, Identity=72%"; Hit description =Putative phragmoplastin
MGERQLAWLLGEDSVLRERRQQCAQRLELYRSARDEIEAVCWSG

SEQ ID NO: 116955 - protein, 133 aa, Glycine max
  Coding DNA Sequence Number=SeqID_177
  Gene Ontology: Mol. function=transferase activity
  Homolog annotation: Hit_ID=Q2HSF9; Match level="QueryCoverage=53%, HitCoverage=13%, E-value=1e-11, Identity=57%"; Hit description =Polynucleotidyl transferase, Ribonuclease H fold
  Subcellular localization annotation: CTP_CleavageSite=44; ConfidenceScore=5.68e-01
MAGSTNSSAATTNNNTQNGTTTTQSNPVVFQLTFSYQQLSCLASASKFPSIWHEAVRLCGWIHSLPIARDHPGCHKGSQSVTKYLFFVKRIVDELSVIDHVQNTETSLHQYTQETVPSPLKNYSVIWLPTRNF

SEQ ID NO: 116956 - protein, 571 aa, Glycine max
  Coding DNA Sequence Number=SeqID_178
  Gene Ontology: Mol. function=GTPase activity; Cellular component =mitochondrion; Biological process=defense response to fungus
  Homolog annotation: Hit_ID=Q8S7E5; Match level="QueryCoverage=99%, HitCoverage=92%, E-value=0.0, Identity=75%"; Hit description =Putative phragmoplastin
  Pfam annotation: Domain name=Dynamin_M; Domain location=223-509; Score=268.3; E_value=1.6e-77; Accession=PF01031.10; Description =Dynamin central region
  Pfam annotation: Domain name=Dynamin_N; Domain location=38-214; Score= 292.8; E_value=6.5e-85; Accession=PF00350.13; Description=Dynamin family
  Pfam annotation: Domain name=GED; Domain location=515-571; Score =26.7; E_value=1.4e-05; Accession=PF02212.8; Description=Dynamin GTPase effector domain
  Pfam annotation: Domain name=MMR_HSR1; Domain location=36-215; Score =0.3; E_value=0.00093; Accession=PF01926.13; Description=GTPase of unknown function
  Pfam module annotation: Pfam domain module=Dynamin_M::Dynamin _N::GED::MMR_HSR1; Domain location=223-509::38-214::515-571::36-215
MDTLIALVNRIQRACTVLGDHGADTAALPTLWEALPSVAVVGGQSSGKSSVLESIVGRDFLPRGSGIVTRRPLVLQLHKVEQRQQEYAEFLHLPGKRFTDFSMVRKEIEDETNKLTGKSKQISPVAIHLSIYSPNVVNLTLIDLPGLTKVAVEGQPESIVQDIENMIHSYVDKPNCLILAITSANQDIATSDAIKVSRQVDPAGERTFGVLTKLDLMDKGTNALDVLEGRSYQLKNPWVGVVNRSQADINRNVDMIAARQQEHSFFTTSPDYSHLVSQMGSEYLARILSKHLESVIRTRLPGIASLINRNIDELEAELAHLGRPVAVDAGAQLYTILELCRDFERVFKEHLDGGRPGGDRIYVVFDYQLPAALRKLPLDRHLSLQNVKKVISEADGYQPHLIAPEQGYRRLLESSLHYFKGPAQASVDAVHFVLKQLVRKSIAETQELKRFPTLQAEIAEAANEALERFREDGKKTTLRLVEMESSYITVDFFRKLPQEVDKGKNPASSLLVDRYAEEHFQRIGSNVSSYVGMVSQTLRNTIPKAVVHCQVREAKRSLLDRFYAQLGKKEV

SEQ ID NO: 116957 - protein, 203 aa, Glycine max
  Coding DNA Sequence Number=SeqID_179
  Gene Ontology: Mol. function=transferase activity; Biological process= DNA integration
  Homolog annotation: Hit_ID=Q2HSF9; Match level="QueryCoverage=63%, HitCoverage=25%, E-value=2e-21, Identity=48%"; Hit description =Polynucleotidyl transferase, Ribonuclease H fold
MTFVGVVSMGLVWRLVHLVGLVVAELLSERGGEIGGVNGEVRSGSEGTVVPFEGEENGNSVSKNTTCLEMEGDQDEHAKGVEGIEWWIVLLLEWVMSVLLWVEGCTGHHYFDCASMSLALYDPSYKKKRGRGGGGKFSRSSTSIGQTCAITCCYFIWAIIMRVKVDVTKITCHMVACTCVKHPISGGCSGGSCKVGSRTLRQL

SEQ ID NO: 116958 - protein, 137 aa, Glycine max
  Coding DNA Sequence Number=SeqID_180
  Gene Ontology: Mol. function=nucleic acid binding; Biological process= transcription
  Homolog annotation: Hit_ID=Q1SUD8; Match level="QueryCoverage=61%, HitCoverage=16%, E-value=2e-25, Identity=64%"; Hit description=Zinc finger, CCHC-type; Zinc finger, SWIM-type
MANTLGNIEIQEIESINVMSMDTPLSFGEVMPRDASNDAEELNIQPCLGLEFESLEKTWLKEMGGKKPVSIITDQDLAIGAVIKKVFLETRHRLCLWHIRKEFPEKLAHVYHKRSTFKRELKRCIRESPCIDIFEEE

SEQ ID NO: 116959 - protein, 120 aa, Glycine max
  Coding DNA Sequence Number=SeqID_181
MEINKCKLGARRENRVSFLVLKREDRMRYRNYKRKHIQEVLGVYGANGKCSTPVLCLCQNMGLVSMSSHSNWRDHHVTLQVSKLIAIFNGNTHPLVIADGGTAISPLPLAGSIEKIDPLR

SEQ ID NO: 116960 - protein, 198 aa, Glycine max
  Coding DNA Sequence Number=SeqID_182
MGDQEEIQEQMKVDMSALKKQMASMMDAMLGMRQLMENNMATATAVSSAAEADPTLPATAHHPLPNVIRRDRSTLGHISNPYLGYNRVAYPYGLPPNYMPPVMRADAGHVPSPILEREPPRQSDKVHEDRIEYAQGDIDFYPPVPVEGADTQHTALAQPHGRTLKPPSTANILVHRRTAPGSGRTKETRSHRREIESY

SEQ ID NO: 116961 - protein, 94 aa, Glycine max
  Coding DNA Sequence Number=SeqID_183
  Gene Ontology: Mol. function=acyltransferase activity; Cellular component=mitochondrial membrane; Biological process=photorespiration
  Homolog annotation: Hit_ID=UPI00006B94D1; Match level="QueryCoverage =98%, HitCoverage=54%, E-value=2e-36, Identity=69%"; Hit description =hexapeptide transferase family protein
  Pfam annotation: Domain name=Hexapep; Domain location=13-30; Score =12.2; E_value=1.9; Accession=PF00132.14; Description=Bacterial transferase hexapeptide (three rep
  Pfam annotation: Domain name=Hexapep; Domain location=37-54; Score =13.5; E_value=0.8; Accession=PF00132.14; Description=Bacterial transferase hexapeptide (three rep
  Pfam module annotation: Pfam domain module=Hexapep::Hexapep; Domain location=13-30::37-54
DNVSIGHNAIVHGCTVQDNVLIGMGAIVMDDCLVEENSIIGAGSVVTQGTHIKSGEVWGGVPARKIKDISSQLLEGEVNRIADNYVKYSSWYKD

SEQ ID NO: 116962 - protein, 132 aa, Glycine max
  Coding DNA Sequence Number=SeqID_184
  Homolog annotation: Hit_ID=Q1XTV7; Match level="QueryCoverage=97%, HitCoverage=88%, E-value=9e-12, Identity=31%"; Hit description =Hypothetical protein precursor
MALASCGTKNMTDNLPKDISERPADENSKKYDEVQLEKAKAVVESEIAKEKCSNPEDWKIAPMGAKACGGPKFYIAYPKASEEQILPLIEGYNKKEAEFNTKYGITSDCSVIAEPKGIKCKNGKAELIFEGQ

SEQ ID NO: 116963 - protein, 74 aa, Glycine max
  Coding DNA Sequence Number=SeqID_185
MGSILSEPQRPFVGGCAKKGTDTVIDPPSPIKRHVKWKMTRTKKTGQMISEATKICWRSRRHRVPWSPMDVRMY

SEQ ID NO: 116964 - protein, 47 aa, Glycine max
  Coding DNA Sequence Number=SeqID_186
MATETSASDHASTTDEYVCECDCVLNSMQVFFMFLSWSQAYLSLPSG

SEQ ID NO: 116965 - protein, 691 aa, Glycine max
  Coding DNA Sequence Number=SeqID_187
  Gene Ontology: Mol. function=transcription regulator activity; Cellular component=nucleus; Biological process=regulation of transcription
  Homolog annotation: Hit_ID=Q2HRT7; Match level="QueryCoverage=97%, HitCoverage=97%, E-value=1e-117, Identity=40%"; Hit description =Basic helix-loop-helix dimerisation region bHLH
  Pfam annotation: Domain name=HLH; Domain location=462-511; Score =62.2; E_value=1.7e-15; Accession=PF00010.16; Description=Helix-loop -helix DNA-binding domain
MPLYELYRLAREKLGKETTSTRAPDQCSSPENDFFELVWENGQISSQGQSSRVRRSPSCKSLPSHCLPSHSPKARDKDVGYGSYTRLGKFGDLDSGLNEIPMSVPSSEVDFCQDEDVLPWLDYPSIDGSLQQEYGSDFLPASNSFTLLDKKSNGNMAFRDSQKTSEEQGNVFKGSSAGQVETARPKASSTSQLFPPSLHQCQTSFVSSRSRASDITENNNTSNANQDASYGKITHILSSSSDFSNAKVQKCDPPMNSNGSSSTIMNFSHFARPAAMVRANLHSIGLKSGLSSSRSDSMEMKNKGAAATSSNPPESILVDSSVECLKEPIIQCQQVVEQSKADVNSLLPKSVEQNAVPSKQSEPAGKESAAKIDLIPNQVPGDNGTKGQTAAEKSKEPAVASSSVCSGNGTDQGSEEPNQNLKRKRKDTDDSECHSEDVEEESAGAKKTAGGRGGAGSKRSRAAEVHNLSERKRRDRINEKMRALQELIPNCNKVDKASMLDEAIEYLKTLQLQVQIMSMGAGLYMPPMMLPAGMQHMHAPHMAPFSPMGVGMHMGYGMGYGMGMPDMNGGSSRFPMIQVPQMQGTHIPVAHMSGSTAFHGMARANPPGFGLPGQGHPMPMPRAPMFPFSGGQMPNVDPQVKQSTGGRDSTSQMPTQCEAAAVGFEQSTLAHNNGHATKANDNGSVNPGPGR

SEQ ID NO: 116966 - protein, 69 aa, Glycine max
  Coding DNA Sequence Number=SeqID_188
MDAESGERIAEKQCGRKKCLAVTQKRQTGTEKSEKFRGFYFLSSNHGLVKSCRGLSFSDPSRIKRSPSS

SEQ ID NO: 116967 - protein, 778 aa, Glycine max
  Coding DNA Sequence Number=SeqID_189
  Homolog annotation: Hit_ID=UPI0000381A60; Match level="QueryCoverage =60%, HitCoverage=45%, E-value=4e-14, Identity=23%"; Hit description =MJ0042 family finger-like protein
EDSVKEEKEVVPDSHTISDIEPVHQAPSTEQAVEKTLSQELEKEPVETDEEKQVQPKAEDVPEASASAVEKPSNTDETSPLTESEGEVVKEAQVLETSAQVEEQPETEAAPVQEKPEKEQPSTVVAVSEPVATEVEEKTEEPEKELQEAEKPSIVAVPEPVVTLVEEKTEEPEKESQEAEKPTTVAVPEPVATQVEEITEESSAVGVPEPSAEKKSSDTIEEKATGPSEDVVEETKNSETGPLETVEAEHVVPEVDESQTEPEKQSLEQKEEEEKQDTSAVPESSEESGDAIEVKTRELEFEAEVLKETNNSQTEKAEPVEAKVDENQSQTEKAEPVAAKVDENQSVIEKTELVAAKVDENQSEPEKQEEEEQPKTVVPEIEAESEEQLENIVEAYPPKDSVIEEVKDTDNGNSEPKAVPEKTEKPVLLSTEVEEKPREQLQVDEEVAEAGKEVETKQEIVLETAKSEETSAGTVTEEKTDKDEETSLTENAEQVLSNVEPQQNPGETSPEVVLETSKSEETSADTVTEEETTEKVVEEVDDKKESSITDVIEAVLNEAADIKKTPEQASIDEEAKTELKEEREISVPAAVEEKVAVAAIDDVDKKEPEAPNVSPESSQEEEFESKRVEEQNEAKAATTETVESVKVDNDSSIVDDKKEEKTDSKVEEISRAINEPVRETLASKFEEETVEPGADKVEKEQTVEPEKTEEVQATKESDATKTSKDLPKETPAKPAQKQSNNIISKVKQSLVKAKKAITGKSPSSKNLSSDAKGDIKVK

SEQ ID NO: 116968 - protein, 97 aa, Glycine max
  Coding DNA Sequence Number=SeqID_190
  Gene Ontology: Mol. function=chromatin binding; Cellular component =chromatin; Biological process=chromatin assembly or disassembly
  Homolog annotation: Hit_ID=Q1SAV4; Match level="QueryCoverage=56%, HitCoverage=14%, E-value=8e-10, Identity=54%"; Hit description =Integrase, catalytic region
MRMNIDREKIVVNTQAGFRDHDQAKDLLEAGLTNPSSHVVVESPCPQGGSFGIDPSSSPMKYHQEKVHSIEPAPPRDLLNKLFDNPGWLRDTQVVGH

SEQ ID NO: 116969 - protein, 127 aa, Glycine max
  Coding DNA Sequence Number=SeqID_191
MGTPPVNENSDAVVGDESRQSQCFWGQMARKGVQANLGLILGWAIGRVRSRGSSSSATSLAPGARSTLQVSGALVVVGNGEVTAKVVVTWRDALEKGKVVEDVAEKANDSPRASPPGDEPSRWPEPA

SEQ ID NO: 116970 - protein, 561 aa, Glycine max
  Coding DNA Sequence Number=SeqID_192
  Gene Ontology: Mol. function=RNA-directed DNA polymerase activity; Cellular component=chromatin; Biological process=chromatin assembly or disassembly
  Pfam annotation: Domain name=rve; Domain location=316-450; Score =47.2; E_value=5.6e-11; Accession=PF00665.16; Description=Integrase core domain
  Subcellular localization annotation: CTP_CleavageSite=26; ConfidenceScore=5.13e-01
MGWNRSLRRLPPFNNGLLHVPPRQLEASSGSSDFTGNSFEAVTTLESFQWSPQAQTAFENLKQALSTTPVLAFPDFTMPFTIETDASGVGMGAVLSQKGHLIAFFSNSFTSKLLGALAYVRGLCAITTAVKKWRQYLLGHHFVIITDHRSLKELLTRVIQTPEQHMYLTRLLGYDYEIQYRSGSHNQAVDALSRLPESESFLSMILSVPSLIFLEELRHQLEDNPEYRTLRHSLRENPQQHPNSPSFRIWCFTLVEFGYQGISQLLLYCLLNTIPLRQGATPKSLKPWHAYQKTFIGQVTKYEAQKMAGLLCPLSVPCRPWEDLSLDFIVELPPYQGNITILVAVDHFSKGIHLGILPTAHMAHMPASLFVNIVVKLHGIPRSLVSDRDPLFISRFWQELFHASGTLLHMSSSYHPQSDGLWGKLLPWVEWSHNTSWNAGTGATPYEVTFGRKPFNFPEYIAGSSNITAIEEMLTDRDDTFQAIRNKLLKAQENMKKQADGKRREMQYEIGDWVLLKLRPRRHTTVKGLKVLTGKLAQRYYEPFQVTERLGLVAYKLQFPE

SEQ ID NO: 116971 - protein, 60 aa, Glycine max
  Coding DNA Sequence Number=SeqID_193
MKNDVEVDYGRNSPPSHLFIAKDDIKGHGSSPKRVGARPGKLLLQPEVTLLAQGSWLLHP

SEQ ID NO: 116972 - protein, 125 aa, Glycine max
  Coding DNA Sequence Number=SeqID_194
MTPYPPTRELAKSHPIVAEGTQIMKIEEGSPIQALTICQASLDDEFDINPLNNTFDKRKTHRRAKNNSNREELRSARNVALNTRGIVLSAKCCAQHKSQPERNCAQCEKLRLAPKVDSILARRAH

SEQ ID NO: 116973 - protein, 86 aa, Glycine max
  Coding DNA Sequence Number=SeqID_195
GGDEFVKPPSMDKYCSVSRVVSSIDVRIAGLLSLSRPRAWTSDVWAASVRLSGVDMLLVLQARSDMCVWRTHNTLAYMSLVEWART

SEQ ID NO: 116974 - protein, 126 aa, Glycine max
  Coding DNA Sequence Number=SeqID_196
MAQNFKGPHHGPTVWVELERGHVQVLKKSTLESVQGENETPDLKQTPLHKKEGWTARHCPQEKEVVTPASLDDYLAGVLRICQLHLGNALTSPPLLLAPPEAEEGMITVTGIGSLAGEAGKGYVSL

SEQ ID NO: 116975 - protein, 479 aa, Glycine max
  Coding DNA Sequence Number=SeqID_197
MSSFMFDFVIDMGGSDYGGSIQQPLMNQEVISIGGSSSDDTCHVASDYEFSSSKRLRPFPASPAREPIPVTVIIPSSASGGARRSGGEVRAFPCMRCSHSGGSPSSSLVIVGYEWVKLANPEDSCKIVVQACGSDNFLFLRAVRGLVLPLNTFQCALLENLNMTSFQLHPNSWAMDRFFKVLATDVTANDLPLMFNRDGEPRFSFYWQSDPIRFKLFDEDLLTLVEKIEPTSGTVPPSAAATAPTTKEEDQPIVEVGLIIGAAKIASSAPSSILTKRKRDDGPSAPSTIEASTPTAIVTVTPAPPPPAMPSIVPTPLLSAGVATTSAPVMLPPSSTPPFPPSIVLAGASYKAKQKTSGGSALAKLLLTMLDGYELFEHCKVLQEEKKDLAGKVEGIAGKMNELAKEFELWAAMEREADKDVEEELLMYKKEVRFFVKDLDLGLFHPFKDGVLLDEEDIATEEEAGEEQGAEEQGNDATI

SEQ ID NO: 116976 - protein, 170 aa, Glycine max
  Coding DNA Sequence Number=SeqID_198
ALAPKMNGAKRSAEAGGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 116977 - protein, 124 aa, Glycine max
  Coding DNA Sequence Number=SeqID_199
  Gene Ontology: Mol. function=transition metal ion binding; Cellular component=cytoplasm; Biological process=fucose metabolic process
  Pfam annotation: Domain name=Transposase_21; Domain location=28-119; Score=-59.4; E_value=1.6e-09; Accession=PF02992.5; Description =Transposase family tnp2
MGPPAKVLWYLPIIPRFKHLFANEDDAKDLTWHANGRKYDGMVRHPANCSQWKKIDSLYPDFGKEARNLRLGLASDGMNPYSNLSTQHSSWPDLLAQPNTRVERASCAKPMIQQKRALSMQHAR

SEQ ID NO: 116978 - protein, 127 aa, Glycine max
  Coding DNA Sequence Number=SeqID_200
  Gene Ontology: Mol. function=nucleic acid binding; Cellular component= nucleus; Biological process=DNA integration
MTPIVKGDRFNLNQCPKNKLQREQMRNIPYASIVGSLMYAQTAAKKVLRYLQGTKDYKLIYQRSDNLEVVGYSNSDFVGCVDSRRSISGYIFIMANGAISWRSEKQSLVATSTMEAEFISLLEAATQ

SEQ ID NO: 116979 - protein, 96 aa, Glycine max
  Coding DNA Sequence Number=SeqID_201
  Gene Ontology: Cellular component=mitochondrion
  Subcellular localization annotation: CTP_CleavageSite=36; ConfidenceScore=5.18e-01
MDKLLFLGTHIRYHKKDNDIPSTQHRSSKGSRRPTNARKPGSFRKWIPIRRVHNRMDKLTLTRQFGIQFGSLGGIGKEFWNVIISIHTDTEERVLY

SEQ ID NO: 116980 - protein, 107 aa, Glycine max
  Coding DNA Sequence Number=SeqID_202
MVHNIPLLHGQEKVGVKEVKDAEAPIHVPTDEAAVSPATPPDRLHPEVNDPLNLMILTIPQLFLRPLQVMWDATVSGVFNQDFPLYIKHEDLSEIAHDGQCLSISVL

SEQ ID NO: 116981 - protein, 130 aa, Glycine max
  Coding DNA Sequence Number=SeqID_203
MDRVTSLLCLLPNTFRTADVPVYFQFHLDKDVMDHEVQKQMKADMEAMKEKMATMMEAMMTMKKIMEANAVIVATTSAVAKVNPMAPSGLNQMNQPTLAMVGKDLGSTGSPYYVQIQNKHAFPLYGWPPN

SEQ ID NO: 116982 - protein, 107 aa, Glycine max
  Coding DNA Sequence Number=SeqID_204
MDEDQWAYEYAMSQEVHMDYDYDNEEECGVTEPHVDCSNAFNTSQVFGTRDDVLQWARTVAHENGFVAVIMRSDTDTGSRGRSSFVLIGCERNGFVGNQCMEGKVGW

SEQ ID NO: 116983 - protein, 32 aa, Glycine max
  Coding DNA Sequence Number=SeqID_205
AGKHDNKLGMQVAPLSYLAPYETKELSQEHPT

SEQ ID NO: 116984 - protein, 68 aa, Glycine max
  Coding DNA Sequence Number=SeqID_206
  Gene Ontology: Mol. function=ubiquitin-protein ligase activity; Cellular component=ubiquitin ligase complex; Biological process =protein ubiquitination
MPMFKPPCKRDGVEGQILDLDTMAKDGVLGGGVDSGVGEKLDLAKMIEELDLGEVSSVFICSVSLEPI

SEQ ID NO: 116985 - protein, 88 aa, Glycine max
  Coding DNA Sequence Number=SeqID_207
  Gene Ontology: Mol. function=manganese ion binding; Cellular component=integral to membrane; Biological process=manganese ion transport
  Homolog annotation: Hit_ID=Q9S814; Match level="QueryCoverage=93%, HitCoverage=6%, E-value=6e-26, Identity=62%"; Hit description =Ethylene-insensitive protein 2
MEAETLNANHPPGFLHRSLPAVVPILLISIGYVDPGKWVAIAEGGARFGFDLMAFMLIFNFAAIFCQYISAKIGVITGKDLAQYNCII

SEQ ID NO: 116986 - protein, 1124 aa, Glycine max
  Coding DNA Sequence Number=SeqID_208
  Gene Ontology: Mol. function=transporter activity; Cellular component= membrane; Biological process=transport
  Homolog annotation: Hit_ID=Q6V397; Match level="QueryCoverage=98%, HitCoverage=83%, E-value=0.0, Identity=48%"; Hit description=EIN2
MAKWGGHDQSFPQTQLSQWHQGSTTISKDALCHNHFLAIMCVFSGLYLVNNVLMNAAANEFYSMGLVLTTFQDALSPMEQVLRSPIAMLAFLLILFFSNQTTALTWSFGGEVVVQSFLKLDIPGWLHYATIRVIAVLPALYCVWSSGAEGMYQLLIFTQIVVALQLPSSVIPLFRIASSRSIMGVHKIPQFVEFLALIIFIGMLGLNIVFVVEMIFGSSDWVGNLRWNVGTGVSLSYLVLLCTAFASFCLMLWLAATPLKSASVQLDDQQWNWDMPQAVPKSRIDNEETDLKETRYQGDASVQGKEPSPALARTLEYSDVPVASFHLDLPETIMEPDVPVTTVRETHPFTSFPCSPTSVKESASTSESEAVPAVSNETSDIILGHSKTLKTETTAPVEKTVEIEGDSNAERDDDDGDSWETEEIQKVVSLAPSSASDGPASFRSLSGKSDDGGNSIGSLSRLAGLGRGARRQLAAILDEFWGQLYGFHGQFTQEAKAKKLDVLLGIDSRLTGSLQRMDPCGKEYSEYLISVGSRAPDTLMNSAPYESPRQNRIQSNLDASYGPQRSSSSLRANPVQFMDEYVQTSSRNLLDAGERRYSSVRNLPTSAAWDYQPATIHGYQVSSYINQVGKDTNSDNLNGLRESPSMGNTNHYRNSMGNTNYRNSIAFALGKKLQNGSGLSQPPGFQNIAVSKNSQLPSERSYYDSRPSGPVDSTVSSVNAKKYHSLPDISGYAIPHRDVYMSDKSAPWDGSVGGYRSSASRTHYEPSLYSNSGSRTGAPLAFDVLSPSKAYSDELSSQLSSGFGTGSLWSRQPFEQFGVDDKIHNAATEDVGNRPSATTQETTSVVDIDGKLLQSFRQCILKLLKLEGSDWLFKQNDGADEDLIDRVAAREKFVYEIETTEMNRNHMGETRYLSSDGKSCSSMKNNEANWSSFSVTSIPNCGDGCVWRADIIISFGVWCIKRVLDLSLMESRPELWGKYTYVLNRLQDTALPFLLFKDTLGIIDLAFSKPRSPMTPCFCLQVPMTYQQKSGSPPSNGMLPPASKPGRGKCTTASVVFEMVKDVEIAISSRKGRTGTAAGDVAFPKGKENLASVLKRYKRRLSNKPVGTTQEGIRKIPTSAPYNL

SEQ ID NO: 116987 - protein, 70 aa, Glycine max
  Coding DNA Sequence Number=SeqID_209
MSELREIPFAPEKKESHEDSTSGDFNHFSVSLTFGNSIRAVGGKTEGILGNARDAAVTVGRHMSPLRGKG

SEQ ID NO: 116988 - protein, 149 aa, Glycine max
  Coding DNA Sequence Number=SeqID_210
  Pfam annotation: Domain name=zf-CCHC; Domain location=77-94; Score =28.8; E_value=1.7e-05; Accession=PF00098.13; Description=Zinc knuckle
MELQRLNQNEETDKKKRNIALKASSSMQEENEEEESEDEEDFSLFVKKFQKFVKKRRIERRQNFNNGRRSQEDSQILRCYKCNQLGHLKANCTSNKEWPEKSDKKRYEERRTKKAYIAWDDNDSSDGSEKEINLLTKDYESNENISQED

SEQ ID NO: 116989 - protein, 155 aa, Glycine max
  Coding DNA Sequence Number=SeqID_211
MAELERHNFHKHLNNLADSSIDLALVKEFYDNLYSPEGPSPKQVRIRGHLIRIDADNLNAILETLVVLAEGESLPDYSRYCRMPTDIREIKVSRCIPGRGFILNAEGHLGKILRKDLITLAQVWSVLSYSNLALTSHTLDLAVDRARLIFGLVLS

SEQ ID NO: 116990 - protein, 302 aa, Glycine max
  Coding DNA Sequence Number=SeqID_212
  Homolog annotation: Hit_ID=UPI00003979F6; Match level="QueryCoverage =49%, HitCoverage=100%, E-value=3e-24, Identity=40%"; Hit description= COG3238: Uncharacterized protein conserved in bacteria
  Pfam annotation: Domain name=DUF606; Domain location=79-220; Score =113.6; E_value=5.5e-31; Accession=PF04657.4; Description=Protein of unknown function, DUF606
LTPVKQADLILINAADLNLYPNGNAFGTVVHAAERSNIDTVMIGGRIVKQNGKVLARHLCGKIPAADPGKLTGNNSMSAVYYVIAFAAGLGITLQTTLNSQLAKGLGGDPVTAALFSFTAGAFGLGIYSLLRGGLFTSLAAIPSQPVWSLAGGLIGACALFSYVVLAPKIGFSALLGLAIVGQLLSSQVIDNFGLLGAIRRPVSLLKLGGMLVMLIGLAIMLFGDKLSALAADVRNLLGECPIWCERTRRIYWTDIEGSELLALEEDTSVVMRWSLPERLGSFALTENSDVLLMGLASRFAL

SEQ ID NO: 116991 - protein, 106 aa, Glycine max
  Coding DNA Sequence Number=SeqID_213
  Gene Ontology: Mol. function=amino acid transporter activity; Cellular component=membrane; Biological process=amino acid transport
  Homolog annotation: Hit_ID=Q9LZ20; Match level="QueryCoverage=62%, HitCoverage=11%, E-value=1e-09, Identity=55%"; Hit description=Amino acid transport-like protein
MHALLGSFNSGNWPNSDDLDRTGLSCCTIMRNRGEFVGYFAKANILMEYVFSNAAVSSSFTEYLSFAFGESDQNVWRVKVHGLLKDFNILDFPAVSYFLVTLLHVS

SEQ ID NO: 116992 - protein, 213 aa, Glycine max
  Coding DNA Sequence Number=SeqID_214
  Gene Ontology: Mol. function=4 iron, 4 sulfur cluster binding; Biological process=electron transport
  Homolog annotation: Hit_ID=Q87IC2; Match level="QueryCoverage=99%, HitCoverage=49%, E-value=1e-85, Identity=69%"; Hit description =Putative arylsulfatase regulator
MSPIVRIHRPVGDDRIQIPRFRPAAAGDGDRLFAPELRRGGFKLGGLYAGRKLDIGGAEFTGKKTIYLARETGIHPVNDCQRVERHAVALQCRDPFHNLIEGRLAAARHAEAIVDLARAIDRYPDQEVMRLQEGGPLIINQHAIGLQIVLNALVLRLIFLLQLNDLFEKLQSHQGWLAALPGENNLFAILALDVLTNKILQYLVAHSFVVRLM

SEQ ID NO: 116993 - protein, 50 aa, Glycine max
  Coding DNA Sequence Number=SeqID_215
  Gene Ontology: Mol. function=4 iron, 4 sulfur cluster binding; Biological process=electron transport
  Homolog annotation: Hit_ID=Q87IC2; Match level="QueryCoverage=100%, HitCoverage=11%, E-value=4e-16, Identity=76%"; Hit description =Putative arylsulfatase regulator
MGLPSQLCITAPFCGKALAIEKNGDVYSCDHYVYPEYKLGNIKAHKLAHM

SEQ ID NO: 116994 - protein, 143 aa, Glycine max
  Coding DNA Sequence Number=SeqID_216
MVVILPKENLVVWFCSLHNRLDNYLKGIINKSVLFFNTFALALLNNINILMFLVFNSALKGLDDTPQPKSKAGARWIVVKCNRQKGSIECGYYVMHWMSTIILGSFRNNWKMYFNDIRPLEVERLKALRIQWTQYYLKIRNQT

SEQ ID NO: 116995 - protein, 67 aa, Glycine max
  Coding DNA Sequence Number=SeqID_217
TPERTQHCIPRMPYVINDHHNTEHQNAPSPSCNLMVHRTKPIARKEALRTEERKEGDNAQMEALCHF

SEQ ID NO: 116996 - protein, 56 aa, Glycine max
  Coding DNA Sequence Number=SeqID_218
GNTGYNKDRRKSLKVYQSHTGQGLTFSPWVKVYDKLGFWLKACRTAGHDTCQGLAS

SEQ ID NO: 116997 - protein, 127 aa, Glycine max
  Coding DNA Sequence Number=SeqID_219
MSRNFTDCVTMGVKYLEVVKQGSHPNKQMIPGRNYGSKDKTLISFERNTIRPVNLPASGTCKNLENDQHRTTNIILILPNLFLSVDIRHRMTIICLCVPSDTIVSGWQKVQNDHNLSPHVFELAASG

SEQ ID NO: 116998 - protein, 221 aa, Glycine max
  Coding DNA Sequence Number=SeqID_220
  Gene Ontology: Mol. function=helicase activity; Biological process =viral genome replication
  Homolog annotation: Hit_ID=Q2R1R7; Match level="QueryCoverage=98%, HitCoverage=13%, E-value=6e-49, Identity=49%"; Hit description=AT hook motif-containing protein, putative
MMFAFTSTGIKLDKTSNNSRGPPTIRIQGQPCHRIGSLLPMPRKKPKFAQLYIFDTENEVQYRINAMSQYSRIQSHIVSALSHMLNQHNSHAKIFRMARDRLACDQANNIKLQLIAARGKDGRVYNMPNVLEIAALIVGDFHPGSKRDIIVETQNGELQRIHELHPSYLPLQYPLIFPYGEDGYRADILHRSTSSSKKRKRNRLTMREWFAYRLQSRSNKA

SEQ ID NO: 116999 - protein, 534 aa, Glycine max
  Coding DNA Sequence Number=SeqID_221
  Gene Ontology: Mol. function=binding; Cellular component=outer membrane; Biological process=pathogenesis
  Homolog annotation: Hit_ID=Q0BI96; Match level="QueryCoverage=90%, HitCoverage=40%, E-value=1e-82, Identity=30%"; Hit description=Outer membrane autotransporter barrel domain
SCGVIGDLVAIVKDRCRSGGDINQRTVQRFGADGATAVERERAAVEVRHGLATAGADAARTAGGVAAIDVDIAAVAGGGGEGAARAVHRDTGAAVADADIAAVAAGRPALHAQASGIGPAEVDVAAVAELRAVASQIAGNAVLRRIEFCGGSQPRAGDRRTAVSTGQRMFLPVGNRARGVAATEGNGGRRVNVALRTALDIDAGGTGAADVDRGVVGLHQCSATAGAVHRHRPRAGGGQRGVSPVKHRALFEAEERRVSGGDVKRVVVVHVDQRIRAIGKKTNLIAAGAEAGNGILRDVNRGVAARVHANRAVAGEVNRPVHVCCGSAAALAFHPHAKVARAAGRIGSARHVDGPGGAGGGAVTTGGQHFQAGAVNAVEVDGAAILQRTVAVSDQHADVLARHARSAAVDVDGAAVDQRGIAGTADRHPGGVLYARANHNRPVVGGAAVGQQRNAAGQPALVQGCLRHVVAQAVLRASPEVNRAAAVVGKSAAVAGEQHAGSGAARAGTVDAHVDIAAVSGLSMASRRMPATPL

SEQ ID NO: 117000 - protein, 216 aa, Glycine max
  Coding DNA Sequence Number=SeqID_222
  Gene Ontology: Mol. function=sodium:dicarboxylate symporter activity; Cellular component=membrane; Biological process=dicarboxylic acid transport
  Homolog annotation: Hit_ID=Q66FM7; Match level="QueryCoverage=71%, HitCoverage=35%, E-value=1e-71, Identity=90%"; Hit description =Proton glutamate symport protein precursor
  Pfam annotation: Domain name=SDF; Domain location=1-142; Score=-82.8; E_value=1.4e-06; Accession=PF00375.9; Description=Sodium:dicarboxylate symporter family
  Pfam annotation: Domain name=YcfA; Domain location=161-215; Score =45.7; E_value=1.5e-10; Accession=PF07927.2; Description=YcfA-like protein
  Pfam module annotation: Pfam domain module=SDF::YcfA; Domain location= 1-142::161-215
ELILAYSTSSSETVLPRIMQKMEAYGAPKAITSFVVPTGYSFNLDGSTLYQSIAAIFIAQLYGIDLSLTDEIILVLTLMVTSKGIAGVPGVSFVVLLATLGSVGIPLEGLAFIAGVDCIMDMARTALNVIGNALAVLVIARWENQFDTKQAAAYELQQVLSWELIRMLLERGWILDRVKGSHHVFVRADKPYHISLPHPEKDLATGTLRKLLKMMD

SEQ ID NO: 117001 - protein, 489 aa, Glycine max
  Coding DNA Sequence Number=SeqID_223
  Gene Ontology: Mol. function=protein-N(PI)-phosphohistidine-sugar phosphotransferase activity; Cellular component=membrane; Biological process=phosphoenolpyruvate-dependent sugar phosphotransferase system
  Homolog annotation: Hit_ID=Q1ZVV1; Match level="QueryCoverage=97%, HitCoverage=100%, E-value=1e-172, Identity=64%"; Hit description=PTS system, sucrose-specific IIBC component
  Pfam annotation: Domain name=PTS_EIIB; Domain location=10-43; Score =52.5; E_value=1.4e-12; Accession=PF00367.11; Description =phosphotransferase system, EIIB
  Pfam annotation: Domain name=PTS_EIIC; Domain location=121-406; Score= 152.0; E_value=1.5e-42; Accession=PF02378.9; Description =Phosphotransferase system, EIIC
  Pfam module annotation: Pfam domain module=PTS_EIIB::PTS_EIIC; Domain location=10-43::121-406
MAAITESLLRDILQAVGGAGNVVHCGNCMTRLRLTLADAARVDSARLKTLPGVLGVIDSDAQLQIVLGPGKAQTAAEKMQAMLNSATPEAPGDLHSIASAQKQQMKAKQTSALHRFLSCFATIFTPLIPGFIGAGLLLGFATLIEQVCHLNQPGEHARWLLDTVAYMKVFGKGLFTFLSILIGYNAQKAFGGTGVNGAIIASLFVLGYVPNATVGYYSGMQDFFGLTIDPRGNIIGVLLAAIFGAWLEKQLRKIIPDNLDMILTSLLTLVITGAVTFLVIMPIGGELFKGMSWLFIHLNNNPFGCAILAGLFLIAVMFGIHQGFIPVYFALMETQGFNSLFPILAMAGAGQVGASLALWFKADKHSLLRSQIKGAIVPGLLGVGEPLIYGVTLPRLKPFITACFGGALGGFFIGLVAWLGLPVGMNTVFGPSGLVTLPLMTSSQGIFAGMAVYLVGLIVAWIGGFVFTWWGGTENVDLSSKSLRQQTVK

SEQ ID NO: 117002 - protein, 109 aa, Glycine max
  Coding DNA Sequence Number=SeqID_224
GTSFVVQVEGTSTWVVVTKNKRGYISCRSVLVEGTSTRLFKENKGGYIPCGSLISGANSSYTMVDYTYDVVVIGAGGAGLRAAIGVLEHGFNTACITKLFPTRSHTVVA

SEQ ID NO: 117003 - protein, 151 aa, Glycine max
  Coding DNA Sequence Number=SeqID_225
GVCMRIFHKGVCVCVCDEGYVCVCGVCVCVYAMTVCVFGQLLQFRTQGPQYPPMVKQGLYYSILTLDDEVQSHYQLGNIGKPLHSMNLDEVSRFMDTPLKQQPSLGENLENFLAPAGVINVGDHQDHNVNVVIGDAFTAGTLVANANSFSY

SEQ ID NO: 117004 - protein, 76 aa, Glycine max
  Coding DNA Sequence Number=SeqID_226
MAQINRYFRRGRSALRSLGRMLLSRNIIYICVRVVMLVRMIHTRLFAAARVESCPVGPPPGSGGGPEADKRKLLAP

SEQ ID NO: 117005 - protein, 240 aa, Glycine max
  Coding DNA Sequence Number=SeqID_227
SLEEISFENNDSEIGTQTMSKDVMSETKPSSEDILLSAEGDGQGHRVTVAQWTEGQYHSNKPQVNNWKLLTRAHEWVIFDTYSGQREQRPKQPRTDKSEKIQAQGAVDESNHTSNCLKENEDKINKDDREGTNKGDRKDPCVGLQNIEGGGLSMGLSKYTLHDKTKGAEGNVNCEQKGPRHMEKLYLRSRGCRKQLAHGHTIGLLTKSNNNAHNEVNNVIENRDNLSPAMRGSGLKEVAE

SEQ ID NO: 117006 - protein, 92 aa, Glycine max
  Coding DNA Sequence Number=SeqID_228
RAQLAQAGLLPPEGPSGPGNFMDYATMPFLTSGMLRNFTDCATMLPFDFRHVAELHGLPNNGPFAKRLLLAKRIITHALSRVLQRLAHHPGT

SEQ ID NO: 117007 - protein, 53 aa, Glycine max
  Coding DNA Sequence Number=SeqID_229
MFMPTTTKLMPPSMMVDATERGISSAHDGSTSTGIVSPKSEDKGDDDKGKDEE

SEQ ID NO: 117008 - protein, 82 aa, Glycine max
  Coding DNA Sequence Number=SeqID_230
MTILMRQSSTSTREDKVETIDKDGKGHTRVTRGCKDQRWHKRRLREIVKWKWHRRIDLLEIEDEDIEIEDEDGETRAAPLQG

SEQ ID NO: 117009 - protein, 188 aa, Glycine max
  Coding DNA Sequence Number=SeqID_231
  Gene Ontology: Mol. function=nucleic acid binding; Cellular component= intracellular; Biological process=DNA integration
  Homolog annotation: Hit_ID=Q1RXN8; Match level="QueryCoverage=99%, HitCoverage=36%, E-value=1e-31, Identity=67%"; Hit description =Peptidase S8 and S53, subtilisin, kexin, sedolisin; Integrase, catalytic region; Zinc finger, CCHC-type
MNNNILERVRCMLLGACLPKSFWGEAVNITVYLINRCPSSALESRTLMAIWSGIPTNFSNWRVFGALAFAHVKQDKLKAQVVKCTFIGYTDGVKGSKEKARFEVESPTHDSKDDYRIRSNEALDREKNDILIASSSKDEISMLKKRLSLEFEMKDLGIARRIPRMDIVRKRGIVLISTRLFEEGSGKV

SEQ ID NO: 117010 - protein, 94 aa, Glycine max
  Coding DNA Sequence Number=SeqID_232
MRGERSCVESSSSDSRRDSMWLYGIEKEQGKVHNWWERVMRESAVWEGIYKEWRRGESKFRSLWSISGKEKAIGEYYRGNFVKCVPWTRVRAGD

SEQ ID NO: 117011 - protein, 66 aa, Glycine max
  Coding DNA Sequence Number=SeqID_233
MHGGITSVVTRGRCRQDEWQDSCHLDAASQSSETPVDAASRSSETRDVNSVSPTDLASGAAMRQQL

SEQ ID NO: 117012 - protein, 61 aa, Glycine max
  Coding DNA Sequence Number=SeqID_234
  Subcellular localization annotation: CTP_CleavageSite=40; ConfidenceScore=5.26e-01
MAGVGRYMAPTDIFQPTLRNFFYKRWPIMFFYLRTARFFRASSTEGSFRPTLACCSSHLGG

SEQ ID NO: 117013 - protein, 112 aa, Glycine max
  Coding DNA Sequence Number=SeqID_235
  Gene Ontology: Mol. function=endonuclease activity; Biological process=response to DNA damage stimulus
  Homolog annotation: Hit_ID=Q7N124; Match level="QueryCoverage=93%, HitCoverage=46%, E-value=4e-42, Identity=78%"; Hit description=DNA mismatch repair protein mutH
  Pfam annotation: Domain name=MutH; Domain location=58-112; Score =25.2; E_value=2.1e-05; Accession=PF02976.5; Description=DNA mismatch repair enzyme MutH
MAFLSPLPPPPENERQLFERAQALAGASFGELAARAQLPIPKDLKRDKGWVGMLLELYLGAMAGSKPEQDFPELGIELKTIPVDAAGKPLETTFVCVAPLTGNSGVTWANSH

SEQ ID NO: 117014 - protein, 71 aa, Glycine max
  Coding DNA Sequence Number=SeqID_236
MFNDAILSPKGIELKTTRGWVPSLGRLHQGRFLSPWAKDLIEAQRSSLHRSFSSKLPSIGIRAQELQVGAP

SEQ ID NO: 117015 - protein, 75 aa, Glycine max
  Coding DNA Sequence Number=SeqID_237
MRVRARLWGLRKDFEPREVRWLRGVDAREVVDGEDYQVRTWGVRGEEGVVEPLAKVVHSLNRMRVRDRGRVRRVI

SEQ ID NO: 117016 - protein, 123 aa, Glycine max
  Coding DNA Sequence Number=SeqID_238
  Gene Ontology: Mol. function=heat shock protein binding; Cellular component=integral to membrane; Biological process=protein folding
  Homolog annotation: Hit_ID=Q5QMD6; Match level="QueryCoverage=88%, HitCoverage=19%, E-value=3e-13, Identity=41%"; Hit description=DNAJ heat shock N-terminal domain-containing protein-like
MEGDEELLAQTKVKVEPKRNEWMTKLPLERKVEVILVFGQTPLWTGPESKDEVCILFHSRMICYLEAYNEATALASNEEDKKRASVDAELVEKYNKAKWSKTLVQKYQEEVASKSKKKSKELM

SEQ ID NO: 117017 - protein, 55 aa, Glycine max
  Coding DNA Sequence Number=SeqID_239
MDSRSPQVILLRMDSSASGTRMDEADATTTKMNEAISLIASYKLEGDHHNTSNLG

SEQ ID NO: 117018 - protein, 196 aa, Glycine max
  Coding DNA Sequence Number=SeqID_240
  Gene Ontology: Mol. function=catalytic activity; Biological process =metabolic process
  Homolog annotation: Hit_ID=Q8H2B0; Match level="QueryCoverage=48%, HitCoverage=12%, E-value=6e-44, Identity=88%"; Hit description=Beta -amyrin synthase
MAWIGYPDKNFKLRVETSEFDPEADTPEERAQVEAACQHFYHNRFKAKPCADLLWCFQVLRENNFKQTIPSVTIEDGEEITYQKVTSAIRRGAHHLATLQTTDGHWPAQIVGPLFFLPPLGFFHGACKKGVQIEILDEGGLILGEENGRKETTCKECVEAMLSKFILMMPKTQVKNQESKQILRIKESFNQESRFK

SEQ ID NO: 117019 - protein, 76 aa, Glycine max
  Coding DNA Sequence Number=SeqID_241
MESGDMRGYLMVIRTFRQPGANEPVDTQRLTSSSAPFGHPGTASWVAGRDTLWFYSPRPETFKPDDARGSAGRDID

SEQ ID NO: 117020 - protein, 38 aa, Glycine max
  Coding DNA Sequence Number=SeqID_242
MLLQGIKMIAVMKGGKVEPDFAWCKEGCRKGSGVIHWC

SEQ ID NO: 117021 - protein, 103 aa, Glycine max
  Coding DNA Sequence Number=SeqID_243
MQSSEFETEKEAVQDCCSILQKTAHQIYGDPTKFGLLLNPGAWGIVINGDLTNPELVGGLTSKISSPIPIKIDETRVLNPPSSKPSPLLEFQCYCVILSPFHY

SEQ ID NO: 117022 - protein, 192 aa, Glycine max
  Coding DNA Sequence Number=SeqID_244
  Homolog annotation: Hit_ID=Q1SMF0; Match level="QueryCoverage=75%, HitCoverage=31%, E-value=3e-12, Identity=31%"; Hit description =Tetratricopeptide-like helical
MDAGNWELPSGLFFTNYGLPKFYFFLGPQTTYFGVLLGAPSSIADLEKSLEFVLVIHMSENGKKIYVVVDCEIGGMYKQYKDKLVRKSIGTIKCRCPFKLKEKFFRELGKHCWDMRIMVVLINVEKIMLLQMTKKMVKPGQILLKSKIKMPKNVTTIKTVYNERQRYWRKQVDPRTEVQHLLKLIECDQYVY

SEQ ID NO: 117023 - protein, 81 aa, Glycine max
  Coding DNA Sequence Number=SeqID_245
MFVNHQVNEVEKSFNAHNEEIRPVTVVSSLPSSSLGFVIAVGVHDRWGSLESDFNIQHQHQHCTFSILGTGTPIVHSFSVR

SEQ ID NO: 117024 - protein, 126 aa, Glycine max
  Coding DNA Sequence Number=SeqID_246
MSKLKDELKKAEDSLASAISANITLVEDNSDLKARDATLELESKGLETHAMNIEDSAKLNVEEVDRLKTSLALIEKNGDVEKEEKVRIEQKAYDDMYEMMGGTNEDENDGDEEGEVHWNVGRDEDS

SEQ ID NO: 117025 - protein, 166 aa, Glycine max
  Coding DNA Sequence Number=SeqID_247
MHELNPSMNSNLVEILKSEASKGKARKRSNCSKAFLWLTRVGKKNTNTQEFYTGSATTRAYIQSPSDLWSLRFLFNLVNSFTSKDQKGMYPPLFSLNNLVDVPSTRTDPQEMYPLLFSVTTTQVDVPSTCTIKDVPSNVLRQSSQAVSPLKLCEWGNKRILRRLVL

SEQ ID NO: 117026 - protein, 99 aa, Glycine max
  Coding DNA Sequence Number=SeqID_248
MVIDYIFVNHFEKQCWLLVIGYYLLSHVQSGGYECGYYVMHWMWNIVAGQHKNDWTLWFGDEKPLNMDNITKLRKVVVNMRTIALMYILLVETGSKGHI

SEQ ID NO: 117027 - protein, 79 aa, Glycine max
  Coding DNA Sequence Number=SeqID_249
  Homolog annotation: Hit_ID=Q1RXS8; Match level="QueryCoverage=32%, HitCoverage=4%, E-value=3e-09, Identity=100%"; Hit description =Multicopper oxidase, type 1
MVIISPSLMAFLSMDVVGMETPSLLIKIWPVATYPSAGGRRVTRGMRVPRKEYARSRHQRLFEENVGKTGKRRDLRTFK

SEQ ID NO: 117028 - protein, 112 aa, Glycine max
  Coding DNA Sequence Number=SeqID_250
  Gene Ontology: Mol. function=oxidoreductase activity; Cellular component=cellulose and pectin-containing cell wall; Biological process=lignin catabolic process
  Homolog annotation: Hit_ID=Q1RXS8; Match level="QueryCoverage=73%, HitCoverage=15%, E-value=4e-37, Identity=81%"; Hit description =Multicopper oxidase, type 1
  Pfam annotation: Domain name=Cu-oxidase_3; Domain location=8-94; Score=44.6; E_value=3.4e-10; Accession=PF07732.5; Description =Multicopper oxidase
MELNSPVMWGSCKILMVLYEDILKCNIFKNGLQHRRNSWQDGVYGTNCPIPPGRNLTYAIRVKDQIGSYFYFPSLGMHKAAGAFGGIRIWSRPQILVPFPSPVEDITILAGD

SEQ ID NO: 117029 - protein, 47 aa, Glycine max
  Coding DNA Sequence Number=SeqID_251
MDNYKGSMNYILAIYLYNTLSYFLTGKMDIDLIFYIAVDQMATVQIK

SEQ ID NO: 117030 - protein, 64 aa, Glycine max
  Coding DNA Sequence Number=SeqID_252
MKRTEIDQSQQECYAPQKNKVDDQGDERQGGIGAVGAPEGPWRQWPAAAVVEEDPFRFFDDSTI

SEQ ID NO: 117031 - protein, 69 aa, Glycine max
  Coding DNA Sequence Number=SeqID_253
  Subcellular localization annotation: CTP_CleavageSite=45; ConfidenceScore=5.47e-01
MSLPSAVHVSPLSSAKPLVTGKHVILLFSRSVPSPKEKGVETRVVITERQGGRNQCPIFAFLLSPMRGK

SEQ ID NO: 117032 - protein, 78 aa, Glycine max
  Coding DNA Sequence Number=SeqID_254
  Subcellular localization annotation: CTP_CleavageSite=37; ConfidenceScore=5.32e-01
MRVHCNQASRRPSMTTDSPPLFMFPWTRKSPVESPTVATYPSAGGRHETRGGIFQGRKTHRVATTVYSRKTSKKPEKA

SEQ ID NO: 117033 - protein, 232 aa, Glycine max
  Coding DNA Sequence Number=SeqID_255
MATMMEAMMSMKKIMEANAVTVATTSTVAKVNLMPPSGLNQMNPPTSDMVGKDLGSTGGPHDVQIQNEHAFPPYGLPPNYTPPSVAYTPSENVNNSTPILIESRQPQSNHAHVSQPIGETHEIPHHNLADFEPCLGYATEGQVVGGILLQNTLEGPQFHPQPHPLAFHNGAIEGGEDYAFANLEELFLVPNIITPPKFKVLDFDKYKGTTCPKNHQKMHCRKMGHTQKIRNY

SEQ ID NO: 117034 - protein, 127 aa, Glycine max
  Coding DNA Sequence Number=SeqID_256
MDGVHKFDERPNAYNKIINMNWVLLIEDIMLKSRRLVDYEYPYVVLASRLIDYFNDDVSNEIVDFTKVASEIIKRHLKKLGMRFVDHEWIMAGEPTIGNFDQMEEDDKAEAPQELAHQWSPFKSLMI

SEQ ID NO: 117035 - protein, 74 aa, Glycine max
  Coding DNA Sequence Number=SeqID_257
MTKLGLCLSSGPPPLDDKRVRITVRMTKLGLCLSSGPPPLDDKRVRITVRYLRVSWVQNDQTWSLLVIGPAASG

SEQ ID NO: 117036 - protein, 59 aa, Glycine max
  Coding DNA Sequence Number=SeqID_258
MDFEICHIMQKNVVELCSRIFQHVQKMLVHCWLWESVERNEDKGYVGVRELNLKVGNWG

SEQ ID NO: 117037 - protein, 75 aa, Glycine max
  Coding DNA Sequence Number=SeqID_259
MPFRDLKSARKRTAFSGKRDELAKRACCAKRVHQYSFCIKVFSEELAKRTHRAKRVCPVRMNTHPLAGLPVAKRC

SEQ ID NO: 117038 - protein, 65 aa, Glycine max
  Coding DNA Sequence Number=SeqID_260
MFAYSPFAKRKLRAKHIFGHALSRESLALSSPPLHLRLIWSSKLAKAELSPFQFDLNWAKRWPAR

SEQ ID NO: 117039 - protein, 48 aa, Glycine max
  Coding DNA Sequence Number=SeqID_261
MVKYRPKSNIEMNRGTRGRARMDARPVINRLLSRIQLRTIKKRYREVA

SEQ ID NO: 117040 - protein, 143 aa, Glycine max
  Coding DNA Sequence Number=SeqID_262
MAPTRHPLDLEKSNRALGFPALITGLCQSYGVPITPSKAQGDAHQDAGAPPPPQLADSAGPLGVERIYSIWFASRRPTTVDSCRYTSVSTGSASFGAEVAWPGDWPDAQAGEEPAGSPGEADESRMDEDMTDLVGFLGGSEAT

SEQ ID NO: 117041 - protein, 181 aa, Glycine max
  Coding DNA Sequence Number=SeqID_263
MPISPYRCISWDHTHKTPSGPEEVQQGPGVSSSGGGPLSVLQGARSPSKESHPQRDSVDPEKSNRALGFPALVTGLCSPTGCPFPPARSRHHDIGKDRARKTPSGPKKSNRVLELPSSNYGPLSVLTECLSPPTNQAFIKKYCIPRQAQGESPQQPGDGWQRATDAPPSPLEFTSAHPQKG

SEQ ID NO: 117042 - protein, 90 aa, Glycine max
  Coding DNA Sequence Number=SeqID_264
MTSEAAKQIADKIDVLTTVIGQPEYPSRVRAVGASVTIKQYFELAPRTSRTSSSMAPEDLEQLTQQIRDQLEESITEKVTRQLMLSFSQM

SEQ ID NO: 117043 - protein, 226 aa, Glycine max
  Coding DNA Sequence Number=SeqID_265
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=54%, E-value=1e-121, Identity=95%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTAIGIMDFQFMGASMGSAVGEKITRLVEYATNQLLPLILVCASGGARMQEGSLSLIQMAKISSALYDYQKNKKLFYVSILTSPTTGGVTASFGMLGDIIIAEPNAYIAFAGKRVIEQTLNKAVPEGSQAAEYLFHKGLFDSIVPRNLLKGVLSELFQFHNFFSLTKNDKA

SEQ ID NO: 117044 - protein, 142 aa, Glycine max
  Coding DNA Sequence Number=SeqID_266
  Subcellular localization annotation: CTP_CleavageSite=87; ConfidenceScore=5.24e-01
DVIILHEIRRPNSLKTVPSGVANCCNLPFGGRVTRGLTGASSKKGKCAESPPMFSRGKRRKNRKDVVDKSGTFAPTYPPSKRKSDLRSSRKSSKRSMIDATSGGALGDITPVEARNLIEKMAPNSQQFSARNDAIVLRGVHE

SEQ ID NO: 117045 - protein, 181 aa, Glycine max
  Coding DNA Sequence Number=SeqID_267
MARRDKNWSFCTLCHPEAAGPMTCGDKIWSFCTPLPFRHSRVRWRAETKIDTAVSDGAQRQKLVILHPLSSSGGGPDDMQRQNLVIPHPFAIQTQPCPMARRDKNWSFCTLCHPEAADPMTCGDTLRSFRTPLPIQTQSCPMARRDQVWSFCTYDTRRYFMVIRTHSFAICKTERLIACRG

SEQ ID NO: 117046 - protein, 416 aa, Glycine max
  Coding DNA Sequence Number=SeqID_268
  Gene Ontology: Mol. function=protein binding; Cellular component =membrane; Biological process=defense response
  Homolog annotation: Hit_ID=Q1SW19; Match level="QueryCoverage=98%, HitCoverage=44%, E-value=1e-93, Identity=45%"; Hit description =Disease resistance protein
  Pfam annotation: Domain name=LRR_1; Domain location=295-316; Score =6.9; E_value=15; Accession=PF00560.23; Description=Leucine Rich Repeat
  Pfam annotation: Domain name=LRR_1; Domain location=318-339; Score =8.4; E_value=7.6; Accession=PF00560.23; Description=Leucine Rich Repeat
  Pfam annotation: Domain name=LRR_1; Domain location=341-362; Score =13.3; E_value=0.89; Accession=PF00560.23; Description=Leucine Rich Repeat
  Pfam annotation: Domain name=NB-ARC; Domain location=2-180; Score= -32.1; E_value=3.1e-08; Accession=PF00931.13; Description=NB-ARC domain
  Pfam module annotation: Pfam domain module=LRR_1::LRR_1::LRR_1::NB -ARC; Domain location=295-316::318-339::341-362::2-180
MKIWDHIESAVIDNKNGSRILITTRDEKVAEYCRKSSFVEVHKLEKPLTEEESLKLFCMKAFQYSSDGDCPEELKDVSLEIVRKCKGLPLAIVAIGGLLSQKDESAPEWGQFSRDLSLDLERNSELNSITKILGLSYDDLPINLRSCLLYFGMYPEDYEVKSDRLIRQWIAEGFVKHETGKTLEEVGQQYLSGLVRRSLVQVSSFRIDGKVKRCHVHDLIHDMILRKVKDTGFCQYIDGPDQSVSSKIVRRLTIATDDFSGSIGSSPIRSILIMTGKYEKLSQDLVNKFPTNYMVLKVLDFEGSGLRYVPENLGNLCYLKYLSFRYTWITSLPKSIGKLQNLETLDIRDTSVSEMPEEISKLKKLRHLLADYRCSIQWKDIGGMTSLEEIPPVFIDDDGVVIREVGKLKQLRELWV

SEQ ID NO: 117047 - protein, 179 aa, Glycine max
  Coding DNA Sequence Number=SeqID_269
  Gene Ontology: Mol. function=nucleic acid binding; Biological process= DNA integration
MTAKKSRSGKVVDEGGEVPYPVVPSKKEKDRHLARFLDIFRKLEITMPFREALQQMSLYSKFLKDMLTRKHTYIHQKNIIVEGNCSAVIQKILPPKHKDHGSVMIPCSIGEVNVGKALIDLGASINLMPLSMCRRLGELEIMPTQMTLQLVYRSITRPYGVIEDVLVRVKHFIFPANFM

SEQ ID NO: 117048 - protein, 50 aa, Glycine max
  Coding DNA Sequence Number=SeqID_270
MEREAIATLKPALDETLCSNKLNSLGKFKNEGSTCLLLDLISLHRHCRLL

SEQ ID NO: 117049 - protein, 110 aa, Glycine max
  Coding DNA Sequence Number=SeqID_271
  Homolog annotation: Hit_ID=Q1SKD7; Match level="QueryCoverage=97%, HitCoverage=27%, E-value=4e-07, Identity=29%"; Hit description =Ankyrin
MAPKKLSAKRSRRDAAAEGTSASPEFDSHRFRSAVHQQCFEAIKGWSFHRERCVQLRDDEYTDFQEEIARRHWTSLATPMAKFDPEIVLEFYANAWPTKDGVRDMRSWVR

SEQ ID NO: 117050 - protein, 167 aa, Glycine max
  Coding DNA Sequence Number=SeqID_272
  Gene Ontology: Mol. function=nucleic acid binding
MKGRNDSQCLLLLLLAFAFHKELYSLETSTDNFVANIENNPKEECNVIFIRSQRIEDTEREKRSKGVLEYTKSQLAMKTRKEIPSVPMKDISYPLVPSKKDKKRYFVRFLDIFNKLGITIPFREALQQMPLYTKFLKDFLAKKGKYINDENIMVEGNCSVMIQRILP

SEQ ID NO: 117051 - protein, 139 aa, Glycine max
  Coding DNA Sequence Number=SeqID_273
MVIMVIGIGGDIGGGGDADGGDSGNMVVVVTWCCWWQQVVVVVVASMLVVVVVAVTMTKCGWVVTTTLVEIVMLFVAVTLMMVVMKSIAIVVMVTTNYGRDNNSVGSDNDDNDDGDDNDGDGNDNDEDGNDSDNRKYQM

SEQ ID NO: 117052 - protein, 563 aa, Glycine max
  Coding DNA Sequence Number=SeqID_274
  Gene Ontology: Mol. function=RNA-directed DNA polymerase activity; Cellular component=chromatin; Biological process=chromatin assembly or disassembly
  Pfam annotation: Domain name=rve; Domain location=219-364; Score =44.2; E_value=4.3e-10; Accession=PF00665.16; Description=Integrase core domain
  Pfam annotation: Domain name=zf-H2C2; Domain location=191-232; Score =18.9; E_value=0.0011; Accession=PF09337.1; Description=His(2)-Cys(2) zinc finger
  Pfam module annotation: Pfam domain module=rve::zf-H2C2; Domain location=219-364::191-232
  Subcellular localization annotation: CTP_CleavageSite=32; ConfidenceScore=5.11e-01
MDASGVGMGVVLSQKGHPIAYFSKPFSPKLLRSSTYVRELFAITAAIRRWRQYLLGHRFIIITDHRSLKELLTQVVQTPEQHMYLVRLMGYDYEIHYRSGAANQATDSLSRIPKFESSIALMLSVPSLSFMDELRTQLHRHPDYIRRHRDIVNNPANHPGFFVVNNLILYRHRIWLPRDVPIISTLLTEYHTTPTGGHSGVAKTIARVSENFYWLGLRDDVVTFVSNCFDCQSTKYEAKKFAGVHLGMLPTTHTAFMVATLFLEMVVKIHGVPQSLVSDRDPLFLSKFWQELFRRSGTHLRMSSAYHPQSDGQTEVINHVIEQYLCSFVHRHPRAWGKLLPWAEWSHNTSWNSATGATPYEITFGRKPFNFPDYLAGTSSNDAIDTMFNEREETFLMIRKKLLKAQETMKRKADAHRREVTFLPGQWVLLRLRPHHQVSAREHPHIFGKLAKRFYGPFQFTEAIGKGLSPDETSWEDWSTLRQDYHLEDRVLSQGPKGDTGKKITETSSNTGQPIIEASNEHEEEWDKPIGCSLEPFMHVGDNVNKLYPEYSKGIAILLAELV

SEQ ID NO: 117053 - protein, 131 aa, Glycine max
  Coding DNA Sequence Number=SeqID_275
MAFANSRIAHKWVLFSNIHSLIRKSHSVIVYLFIKWNGGQVGYLIRRANASWVQPKWGASAVQLDPNTWVLEYQRSYIFDGTRLYSAALEFLKYRISRIVARLKKDFWLFVAFEDKQYNGFTVNNGPQIPT

SEQ ID NO: 117054 - protein, 65 aa, Glycine max
  Coding DNA Sequence Number=SeqID_276
MFHFLPLPPPSFSFCHRDAQRPSKEEIFRVLILIQESILHQEDICATFIVRSLQDQILSTRSLML

SEQ ID NO: 117055 - protein, 65 aa, Glycine max
  Coding DNA Sequence Number=SeqID_277
MWYHGDQSGSRCFARMLQPCGIGTGLKEHSNWVTPKTYTLKSSLGPLPPDSGPTPKIIFASRHCS

SEQ ID NO: 117056 - protein, 60 aa, Glycine max
  Coding DNA Sequence Number=SeqID_278
MEALIETLRCAIYGGAHNSGCCIPNEELGREVSYMGNQPRQNFNAGGYFGFQHGQPYNSQ

SEQ ID NO: 117057 - protein, 113 aa, Glycine max
  Coding DNA Sequence Number=SeqID_279
MTTLTQIWMTLLLSNIQPSDHNSDLPLPNFQLVYAILTRMSIHVAQLIVDVIYLFVGMAPTRHPLDPDKSNRALGFPALITGLCQSFGVPVAPRKTKEEEHEVQTCIKELDGA

SEQ ID NO: 117058 - protein, 128 aa, Glycine max
  Coding DNA Sequence Number=SeqID_280
SSVGPTVLLIVSSPHRTGILLRLYRLRRLETPSFSRVTDVLCSHKDLRFEPNLGVVLNAKHGASVRLAGSVNYFALHALSSNKVWVFAVKDDDDGGLRLMRCAVIECTRPVFSVNVAFGFLILGEENG

SEQ ID NO: 117059 - protein, 162 aa, Glycine max
  Coding DNA Sequence Number=SeqID_281
  Gene Ontology: Mol. function=nucleic acid binding; Biological process= DNA integration
  Homolog annotation: Hit_ID=Q1T010; Match level="QueryCoverage=97%, HitCoverage=11%, E-value=8e-33, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MATTSSNNGLPAHLPIFDGKNYDQWIAKMKVIFRFQDVVEIVNTGVAALPRNPTDDQNAAHKEQKKRDGKALFIIHQCLDADIFEKIVHCENAKEAWDTLARNYGGDEKLKKVRLQALRRQYELLQMTEGETVNQYFVRLTSLTNQMVRNGEKISDLMKIEK

SEQ ID NO: 117060 - protein, 279 aa, Glycine max
  Coding DNA Sequence Number=SeqID_282
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=97%, HitCoverage=20%, E-value=1e-86, Identity=56%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
IEIVMSTEGVLIHQKKYARDILKRFNMNNSKPVTTPIDTGTKLIKEGVEEPVDATLFKQIVGSLRYLCHTRPDITYGVGLISRFMEKPMTSHLVAAKRILRYVKGTEGLGILYRTGIDTPDAELYGYSDSDWSGDVNDRKSTAAYVFMYGNAPFSWCSKKQAVVALSSCEAEYIAASMAACQAQWLCMLMQELGLKSDDKVRIMLDSKSAIDLAKHPVAHGRSKHIETRYHFLRDQVNNDKLELLHCKTEDQLADILTKALKTSTLENLKMKLEMNSTS

SEQ ID NO: 117061 - protein, 119 aa, Glycine max
  Coding DNA Sequence Number=SeqID_283
  Subcellular localization annotation: CTP_CleavageSite=45; ConfidenceScore=5.81e-01
MFNKNAVAKCFANPFSLTTFSLLHNSAFCNPSPLSPHHPRSFGVSSSASWGSSLLPRDSNCQHLGLLKTLLSILFITYSKIHSVEAVARGLKDPSFRVIQNHFAISGILGETVAKIGDL

SEQ ID NO: 117062 - protein, 264 aa, Glycine max
  Coding DNA Sequence Number=SeqID_284
  Gene Ontology: Mol. function=DNA binding; Cellular component=nucleus
  Homolog annotation: Hit_ID=Q1RWS5; Match level="QueryCoverage=99%, HitCoverage=74%, E-value=1e-61, Identity=52%"; Hit description=SBP
  Pfam annotation: Domain name=SBP; Domain location=178-256; Score =177.7; E_value=2.8e-50; Accession=PF03110.5; Description=SBP domain
  Subcellular localization annotation: CTP_CleavageSite=58; ConfidenceScore=5.20e-01
MEFGGNMFCLNNRDQNGNTNNNGNTFAWDSWETPANSSNNNNNNNTSSRLVNAFHLPAASRVAEADGSVPATRHEAAGLASALMFLPQNGGGMRHRQQQQHPYGGDGSHVHPDPHLMCLKLGKRHYFEDTSGSGSGSVAAAATLGGGLVLGDKRGKGYSSGGGASVKAAGLTAVTVPRCQVEGCHLALLNAKDYHRRHKVCEMHSKAPKVVVLGMEQRFCQQCSRFHVVSEFDNSKRSCRRRLAGHNERRRKSSHDSVARNSSK

SEQ ID NO: 117063 - protein, 408 aa, Glycine max
  Coding DNA Sequence Number=SeqID_285
  Gene Ontology: Mol. function=5-formyltetrahydrofolate transporter activity; Cellular component=chloroplast envelope
  Homolog annotation: Hit_ID=Q9SKZ5; Match level="QueryCoverage=85%, HitCoverage=62%, E-value=1e-138, Identity=73%"; Hit description =Expressed protein
  Pfam annotation: Domain name=BT1; Domain location=84-408; Score =240.5; E_value=3.6e-69; Accession=PF03092.7; Description=BT1 family
  Pfam annotation: Domain name=MFS_1; Domain location=80-408; Score= -17.6; E_value=0.002; Accession=PF07690.6; Description=Major Facilitator Superfamily
  Pfam module annotation: Pfam domain module=BT1::MFS_1; Domain location=84-408::80-408
MEISGTVPSSGSSLRLSSDDGDPLLGSRIRAGKDDALTADTDLEASSSGRIASRKQKYWVSSIKLFGVELSPDNVAVAMVYFVQGVLGLARLAVNFYLKDDLHLDPAEAAVISGFSALPWLVKPLYGFIRSYLVLSGLLGALSWSLMATFVDNKYSAGFCILLGSLSVAFSDVVVDSMVVERARGESQSTSGSLQSLCWGSSAFGGIVSSYFSGSLLDAYGVRFVFGVTSLLPLITSVVAVLVKEQPMFGTTRGLNILFAGPEFLESSKQRIIQLWGSVRQRSVFLPTLFIFLWQATPQSDSAMFYFTIYFSFKKLLIHFSTNSLGFTPEFLGRVKLVTSIASLLGVGLYNGFLKNVPLRKIFFATTLLGSTLGMTQVFLVTGLNRKFGISDEWFAIGDSLILTVLSQ

SEQ ID NO: 117064 - protein, 167 aa, Glycine max
  Coding DNA Sequence Number=SeqID_286
MWGTLAITYKGTSHVKRNKLSLLTRRTYDNYDHIDKILRSLSRKWRPQVTTLWALKNLDSMSLEELVDTLKSLALSNWKIKKASSREQASKSSSKALKAKNSSAEEFEEKYDEDEVAFISRKIHKMWKIKGECRWKNSSKRVFKEKKDKDKSSIICYECKKYGHFKV

SEQ ID NO: 117065 - protein, 247 aa, Glycine max
  Coding DNA Sequence Number=SeqID_287
MATNQAQTLMDYHTPTIGGANTIQLPDLPKGVTFDFKHRFLQMLDKNLFSGAAHEDPMWYMRKFIKHGTGCAHYLRIVSLHGTTVQVPSNEGISFPTSLDFSCGGNLLLKPPIDAIKIIEDICSNPYSNTGDRRIMKRDVRKDDSQTELEKQMQDLTLNIETLTRAQDQVPITTPSFPTYDRDSGKIKECIGLNPCKIRGLDKRGDWGCAGEGGQVRLGRLTLRLGDEKCVAMFGPPERFLIDEDLY

SEQ ID NO: 117066 - protein, 72 aa, Glycine max
  Coding DNA Sequence Number=SeqID_288
MDEVAHACLVLFSPFHPPGVPFLSVPSPCVVTDFLFLLVAPHAQEQACNESYIVVACMDPARSCNSVGIAAS

SEQ ID NO: 117067 - protein, 70 aa, Glycine max
  Coding DNA Sequence Number=SeqID_289
MGGVAYVQGDLNTCYLVFLSESVVWTHLGYFLTNGTTLHLKVEVSRMEKKKSLEETPLQEKDESRRSSPP

SEQ ID NO: 117068 - protein, 186 aa, Glycine max
  Coding DNA Sequence Number=SeqID_290
  Gene Ontology: Mol. function=sequence-specific DNA binding
  Homolog annotation: Hit_ID=Q329F2; Match level="QueryCoverage=54%, HitCoverage=94%, E-value=4e-34, Identity=71%"; Hit description =Putative DNA-binding protein
  Pfam annotation: Domain name=DUF1044; Domain location=1-91; Score =85.1; E_value=2.2e-22; Accession=PF06296.2; Description=Protein of unknown function (DUF1044)
  Pfam annotation: Domain name=HTH_3; Domain location=131-185; Score =29.1; E_value=1.6e-05; Accession=PF01381.12; Description=Helix-turn -helix
  Pfam module annotation: Pfam domain module=DUF1044::HTH_3; Domain location=1-91::131-185
MRTFKTCWFSRKARAHGITDKALCRAVKDVQRGLATDLGGGVFKKRLNHNRDRALAQTNITGAELHAFRKLAMQFGALSDDQEKTFRSQAFEAIHSAAEGLHRAGAISLETLRSFDESCLAPVEMLQPQEIKALREQLRLSQPVFARYLNTSVSTIQKWETGVKRPGGVSLKLLSIVRKHGLEVLL

SEQ ID NO: 117069 - protein, 389 aa, Glycine max
  Coding DNA Sequence Number=SeqID_291
  Gene Ontology: Mol. function=citrate transporter activity; Cellular component=integral to membrane; Biological process=citrate transport
  Homolog annotation: Hit_ID=UPI00005EE943; Match level="QueryCoverage =99%, HitCoverage=84%, E-value=1e-166, Identity=79%"; Hit description= COG2610: H+/gluconate symporter and related permeases
  Pfam annotation: Domain name=CitMHS; Domain location=1-335; Score =202.3; E_value=1.1e-57; Accession=PF03600.6; Description=Citrate transporter
LIELSGFSRSIVAAAIRILGRRHAIPVIVLVCALLTYGGVSLFVVAFAVYPFAAELFRQSGIPKRLIPATVALGAFSFTMDALPGTPQIQNIIPTSFFGTNAWAAPWLGLIGSLFIIAVGLLYLERQRRKAQLKGEGYGTDLLNEPETPDDINLPNPLIAILPLILVGVFNLGFSHWIPQGYGASHKLTLPGLAKPIATDVAKITAIWAVEAALVSGILLVVVFGFRNIRGRLAEGSKTAVGGAILAAMNTASKYGFGAVIAALPGFLVLSQALSAIPNPLLNKAISVTLLAGITGSASGGMSIALAAMADNFVAAAHAAHIPLEVLHRVASMASGGMDTLPHNGAVITLLAITGLSHRQAYGGIFAITLIKSAAVLFVIGVFYLTGIV

SEQ ID NO: 117070 - protein, 205 aa, Glycine max
  Coding DNA Sequence Number=SeqID_292
MAVYYIEFDEFKEELERSHWDEELTDFGDGNIDVAIVKEFYANLYDPEDKSPKFALLRPDPQELAAKLCIPGKGFELNADGQPLKILRKNLTTLAQTWSVLSLSNLIPTSHTSDVTLDRARLIYGIIMKMDMNVGYLISLTAQHDTSRLGFPALITALSKARGVQSDSRSLESLSPAINLAYIKKDYWNLDDPTITFRGPRKARG

SEQ ID NO: 117071 - protein, 76 aa, Glycine max
  Coding DNA Sequence Number=SeqID_293
MSEKVKMIKPGDAQIIKQRGMVEEFEGKKRKGKDMIKKLKRKRNQVGPTSNSIGRKGKHQKGKNANLERYHFLRPS

SEQ ID NO: 117072 - protein, 96 aa, Glycine max
  Coding DNA Sequence Number=SeqID_294
MAKFDPEIVLKFYASAWPMEEGVRDKRWRASGASSARGGTRPRLRRGGHRPAVVYTGVGLCPDRYGEAGADYAHQHDYFDSDMDDAATQQHPAQQP

SEQ ID NO: 117073 - protein, 57 aa, Glycine max
  Coding DNA Sequence Number=SeqID_295
MKLASTGNTDHGNIRAEEVASVSSDEVSDPIEDITSSTDGECNLDGMTTSGTGMTKW

SEQ ID NO: 117074 - protein, 91 aa, Glycine max
  Coding DNA Sequence Number=SeqID_296
  Gene Ontology: Mol. function=nutrient reservoir activity; Cellular component=vacuole
  Homolog annotation: Hit_ID=P25974; Match level="QueryCoverage=73%, HitCoverage=16%, E-value=4e-21, Identity=89%"; Hit description=Beta -conglycinin, beta chain precursor
MLTCLKEHEQKEAAIGRTTFGIAKLIHLSSMLPQISISLLLVLMLRTTRGTSLQIQRQRQVQELAFPGSAQVVEKLIKNQRESYCVDAQPQ

SEQ ID NO: 117075 - protein, 498 aa, Glycine max
  Coding DNA Sequence Number=SeqID_297
  Gene Ontology: Mol. function=oxidoreductase activity; Cellular component=membrane; Biological process=electron transport
  Homolog annotation: Hit_ID=Q9SML3; Match level="QueryCoverage=85%, HitCoverage=98%, E-value=1e-145, Identity=57%"; Hit description =Cytochrome P450 monooxygenase
  Pfam annotation: Domain name=p450; Domain location=36-490; Score =386.7; E_value=3.4e-113; Accession=PF00067.12; Description =Cytochrome P450
MDIASCALLIVLTCAIVHALLGSFLAMATKANHKLPPGPSRVPIIGNLLELGEKPHKSLAKLAKIHGPIMSLKLGQITTVVVSSAQMAKEVLLTNDQFLSNRTIPQSVSVLNHEQYSLAFMPISPFWRELRKICNTQLFAHKSLDASQDVRRKIVQQLVSDIHQSSQIGEAVDIGTAAFKTTINLLSNTIFSMDLIHSTGKAEEFKDLVTNITKLVGTPNLADFFPVLKMVDPQSIKRRQSKNSKKVLDMFNHLVSQRLKQREDGKVHNDMLDAMLNISNDNKYMDKNMIEHLSHDIFVAGTDTTASTLEWAMTELVRNPDVMSKAKQELEQMTSKGNPIEEADIAKLPYLQAIVKETLRLHPPVPFLLPRKAGKDVDIGGYTIPKDAKVLVNMWTICRDPTLWDNPTMFSPDRFLGSDIDVKGRNFELAPYGAGRRICPGLLLANRMLLLMLGSLINSFDWKLEQGIETQDIDMDDKFGITLQKAQPLRIVPLKINN

SEQ ID NO: 117076 - protein, 501 aa, Glycine max
  Coding DNA Sequence Number=SeqID_298
  Gene Ontology: Mol. function=oxidoreductase activity; Cellular component=membrane; Biological process=electron transport
  Homolog annotation: Hit_ID=Q9SML3; Match level="QueryCoverage=84%, HitCoverage=98%, E-value=1e-146, Identity=58%"; Hit description =Cytochrome P450 monooxygenase
  Pfam annotation: Domain name=p450; Domain location=36-494; Score =403.5; E_value=3e-118; Accession=PF00067.12; Description=Cytochrome P450
MDIASCALLIVLTCAIVHALLGSFLAMATKANHKLPPGPSRVPIIGNLLELGEKPHKSLAKLAKIHGPIMSLKLGQITTVVVSSAQMAKEVLLTNDQFLSNRTIPQSVSVLNHEQYSLAFMPISPLWRELRKICNTQLFAHKSLDASQDVRRKIVQQLVSDIHQSSQIGEAVDIGTAAFKTTINLLSNTIFSMDLIHSTGKAEEFKDLVTNITKLVGTPNLADFFQVLKLVDPQGVKRRQSKNVKKVLDMFDDLVSQRLKQREEGKVHNDMLDAMLNISKDNKYMDKNMIEHLSHDIFVAGTDTTASTLEWAMTELVRNPDVMSKAKQELEQMISKGNNPIEEADIGKLPYLQAIIKETLRLHPPVPFLLPRKADKDVDIGGYTIPKDAQVLVNTWTICRDPTLWENPSVFSPDRFLGSDIDVKGRNFELAPFGAGRRICPGMLLANRMLLLMLGSLINSFDWKLEHGIEAQDMDIDDKFGITLQKAQPLRILPVPVKINN

SEQ ID NO: 117077 - protein, 139 aa, Glycine max
  Coding DNA Sequence Number=SeqID_299
  Gene Ontology: Mol. function=adenylosuccinate lyase activity; Cellular component=cytoplasm; Biological process=purine ribonucleotide biosynthetic process
  Homolog annotation: Hit_ID=Q6T7E9; Match level="QueryCoverage=96%, HitCoverage=27%, E-value=2e-57, Identity=76%"; Hit description =Adenylosuccinate lyase
MAIFAARLSRERKELSQVEILGKFAGAVGNYNAHVAYPEVKWPHIAEQFLQSLGLIFNPYVAQIETHDYMAKLFHLLIQFNNISLGYFKQAGEIGSSTMPHKVNPIDFENSERNLGVANGGLSHLSMKLPISCWQGRPP

SEQ ID NO: 117078 - protein, 150 aa, Glycine max
  Coding DNA Sequence Number=SeqID_300
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=90%, HitCoverage=25%, E-value=9e-57, Identity=88%"; Hit description =Adenylosuccinate-AMP lyase
MCMLPVRLNACCSYLGFLKLLRFPVSVTVLNLFLQGLIDDFSVDDALEVKNIERVTNDDVKAVEYFLKQKCQSNAEVVKVLEFFHFACTSEDINNLAHALMLKETMNSVMFPVMDQIIKALCDMAKDNALVPMLSHTHGQECSFVHLLKI

SEQ ID NO: 117079 - protein, 132 aa, Glycine max
  Coding DNA Sequence Number=SeqID_301
  Gene Ontology: Mol. function=catalytic activity; Biological process =metabolic process
  Homolog annotation: Hit_ID=Q6K2P5; Match level="QueryCoverage=96%, HitCoverage=16%, E-value=2e-28, Identity=47%"; Hit description =Putative pentatricopeptide (PPR) repeat-containing protein
MLASAGRWEEATIVRKEMRDIGIKKNVGYSWVAVKNRVHVFQAKDSSHEKNSDIKAMLAKLKGETKKAGYVHDTNLSLFDLEEEKEKASEVWYHSEKIALTFGLIALPHGFPIRITKNLRICVDCHGAIKFN

SEQ ID NO: 117080 - protein, 151 aa, Glycine max
  Coding DNA Sequence Number=SeqID_302
MGVGLGANVPFRIGMKECRGGLSFIYVGGINGILCLDWMGDYIFLGGRGSCHGVCAEPYEGQFKAGVDNENLWTMEFGLQTNVRQCITHARYLHWTHVYKIIYASGGGSKDRAVEWWYFMMWEFGPFHDACQTEQSDFGRQSIVIEVYIFN

SEQ ID NO: 117081 - protein, 166 aa, Glycine max
  Coding DNA Sequence Number=SeqID_303
MLLFFTATFRRDYGGVGGGCGCASDTGRRTIVGGRGVEGVLGDSDAATGGDHEGARVGGLDDGVGGARGGEEEALRGEDGGEVWLSGGAGGGGGGGVGEGEDCGVVGRRGWWGVIAVVRLAENGGVFELQETEVEVFGEKAGHLCTMKNQRERQNNERDFVSVCLI

SEQ ID NO: 117082 - protein, 136 aa, Glycine max
  Coding DNA Sequence Number=SeqID_304
  Pfam annotation: Domain name=SMP; Domain location=23-82; Score=5.7; E_ value=0.072; Accession=PF04927.3; Description=Seed maturation protein
MLPLILLPSVTRIQSQNTEDIDTFQNAIQQQNTKMSQEQLRRRSPLSMASAEVSNKPDVTATPDGVAASVAAAARLNENVKSICKECCSLLGTSGSGSYVSLWNIYITMESKFIFLDSAKRLVYVTLRVMEVHLAV

SEQ ID NO: 117083 - protein, 90 aa, Glycine max
  Coding DNA Sequence Number=SeqID_305
DMGYVGVRELRWRWATGDGGFMRALWMWVKLPAFIVDHKVVPGDMSRGSGDLGDVRLEKRSQETKGASGNRLPACVIDYTEGWVTGNRLP

SEQ ID NO: 117084 - protein, 378 aa, Glycine max
  Coding DNA Sequence Number=SeqID_306
  Gene Ontology: Mol. function=nucleoside-triphosphatase activity; Cellular component=chloroplast
  Homolog annotation: Hit_ID=Q2PMM5; Match level="QueryCoverage=99%, HitCoverage=24%, E-value=9e-89, Identity=73%"; Hit description =Protein ycf2
MVPYLDRIYYGEFVQIPLCLPQWNLISEIWNLISEIPGNCLHNLLLSEEIIHRNNELLLISTHLRSLNVQEFFYSILFLLLVAGYLVRTHLLFVSRVYSELQTEFEKNLFLVALEQLGDSLEEIRSFAFGGNMLWGGGPTYGVKSIRSKKKYLNLIDLISIIPNPINRIAFSRNTRHLSHPKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESYYLSLGLLVNYLSRVCERCSTRIFLLLLRLIFPKK

SEQ ID NO: 117085 - protein, 50 aa, Glycine max
  Coding DNA Sequence Number=SeqID_307
MSFDQNSKLKGHEVLRELPPEIVKIYQEIETLKDKLGKFGDGHECYVEFD

SEQ ID NO: 117086 - protein, 60 aa, Glycine max
  Coding DNA Sequence Number=SeqID_308
MEVGSLSFNKILQWLFSAMESQRMIKEKRNIPRIFQRHLSIFPLDATSMEGVTLAHRKLP

SEQ ID NO: 117087 - protein, 121 aa, Glycine max
  Coding DNA Sequence Number=SeqID_309
MPKKSSSKAISVNDASEEESNDDCDEEDVELKDSSSNEDNKEEANLCVMVDASTSKAELAFDASLDDEDSSPRTLEHKDLKKAHQVHLVDFVLETTSLSSVQDASVCEEVKALLDKKVSSG

SEQ ID NO: 117088 - protein, 105 aa, Glycine max
  Coding DNA Sequence Number=SeqID_310
  Gene Ontology: Mol. function=nucleic acid binding
  Homolog annotation: Hit_ID=Q1SDG1; Match level="QueryCoverage=68%, HitCoverage=6%, E-value=4e-10, Identity=39%"; Hit description =Integrase, catalytic region; Zinc finger, CCHC-type
MASWDLSMDQSSKVYIKLEDVCVKSIGKKTPEMMEEGYVVNKPPLLKGENYDYWKERMIAFFESTHIDMWDVVEKGDHIPLDTQRNKICRDRWTDEHKSKSVLNS

SEQ ID NO: 117089 - protein, 104 aa, Glycine max
  Coding DNA Sequence Number=SeqID_311
MCNNFRQFSLRIVFCWDSTSLENLRMVTARCKHTKIIAGEPPPPANMDQMEEEAEEEAQQEPTHQWNPFESLMIQKMNAILHLHQERQVEVHSSLETLPLCLRT

SEQ ID NO: 117090 - protein, 118 aa, Glycine max
  Coding DNA Sequence Number=SeqID_312
  Homolog annotation: Hit_ID=Q6CQE5; Match level="QueryCoverage=36%, HitCoverage=39%, E-value=3e-08, Identity=67%"; Hit description =Protein TAR1
MVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRTLKRESKSA

SEQ ID NO: 117091 - protein, 689 aa, Glycine max
  Coding DNA Sequence Number=SeqID_313
  Gene Ontology: Mol. function=lipoxygenase activity; Cellular component=chloroplast; Biological process=electron transport
  Homolog annotation: Hit_ID=Q1S9M9; Match level="QueryCoverage=99%, HitCoverage=79%, E-value=0.0, Identity=70%"; Hit description=Plant lipoxygenase; Lipase/lipooxygenase, PLAT/LH2
  Pfam annotation: Domain name=Lipoxygenase; Domain location=11-673; Score=1169.2; E_value=0; Accession=PF00305.9; Description =Lipoxygenase
MARSYLCSQTPSGLRRLREEELKLLRGNGEGERKSSDRIYDYGVYNDLGDPGSNIDLKRPILGGSKQYPYPRRCRTGREHSDSDPSYEKRSSSFYVPRDETFSEVKQSQFTKTTISSGVSAVLESLDAILTDQNLGFRSFEDIDTIYKEGFKLSPLKENGLNFLQRVIPRLIKAANDSQNLLRFDTPETVKRDRFFWFSDEEFARETLAGEWPLRSKLESQIYGPPESAITREVIQPHIIGYGTIEEAIKEKKLYMLDYHDLLLPYVSKVREIKDTTLYGSRTLFFLTEQGTLKPLAIELTRPPMDGKPQWKQVFTPASHSTNLWLWRLAKAHVLAHDAGVHELINHWLGTHAVMEPFVVATNRQLSSMHPIYKLLHPHLRYTLAINSLAREILINANGIIEKSFSPNKYSMELSSVAYDQLWQFDLQALPNDLIYRGMAVVDPNAPHGLKLTIEDYPFANDGLLIWDSIKQWVTDYVNHYYPTPSIIESDQELQAWWTEIRTVGHGDKSEEPWWPNLKTPKDLIDTITTITWTASAHHAAVNFTQYTYGGYFPNRPNIVRTKIPTEDPSKEEWETFLNNPEQTLLECFPSQIQATTMMVVFNILSYHSPDEEYIGQYLKPSWTEDPTVKAAYEKFNGRLKEIEGIIDSRNADCNMKNRHGVGVVPYEQMKPFSGPGITGKGIPYSVSI

SEQ ID NO: 117092 - protein, 269 aa, Glycine max
  Coding DNA Sequence Number=SeqID_314
MTMDSHALESSSYVIANSYEVELYVECVGDNEGDVQLYDSKEERKIGLDDGFDLPIPEFGRMKNKRIKNLTLKKVCNSSDDACDNAFVHKDDDIANRQRVRVELDEVSIDYFSQEKNLNLPSEVRSDAHFRLVDKVVDGKKAIGGGKKATSRGKKPIGRVIRLVVEDIVNVETNKWVFISDQQENKPQLRRRKPNEDPNKTRLRRDLTPYKCSRCWATSHNTRRCTLPPLVVPEEENEVPRGAAEGVVEGGTKGATEDGTEGAAHGGNE

SEQ ID NO: 117093 - protein, 153 aa, Glycine max
  Coding DNA Sequence Number=SeqID_315
  Gene Ontology: Mol. function=lipoxygenase activity; Cellular component=chloroplast; Biological process=electron transport
  Homolog annotation: Hit_ID=Q1S9M9; Match level="QueryCoverage=98%, HitCoverage=18%, E-value=6e-43, Identity=53%"; Hit description=Plant lipoxygenase; Lipase/lipooxygenase, PLAT/LH2
  Pfam annotation: Domain name=PLAT; Domain location=52-149; Score =53.5; E_value=7.1e-13; Accession=PF01477.13; Description=PLATLH2 domain
MATSSGKTNTKSQNVNVNVKAIVTIEQSNGGLLLNLINSAVDGIKELAGKTLVLELVSDELDPKTNLERKTIKGNARKTEEKENEVLYEATFELAAEFGKVGAVLVENEQHNEIFLKSVVFDGFPDGPVHLTCDSWVQPMHDNPVKRVFFTDK

SEQ ID NO: 117094 - protein, 69 aa, Glycine max
  Coding DNA Sequence Number=SeqID_316
MDGTDNQVSPLDLLVGAEHISSYDLKSAIDGWPINLQGDILAFLFGSEVEVPFRRAPHRKGGRGGHHPC

SEQ ID NO: 117095 - protein, 195 aa, Glycine max
  Coding DNA Sequence Number=SeqID_317
  Gene Ontology: Mol. function=RNA-directed DNA polymerase activity; Cellular component=chromatin; Biological process=chromatin assembly or disassembly
MNELLKSFLRKFVTVFFDDILVFSPTFDDHLKHLACVFDSLTEGQFFLKESKCSFAQQQLEYLGHIISAKGVAPNLANIKEMVEWPVPTTTNSLGGFLGLTRFYQKFIKGLKRAMTQAPVLALPDFSAPFTLETEASGTAMGAILKQHAHPLAFFSKHVCPRLQRASTYGVEFSCASSSSSKLVPSALEPLIHQA

SEQ ID NO: 117096 - protein, 141 aa, Glycine max
  Coding DNA Sequence Number=SeqID_318
MVIGDFISRLSFPACLHFSGENTETFSSLTSYPELRRSEFLIGGYVGARASLLSTTPPFVAMTQELVARGDTLRLSAPRHSVIPSVIDEQRPIWSSAPFPEMSAFSNGDFSSLTSYPELRRSEFLIGGYVGARALLLSAAP

SEQ ID NO: 117097 - protein, 66 aa, Glycine max
  Coding DNA Sequence Number=SeqID_319
MESAPVSLASLARKRACCDKTYMLKTIKCMPKLLNPRSLVRLNIQASSADPSCKTRLKLNNIIVTA

SEQ ID NO: 117098 - protein, 119 aa, Glycine max
  Coding DNA Sequence Number=SeqID_320
MGLNQTIRVKSYCRLNLLRASTFNFERLDILRDSIRHPKNRHSISSVSIYYGIQSDIRVKSYCRLNSLRGSTFNFEGLDMLRDSIRHPSKKLLSFELAQSFDIQFRASRYITGFNQTSE

SEQ ID NO: 117099 - protein, 42 aa, Glycine max
  Coding DNA Sequence Number=SeqID_321
MWLQSRKRSFYKTDVNNGIKTDVNNRCYYGVVNIGFGKTDVN

SEQ ID NO: 117100 - protein, 214 aa, Glycine max
  Coding DNA Sequence Number=SeqID_322
  Gene Ontology: Mol. function=nucleic acid binding; Biological process= DNA integration
  Homolog annotation: Hit_ID=Q1S7C5; Match level="QueryCoverage=68%, HitCoverage=12%, E-value=8e-09, Identity=57%"; Hit description =Integrase, catalytic region
  Pfam annotation: Domain name=zf-CCHC; Domain location=175-192; Score =6.2; E_value=0.093; Accession=PF00098.13; Description=Zinc knuckle
MAKSPPPSSATPSFSSSSAFPHSIFEELTDLNFLLWRQQVEPAIKTHQLHRYLVCPNIPLQYASLHDYNSVISVTESKFQPMQIEEVESLFLAHEMSLEKLQKKLTSETASLNLIEIPSSKSQQQSSSSAQANVASENANLNYNSYFGFRSFGRGRSSWNNRGGGRGCRGRFSNVQCQVCYKFGHPALDCYHCYDQNYQPQMPANLQGFQTSNL

SEQ ID NO: 117101 - protein, 122 aa, Glycine max
  Coding DNA Sequence Number=SeqID_323
  Gene Ontology: Mol. function=RNA-directed DNA polymerase activity; Biological process=RNA-dependent DNA replication
  Homolog annotation: Hit_ID=Q1T5K4; Match level="QueryCoverage=70%, HitCoverage=8%, E-value=4e-12, Identity=42%"; Hit description=RNA -directed DNA polymerase
MAVSFLKDVEGHRIQPQTRDQWVWTADPNGQYSVRSAYNVLTEDLSQEIQDGAFEELWKLKVPFKIATFAWRLLKDRLPTRVNLRRSMVGIVVLGAFGGCFPASSKKTFSPTHLWSVGGNEG

SEQ ID NO: 117102 - protein, 155 aa, Glycine max
  Coding DNA Sequence Number=SeqID_324
  Gene Ontology: Mol. function=RNA-directed DNA polymerase activity; Biological process=RNA-dependent DNA replication
  Homolog annotation: Hit_ID=Q1SRI1; Match level="QueryCoverage=64%, HitCoverage=21%, E-value=9e-18, Identity=33%"; Hit description=RNA -directed DNA polymerase
MDGSWIEEPATVKEAVRRFFSQRFQEYDFDRPRLDGYGEKDISGILSWHKQGGKQWKVDAANYLNCSWMSFPFTYLGVPIGAKPRRCQTWDPIISKVPKSVMDKLESLQRTFLWGGAYEQNKIAWIKWEMVFLPKEVGGLGVKDINSFNLSLLAK

SEQ ID NO: 117103 - protein, 162 aa, Glycine max
  Coding DNA Sequence Number=SeqID_325
  Gene Ontology: Mol. function=binding
  Pfam annotation: Domain name=Fes1; Domain location=55-152; Score= -6.9; E_value=0.0014; Accession=PF08609.1; Description=Nucleotide exchange factor Fes1
MDRTLCLSLLFFTAAVAAETGGAEPNLTSGGLLWSTAAEESDLAPPPDDGGFSSLDGMLQWAISHSDPGKLKESAEAQQRLPPSELYKRQFEIKEIMEKMKMPSDAELMRIAISDLNNVSTSLEDRHRALQELLELVESIDNANGTSNLGYNYCKLQLKTAI

SEQ ID NO: 117104 - protein, 456 aa, Glycine max
  Coding DNA Sequence Number=SeqID_326
  Subcellular localization annotation: CTP_CleavageSite=66; ConfidenceScore=5.52e-01
MAFASSNPPSPSSPLFSSFPEAETSIPVNATPIQTEIPTNVTPPQTDRMLIPTPNSTVTLTPTLMSISMAVTLSTQSSTFFLHAILEKLTNSNYLLWCQQVEPVLKGHHLHHFLVNLSIPPRTAWHLWDKHHSHFRSMIRAKVGQSENFLHIQMLVNSLDLIGVSITLEEQLDVILEGLHEEYESTMSLIFSKFEPLSIDEVLQIPNSLSNLPNSSIDNSNNQNFDAQANLAQARLGERNMRGERNSGWERVRTRRERKESIRERSREGQCLNFAGNWKGRQQSYMRTNWRDHKDISSFYFTCFPEDATKEELWQHFKKAGDLGRKLDNIVFGGLKMFVNIPKFGRAIPGKSQPVAYGRVYAKPSEEENRDAYLRMKQGGSMGMKRGSYADAVKKNNPRADQGHKWLNEAWVGRLKNLSLFDRVEDDILWDFEVNVSPKYIGDDMILLLGLTDDKA

SEQ ID NO: 117105 - protein, 109 aa, Glycine max
  Coding DNA Sequence Number=SeqID_327
MQQMKKIVAGIGDMVDVDDDVEGLRKTDMARILLKTPWRPLIQHIVTVHIQAEIFHCRRDMEYSSSDEIQLEESADGSPRWITAPMTQENDGSTRWILASTIRWTKQPA

SEQ ID NO: 117106 - protein, 102 aa, Glycine max
  Coding DNA Sequence Number=SeqID_328
MIVSSTDSIGQCLAIGKLEDALEDRGSSFGVVAASKSCKNFMILSELRLLQVALISKSMGIKSPTVNLLCIQENKIAIIQSKRTMNVWEIPFAGKRTRSLSI

SEQ ID NO: 117107 - protein, 45 aa, Glycine max
  Coding DNA Sequence Number=SeqID_329
MYVSLAKGMCVMNGPRKLASRGPGGQGGRRTSSAPEYDSHRFRSV

SEQ ID NO: 117108 - protein, 61 aa, Glycine max
  Coding DNA Sequence Number=SeqID_330
MEKGTSLPMEKEVPMEKGTSLPMEKGFKILLFPIIDSLGNPLRIFTCGIRACVMKFLILQE

SEQ ID NO: 117109 - protein, 186 aa, Glycine max
  Coding DNA Sequence Number=SeqID_331
  Homolog annotation: Hit_ID=UPI00006A17C9; Match level="QueryCoverage =85%, HitCoverage=92%, E-value=4e-10, Identity=29%"; Hit description =UPI00006A17C9 related cluster
MSKSCGFGMTGPLDESISCFLIRVDPWRGLHVLTIRGLHSLTSRGLHVLALRGLHALTLGTSYPHCQRTTRPHLERTTRPHHQRAARPHLQRTTCPRLERATRPHLGGLHALTLRGLHVLANRGLHALTLRGLHVLANRGLHALTLKRTTRPRQQRAARSHLQRATRPRHQSTACPHLPRTTCPHL

SEQ ID NO: 117110 - protein, 150 aa, Glycine max
  Coding DNA Sequence Number=SeqID_332
  Gene Ontology: Mol. function=RNA-directed DNA polymerase activity; Cellular component=nucleus; Biological process=RNA-dependent DNA replication
  Homolog annotation: Hit_ID=Q1SYP9; Match level="QueryCoverage=99%, HitCoverage=15%, E-value=2e-36, Identity=47%"; Hit description=Myb, DNA-binding
MVDGAWTDDPTTVKEAVKVFFEQHFKENEKDRPTLDGVAFKTIDNQQNQTLVSCFQEEEIRRAVWDCGSEKSPGPDGLTFKFIKQFWNIIKPDVMRFLDEFYVNGIFPKGSNASFLALIPKVADPQLLNEYKPISLIGCTYKIVAKILAS

SEQ ID NO: 117111 - protein, 45 aa, Glycine max
  Coding DNA Sequence Number=SeqID_333
MNSLHQLYILAVLQCRLVSAETDSVELGSDDIMVGVGSLLILPLA

SEQ ID NO: 117112 - protein, 263 aa, Glycine max
  Coding DNA Sequence Number=SeqID_334
  Gene Ontology: Mol. function=nucleotidyltransferase activity; Biological process=DNA modification
  Homolog annotation: Hit_ID=Q0QCD2; Match level="QueryCoverage=99%, HitCoverage=84%, E-value=1e-100, Identity=68%"; Hit description =Similar to traC
  Pfam annotation: Domain name=DUF1738; Domain location=37-153; Score =235.5; E_value=1.1e-67; Accession=PF08401.2; Description=Domain of unknown function (DUF1738)
  Subcellular localization annotation: CTP_CleavageSite=103; ConfidenceScore=5.39e-01
MTISLHTQTGAPNTSAATSVSPLEQSGSSKTKFSKNSTDIYQSVTDSIIAALEAGVKPWSCPWQRVPGMSGLPSNYATGAAYSGMNIMLLWSSASEQGFNDSRWMTYKQAKAEGGQVRKGEHGTTAIFYTTLEKETDDGETDYIPILKTFTVFNVEQINGLPMSDEAVFPAGTFEPLPPAEALFLNSGATIIEKGQNAFFAPSTDEIHLPERRLFSDAANFYATGLHELIHWCGAKSRLNREMKGKFGSESYAFEELIAELGS

SEQ ID NO: 117113 - protein, 110 aa, Glycine max
  Coding DNA Sequence Number=SeqID_335
  Homolog annotation: Hit_ID=Q1SKA6; Match level="QueryCoverage=55%, HitCoverage=7%, E-value=8e-10, Identity=50%"; Hit description =Rad21/Rec8 like protein, C-terminal; Rad21/Rec8 like protein, N- terminal
IFYKKVEYVLEDCNEVLVKINKFVVNKEGLVCVETLCMPVTKPERFELDAFELDEPEDAGRYIVRKSIKSAKDIVRFPFQQNATILYILHTVYRGRENLPLLTVHYVSLI

SEQ ID NO: 117114 - protein, 126 aa, Glycine max
  Coding DNA Sequence Number=SeqID_336
  Pfam annotation: Domain name=zf-CCHC; Domain location=36-53; Score =23.7; E_value=0.00012; Accession=PF00098.13; Description=Zinc knuckle
MKRKEERFNKFLRNKGNQRRINFNSKKRGEDSSSVPKCYECNQPEHLRVNCPSFKKRMEKTDRKTFKDKKAKKAYITWEDNDMDSFKESENEVVNLSLMTKNYKSEEENFKMHSMTYIKNQSNLPN

SEQ ID NO: 117115 - protein, 127 aa, Glycine max
  Coding DNA Sequence Number=SeqID_337
  Homolog annotation: Hit_ID=Q9AY32; Match level="QueryCoverage=46%, HitCoverage=90%, E-value=9e-25, Identity=95%"; Hit description=RRNA intron-encoded homing endonuclease
RSWTLGWVDRSASGVHRSARPFCRRCAPVLNWPGRASGADSDPIVLAFGIGVMINRDSRGHSYFIVRDTVLVSTINDANQGSADVAFRTPLAPYEKSKSLGSGGSMVARLKLKGIDGRAPPGVEPAA

SEQ ID NO: 117116 - protein, 71 aa, Glycine max
  Coding DNA Sequence Number=SeqID_338
MASYGGELLLDSSSPGSGISSQLFFFSIPLPLKFKKQRTPLIKKIQGLQAPMELHHAVSRASSSRFYHFQS

SEQ ID NO: 117117 - protein, 89 aa, Glycine max
  Coding DNA Sequence Number=SeqID_339
MELASAHGPEIYPKAHKNPRAFSCISGPIYLEFSIQCPCGVGLHHKPLVYAMMPCILSLYFSYTLTYFFMVNSNRRSIIYIVQPPSFVA

SEQ ID NO: 117118 - protein, 351 aa, Glycine max
  Coding DNA Sequence Number=SeqID_340
  Gene Ontology: Mol. function=hydrolase activity
  Homolog annotation: Hit_ID=Q8PAX3; Match level="QueryCoverage=98%, HitCoverage=74%, E-value=1e-146, Identity=71%"; Hit description=PHB depolymerase
MLATVSADAGAQCLRGFGLAEAGDIVQLALDAQQRGIADRRRIDLLAVDHPLATRQQEVLEHHGNRIQVVLGRHVQHCVVLVVETTVRIGVFQVALDQVGVEIPVRAEMAAGVHRQEAGVLQEARVHAATGAGVTGRHRVDDVVLEPRQRVLRGQVVHCGRAAARIDRATHHHQRARRRFATAGHQRNRGQHRHCGLAHADHVQALDTEVADEFLDVRNVVVQAEFALAGRHHARVDPVGHVHAVVAQQRAHGIAQQRGVVAGQRCEHQHERLVEHRMQLVGFIAVALEAQQLAERLAHFLVHHDRHAFAIDVDFVDAPFGLLVILADAMEQLIDRRQAISAGHLRPPVAL

SEQ ID NO: 117119 - protein, 123 aa, Glycine max
  Coding DNA Sequence Number=SeqID_341
GPGVPALITRLCQSFRIPVTPSKDTDAPPPPHQVDPAGSLGMERYLQHLVCQQAANHRGQGQGFAPFACPNPEQFRAKVAWSEDWPEAQAGEAPTRSPGDAEEARMDEEMTDLLSFLGGSGAT

SEQ ID NO: 117120 - protein, 264 aa, Glycine max
  Coding DNA Sequence Number=SeqID_342
MEAMKEKMDTMMEAMMSMKKIMEANAVTVSATSAVAKVNPMPPSGINQMNHPTSAMVGKDLGTRLPAIWLASQLTPPNMVYTPNENVNNSTSILIESQQPQSNHAHVSQPMGETHQMPYHNLADFEPCLGYATKGQAVGGIPLQNTLESPQYHPQPHPSHSTTVKNPHAMAEMGKLDYLEERLTAIEGGKDYAFVNLEELLLVPNIITLPKFKVSDFDTYKGTTCPKNHLEMYYRKMGAYAKDEKLLMHFFQEKSYWGSCYLVH

SEQ ID NO: 117121 - protein, 74 aa, Glycine max
  Coding DNA Sequence Number=SeqID_343
SMMIGCGITWMLGKLGRIDGDPVLRETRIWATWEYVSSVGGGQQGMETLGTSGGVLLPKTKLDQSRPNPGIVSQ

SEQ ID NO: 117122 - protein, 72 aa, Glycine max
  Coding DNA Sequence Number=SeqID_344
  Subcellular localization annotation: CTP_CleavageSite=29; ConfidenceScore=5.01e-01
MEGPNLNNLPNTDLKWCDPVKKNNTFLTRLSMHAERSPSNLSMSIGLLEGETTENRSTIVRTESIKPAVAEK

SEQ ID NO: 117123 - protein, 133 aa, Glycine max
  Coding DNA Sequence Number=SeqID_345
  Gene Ontology: Mol. function=DNA binding; Biological process =regulation of transcription
  Homolog annotation: Hit_ID=Q9SQQ9; Match level="QueryCoverage=56%, HitCoverage=23%, E-value=9e-19, Identity=71%"; Hit description =Transfactor-like
  Subcellular localization annotation: CTP_CleavageSite=28; ConfidenceScore=5.20e-01
MVLLFSVVSPSSNPMLIDKLLGLLSACMLNRVRKVLFFFTGSHHLRSVFGCETTVHGTVICIYRLVVVGTERTLLTLALRVEVWQLQVLLLLNSVYQVFPEPSLTLPEGIFLEPQYVAAGVFAPEYVVRWVFS

SEQ ID NO: 117124 - protein, 494 aa, Glycine max
  Coding DNA Sequence Number=SeqID_346
  Gene Ontology: Biological process=protein localization
  Homolog annotation: Hit_ID=Q5THJ5; Match level="QueryCoverage=89%, HitCoverage=17%, E-value=6e-08, Identity=22%"; Hit description =Vacuolar protein sorting 13D
  Pfam annotation: Domain name=DUF1162; Domain location=153-486; Score =80.9; E_value=3.9e-21; Accession=PF06650.2; Description=Protein of unknown function (DUF1162)
MHFLIQTVARDIPVAPEKSAVAFKNENPTVSVLEQKEIYLLPTVRMTNLLHSQIDVILSETDQSNLDGYDKIGKQAVISCGSTVDFYANPEVIYFTVTLTSNSSSKLVNSGDCVKKFLKKNNDVHHLDINLDFDGGKFSATLRLYRGSRGVLEVVILAFVFILQNIYLAVIFTSYSMKNDTDFPIYVLETKRSPLSRIELENLNPSIPSALGLCLPPKSISSWFLKSERVLMKLLDNHTSEALLDLGSLSGLTEISFEKEEGSGIKSVTKLGVSIGPSSGEIVVPSQMVTLVPRYVVCNEYEECITIRQCYFQDEVAGVISINSKQRMPLQLKEGFKNTREFSLFEHFIRKHRSKSDNSLLYIQIQLNEAGLGWSGPVCIASLGHFFLKFRKQTNEDTISDNKMTQFAAVHVVEEGSTLVSRFYKPPNTSLPYRIENCLHSLSITYYQKGLLEPEVLGPACSADYVWDDLTLPRRLVIRINGCHLNLAIDSFFK

SEQ ID NO: 117125 - protein, 410 aa, Glycine max
  Coding DNA Sequence Number=SeqID_347
  Gene Ontology: Mol. function=nucleic acid binding; Cellular component= nuclear pore; Biological process=DNA integration
  Homolog annotation: Hit_ID=Q1S7C5; Match level="QueryCoverage=75%, HitCoverage=33%, E-value=8e-20, Identity=34%"; Hit description =Integrase, catalytic region
METFSQTWATKGIGSTFAFRQKIKRSDDGIHSSSSSCFLIEAPSMVEPVIKSHKFQHFVVNPQIPLRYLNNDDRASDHVNLAFKAATHSYEVWETIHEYFQLQMKVRVHQLCPDLCSVQLDGKSMCEYLSQIKSIADELASVGILVKHEEYVDVILVNLPQEYALVIAVIEGNFKTPPVNEVEAQLLSFESLNNQFCQQSFPRVNYASHGGSGTRGGSSGSRGGYGASSVSHGSGSVLEHGGASDCSGRGRGADESYQPPDSMVLYDPTTQQPVNFKSSNIWTNPSYKSAAPSAMITDSTSQGSSAEANTTWIPDSGASNHVTGAVQNITQFSHFDGPDQIYIGNGQVLQIKGSGAVGSNCLYSFPHLRLHDSSDSAVSPCKNKADVHSVPVHFLATVTSVDVPAPAVVF

SEQ ID NO: 117126 - protein, 115 aa, Glycine max
  Coding DNA Sequence Number=SeqID_348
MEFGLKNLKSGWRAVLLNGGHGGKAWRFFEKTPPNSGGMAGCEWQRHGGHGGVAEMADFFCFLSAVGVGLTRPNPTRCESERSPPTKSALSRNAPHPAATPPACRTQPTKTTLRR

SEQ ID NO: 117127 - protein, 319 aa, Glycine max
  Coding DNA Sequence Number=SeqID_349
MTLGQVFLRKCIKGKGFSGTKRYFGDLGKTHINQFMTGQQLRSAGSNIAFAVVAEISDSVLKGAEANGFNGLVSGFHQGILKLAMEPSVLGTALMEGGPDRKILLDRSPGVDELYIEGYIQAMLDTVYRQEYLRVRVIDNQVILKNLPPNHSLINEITGRVKEFLVSKALLKGDPSTTSRPLSRLRGESSLTCLEICILLDIESLMAEWRIGPTVLTLCEHLFVSFAIRILRRQANKFMFSIKWGKKSEDVGNDAEVPENSSQKVQKVSFIRKWGIGKFVLSGLLAYIDGRLCRGIPNPVARRVVSGFLLSYIDQNDDE

SEQ ID NO: 117128 - protein, 144 aa, Glycine max
  Coding DNA Sequence Number=SeqID_350
MLSYSIHSESTAASIVKEEDDNESKDFTPIVIAKLGNLHMISISNNHQTYNQFSLQYINLELKWNGAPFASMLRRHQLDYCDSNDSVLTVVFVLLASSSNVKQFRYSSIFLQIIANFIPGESRSSYSSTQEALRSLIHSVIKVV

SEQ ID NO: 117129 - protein, 72 aa, Glycine max
  Coding DNA Sequence Number=SeqID_351
MECVDDMMLTKPRRERVARGDGWCRGGRHDLGWHEGGWQHMCSGSRLGDGDSFEFKEKGNGGVGIDEWAKEK

SEQ ID NO: 117130 - protein, 67 aa, Glycine max
  Coding DNA Sequence Number=SeqID_352
MATLTLSTEDVTQVVKISTLSTEGVHFVWVMTMGREEERPWMSVGCEEKHPRKGKGSGVRREREEVL

SEQ ID NO: 117131 - protein, 702 aa, Glycine max
  Coding DNA Sequence Number=SeqID_353
  Gene Ontology: Mol. function=protein serine/threonine kinase activity; Cellular component=integral to membrane; Biological process=protein amino acid phosphorylation
  Homolog annotation: Hit_ID=Q6QLL5; Match level="QueryCoverage=96%, HitCoverage=96%, E-value=0.0, Identity=55%"; Hit description=WAK -like kinase
  Pfam annotation: Domain name=Pkinase; Domain location=332-607; Score =173.3; E_value=5.9e-49; Accession=PF00069.15; Description=Protein kinase domain
  Pfam annotation: Domain name=Pkinase_Tyr; Domain location=332-604; Score=112.8; E_value=1e-30; Accession=PF07714.7; Description=Protein tyrosine kinase
  Pfam module annotation: Pfam domain module=Pkinase::Pkinase_Tyr; Domain location=332-607::332-604
  Subcellular localization annotation: CTP_CleavageSite=24; ConfidenceScore=5.15e-01
MFHYNTKFAMVLTFFIFMFCFFCSTSARSNNNCERSCGEHSLQYPFGFSSDCEVKLNCSKENKAEIGELEVQSVTSDGIFVSLPVQCNRSVSFIDPLFRDNFAPTWNNTFLVQSCKPKLDGCVIPTSSFAGGRKDVEGCEDLSCFTQLQKSKSNGSREDDVLTHSDWERVGCRFLFSALAFDRSKVKELSLQFQMVELGWWLQGNCSCSNNASCTEVNTDGGKRGFRCRCDEGFIGDGFRAGDGCRRVSECKASTLWSGGCRKAVKIGVLVGGIIFGGILVAALFLVCYFNRRQSSWLRKQVTVKRLLREAAGDSTVPLYPYKEIERATSFFSEKHRLGTGAFGTVYAGHLHNDECVAIKKIKYRDTNSVDQVMNEIRLLSSVSHPNLVRLLGCCIEGGEQILVYEYMPNGTLSQHLQRERGGVLPWTIRLTIATETANAIAYLHSANDHPIYHRDIKSSNILLDYNFQSKVADFGLSRLGMSETSHISTAPQGTPGYVDPQYHQNFHLSDKSDVYSFGVVLVEIITAMKVVDFARPQSEINLAALAVDRIKKGCIDDIIDPFLEPHRDAWTLYSINKVAELAFRCLAFHSDMRPTMIEVAEELDLIRRSGWATMEETICMASSVGSVCSSPRNGSVNSLRGVSFERAAGLGSETLIVPHKTDVFLQSIEEVKDSSPVSVHDSWLSGTSSPSTNSLLGHVVQ

SEQ ID NO: 117132 - protein, 84 aa, Glycine max
  Coding DNA Sequence Number=SeqID_354
MSEFTSNCPHRILAKLHQLDFAPYVSGSYNAQWNAPKLLHDKHMLHSSYILGKMEQASFVANLGVAFVDDWVFLAGRVGGNEKE

SEQ ID NO: 117133 - protein, 278 aa, Glycine max
  Coding DNA Sequence Number=SeqID_355
  Gene Ontology: Mol. function=catalytic activity; Cellular component =nucleus; Biological process=metabolic process
  Homolog annotation: Hit_ID=Q4K992; Match level="QueryCoverage=100%, HitCoverage=61%, E-value=2e-40, Identity=36%"; Hit description=Non -ribosomal peptide synthetase
  Pfam annotation: Domain name=Condensation; Domain location=1-270; Score=128.5; E_value=1.8e-35; Accession=PF00668.10; Description =Condensation domain
MLFRLGDEVCLAAYERSLQAVVARHQVLHSLIVQMPSQSAVARACELTLSLERVTLAAAHWPDRLRQDIDRPFALGAELPIRAAVYRVAQPDGGWVTYSLILVHHLAFDGWSQPVLLQELDVLYQAQRQGQEAGLAALPLHYGDYAVWQRRWLESAQADEAKAYWRQALDGWQALEMPLDFVRPARFDHRGANHVIALPETLTMQATQFARRQGVTPFALYLAAFNLLLGYFSGQQDILVGTPVANRPVAETRSAIGFFVNTLPLRSQIDDAASLNDY

SEQ ID NO: 117134 - protein, 113 aa, Glycine max
  Coding DNA Sequence Number=SeqID_356
  Gene Ontology: Mol. function=cysteine-type peptidase activity; Cellular component=cytoplasm; Biological process=fucose metabolic process
MPLGGYYYKAKEKLCPIGMKYQKIHACPNDCILCRHEFQEMSKCPICGTSRYIKLIDTVDLEGGPVGKPVVPAALLNRPTRGERRFAYWALAECILAYYVGTDEGVSEMLLVP

SEQ ID NO: 117135 - protein, 79 aa, Glycine max
  Coding DNA Sequence Number=SeqID_357
  Homolog annotation: Hit_ID=Q9SVL6; Match level="QueryCoverage=77%, HitCoverage=30%, E-value=3e-11, Identity=58%"; Hit description =Putative cold acclimation protein
MGRILQEYVAMKTDAVVASLIDYDIEELKVAANKLLHDATMLGGKGFGTSFFKWIASFAAMYKFNFHPVCQYQPIHMFV

SEQ ID NO: 117136 - protein, 202 aa, Glycine max
  Coding DNA Sequence Number=SeqID_358
EEIARRQWTQLAAPIAKYDPKIVMELYANAWPTEKGVRDKRSKGQHYEFNQRRSQASGFDEEAISQQLCITGDHASQTPTRPEEVQQDTRVSSLDHGPLLVLWGAGEGPPAASRRYAAATSMHVTDQQATNLRGQVQLNESFYQYTLHQQSQDPSPFPWPTLEQFGATVAWPGDKPDFKARAGPAGAPGDEDGAQEDDDMAD

SEQ ID NO: 117137 - protein, 75 aa, Glycine max
  Coding DNA Sequence Number=SeqID_359
MAEDMNVDIVTQVQTTTFVLDKSKIEEHVDTLLDMDKVAFTLTIKKPNSAAPIKELEQWNQVIRNDARNDAALIM

SEQ ID NO: 117138 - protein, 40 aa, Glycine max
  Coding DNA Sequence Number=SeqID_360
MPKMYRLSTWLRPATWQSTNRLMTKKPLTHWYECVQALNN

SEQ ID NO: 117139 - protein, 66 aa, Glycine max
  Coding DNA Sequence Number=SeqID_361
PGFYAYASLEVFTFVFVYAIPQLLGNCHGFGNSLEHNTVGCRCILCLYKMFTPPTKTCTDRLSGRH

SEQ ID NO: 117140 - protein, 66 aa, Glycine max
  Coding DNA Sequence Number=SeqID_362
MVNTIKIEKFTRKNNFNLWRIKMKGMTLKEHLDELNSVMMELYDVDVKMEDEDMTMIMLAFLPPPL

SEQ ID NO: 117141 - protein, 146 aa, Glycine max
  Coding DNA Sequence Number=SeqID_363
  Gene Ontology: Mol. function=DNA binding; Cellular component=nucleus; Biological process=DNA integration
MTSSFLMGTAEVPMTCVYHSKVENSFHIYLLLCVGNMLIVSQNLLATQKLKSLLSNEFEMKDMGVAEKILGVEIKSRRSYYYVRRNTLRKYLKGTTDIGLVYHGDMSCAIVGYSNFDYPLDLDARKSVTGYAFIIDNSLVSWKETL

SEQ ID NO: 117142 - protein, 67 aa, Glycine max
  Coding DNA Sequence Number=SeqID_364
MVVVVVIVVALTTVVTTNKTDVTIVVDGGNDIVHVGSDNDGHKDNFMLVVITMVMMTMMVIVVTILT

SEQ ID NO: 117143 - protein, 161 aa, Glycine max
  Coding DNA Sequence Number=SeqID_365
  Homolog annotation: Hit_ID=UPI0000397C87; Match level="QueryCoverage =95%, HitCoverage=35%, E-value=6e-26, Identity=43%"; Hit description =COG3550: Uncharacterized protein related to capsule biosynthesis enzymes
  Pfam annotation: Domain name=HipA_N; Domain location=50-139; Score =30.5; E_value=4.7e-06; Accession=PF07805.3; Description=HipA-like N -terminal domain
MGALSYLPHSSYKETYHQGELDLHELGLQAQAIFDGQTDDVLGALVAAGSSGGARPKAQLYFSDDDFLHCRAIARPGDEAWLVKFTSGHLALGHEEGLCEAAYLTMAARAGLAVPDWQLLPAPAVSGARYWLGLKRFDWISGSERNGRTIRVTGLWPRFTM

SEQ ID NO: 117144 - protein, 166 aa, Glycine max
  Coding DNA Sequence Number=SeqID_366
  Homolog annotation: Hit_ID=Q1SKD7; Match level="QueryCoverage=97%, HitCoverage=45%, E-value=9e-07, Identity=25%"; Hit description =Ankyrin
MESKKRKAPATPSQVRYDRSKFTSPEARERYIDIVVPRKLLPFNEELERRKWDEELTSFVEGSIDVAIVKEFYANLYDPEDKSPKQVRVRGHLVKFDEDTLNTFLKTPVIIEEGETLSAYSRFALLRPDSQELATKLCIPGMGFELNANGQPLKILRKNLTTLAQT

SEQ ID NO: 117145 - protein, 49 aa, Glycine max
  Coding DNA Sequence Number=SeqID_367
MTSIDFVKYAKRCEECQRFGIPKTIMTDHGIVFTSNKVVAFDLESLALG

SEQ ID NO: 117146 - protein, 123 aa, Glycine max
  Coding DNA Sequence Number=SeqID_368
MVAGENVAKQQHHPDLREGGHAGAHDLHPSPYYPPGKVLPWNAQQMADNLLIEAEGLTPPLAELTMPAFFQDQWMPQNLIDGILIKGNPLAPYPGALISDSFFYKPGVSIKLHDYLRIELSHG

SEQ ID NO: 117147 - protein, 215 aa, Glycine max
  Coding DNA Sequence Number=SeqID_369
MTQVSVHIAQLISDAIYQFAGIMPPRHPVDPEKSNKALGFLALITGLFQFYGVSGQAPQQPDEDQQQPAADAPPPPVEEVPSLRSISDHLWRIELLMQKYMQHVTSQQAEYAEFQEEIARRQWAQLVSPMAKFDLEIVMEFYANVWPTEEGVKDKCPWAFGFDEEAISHLLCVSGQDFAQSVVGRQVSVHITQLISDAIYQFAGITPLRHPVDPE

SEQ ID NO: 117148 - protein, 151 aa, Glycine max
  Coding DNA Sequence Number=SeqID_370
MVLGAPSNTHLSDGGVNGLGEWEESKEFSDCVVLNSLTREKGDTKEFRQLVLRSFGKGRRETQKEFRRLVLGEFFLAKGEENEKMNSTSFQGFENQKTSESFWYKEEEEVQRDSRLVKDCMNKYQSVLKSKSKPCFYRLFMSGQEDHLEEL

SEQ ID NO: 117149 - protein, 510 aa, Glycine max
  Coding DNA Sequence Number=SeqID_371
  Gene Ontology: Mol. function=DNA binding; Cellular component =intracellular; Biological process=DNA integration
  Pfam annotation: Domain name=rve; Domain location=261-408; Score=4.9; E_value=0.0023; Accession=PF00665.16; Description=Integrase core domain
MNALLFHPSLDAALSEEAISKIEERKHTKVMKKAHSAILLSLRDEMLWEVAKEKSAMVVWEKLESLCLKNSLANRLYLKKCLYASLMEEEKPLKKHLDDFNRIILDLNSIDVKATLSMVEVKATLNSKESQRENDSKKEETAKGLFTSNKNGKKDFKNNKSKFKNKKMNKHNVDVEALVVSNEDSKKEWILDSRIRMYNGMDKVLEDVRHVPELKRNLISLGTLDNDGCGYKCDQGSLEVYNGNMLAHVSQRGMEELARHVAFVQNKIESLNFCEHCVLGKAKRLKFPTNTHSSNTTLDYVHADLWGPSRIESHGGARKLKKLGTSNGLEFYDEMFKTLCKENDIARHLIVRGTPQQNGLVEKFNRTILEQVSGMKAYYGELKTFGCITYAYLKHDKLELRALKCIFIGYLERVKGHKLWCLESGHKRVLGRFNLKGSELVTTPLAQHLKLFKEQEPKPDLSYSMSVASRFMANLGKKHLEAAKWVLRYISGTIGVGLKYVNHGEVPKIE

SEQ ID NO: 117150 - protein, 82 aa, Glycine max
  Coding DNA Sequence Number=SeqID_372
MGSSCIGVPLRPSLLGELTFSHPSSVGYLETLGYDVDDPLAIRWKPMRGIENAFLVREKLISSRAQVIISSYNKLSDCCRRT

SEQ ID NO: 117151 - protein, 85 aa, Glycine max
  Coding DNA Sequence Number=SeqID_373
MSLLVDGLTKVTTDKWMDITDMGHVIASRYNVYLKERCPLPPVSLLWSSNCHPQAKSWPNPYISRMQHYKSFVMFKRDYVDLNDD

SEQ ID NO: 117152 - protein, 82 aa, Glycine max
  Coding DNA Sequence Number=SeqID_374
MAFLGETSSQTVVNSTLGFIFPNGSIVHNDSDVSFQASTPVPIRVPNGCDFQTLKTKIHNTLKLTDKQFLDEIYYRQPFTYA

SEQ ID NO: 117153 - protein, 159 aa, Glycine max
  Coding DNA Sequence Number=SeqID_375
  Gene Ontology: Mol. function=unspecific monooxygenase activity
  Homolog annotation: Hit_ID=O04892; Match level="QueryCoverage=83%, HitCoverage=35%, E-value=3e-41, Identity=66%"; Hit description =Cytochrome P450 like_TBP
  Subcellular localization annotation: CTP_CleavageSite=44; ConfidenceScore=5.42e-01
SGRWNNVGKGSRQNGSVTSGKGLALRAGHGGPSPEPVGCRWTARAASAARAGRRVPVGGRIGNGPFGASSPGVEQSTQNCALNVKVKKFNQARIPTVPVYYPAKPQPRERAWRNQRGKKTLLSLTLVRLCEMTLRGGALPLFLDPRSASAGRSGREDIV

SEQ ID NO: 117154 - protein, 205 aa, Glycine max
  Coding DNA Sequence Number=SeqID_376
MFEMFRKLVAWKPEDEYQVKENFKSKGSKHLSQILLEKFSIQAKKNYSSEQGGSMHTGGSISALDWIVHLFHRFGKPPHIVKLFKETRSRKKDNTWVDKRSKQKPMPWGRLYGAGNMSSHYRLSVESLTQVNRASCRSSKTIAPKIEQQMKEQQEQHQKTQEKMLNSIRELNAYVSDLSQCLQSHHHHDSNNEEYFDHDDKYHRT

SEQ ID NO: 117155 - protein, 93 aa, Glycine max
  Coding DNA Sequence Number=SeqID_377
MQSIHDSDQHRPIISMEDFMAQVAWPRVQPSPLGGGEAFTAQEPQPKPQMKVAPEATPKATPQASPVTTPGVEVSEEEDYAAYVDYAADMTVA

SEQ ID NO: 117156 - protein, 54 aa, Glycine max
  Coding DNA Sequence Number=SeqID_378
MVVKSTNGRDHWTALKELFEMIRDFNLKLNQKKYLFGGLAGKHMIRDMYNHLRI

SEQ ID NO: 117157 - protein, 96 aa, Glycine max
  Coding DNA Sequence Number=SeqID_379
MSHHSSSVNGEGRHRSQLRPHSHRREKERKPQKANINLPYFYGKDNVEAYLDWEIMVEQQLKRKSTSKSYGPHSYPKKDQGQGILGATPSKSKDDK

SEQ ID NO: 117158 - protein, 73 aa, Glycine max
  Coding DNA Sequence Number=SeqID_380
MQNSQPRQATARRSGEAGNGTADVNFEVLSFARGVVENPYLQTSPSLLRESSLPIICEVGGGLWTSEASYEGL

SEQ ID NO: 117159 - protein, 51 aa, Glycine max
  Coding DNA Sequence Number=SeqID_381
  Homolog annotation: Hit_ID=O64948; Match level="QueryCoverage=63%, HitCoverage=3%, E-value=7e-09, Identity=90%"; Hit description=Lon protease homolog 1, mitochondrial precursor
MAELFELPNRLAILPFRNKVLLPGAIIRIRCTSPIRWGEEKLFLDLVYWRP

SEQ ID NO: 117160 - protein, 84 aa, Glycine max
  Coding DNA Sequence Number=SeqID_382
MARSVFALCPYFRDLHGRELKGLLVIIPKVVISLLMVSRGIIPVEEHIAAVGAVATYPFAGERGEAHGCVFHRRKMRGVATNDY

SEQ ID NO: 117161 - protein, 51 aa, Glycine max
  Coding DNA Sequence Number=SeqID_383
MWSLLKRRNASGVGFYVFGFKLKRADHRLALYVPLREVDSSLAFATHVHRI

SEQ ID NO: 117162 - protein, 166 aa, Glycine max
  Coding DNA Sequence Number=SeqID_384
  Gene Ontology: Mol. function=DNA binding; Cellular component =chromosome; Biological process=chromosome organization and biogenesis (sensu Eukaryota)
  Homolog annotation: Hit_ID=UPI00000E8E77; Match level="QueryCoverage =76%, HitCoverage=74%, E-value=3e-50, Identity=79%"; Hit description =H3 histone, family 2 isoform 2
MEKSEECFWNLEEEFEFLKTCSYSHRAVLISLLPKSSNLCVRNGSYEANRKEVHQRKSFEKATCHESSTQVRSGDRRREEAAPFQAKYGGAKGDPKVPKEHRASHKEASFPKTRKGNRSGLQDQSLLPQQRRLHSPRSRRGLPRCALRGHQPLHHSPKRVTIMPKD

SEQ ID NO: 117163 - protein, 60 aa, Glycine max
  Coding DNA Sequence Number=SeqID_385
MSVASYEVHQEGSRRVEYEVDDFRPTTPGHSPGVVVKDLSGLTGEAIELEEDFHKFQSGG

SEQ ID NO: 117164 - protein, 45 aa, Glycine max
  Coding DNA Sequence Number=SeqID_386
MYRGPRGSFGVEGRSKVGPSGQAEGIYTNAPDPIRTPQLSVLGRE

SEQ ID NO: 117165 - protein, 199 aa, Glycine max
  Coding DNA Sequence Number=SeqID_387
  Homolog annotation: Hit_ID=Q47522; Match level="QueryCoverage=26%, HitCoverage=64%, E-value=7e-24, Identity=100%"; Hit description=LacZ protein
MELEAEEDGYLIAILKGDGETVPVTEVIGYLGEEGENIPTAGGSAPAEAPAPATAAASTDEDKSDDAYDIVVIGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 117166 - protein, 79 aa, Glycine max
  Coding DNA Sequence Number=SeqID_388
  Homolog annotation: Hit_ID=Q1SWX1; Match level="QueryCoverage=78%, HitCoverage=12%, E-value=1e-07, Identity=38%"; Hit description=IMP dehydrogenase/GMP reductase
MGQLQRQAFRKAYGKIWDLTVAEDSTEAIASLAQYYDQPLRCFTFGDFQLTPTVEEFEEILGCPLGGRKPYLFSDSIPP

SEQ ID NO: 117167 - protein, 68 aa, Glycine max
  Coding DNA Sequence Number=SeqID_389
  Subcellular localization annotation: CTP_CleavageSite=46; ConfidenceScore=5.59e-01
MLSSAHQWAKRASTAKRSFSALSATEESSKASISRSHAKRKISALSAAVVFSQAQRTTGVKLKSTYSC

SEQ ID NO: 117168 - protein, 71 aa, Glycine max
  Coding DNA Sequence Number=SeqID_390
MAKRVWMTIICLRVPLNLLYLDGEKGTDDIICLRVPSDLLSLDGEKGADDHNLSLCAIKLDCLWMTKGRLK

SEQ ID NO: 117169 - protein, 106 aa, Glycine max
  Coding DNA Sequence Number=SeqID_391
MAYKDRNGRSLSLFRHYQSPLIIQRQASPMVCGDDDGQTNIVICFPCRETQCLLTKATEVSPAIPRQASPIACGGRHDYPFYYFQGTKAFADAPDVFYALSFDRFC

SEQ ID NO: 117170 - protein, 198 aa, Glycine max
  Coding DNA Sequence Number=SeqID_392
  Gene Ontology: Mol. function=DNA binding
  Homolog annotation: Hit_ID=Q1S0F5; Match level="QueryCoverage=95%, HitCoverage=39%, E-value=3e-18, Identity=31%"; Hit description=IMP dehydrogenase/GMP reductase
MDQLQHQAFHKAYGKIWDLAMIEVSVEAIASLTQYYDQPLRCFTFGDFQLVPTVEEFEEILGCPLGRQKPYLFSGFYPSMARIAMVVKISMQELDQVKQNRNGIVGIPRRHLEEKAKVLADQGEWALFIDVLALLVFGLVLLPNVDGLVDLAAIDAFLAYHHSKESPVVAILADTYDTFDRRCINNGTRIVCYTPALY

SEQ ID NO: 117171 - protein, 203 aa, Glycine max
  Coding DNA Sequence Number=SeqID_393
  Gene Ontology: Mol. function=transcription factor activity; Cellular component=intracellular; Biological process=regulation of transcription, DNA-dependent
  Homolog annotation: Hit_ID=Q6CYX4; Match level="QueryCoverage=95%, HitCoverage=64%, E-value=4e-64, Identity=62%"; Hit description =Putative DNA-binding protein
MTIQQIARLHPAFITGGEVKKAGQRVRFQHFAQFKQLFGVLLIKFLHSPVAAFNRFQQVIAHKAQQELAHHHWTDPHLLRQLQFGKTVAWHQQALVNQVKKRLLKLHRLLVDRWAEYAKPILLAGIAHDHVGLSHFFQHAALMQMLQRVPHRGAADIKHLGQRRLRGQRRAHMAAGNGFQHLIDDVLAQIPTSTQTALRFFMH

SEQ ID NO: 117172 - protein, 168 aa, Glycine max
  Coding DNA Sequence Number=SeqID_394
  Gene Ontology: Mol. function=sulfuric ester hydrolase activity; Cellular component=integral to membrane; Biological process =metabolic process
  Homolog annotation: Hit_ID=UPI00005F820E; Match level="QueryCoverage =97%, HitCoverage=28%, E-value=5e-47, Identity=55%"; Hit description =COG3083: Predicted hydrolase of alkaline phosphatase superfamily
MRQATGVDEQIATVLHTLQQNDALKNTVVVITAQRAITFDNSDNPGNRATLQVPLVVHWPNTPAQSIDRLTDQQDVMTTLMQRLLHVRTNPVNYSQGEDLFAAQRSHNWVASSEDGKLVVTTPTVTLVLSNNGNYSAYDAQGKELKDHKPQLALLLQVLTEEKRFTAN

SEQ ID NO: 117173 - protein, 211 aa, Glycine max
  Coding DNA Sequence Number=SeqID_395
  Gene Ontology: Mol. function=catalytic activity; Biological process =carbohydrate metabolic process
  Homolog annotation: Hit_ID=Q2CAT9; Match level="QueryCoverage=96%, HitCoverage=36%, E-value=1e-34, Identity=44%"; Hit description =Putative trehalose synthase protein
MSVYQRGIRRRLAPMLEGNIRRLALCHAVLLSLPGVPVMRYGDEIGMGEDLSLKERYAVRTPMQWSAGVNGGFSTAAAEKLLVRPVASGPWRYQQVNVELALRQRHSLLQRVRQMVQLRAEYHEPGTTPFELVSGLPPSVLALRYRSQSRDLLMLANFSERPVEVRLPRQETGYWSCVLEDHRYRDSPTGGKVCRLQLADYGYRWFSRQHD

SEQ ID NO: 117174 - protein, 291 aa, Glycine max
  Coding DNA Sequence Number=SeqID_396
  Homolog annotation: Hit_ID=Q47522; Match level="QueryCoverage=14%, HitCoverage=53%, E-value=8e-19, Identity=100%"; Hit description=LacZ protein
  Pfam annotation: Domain name=EAL; Domain location=1-168; Score=-93.2; E_value=0.00019; Accession=PF00563.11; Description=EAL domain
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPPNSKEEAILESIIHLAAKLELVVTAEGVETQEQADILTHLGCNQLQGYLLGRPVNVENLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 117175 - protein, 42 aa, Glycine max
  Coding DNA Sequence Number=SeqID_397
MVATSQIKTKRSVKDKQARLCEGLDDPLKVPTSSSLSLHGLN

SEQ ID NO: 117176 - protein, 72 aa, Glycine max
  Coding DNA Sequence Number=SeqID_398
MRCGPMRSTSSHEWSIYARSGFGTQPLKPQVEYAQSGFVEFGLTEVWHNTQSLKSQARVKYALSEFAEYYQD

SEQ ID NO: 117177 - protein, 32 aa, Glycine max
  Coding DNA Sequence Number=SeqID_399
MAYTLKSPLGTLPPDSDIAHELYNTHDLTLVF

SEQ ID NO: 117178 - protein, 222 aa, Glycine max
  Coding DNA Sequence Number=SeqID_400
  Gene Ontology: Mol. function=unspecific monooxygenase activity
  Homolog annotation: Hit_ID=O04892; Match level="QueryCoverage=52%, HitCoverage=32%, E-value=7e-13, Identity=44%"; Hit description =Cytochrome P450 like_TBP
  Subcellular localization annotation: CTP_CleavageSite=32; ConfidenceScore=5.26e-01
MALKARDLYPGRRGKDQAPMSRRARRVAAKPRARARAERSSVQILVVVANSQMRTLKAEEGKGTGEARLIALCARTPKGNRPAHPGNGSAGGRVQRLEEHRTSRGVRQGKSAKWIRNLGKRIGSEGWARGSQSRTRRLSVDCSSCFRGESGSSRADRGRIGNGPFGASSPGVEQSTQNCALNVKVKKFNQARVNGGSNYDSLKRNHSQGNGLGGISGERRPC

SEQ ID NO: 117179 - protein, 67 aa, Glycine max
  Coding DNA Sequence Number=SeqID_401
MARSMFAPCPYLRDLYGRELKRFLAIIPKVVISLLMVSRGIILFEEHIAAVRTTSNNMFSKRKTLDE

SEQ ID NO: 117180 - protein, 117 aa, Glycine max
  Coding DNA Sequence Number=SeqID_402
  Homolog annotation: Hit_ID=Q1SWQ8; Match level="QueryCoverage=94%, HitCoverage=40%, E-value=1e-09, Identity=29%"; Hit description =Nucleic acid-binding, OB-fold; TonB box, N-terminal
MVFIRVTVVRECVLEDIPFRKYRFAGFADVVAGQFEPRLLVDVIGVVEEVVFRQVSGKGRWVVFKLKDLSQQLLSCTLWDDYCLQFLKFLDDYKGDGPITVLLTHGRIKEAQGISLS

SEQ ID NO: 117181 - protein, 295 aa, Glycine max
  Coding DNA Sequence Number=SeqID_403
  Gene Ontology: Mol. function=adenylosuccinate synthase activity; Cellular component=membrane fraction; Biological process=purine nucleotide biosynthetic process
  Homolog annotation: Hit_ID=Q1H0Y6; Match level="QueryCoverage=95%, HitCoverage=64%, E-value=1e-123, Identity=76%"; Hit description =Adenylosuccinate synthase
  Pfam annotation: Domain name=Adenylsucc_synt; Domain location=9-285; Score=393.5; E_value=3.2e-115; Accession=PF00709.11; Description =Adenylosuccinate synthetase
MTQSKQAKNVVVIGTQWGDEGKGKIVDWLTDHAQGVVRFQGGHNAGHTLVVGQGAEQKVYKLNLVPSGIVREGVNCYIGNGVVLDTTHLLNEISTLEQGGLDVKNRLKVSPGCPLILSHHVAVDLAREAKRSADKKIGTTGKGIGPAYEDKVARRALRVYDLFYPERFAEKLREVMDYHNFVLTNYLGATAVDFQQQYDASMQHAAALKPMVADISAALYEANARGEHLLFEGAQGTLLDVDHGTYPYVTSSNCIAGQASAGTGVGANMLHYVLGITKAYNNTCRRWPIPERAGY

SEQ ID NO: 117182 - protein, 139 aa, Glycine max
  Coding DNA Sequence Number=SeqID_404
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=17%, E-value=4e-69, Identity=75%"; Hit description=DNA -directed RNA polymerase beta chain
  Pfam annotation: Domain name=RNA_pol_Rpb2_6; Domain location=1-137; Score=-75.9; E_value=1.8e-09; Accession=PF00562.18; Description=RNA polymerase Rpb2, domain 6
MAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIF

SEQ ID NO: 117183 - protein, 224 aa, Glycine max
  Coding DNA Sequence Number=SeqID_405
  Homolog annotation: Hit_ID=UPI0000503967; Match level="QueryCoverage =93%, HitCoverage=89%, E-value=3e-08, Identity=27%"; Hit description =UPI0000503967 related cluster
MRSDCLVQFSMLHFYSEPHELIVVHASSTNESGAMRSDCLVQFSILHFYSEPHELIVVHASSTNESGATRSDCLVQFSILHFCSEPQDVIVDHASSTNESGAMRSDCLVQFSILHFYSEPLEVIVVHASSTNESGATRSDCLVKFSILHFYSDPHEVIVVHASSTNESGAMRSDCLVQFSILHFYSEPLDVIVVHASSTNESGAMRSDCLVNSLFSTFIRTPMN

SEQ ID NO: 117184 - protein, 96 aa, Glycine max
  Coding DNA Sequence Number=SeqID_406
GSPKGDCREDEARLFVRLRAAHSVQTCRRSIGECTTVSGPGGRRKGAILPRCPAPCARTAHGPCGRKFSPISTAPSTRAISISRNTTGPASAVHKG

SEQ ID NO: 117185 - protein, 303 aa, Glycine max
  Coding DNA Sequence Number=SeqID_407
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=3e-26, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYMSSPSKDYTTTCLAIRGLHDFTFRGLHVLAIRGLHALTFRGVHVLAFRRLHVLTLRGLYVFAFRGLYVLAFRGLHVLDFKGLHVLAFRGLHVLTFRGLHVLSFRGPLVVAFRRLHVLIFRGLHTSPSEDYTSTTSQGYTSSPSEGCKPSPSKDCTLPLLQDYTGLLALAFRGLHVLAIRGLHALTLRGLHVVSIRGSRTHTFRGLHILAIRGGLLALAFRGLHVLAIRGQYVLTFRGLHVVAIRGSHTHTFRGPHILAIRVSRTLTFKGLHVLAFRGLHVLAFRGLHILAFRGPH

SEQ ID NO: 117186 - protein, 160 aa, Glycine max
  Coding DNA Sequence Number=SeqID_408
  Gene Ontology: Mol. function=actin binding; Biological process =cytoskeleton organization and biogenesis
  Pfam annotation: Domain name=Transposase_21; Domain location=45-160; Score=52.3; E_value=4.5e-19; Accession=PF02992.5; Description =Transposase family tnp2
MAKKILCPMGMEYKKIHACPNDCILYMKKYINTSGHLFANANDAKDLTWHADGRNCDGMIYHLPNSTQWKKINLLYPEFGKEARNLRLGLATDRMNLFGSLSTQYSSWPTLLVIYNLSPWLCMKRKYMMLFMMIFGPRQPRNDINVCLGPLIEDLTYLSN

SEQ ID NO: 117187 - protein, 173 aa, Glycine max
  Coding DNA Sequence Number=SeqID_409
  Gene Ontology: Mol. function=ferrochelatase activity; Biological process=heme biosynthetic process
  Homolog annotation: Hit_ID=Q1SPB9; Match level="QueryCoverage=98%, HitCoverage=36%, E-value=3e-15, Identity=27%"; Hit description =Transposase
YALNQIAAEFECVHYAGKNPSTCGCVMRTMHGLPCARELSKYVVGCIPLDSIHMFWRRLGFSDQGLSEPDVSIKEVMETISKRFEELDICGKFTLKTKLCEIAYLYQNSMCPPPAKFNTKGAPKKPMKRNPSASSSEQSNPRRIMPMLDQFQPFIHDFIDNIVDVQADRNCGY

SEQ ID NO: 117188 - protein, 76 aa, Glycine max
  Coding DNA Sequence Number=SeqID_410
MENWRTTLRNNFAGFQSRRWRMHEQRQAMTFMGLRKKVENGELTRWWRMHEQRQAMTFMGLRKKVENGELAKSATQ

SEQ ID NO: 117189 - protein, 226 aa, Glycine max
  Coding DNA Sequence Number=SeqID_411
  Gene Ontology: Mol. function=hydrolase activity
  Homolog annotation: Hit_ID=Q1VT23; Match level="QueryCoverage=81%, HitCoverage=54%, E-value=1e-20, Identity=33%"; Hit description =Hydrolase of the alpha/beta superfamily protein
MADRARETADIIDWARRDGRFDARCVGLWGTSQAGWVMPAVARLRPDIAFTLALAPAINWLRQGRYNTRAAMAAAGDDEALIQAREAHWRHIQTLLEQPDGYAQYRREYGAAAALSADRWHFIRANMASDATAELRHFTTPVHLILGGRDVNVDADETERVYRQTIPASLLTVTRIDEADHVMIKPLFARHPWLINVVGLFAPRSVQYDAYRQDVAAFLAAQPCGR

SEQ ID NO: 117190 - protein, 449 aa, Glycine max
  Coding DNA Sequence Number=SeqID_412
  Gene Ontology: Mol. function=electron carrier activity; Cellular component=membrane; Biological process=electron transport
  Homolog annotation: Hit_ID=Q8ZQN3; Match level="QueryCoverage=99%, HitCoverage=60%, E-value=1e-104, Identity=43%"; Hit description =Putative transport protein
MDFHQPIEGVLDHPLFQRLRAHRHAGGERAVAQRHHAVEDRLANQEMLHLFILLQRRDGLMQHFIDPIDILVAADGVVGAVYPEFARIVGQRSDRGVRHDVVDAVVVAQADRANGHALHGAGDAADGDVFAGVHAVFELDEHAGDHVFHQRLGAEADSQPQRAGARQQRRDVQPHLRQHDHHGNGADNDGQHVAKQRQQRAFACARPHAVAQFQRQAVLDDAGHQRPAEDGDQQDQQDMHQPAERSLAIFAARPLVQVDQVPGIEQEQRHRQHHHHPQYLQPVGDVGVDAPLEHRIAQINVGRQRNAAENPAGQHAGQQSADADHQQAFHRGAHHKAQAVADVELGQHEQHQKIGDRQQMPDMPQAAQDRAEKRHRPFGQQVDLLLYRLAVVQDQPDGVQRQRQHHHQIDGGGGRVADLHRHLRHHHHHDVADHAAEPREARVPVARAL

SEQ ID NO: 117191 - protein, 101 aa, Glycine max
  Coding DNA Sequence Number=SeqID_413
  Gene Ontology: Mol. function=RNA-directed DNA polymerase activity; Biological process=RNA-dependent DNA replication
MQQQLFSSLKSVTLYIYERFSSNFHCNILYKIIFKVLANSLKPILPHCISLEQLAFVDDRAILDNVILACKILHHIRFRKTGKQGKIALKIDISKSFDIVD

SEQ ID NO: 117192 - protein, 127 aa, Glycine max
  Coding DNA Sequence Number=SeqID_414
MVMGDFISRLSFPENNETFSSLTSYPELRRSEFLIGGYVGARASLLSTTPPFVAITQEPVARGDTLRLSAPPLPFRHSRVRWQAETKFGHSAHMIRGDTLRLSAPLSHSDTVVFDGKQRPSLVILHT

SEQ ID NO: 117193 - protein, 553 aa, Glycine max
  Coding DNA Sequence Number=SeqID_415
  Homolog annotation: Hit_ID=O87109; Match level="QueryCoverage=99%, HitCoverage=55%, E-value=1e-100, Identity=41%"; Hit description =Surface layer protein
MIGIFGRLPTAAEIDYYDSAFDIGSQPPAYMASILMSQPDAAWMNGQSEYDILSQVYFSVYNTAPDPDYINALLQQGHFNSAVASVVIELFNYPGDDPVMLAQRDALDQRIAEGLYPGTAADAAGGSGDAQAMFYLLRAPWQTDEIAHDGKLLNQGGNLAALAQSKIATLPINDLSDHDFILHLFAQGFERPPTAPELATYQQRLAEGATRGDLLVDMIAQLRGVVAPEDAAAQQHFNAAGQEYSPGELPATEYLEQIAALFRALPERAVDSASLDNWSKTLASGTLSYTELVTALLATPEFQAQVGGLQGDDFIQHVYQAVHGRAADEQQLEHYRALGGDKALVTQAVIADLINAPPAGDVQYEQWMFARDVGASLAYKTTASLATSEGGGNASGTVNTHAHHTLSNAETAVLFRVFLHADADVMVDLSYASQLSYLIVNGDAAADIWLHNNPAARYGVDMTVNNANVIMHGTYGDDRVQLTSQADLAAAQGHFYLNNGNDSLLWGGNANGGANHVGWVFSADGGDGHDILSANLIVKMTSTLDLFGARIST

SEQ ID NO: 117194 - protein, 51 aa, Glycine max
  Coding DNA Sequence Number=SeqID_416
MSQNFTDCLTMGVKFLEVVKKRLHAIKQWPSCEDGSTPGNGASADAGTGLG

SEQ ID NO: 117195 - protein, 179 aa, Glycine max
  Coding DNA Sequence Number=SeqID_417
MEANLCISGKGFILNTEGQPWKLLRKYLTTLAQTWSIFLYSNQAPTSRTSDLNTDRARLVYGLITRMNMNIGGLISGQMTMMAQSNSSRLGFPALIIAFCRSRGVGSDALTSYENLRPAIDLAYIIRNCWNVNDQIVNFPEARKTKLRAADVPSSFAPIVGIPTSSTSALLPALADLSA

SEQ ID NO: 117196 - protein, 238 aa, Glycine max
  Coding DNA Sequence Number=SeqID_418
  Gene Ontology: Mol. function=beta-lactamase activity; Cellular component=integral to membrane; Biological process=beta-lactam antibiotic catabolic process
  Homolog annotation: Hit_ID=Q1CYE9; Match level="QueryCoverage=81%, HitCoverage=36%, E-value=8e-50, Identity=54%"; Hit description=Beta -lactamase
  Pfam annotation: Domain name=Beta-lactamase; Domain location=1-230; Score=27.5; E_value=5.9e-07; Accession=PF00144.14; Description=Beta -lactamase
MSATKSVVALAIALLLDEGKLASIDTPVSQIYPEWKQGRKSAITVRMLLDHTSGLQNVANAGEELEGAPDLVRLALAAELSDAPGTVFSYNNKATNLLPGIVERLAGEPLDAYVDARLFKPLGIAHYTWMKDEAGTPLGMAGLSLRAADLAAIGQLLLEGGVAPDGKRLLSEQSVALMTTESARAPDVGLLWWRVPAWERYQLKPRLQTLLVQRRVDDDVQRALQASAGRAFESRSAL

SEQ ID NO: 117197 - protein, 75 aa, Glycine max
  Coding DNA Sequence Number=SeqID_419
MTTAPRAPGLLVLATNTNPGASCAKELKSVKCDSRGPGDGNPVNHRVFERKLRPKPLGRGHACLGVTHRFPNANM

SEQ ID NO: 117198 - protein, 145 aa, Glycine max
  Coding DNA Sequence Number=SeqID_420
MTGPLDESISCFLIKVDPWVLVPITFRGLYVLAIRGLHILACRGLHALAFRRLRVLIFIPWPPPDIGGLPTVPAQPEREAIAQLLCIPGQDFICAATKRRVQIVHTNMITLTQIWMTLLLSNILPSDRNADLPLQKYQLVYAVMT

SEQ ID NO: 117199 - protein, 46 aa, Glycine max
  Coding DNA Sequence Number=SeqID_421
MGTTTGLWEFYGSITGVPEALESHFLTKRGRWLPPSSPKRARLLPP

SEQ ID NO: 117200 - protein, 231 aa, Glycine max
  Coding DNA Sequence Number=SeqID_422
  Homolog annotation: Hit_ID=UPI0000E69072; Match level="QueryCoverage =41%, HitCoverage=59%, E-value=2e-08, Identity=34%"; Hit description =acetyltransferase, GNAT family
  Subcellular localization annotation: CTP_CleavageSite=69; ConfidenceScore=5.35e-01
MGPGRRPDTGTGTAAAQSAAGCRRFPAPDRCIRWRSGGWRSPAQAPGNAGVPTVRTLAGQRVRGRQPSRAWAGWRAGGTGSGAGGADGGWPHERIHIAPFPLRTDLPDLSDRCRAGVHAPAARGRHGAVAGVRHCLADQPGRGLASGPVGAAAGPFGVGVRVAGSVRHRRLDRGLCAAGIVGAEGRGALSFRGCRGQCAEHGSALQQGQAKQKGRAKPARVAWSAGAQAGA

SEQ ID NO: 117201 - protein, 148 aa, Glycine max
  Coding DNA Sequence Number=SeqID_423
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=97%, HitCoverage=36%, E-value=1e-51, Identity=64%"; Hit description =Photosystem II 44 kDa reaction center protein precursor
  Pfam annotation: Domain name=PSII; Domain location=1-148; Score= -158.2; E_value=0.0013; Accession=PF00421.9; Description=Photosystem II protein
SEVFRGPLGQESFSKLKAFTSLVRDQRLGANVGSAQGPTGLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 117202 - protein, 119 aa, Glycine max
  Coding DNA Sequence Number=SeqID_424
  Homolog annotation: Hit_ID=Q5NE32; Match level="QueryCoverage=71%, HitCoverage=66%, E-value=8e-08, Identity=31%"; Hit description=Type 1 non-specific lipid transfer protein precursor
  Pfam annotation: Domain name=Tryp_alpha_amyl; Domain location=31-118; Score=17.7; E_value=0.0015; Accession=PF00234.12; Description =Protease inhibitorseed storageLTP f
MQEKKVTIALLMLVLVAGMGVTTTLSENQACASGDAQVLLERCFAYLLGEVPDGPLPWCCEGVSAVFQLSKTPQRRRDVCHCLKRDTAVFHFDPEKLKMLPQDCKITSRFSLDPRQNCN

SEQ ID NO: 117203 - protein, 110 aa, Glycine max
  Coding DNA Sequence Number=SeqID_425
MWDTLDITKKGPLRQQVTTLRAIRNLDSMTLEELVETLKVHEQELAQDEGTKKWKSLTLMVQRPKHNSVSKESSSKALVVTDALEEEYDDDDFDEKYDELSLITRKIRKI

SEQ ID NO: 117204 - protein, 386 aa, Glycine max
  Coding DNA Sequence Number=SeqID_426
  Pfam annotation: Domain name=RRM_1; Domain location=56-126; Score =31.4; E_value=3.1e-06; Accession=PF00076.12; Description=RNA recognition motif. (a.k.a. RRM, R
MQKTKGSSRIPLCFYDRLDYLNQSKRKRVERRVDRSGQRQSYNQDNWRGRKDIALFYFTRFPEDATEKDLWHHFKKFGDIREIFVSKNRNRNGTRYGFARFKGVEDVYNLERKLDNIVYGGLKMYVNTPKFRRNRFQRTNLQAKRVEYVEQKEEEATRPRHVHQSVNQGTYAKVVAENNKGTGASRPAGNANRRYEGSWSSVYLDVTETGSNWAKEAWVGRLKNLAIFDRVENDLYWDFEDDISPKYVGDDMVLLIGLTDERVKQMMEEEERRATPFHSLEKWSPKIHTGYRLTWVTCWGIPLLAWDTKQISKIVVVIRDMVDVDDDVELVRRLDRARVLLKTPRRPFIQHTVNVHIQGETYSVHIVEEGGSNPERCQCRRRSMHE

SEQ ID NO: 117205 - protein, 171 aa, Glycine max
  Coding DNA Sequence Number=SeqID_427
  Gene Ontology: Mol. function=pepsin A activity; Biological process =proteolysis
  Homolog annotation: Hit_ID=Q9LEW3; Match level="QueryCoverage=76%, HitCoverage=26%, E-value=3e-35, Identity=54%"; Hit description =Nucleoid DNA-binding protein cnd41-like protein
MYMISSEQKKSRLAKKLGPKRKASLEVVHKHGPCSQLNNHDGKAKSKTPHSEILNQDKERVKYINSRISKNLGQDSSVSELDSVTLPAKSGSLIGSGNYFVVVGLGTPKRDLSLIFDTGSDLTWTQCEPCARSCYKQQDAIFDPSKSTSYSNITCTSTLCTQLSTATEETF

SEQ ID NO: 117206 - protein, 481 aa, Glycine max
  Coding DNA Sequence Number=SeqID_428
  Gene Ontology: Mol. function=pepsin A activity; Cellular component =cellulose and pectin-containing cell wall; Biological process =proteolysis
  Homolog annotation: Hit_ID=Q8H9F4; Match level="QueryCoverage=96%, HitCoverage=94%, E-value=1e-124, Identity=50%"; Hit description=41 kD chloroplast nucleoid DNA binding protein
  Pfam annotation: Domain name=Asp; Domain location=135-478; Score= -56.0; E_value=2.7e-10; Accession=PF00026.14; Description=Eukaryotic aspartyl protease
  Subcellular localization annotation: CTP_CleavageSite=51; ConfidenceScore=5.15e-01
MSSFLLASFALLFCISTLEKSFAFQATKESNNLRQYHFVHLNSLFPSSSCSSSAKGPKRKASLEVVHKHGPCSQLNHNGKAKTTISHTDIMNLDNERVKYIQSRLSKNLGRENSVKELDSTTLPAKSGSLIGSANYFVVVGLGTPKRDLSLVFDTGSDLTWTQCEPCAGSCYKQQDAIFDPSKSSSYINITCTSSLCTQLTSAGIKSRCSSSTTACIYGIQYGDKSTSVGFLSQERLTITATDIVDDFLFGCGQDNEGLFSGSAGLIGLGRHPISFVQQTSSIYNKIFSYCLPSTSSSLGHLTFGASAATNANLKYTPLSTISGDNTFYGLDIVGISVGGTKLPAVSSSTFSAGGSIIDSGTVITRLAPTAYAALRSAFRQGMEKYPVANEDGLFDTCYDFSGYKEISVPKIDFEFAGGVTVELPLVGILIGRSAQQVCLAFAANGNDNDITIFGNVQQKTLEVVYDVEGGRIGFGAAGCN

SEQ ID NO: 117207 - protein, 261 aa, Glycine max
  Coding DNA Sequence Number=SeqID_429
  Gene Ontology: Mol. function=pepsin A activity; Cellular component =cellulose and pectin-containing cell wall; Biological process =proteolysis
  Homolog annotation: Hit_ID=Q8H9F4; Match level="QueryCoverage=87%, HitCoverage=46%, E-value=2e-70, Identity=57%"; Hit description=41 kD chloroplast nucleoid DNA binding protein
MDSHAQLAMTYILGKLLFHCKIFYVLNDAVIHKSQANLLGTGHVEYPLRRKLHRDAAGEGKIYLGNRKDLVAAEIITRVEYGEFPGGGVFGHALPEGGAEGGVGGGGEAGDHGAGVDDCTAGGEGGGGDWEFGAAHGDAGDVEAVEGGAAGDGGEGGVLDVGSGGGAEGEAAGGAGGGGEAVGEDFTIYGGGLLDEGDGVAAEADEAGGATKEALVVLAATEEEVVDDVGGGHGEPLAAEVANGERTVTVLDAVYACFCGG

SEQ ID NO: 117208 - protein, 510 aa, Glycine max
  Coding DNA Sequence Number=SeqID_430
  Gene Ontology: Mol. function=nucleic acid binding; Cellular component= chromatin; Biological process=DNA integration
  Homolog annotation: Hit_ID=Q1RWN2; Match level="QueryCoverage=89%, HitCoverage=39%, E-value=1e-147, Identity=52%"; Hit description =Peptidase S8 and S53, subtilisin, kexin, sedolisin; Integrase, catalytic region; Zinc finger, CCHC-type
EDASSENEEEAVVEGTETAGVTDQDAEATTSTSSDSSNEDASVHATAEGRSRRAPNYLQDYETGEGLSEDEDYFAMFISDDEDYFAMFTSHEDPSSFEEAERDEKWRKAMDLEIEAIKKNETWQLTTLPKGAKKIGVKWVFRTKLNENGEVDKLKARLVAKGYAQQQGIDYNEVFAPVARWDTIRMVLALAAQKGWNVYQLDVKSAFLHGELTEDVYVEQPPGYVRKGEEEKVYKLKKALYGLKQAPRAWYSKIEAYFVKEGFERCDHEHTLFVKTGGDLGKMKYFLGVEIQQNSEGIYLSQKKYACELLEKLGLQNCNSVKNPIVPGFKLSKKGEGARIDATSYKQLIGSLMYITVTRPDLMYVGTVELGVFYKRGDVKDLVAYTDSDYAGDIDDRRSTSGYVFLLSGGAVSWASKKQPVVTLSTTEAEYVAAAVCACQCVWMRKVLEKIGLSQSKCSVIMDLTKKEVVKLIHCGTSNQVADIMTKPLKLDVFLKLRVQLGVREVPNLN

SEQ ID NO: 117209 - protein, 131 aa, Glycine max
  Coding DNA Sequence Number=SeqID_431
  Homolog annotation: Hit_ID=Q2PMM5; Match level="QueryCoverage=99%, HitCoverage=5%, E-value=6e-72, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPI

SEQ ID NO: 117210 - protein, 60 aa, Glycine max
  Coding DNA Sequence Number=SeqID_432
MGAGHARSRYLNRKEGDAEGRASDWSEVVTSHMDSLMCSSAPDPEMWIIQLNISMAYFSC

SEQ ID NO: 117211 - protein, 128 aa, Glycine max
  Coding DNA Sequence Number=SeqID_433
  Gene Ontology: Mol. function=catalytic activity; Cellular component =cytosol; Biological process=cellular metabolic process
  Homolog annotation: Hit_ID=Q1T188; Match level="QueryCoverage=96%, HitCoverage=38%, E-value=1e-55, Identity=80%"; Hit description=NAD -dependent epimerase/dehydratase
MCGVPDDPKKINHLVSLDGAKERLHLYKANLLEEGSFDSVFQGCHAVFHTASPFYHDVKDPQAELLDPALKGTLNVLKSCVNLPTLERVVLTSSVAAVAYNGKPRTPDVVVDETWFSDPDFCRESQVF

SEQ ID NO: 117212 - protein, 182 aa, Glycine max
  Coding DNA Sequence Number=SeqID_434
  Gene Ontology: Mol. function=nucleic acid binding; Cellular component= intracellular
  Homolog annotation: Hit_ID=Q6K687; Match level="QueryCoverage=79%, HitCoverage=24%, E-value=2e-30, Identity=51%"; Hit description=Zinc finger (CCCH-type) protein-like
MGSEEERVLENQLELQLQEQRDSLSAIDQALLSDPTDPELLALNLANGASLSRSREPRSESLLGDVHEELVQAIKDAEEGLLHLKRARLLQEADSVLHNTNIFTEEKVDPLDPTYVEPEPLEDKCYSVGSKCRFRHKDGRWYNGQVVQLDNSVAKVSFLTPTSENMLVFLVLHLCTVISFQF

SEQ ID NO: 117213 - protein, 514 aa, Glycine max
  Coding DNA Sequence Number=SeqID_435
  Gene Ontology: Mol. function=nucleic acid binding; Cellular component= chromatin; Biological process=DNA integration
  Homolog annotation: Hit_ID=Q1RWN2; Match level="QueryCoverage=98%, HitCoverage=38%, E-value=1e-157, Identity=53%"; Hit description =Peptidase S8 and S53, subtilisin, kexin, sedolisin; Integrase, catalytic region; Zinc finger, CCHC-type
  Pfam annotation: Domain name=zf-CCHC; Domain location=251-268; Score =22.9; E_value=0.00017; Accession=PF00098.13; Description=Zinc knuckle
MSAESSNFVQPAIPKFDGHYDHWAMLMENFLRSKEYWHLVETGIPTVAEGIQSTEAQRKSIEDHKLKDLKAKNYLFQAIDRNIMETILDKGSSKSIWDSMKQKYQGTSRVKRAQLQALRKEFEVLQMKGGEKVEEYFARTLTIVNKMKIYGENITQVMIVEKILRSMTSRFDYVVCSVEQSNNLDSLTVDELQSSLLVHEQRMNSHGGDTRDEQALKVSHEEQNGGRGRGRGFGRGRGRGRGRQSPNKATMECFKCHKLGHFQYECPRWKESANYAEIYEEEEMLLMSLVEADNLQQEETWFLDSGCSNHMCGNREWFSTIDEAFRHSVKLGNDSKMEVLGKGNIRLQINGAIHVVTDVYYVPDLKNNLLSVGQLQERGLALLIQDGKCKLYHPRRGLIMQTEMTANRMFVLLASVVLEETSTFLQLATEDSSQLWHRRFGHLSYKGLRTLQHKQMVKGLPFFKDSSKSCPGCFVGKQHRDVIPKKSQWRASHKLQLVHADICGPITPNSNSNK

SEQ ID NO: 117214 - protein, 114 aa, Glycine max
  Coding DNA Sequence Number=SeqID_436
MARNRYNNEENFALNPTLEELLAIMNEIDAKPILPHFLVPKVEYFDGSIKTFHSHMLISGGNNALKCKMFIGTLLGVALDWFSGILDRSIVGFEEFFATNKQKTLTMADLFDVR

SEQ ID NO: 117215 - protein, 88 aa, Glycine max
  Coding DNA Sequence Number=SeqID_437
MFSQKGHFIWFEGEVLRDFEVIEIGEDNDDDGGGEEIEKVRDGGREREREKRMGGRGREVLWLKEVIQRVRSTKGDDGMWIFKLNIVA

SEQ ID NO: 117216 - protein, 131 aa, Glycine max
  Coding DNA Sequence Number=SeqID_438
MSSIIYAFKDYNISKNGQLSDPNFIWGLSFTDVLILASRIAVFDTNYHTKQRITQCFDQEYKRIPRKGAKGSFLDFSRPPLAKARLGELITSGLRFSSLGYDGGCFKGLEGSTLRGIEIKEEERKEEEEEE

SEQ ID NO: 117217 - protein, 67 aa, Glycine max
  Coding DNA Sequence Number=SeqID_439
MVMYFTKHGETPWFSIWLLSILADPRRYVFTGTEINGFARHRRLTQGDEVGQTADEVTRVVYFIDHG

SEQ ID NO: 117218 - protein, 101 aa, Glycine max
  Coding DNA Sequence Number=SeqID_440
MGSYLAHGLEIYPKAHENPRAFPWISGLIYLESFIQFPCGVKRYNWQAKIRMPQLSLGTIRILSSCGKLVSSRSVIQKHSSGRPNVLNMKFSIPNIYGILQ

SEQ ID NO: 117219 - protein, 398 aa, Glycine max
  Coding DNA Sequence Number=SeqID_441
  Gene Ontology: Mol. function=hydrolase activity; Biological process =aromatic compound metabolic process
  Homolog annotation: Hit_ID=Q5YUS0; Match level="QueryCoverage=32%, HitCoverage=84%, E-value=1e-48, Identity=75%"; Hit description =Putative peptide methionine sulfoxide reductase
  Pfam annotation: Domain name=Abhydrolase_1; Domain location=56-251; Score=36.0; E_value=1.3e-07; Accession=PF00561.10; Description =alphabeta hydrolase fold
  Pfam annotation: Domain name=Thioesterase; Domain location=25-261; Score=-49.4; E_value=0.089; Accession=PF00975.10; Description =Thioesterase domain
  Pfam module annotation: Pfam domain module=Abhydrolase_1::Thioesterase ; Domain location=56-251::25-261
MPAPQHVYAADGTRLATYTWAELDAPVVVTVHGFASSARDNWVLTGWVRELTRAGYRVLALDQRGHGQSEKPHESAAYAIRQLVTDVETVMDTYLVDDAFYLGYSLGARVGWEVARELPHRIGRAVLGGVPDGIPLARLDLAQVRAYIADGTPVEDRTTQNYIALTERVPGNDLRALVALAEGLRASGTIDPDPADAPVVPLLFATGSKDAIIEGSRALAAAAPDGRFVELPNRHHFNAPGSRDFKKAALAFFAEARPVPVRRRRPRAWAAPIRRAGSGTCSRSERAGGLDGGHGLARPEAGGVDVGDGVAGDLLLLGGEREDRGAVARTDVVALTVQRRRVVDLEEEGEDVAVGGLRRVEHDLHRLRVAGVVPVCGVVVLATGVAHPGVDHSGAGGG

SEQ ID NO: 117220 - protein, 458 aa, Glycine max
  Coding DNA Sequence Number=SeqID_442
  Gene Ontology: Mol. function=transporter activity; Cellular component= membrane; Biological process=transport
  Homolog annotation: Hit_ID=Q3PGZ6; Match level="QueryCoverage=81%, HitCoverage=63%, E-value=4e-74, Identity=39%"; Hit description =Binding-protein-dependent transport systems inner membrane component precursor
  Pfam annotation: Domain name=BPD_transp_1; Domain location=131-349; Score=15.2; E_value=0.0012; Accession=PF00528.12; Description =Binding-protein-dependent transport s
MARWRWWCGLNIWNSAMPAQIAFAAGRSAPSDCTGAAGSAYPSARRKCYPELAAGSGCSGDAMSVAAVSQAGTTRARFRFGPLWLVAPGLVFLIIFFLVPVARLMGLSFENADTGAITGAHYTRIFDTDVYFRVLLITFRIAALTTMFSLLFGYPLAYWLSRLPERKRGMMILLVMVPFWTSYLVKSFAWVILLGRTGVINQLGLGSGVIGSPLEMLHNEFGVMIGMVHAMLPLAVLTMLPVMSGIDRRLTQASGTLGADSAKSFWLVYFPLSLPGAAAAGLLTFISSLGFFIVPALLGGRQQTMLAQLIIVQVQEILNWAFAGALAAMMLVAALVTCWVYDRVFGLSSLSGDTGAAHKGKNGILRNIGLRILEISALASSRIAMAVRTLLGQAITKRLLGIYCFLSCAFLMLPTLIVIPIAFTSSQFLEFPPPGFSLDWFRAYFTSDLWLSATVRSF

SEQ ID NO: 117221 - protein, 85 aa, Glycine max
  Coding DNA Sequence Number=SeqID_443
MKRMERVKGRGATKKVRKRARGRKINETNHTLTRVTRSELNPTAQIVAASDLRTSFVQLFQQPSTFSFLYYYVICMLVKATSCIF

SEQ ID NO: 117222 - protein, 69 aa, Glycine max
  Coding DNA Sequence Number=SeqID_444
  Homolog annotation: Hit_ID=Q1SRL5; Match level="QueryCoverage=98%, HitCoverage=38%, E-value=1e-07, Identity=44%"; Hit description =Peptidase C48, SUMO/Sentrin/Ubl1
MRKSKADEKILSYNDVVLRRFDLDILSGYPAGSTIHCILDNTMPSVAEALGDFIEPLHLPDKMLLILSL

SEQ ID NO: 117223 - protein, 161 aa, Glycine max
  Coding DNA Sequence Number=SeqID_445
  Subcellular localization annotation: CTP_CleavageSite=51; ConfidenceScore=5.05e-01
MDLLFFSFRRSYGNSRIAQQHLLLVSATLRIFMNRVTLLPFDFWRVSRLTYCATKGAKYLETLPASSSSSSCFFFFIACASSLCLFFFFVEEVAEVACGGAARKLLQSATVVEEVCASTVECCRRWRKALSKITGSFTDQVIRKHFPDQLDPEDAYGSLDP

SEQ ID NO: 117224 - protein, 413 aa, Glycine max
  Coding DNA Sequence Number=SeqID_446
  Homolog annotation: Hit_ID=Q1T1F7; Match level="QueryCoverage=12%, HitCoverage=10%, E-value=1e-07, Identity=51%"; Hit description=IMP dehydrogenase/GMP reductase
  Pfam annotation: Domain name=DUF1723; Domain location=230-279; Score =50.1; E_value=7.5e-12; Accession=PF08330.1; Description=Protein of unknown function (DUF1723)
MASGNERCRFGTLVTRILRDEARGCCGFTKNHPTVGGHARKKVFSVEQFILPEEPFFGEIIGRSSSGNFSGRRVGDWATPDLVVRRVTFGTLQNCCSAMPFLLLSCFFRRCCHRSQSLVSIVTQSWFVLDFSFVVIIVRIRGLGWTLSRVIGRALCRKVSRDADEGPKRRRPTTSAHRQRKAAPAHVVEDVEHVDHVSKEVEKFGRLAPKIEGLVTATRLSHLIACSMDTGDRGLMLSFAERWHKETSSFHLPVAEVTITLDDVALLLHLSNTSVFHSFEDVHVDDVVFLLVELLEHPPTVRDDTFVEAYVPQQPVAATTMDKALADAHADAEQPQHTADAQFGDDAWEALLPLEPDVAVVEAKELEDNRDLIDDFFLREGIGAERVEEVVDEDGKVVGEECNVSIYSTNYPF

SEQ ID NO: 117225 - protein, 1507 aa, Glycine max
  Coding DNA Sequence Number=SeqID_447
  Gene Ontology: Mol. function=peptidase activity; Cellular component =cell surface; Biological process=pathogenesis
  Homolog annotation: Hit_ID=Q9LST1; Match level="QueryCoverage=29%, HitCoverage=43%, E-value=8e-16, Identity=23%"; Hit description =Arabidopsis thaliana genomic DNA, chromosome 5, BAC clone:F15L12
MTQLATDPNAMLVLHGCFCKCNNCQEWNVDHRFLEEKSECSSCCALVTCWSWVRIRKQPLCICKATNLQKHTGVKGPSKNPKTVPSNPKVGLAGKCSVTRTLTQQAGKHLDNSVSETHPPSRMHQSGTEANKVSEACLSQGVSDISEKRQQTQLQTTKFSGLRMPSPSLGFFSLAKTSSSHSQLQKSSKPCKPARSNIPQLQNLETNSVNEARLPHAPGIRSQIVKGAAKNCTEELTLLDVKSESRMQVDNKQMAGVEVEHNSMGSEKISKQEKVENNLEHVNIKPKEQGELHRSENASSMENVIFPRHEKKLLSVSQTQEQSEKEAGHPDVLSNKYQSVFQEPQSMDHHGMLRNSIMTGSISNTVHNAMGQDEDEQIKLFACDVLTSNESLVLQAKHGTSFKGSRLSEEFKEYNSVKTAFLNSSLVDLSETVLGGSIQEIPFKNTEQVNGDAADFVTSGGDAQVHLLNANLSVDCNESTESNLEAVNQQLQGEQLKTTSAGIVGEISSSKEDESHVNSCQLVHMTTLSSKGSPQKSIPEINGPAETEPKIAEIEDCQFPVDDQSGFIQTRPELEGCEKVIDSKAMHDSSQAFELDSLSEDCVALSAPACNTVVSNVSWESRPFQENNVEILHFTSQLCPVVKVDFDPSKNEMSTNSCRMISELQLGDEDSSRDVSMHYDVPIDVPGNFEQQINKNIYSKASEMLCEGESLVLNHGHLLDQSEFSEELSADFISNTKDSISTVAGKSSGCLQHTLPAQLSVLLDGDWLPTNTASSEEIKKTNLSESALEGCDIHTSERNASNYHIQAMPEIKDGNIDVDEREELLRIDDSKEGSSDILPLVEAQLNDNVISSECNSSIEVSKDSFTDIVAWKSEEDCSLSQSSNFPASDNLTFNTGIPQKLNQNSPHGDWPDTVSATACDTKVNNVSQESQPCHENDVGDLQFTAQLSPMVKADFDSTENDISTNNCCTISELELRDDGSSRDASMHYDGQCGVTGNFEQQTSMITYSVANEMLCEDESLVLSHDHLVDQSDFSEVSADFVSNAKGSIGSGAENPSGHLQHTILTPLVQEFDHTNRETEESHLENAQVQSFTENPVAYHCSSKHSLVTDDKFPLADNNDINEDSHLSDFQRLGAVVGVDSQNADNILIASSQEIKKTSLSEGALEGCDTHTSEHNASNHHIQAMPKNKEGNLDVDETAELLQIYDAKKGSSDILPIVEVQLKDSQNVDDLLHLDGDWPPTNFVSSEEFKKTNLSEGALEGSDIHSSEHNASNHHIQAMPENKDGNLDVDEREEFLQMDDVKKGSSDILPLVEVQLIDNVVSSKCNSSIEVNKDSVTDVVTWKSEEHCSLSESSNLPALDDLTTFNTRTPQVCEVSSLNSTIFLDEAETDIFEKDEFPHTDMQHQSNGNINSAEDSSKIIRLEDSVTKCKQEVPTVKPPPNAAPFSDEWLAAIEAAGEEILTMKSGAVQNSPPDKPQQEPGPWSPVRRKNQSIGPFDCTKHNIQHSSP

SEQ ID NO: 117226 - protein, 460 aa, Glycine max
  Coding DNA Sequence Number=SeqID_448
  Gene Ontology: Mol. function=prephenate dehydratase activity; Cellular component=cytoplasm; Biological process=L-phenylalanine biosynthetic process
  Homolog annotation: Hit_ID=Q1SRL6; Match level="QueryCoverage=83%, HitCoverage=99%, E-value=1e-147, Identity=71%"; Hit description =Prephenate dehydratase with ACT region
  Pfam annotation: Domain name=ACT; Domain location=290-370; Score =31.2; E_value=3.6e-06; Accession=PF01842.15; Description=ACT domain
  Pfam annotation: Domain name=PDT; Domain location=103-280; Score =272.4; E_value=9.2e-79; Accession=PF00800.9; Description=Prephenate dehydratase
  Pfam module annotation: Pfam domain module=ACT::PDT; Domain location =290-370::103-280
MAASRIVAHPPPYPHRQSPPSDAPPSLNLTLNPKRYRNLGIRASLRGHEEKNKNDLADKPHSVELRATSTPDDVVSRDLLSLPRPLSSTQLSASVSDSSRLRVAYQGVRGAYSESAAQKAYPNCEAVPCEQFDTAFDAVERWLVDRAVLPIENSLGGSIHRNYDLLLRHSLHIVGEVNFAVRHCLMANHGVKREDLKRVLSHPQALAQCENTLTKFGLVREAVDDTAGAAKHVAYHKLQDAGAVASSAAAKIYGLNILDQDIQDDSDNVTRFLMLAREPMIPGTDRRFKTSIVFSLEEGPGILFKALAVFALRQINLTKIESRPLRNQPLRADDSNNSKYFDYLFYVDFEASMAEQSAQNALRHLKEFATFLRVLGSYPVDTSLTTPEYNYCCAQHSPSGDAYEDGAKTVVVEACGEEIGGVVEDGEGEAMRQGGGGQRRGVVWVYGEGKGLWKRVREKE

SEQ ID NO: 117227 - protein, 353 aa, Glycine max
  Coding DNA Sequence Number=SeqID_449
  Gene Ontology: Mol. function=nucleic acid binding; Cellular component= DNA replication factor A complex; Biological process=telomere maintenance
  Homolog annotation: Hit_ID=Q9FHJ6; Match level="QueryCoverage=48%, HitCoverage=22%, E-value=1e-45, Identity=44%"; Hit description =Replication protein A1-like
  Pfam annotation: Domain name=Rep_fac-A_C; Domain location=161-269; Score=31.4; E_value=3.1e-09; Accession=PF08646.1; Description =Replication factor-A C terminal domain
NLLKEASQGGELSYERASSPSFLSKAHLGGEASSSMAYSLVDGASSHLFSFVFRCISMVFSFDVVDFDGGEIRATCFNVVADQFYNVIEAKGQRLKTICHVGEFPVLATKAARLNDFNGKSVRTIATSQLYVEADFPETDVRKTISQIKDEKLGTLEKPDWISVFVAVSHIKVDNFCYLGCPLKIRDRQCNKKVTNNADGTWHCERCNQSIDTCDFRCLLSMQIEDHTSITWNWISVPRAGLSSNTTLERCKISRNNDDGYDEDMEVDLTLSIGGGNQVNNNKNSSSKKPYLLPLGCSDSPNGKTRDLNSSVSFQSDRVRDFSDPTTPMRSSSVTFDQERKGPHWLSQGLKLK

SEQ ID NO: 117228 - protein, 95 aa, Glycine max
  Coding DNA Sequence Number=SeqID_450
  Gene Ontology: Mol. function=nucleic acid binding
  Homolog annotation: Hit_ID=Q1SDG1; Match level="QueryCoverage=67%, HitCoverage=5%, E-value=8e-13, Identity=55%"; Hit description =Integrase, catalytic region; Zinc finger, CCHC-type
MKKAYITWDDNDMESSEDSENEEINLCLMAKSYESNEEVSLKKKWYIDNGCSKHMTGDASKFSHISPKKSGHVTYGDNNKGRILGVGKIGTNKLN

SEQ ID NO: 117229 - protein, 112 aa, Glycine max
  Coding DNA Sequence Number=SeqID_451
  Gene Ontology: Mol. function=oxidoreductase activity; Biological process=metabolic process
  Homolog annotation: Hit_ID=Q8LKV5; Match level="QueryCoverage=73%, HitCoverage=22%, E-value=1e-27, Identity=68%"; Hit description =Steroleosin-B
MAVDALLALSAIIISLISIRNGKFQHLIFRKFESWLPMPRMSLHVVVKATLVNFYETLRFELKDEVGITIATCGWIGSEMTRGKFMLEEDAEMQWKEEREVHVIATRGKKSF

SEQ ID NO: 117230 - protein, 80 aa, Glycine max
  Coding DNA Sequence Number=SeqID_452
MNPKAVSLLSPVINQEENPLLAMNPKAVSLLSPVFNQGENPASCNEPKERWSLVFSVQPRRLSLEKQSPIVGLLKNSQQE

SEQ ID NO: 117231 - protein, 69 aa, Glycine max
  Coding DNA Sequence Number=SeqID_453
MAKQRNGPTISRIEPDRKAVVRKGGIEREDRLHVVLLEDILPDLKLVLLLAAQPPIAGLNTATGPFPCL

SEQ ID NO: 117232 - protein, 147 aa, Glycine max
  Coding DNA Sequence Number=SeqID_454
MAHPDSIPTVEQFIEMVAWPGTQSSLHKEDEGPTAQIPQHMENESSEAIIPEPFDIGEEAKETQVRQVAATTPKRSLKATSEPSAPMVNLPSPQPAAEPSTPLLQMAEDPTTPVLAVDTSPPATPELQLKDEENGQTQDTQDQSQEF

SEQ ID NO: 117233 - protein, 86 aa, Glycine max
  Coding DNA Sequence Number=SeqID_455
MGCSRIASTRKFFVESDCNFSFVVFLPYSIFIFTHRVQPIIKEVNYDGEPVANPDAFALEVYNPPPSREYVKLIKAELLRIMEVLA

SEQ ID NO: 117234 - protein, 385 aa, Glycine max
  Coding DNA Sequence Number=SeqID_456
  Gene Ontology: Mol. function=calcium ion binding; Cellular component =plasma membrane; Biological process=protein amino acid phosphorylation
  Homolog annotation: Hit_ID=Q9FQ12; Match level="QueryCoverage=65%, HitCoverage=91%, E-value=7e-39, Identity=39%"; Hit description =Lectin-related protein
  Pfam annotation: Domain name=Lectin_legB; Domain location=26-267; Score=132.8; E_value=9.7e-37; Accession=PF00139.10; Description =Legume lectin domain
  Subcellular localization annotation: CTP_CleavageSite=48; ConfidenceScore=5.22e-01
MFVIILLLLSNLLIQTQSGASTVVIDPNTFSFVTFTPESCTNGELLCMGSATAGNGYLSLTPEPQQSGNSSSSLSNTTNNVGRVLYPLPVNVWPAIISTTFTVRITPFSENSTGSGDGMALVFAQDNRPSPNASYGSYLGMFDQSTQGGGFQQIAVEMDTFMNEFDLDGNHIGIVTTSITNPLASESLNSSGIDLKSGRDIEVKIDYDGWSKMIFVSVGYSESQLKSVLNHSINLPDIVPSSIYVGFTASTGNTFPESHQVLNWVFTSVPLPILSAEHTKVGTIKTILVVVAVCLFPFIWIAASLRRRYMRAKKKGDIESLSKKAADIAEVFTYKQLSRATCNFSQENLLGRGAFGSVYKGIILDSGKTVAVKKISATSKQGMFW

SEQ ID NO: 117235 - protein, 217 aa, Glycine max
  Coding DNA Sequence Number=SeqID_457
  Gene Ontology: Mol. function=protein serine/threonine kinase activity; Cellular component=cell surface; Biological process =protein amino acid phosphorylation
  Homolog annotation: Hit_ID=Q9FHG4; Match level="QueryCoverage=69%, HitCoverage=22%, E-value=4e-32, Identity=49%"; Hit description =Serine/threonine-specific kinase like protein
MLDSNHDAHLGDFGLARLLKNEGSVTTNLNGTLGYLAPELSFTGRATPESDVYSFGMVVLEVTCGKRLNWLKQGNSFVDSVWNLHSQNALLECVDQRLENKFDEEEAKRALMVGLACMHPDSLFRPRMRKVVNIFQNPNEPLMELPGVRPTGVYVSVSSSTSASNSSSREACLVLDTERSHKLSLLALWVRVVSSYFTWMKHFGGIEQGYKWSFLAL

SEQ ID NO: 117236 - protein, 314 aa, Glycine max
  Coding DNA Sequence Number=SeqID_458
  Gene Ontology: Mol. function=RNA-directed DNA polymerase activity; Cellular component=nucleus; Biological process=RNA-dependent DNA replication
MEGFQEGGGQASMRTEKIPMGRSCRSQQDSLGQMDTVCLPKDKGGLGIKDVNTFNLALLAKWKWHLFQHQGQLWAKVLESKYGGWRGLNEAPRINSESIWWRDLKMVSHHPENGEALQRSTVWRVGCDDRIKFWEDNWIGGHGALVAKYPRLYLISSQQNQTIQQMGVHKDIGWEWEFTWRRPLFDNDIEMAVSFLKDLESKLIQSQRSDDWVWMTDPSGQFSTKSAYNVMRGVLSEGTEDIAFEELWRLKVPNKILIFTWRLLRDRLPTRRNLHRQQVEINDRRCLFCSSMEEDTGHLFFHCSKISPVWWESL

SEQ ID NO: 117237 - protein, 68 aa, Glycine max
  Coding DNA Sequence Number=SeqID_459
  Subcellular localization annotation: CTP_CleavageSite=43; ConfidenceScore=5.20e-01
MKNKNLGVNVGLQLRDQSCITLFININNLTSNIKTNNKKTMSRQMTNNKMMTNRDTLPMNILITDLTS

SEQ ID NO: 117238 - protein, 84 aa, Glycine max
  Coding DNA Sequence Number=SeqID_460
MITLEARAEHKPAMGGGKVDIIGRSGESSSRYPRYGISTFAVLGGGVFALSHHTDRHVLERLKIIMFNIRNVLTFSERDIRLLK

SEQ ID NO: 117239 - protein, 34 aa, Glycine max
  Coding DNA Sequence Number=SeqID_461
MRGQHKVRDIHVGEQSDCVSRKGGGGVKEGMPQR

SEQ ID NO: 117240 - protein, 804 aa, Glycine max
  Coding DNA Sequence Number=SeqID_462
  Gene Ontology: Mol. function=nucleic acid binding
  Homolog annotation: Hit_ID=Q1SDP2; Match level="QueryCoverage=97%, HitCoverage=68%, E-value=0.0, Identity=70%"; Hit description=RNA -binding region RNP-1 (RNA recognition motif); Aldehyde dehydrogenase
  Pfam annotation: Domain name=RRM_1; Domain location=112-191; Score =30.5; E_value=5.7e-06; Accession=PF00076.12; Description=RNA recognition motif. (a.k.a. RRM, R
MSDEGERTCPLCAEEMDLTDQQLKPCKCGYEICVWCWHHIMDMAEKDDTEGRCPACRSPYDKEKIVGTAANCDRLVNGVNIEKRMKTQKTKSKSTDGRKQLSSVRVIQRNLVYIVGLPLNLADEDLLQRREYFSQYGKVLKVSMSRTAAGVIQQFPNDTCSVYITYSKEEEAIRCIQNVHGFVLEGRPLRACFGTTKYCHAWLRNVPCSNPDCLYLHEIGSQEDSFTKDEIISAYTRSRVQQITGATNNMQRRSGNVLPPPLDDNMNSSSAKPIVKILQVFHHIDNSVSTVRGSPPNGIYGKNMALPTSAAWGTQVTNCQPPAGGLSYPNGPSKPKPDTGSSTLVFSAAVTGSIQASDVTKRPPSSNGSHSMTPRVKSELLKPVKQYNNSVDSLVSEGEKTLASDVSPMLVNLNRQLSPLPLSRDSDGNCTTANTINSTNMIGQSCNFGLEEAMTATNEEIQNLSNELSSINIDRNAEHCGITKPNNSPPTDHALIKSPQIQGSQYNVDRFRDEITTDVAGKATSDFLVCNSTEQCDWKLDSQSLVVSDNAEIDDDVTSFDNQRLKDPEVVCRSYFPKSTRFLQASNHSSPCLLQHGEPCTAINAGSVSADDRVRDESMLHASNILCNGHPEKLVSSSSYGLLHDERNGHIIQRLVGEAVNSGHDIARDKGESSIISNILSMDFDTWDDSLTSPHNLAKLLGDNTDNQPGPLNKSSSWKGHSNNQSRFSFARQEESKIQMFDPHASYGVSHQRPNRTVFLNCAERDLYMDKLGIANGFSTSNFEEAENMVSGHSIASSNKFSGE

SEQ ID NO: 117241 - protein, 138 aa, Glycine max
  Coding DNA Sequence Number=SeqID_463
MGHAVPAGYSGLRNTEKNQKTAKQEPNIGEQSQEAITAQRYFIHITRMMDLSSYKAIYFIPPLSEYQTVASKSISKQFPFTSRIKPLLLPTRVVNLKEQLTSANPELQRKEREMSAQLPKKQNTNVILDMENTKSSTK

SEQ ID NO: 117242 - protein, 98 aa, Glycine max
  Coding DNA Sequence Number=SeqID_464
  Homolog annotation: Hit_ID=Q1SDP2; Match level="QueryCoverage=38%, HitCoverage=3%, E-value=3e-10, Identity=81%"; Hit description=RNA -binding region RNP-1 (RNA recognition motif); Aldehyde dehydrogenase
MESKACSTLSWEEKPGGGNLLGMENPGGAETCALEMAVNHKIKPCINSEEGKQVAQRKQTYIQLKLFYFLTRKETIKQQNQQSLCHFDKVDIIFFHIQ

SEQ ID NO: 117243 - protein, 89 aa, Glycine max
  Coding DNA Sequence Number=SeqID_465
  Gene Ontology: Biological process=multicellular organismal development
  Homolog annotation: Hit_ID=Q9LQR0; Match level="QueryCoverage=56%, HitCoverage=26%, E-value=7e-22, Identity=92%"; Hit description=LOB domain-containing protein 1
  Pfam annotation: Domain name=DUF260; Domain location=37-89; Score =43.1; E_value=4.9e-10; Accession=PF03195.5; Description=Protein of unknown function DUF260
  Subcellular localization annotation: CTP_CleavageSite=54; ConfidenceScore=5.71e-01
MESSDTYTPTSSAPLSHSPSNSSSSSPPPPPTVVMSPCAACKILRRKCAEKCVLAPYFPPTEPAKFTIAHRVFGASNIIKFLQIFSIDL

SEQ ID NO: 117244 - protein, 186 aa, Glycine max
  Coding DNA Sequence Number=SeqID_466
  Homolog annotation: Hit_ID=Q1SDP0; Match level="QueryCoverage=41%, HitCoverage=17%, E-value=1e-11, Identity=47%"; Hit description =Pathogenesis-related transcriptional factor and ERF
MELARGRRAGPPPHKHIKQKLCSDKCHNGPASHGSCLRPILVATKLQGGSLIIELNFSSPPFYFDMMGRHVSPSTNNETNCHYEGEEIPNLMGIDRCFIQLKEEISQYALRVGMLDEVKQRLWGIEFIELVGKMAADGKVAEIENPDDAAAENVGTGVALTWPCVCHAQLGSPFEGSTPILSALSC

SEQ ID NO: 117245 - protein, 44 aa, Glycine max
  Coding DNA Sequence Number=SeqID_467
MDPIGNNRMREVILVGSVTGHRYCKREQIFFVAGSLSMRRSPSR

SEQ ID NO: 117246 - protein, 99 aa, Glycine max
  Coding DNA Sequence Number=SeqID_468
  Homolog annotation: Hit_ID=Q8L6J9; Match level="QueryCoverage=86%, HitCoverage=8%, E-value=3e-07, Identity=63%"; Hit description =Putative carbamoyl phosphate synthase large subunit
MQGILDPPQQHFQCMSQVYHHHHHHHIQFALSNHPKHMKGEQQLDTASTSAPVSPLTILPFLNSMYGIRTGDVPQMHARPTPPAHTGWYNDTIKLFQIE

SEQ ID NO: 117247 - protein, 137 aa, Glycine max
  Coding DNA Sequence Number=SeqID_469
  Gene Ontology: Cellular component=integral to membrane; Biological process=autophagy
  Homolog annotation: Hit_ID=Q1S1A5; Match level="QueryCoverage=83%, HitCoverage=40%, E-value=2e-46, Identity=71%"; Hit description =CD9/CD37/CD63 antigen
MREINWPQSGWCMVCMLSMPLNKSGCCKPPTDCGYVYQNETVWIPGSGLMGANPDCTRWSNDQEQLCYACDSCKAGVLASLKKSWRKVSVINIVVMIILVIVYIIAYAAYRNNRKMDNDEPYGEARMTKAQPSAFHL

SEQ ID NO: 117248 - protein, 612 aa, Glycine max
  Coding DNA Sequence Number=SeqID_470
  Gene Ontology: Mol. function=isomerase activity; Cellular component =proton-transporting two-sector ATPase complex; Biological process =ATP synthesis coupled proton transport
  Homolog annotation: Hit_ID=Q1SRM2; Match level="QueryCoverage=99%, HitCoverage=96%, E-value=0.0, Identity=63%"; Hit description =Eukaryotic DNA topoisomerases I, dispensable insert
  Pfam annotation: Domain name=Pox_A_type_inc; Domain location=207-229; Score=6.9; E_value=8.1; Accession=PF04508.3; Description=Viral A-type inclusion protein repeat
  Pfam annotation: Domain name=Pox_A_type_inc; Domain location=328-350; Score=1.1; E_value=56; Accession=PF04508.3; Description=Viral A-type inclusion protein repeat
  Pfam annotation: Domain name=Pox_A_type_inc; Domain location=385-407; Score=9.7; E_value=3.1; Accession=PF04508.3; Description=Viral A-type inclusion protein repeat
  Pfam annotation: Domain name=Pox_A_type_inc; Domain location=69-88; Score=2.2; E_value=39; Accession=PF04508.3; Description=Viral A-type inclusion protein repeat
  Pfam module annotation: Pfam domain module=Pox_A_type_inc::Pox_A_type_ inc::Pox_A_type_inc::Pox_A_type_inc; Domain location=207-229::328 -350::385-407::69-88
  Subcellular localization annotation: CTP_CleavageSite=59; ConfidenceScore=5.51e-01
MATRSGSSEVPQKVSPRAVRKLKPTTLDIDSASSLSQATKSSKERSPKVTDRRSPRSPVVERKRPSKISELESQISQLQNDLKKVKDQLILSESCKKQAQQEAEESKEQLLALSAKLEESQKQVLDLCSTGEARVLELQNIVEERDMACQSELESSKKQLSVESAALASATNEIQMLKAQLELVANCESVQSQHAESADIELLNLKQNLSETLSLVDALKNQLRDCKESEAQAQALVNETMMQLEAAKGTVEFLRADVAKAVDGYNSIAKELDQSEARVNSLEALVSNLETDPINNKCILSENVADDHKFEYQPEILKQGEDPSQLEAEVVSLKSEVERLRSAIETAEIKYQEEQNRSTVQIRNAYELVDQIKSESCQRECELEAELKKKKADIEELKANLMDKETELQGIVEENDNLNLKLQESMSSKNEHELKREIKRLEECVAELKADMMDKETMLQSISEENETLKSEMNNCSKAREEVAAEVEQVRAAEREALMKLGIVMEEADKSNKKAARVAEQLEATQAANSEMEAELRRLKVQSDQWRKAAEAAAVMISTGNNNGRLTERTVSLDNNNYKGSPYAEDMDDDFQRKKNGNMLKKIGVLWKKPQK

SEQ ID NO: 117249 - protein, 61 aa, Glycine max
  Coding DNA Sequence Number=SeqID_471
MHTPELSSDEFKNLKKGILEGREKERERKRVGPRGKEILLIEIDGREGLSSFVECPGDVDL

SEQ ID NO: 117250 - protein, 76 aa, Glycine max
  Coding DNA Sequence Number=SeqID_472
MQYILSCGLLLPIESLFTIQSSVFNYRVHYGRENTWHGSCSQAEVPPKKAEDEVLIAGFGRKGHAVGDIPEFDLRL

SEQ ID NO: 117251 - protein, 54 aa, Glycine max
  Coding DNA Sequence Number=SeqID_473
MEFEDKGESAFETKLIFNMHPIGGIKRHWEFNVVYILRYYKVESLESLIFILIL

SEQ ID NO: 117252 - protein, 68 aa, Glycine max
  Coding DNA Sequence Number=SeqID_474
MDEIREINSKKGPTSIWSSRDLIKVALRRRIGDGVNINVWSQHWINNETSGPIGDVPHSQSKSWWLKI

SEQ ID NO: 117253 - protein, 142 aa, Glycine max
  Coding DNA Sequence Number=SeqID_475
MPNTFNFRSVFNEIRRQHSRQEEQLHGYDRSVTMIFWNDFNFAESFISIKFEENGVASWEKSTVSKKVSSWNHQNKDNNKSVIEHGKSRDTFRWRKRIGHMLQLIRWKKSGGVCHVGTKVEGVKVRKGWMRTLTKRKTTTME

SEQ ID NO: 117254 - protein, 43 aa, Glycine max
  Coding DNA Sequence Number=SeqID_476
MEYATGEVDRELVLPFLLGTLALGQLRTGGVAMVFLKPKKACL

SEQ ID NO: 117255 - protein, 163 aa, Glycine max
  Coding DNA Sequence Number=SeqID_477
  Gene Ontology: Mol. function=RNA-directed DNA polymerase activity; Cellular component=intracellular; Biological process=RNA-dependent DNA replication
MIVNEASGFHVLSFLDAYSGYNQIRMHDLDEEKMTFIIEDATFCYRVMAFILKNAGATYYRLMDQMFKQLIKHKIKVYVDNIVVKSQSIAQHGVDLEEVFEELLKYDMCLNHEKCTFEKCTAILDMHSLTNVHEVQKLNGRLASLSRFLPKLVEKREAILQIA

SEQ ID NO: 117256 - protein, 80 aa, Glycine max
  Coding DNA Sequence Number=SeqID_478
  Gene Ontology: Mol. function=RNA-directed DNA polymerase activity; Biological process=RNA-dependent DNA replication
MKTQFMLDFPAEFAGNNQTTPNWWTLYVDGASNVKGSGARIILNGLDNVTLKQALKLNFKATNNQAEYEALIAGCQQIPD

SEQ ID NO: 117257 - protein, 76 aa, Glycine max
  Coding DNA Sequence Number=SeqID_479
  Gene Ontology: Mol. function=RNA-directed DNA polymerase activity; Cellular component=mitochondrion; Biological process=RNA-dependent DNA replication
MEIMGPLPKALGEVKYLLVAIDFFTKWKHLICRYDLPYAIVMDNDTQFKAQTYEDFLIRHDVKHLVTSVEHPQTND

SEQ ID NO: 117258 - protein, 89 aa, Glycine max
  Coding DNA Sequence Number=SeqID_480
  Subcellular localization annotation: CTP_CleavageSite=31; ConfidenceScore=5.25e-01
MSHNHNRVSFGKTHLNTSKENNNIINHFPPSTSKTRGVWTVSLPYGVSQKPQSTNKPVNHIINNKEGKDKACEDLDSLVCYTISKVGGV

SEQ ID NO: 117259 - protein, 451 aa, Glycine max
  Coding DNA Sequence Number=SeqID_481
  Homolog annotation: Hit_ID=Q1S0F5; Match level="QueryCoverage=57%, HitCoverage=61%, E-value=2e-22, Identity=31%"; Hit description=IMP dehydrogenase/GMP reductase
MGSSQKPSLKKRFYQVKVKSLGITSLKELGQLMGQLQRQAFRKAYVVEVLHFWGLPAITHGGRIRRNPRMSSKGKETIPILRELDRQKQVENGVVGIPRKCLEAKARILAGRSEWTPFIVVLALLIFGGVLFPNVDGLVDLAAIDAFLANHNHKESPVVAMLADLYDTFDRRCEKSSMRIVCCTPALYVWLVSHHFRQEVRHACPLESHRSCTEKGRANWDQLLAKREGASINWGCINYNPILAIRQLGYPMRGAPLEEELAPVISRGFNKTNMETLQKVRKAWEVVQKKDKELRGSNNGPISGYREWLKAHVQGLDWLPSLRTTKREEVEAPEEDEEVQALRTELEQAQTVKERFKSAALKIRKENTELRDVYVATTKALERETKRARREEHGRNKFRGALWGSNSELKLRREERDQSRVDSLILKDELKGLLEVQRKVCLSGYARQRPT

SEQ ID NO: 117260 - protein, 84 aa, Glycine max
  Coding DNA Sequence Number=SeqID_482
  Homolog annotation: Hit_ID=UPI0000612705; Match level="QueryCoverage =95%, HitCoverage=91%, E-value=2e-08, Identity=31%"; Hit description =UPI0000612705 related cluster
  Subcellular localization annotation: CTP_CleavageSite=73; ConfidenceScore=5.54e-01
MARTCSPLKAWACSPHKVRTCIPLMERTRSPLNVRACSPLKMRTCSPLMARRCIPLKARTCNPMKARACNPLKARACSSLKMWT

SEQ ID NO: 117261 - protein, 247 aa, Glycine max
  Coding DNA Sequence Number=SeqID_483
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=100%, E-value=1e-45, Identity=33%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLRLLSIRGIHVLTFRGLHVLTLRGLQALAFVGLHAQAFRGLHVLAIRGLHVLALRGLHVLTFKGLHTLTFRGQHVLAFRGIHVLTCRGLHVIPFRGIQALASIGLHALTFRGLHILAFRGLHGLPFKWLHVLTFRGLHLLAYRGLFILPFKGLHVLAFRGLHIPIIRGLHALAFIGLHALAFRGLDVLPFRGPLVLAFRGLHVLAMRGLHVLAFRGLHVLAFRGLHVLTFRGLHVLAIRGMHVLTY

SEQ ID NO: 117262 - protein, 103 aa, Glycine max
  Coding DNA Sequence Number=SeqID_484
  Subcellular localization annotation: CTP_CleavageSite=50; ConfidenceScore=5.03e-01
TYQGNPCGVYPDLSSFTGSGIYPDLSSFTGSGVYPDLSSFIGSGVYPDLSSFTGSGVIQISVTCIKRSAPTQVHIIWFVFCDEDITKGKDHEALEGSHDQRQT

SEQ ID NO: 117263 - protein, 51 aa, Glycine max
  Coding DNA Sequence Number=SeqID_485
MERPTSTPEASIEYFAKNEKAEMSNLLAKLISMKYKGKSNIREYFHSGSLQ

SEQ ID NO: 117264 - protein, 170 aa, Glycine max
  Coding DNA Sequence Number=SeqID_486
MRARLLNAFIQRSKPDLLIEHVGHEPDHEQDRHPRAEHDHHAGEGDMEVVAPQVVGDQAQDQQRGRLPADDRGDQPLALGLGQHSHFIADLLLAEVAPVRHLFVERAAVELVVAKQNSQTLEQGNHGWLLVERASISIGRCGGSSSSTSSEPCNGGNAKRRKGLTGGSEN

SEQ ID NO: 117265 - protein, 70 aa, Glycine max
  Coding DNA Sequence Number=SeqID_487
LRLAGDSIAIAAPSVHLPYLAAGTSAVLAPTDTTIHYREPAPPIGSFLVHKTLKLICYIRVKEKTAFKAC

SEQ ID NO: 117266 - protein, 174 aa, Glycine max
  Coding DNA Sequence Number=SeqID_488
STWTTGLSAPASLLDKDHRREAFRVCFTPDDEADASEGRGGGGGGERGGGGGEANKGNEGRIETHKAKLSNEEVSATNEGSAKNSMKNNYDEVSRFEDKDKEQTIQNSKMKTEGGSENNVKNKDVEDGYSVDSNITEQANIVKNIILTSNSALVLNLSLLAEKDFNFVVTDNMC

SEQ ID NO: 117267 - protein, 326 aa, Glycine max
  Coding DNA Sequence Number=SeqID_489
  Homolog annotation: Hit_ID=Q399J7; Match level="QueryCoverage=39%, HitCoverage=84%, E-value=3e-18, Identity=39%"; Hit description=GCN5 -related N-acetyltransferase
  Pfam annotation: Domain name=Acetyltransf_1; Domain location=178-257; Score=43.6; E_value=6.7e-10; Accession=PF00583.14; Description =Acetyltransferase (GNAT) family
MDDGCEFVQKTLFIHTVFIYTGCVHFVPFGGRKFDRRNEVLAETGGAVSALTPREHTVLRQQCVVSGPYGHHCATPVRTGISWQQAAESPETVPLIQVQVAPEGGGKPPPYRRPSGVPGRLDGGTMPPLLIAATTPEDPGFVALRAESLEQHFNMLRRLAENWQSGKNRFNAPGEKLLGAFVRGQLVGVCGLNVDPFSQQPRAGRIRHLYIRDSHRRQGIGQQLLLSVITHSGAWFDFLNTHAPAQGWPFYERFGFRPVYDEPRVTHRLFCSLPLTLTAESACDDHHRILHFAFSPHCSTPAGTLIVKASGDKNVRGDKRQRVRPR

SEQ ID NO: 117268 - protein, 219 aa, Glycine max
  Coding DNA Sequence Number=SeqID_490
  Homolog annotation: Hit_ID=Q1SP02; Match level="QueryCoverage=94%, HitCoverage=50%, E-value=7e-15, Identity=28%"; Hit description=IMP dehydrogenase/GMP reductase
  Pfam annotation: Domain name=DUF1723; Domain location=24-73; Score =54.2; E_value=4.2e-13; Accession=PF08330.1; Description=Protein of unknown function (DUF1723)
LVPEIEGMIAATGLSPLIRCSVITTDLGLISAFVERWHRKTSTFNLPVGELTITLDDMASLLHVPITGALHTFEPLVTSDMIGLLTKLLEVSHEEATFETRQAGGPHGQMMGCSTRMYLLHLAGGFAWGAALLVHMYEHLNDASQTSTRQRWACWIYEHFPTMHTSVIHDAYDEGSPRACRWLTGKAHMTGIKGAPYRRRRDALTVTDVCWMLYAEHRG

SEQ ID NO: 117269 - protein, 42 aa, Glycine max
  Coding DNA Sequence Number=SeqID_491
MELAKENSVFGHSVLSVNDVALSMVALQDKHVFTSIMVPLWL

SEQ ID NO: 117270 - protein, 54 aa, Glycine max
  Coding DNA Sequence Number=SeqID_492
MELAKENSVFGHSVLSVNDVALSMVALQDKHALPNYVYCKLQVVNYEWDHTMSC

SEQ ID NO: 117271 - protein, 190 aa, Glycine max
  Coding DNA Sequence Number=SeqID_493
  Pfam annotation: Domain name=zf-CCHC; Domain location=10-27; Score =19.1; E_value=0.00069; Accession=PF00098.13; Description=Zinc knuckle
ASMQEKTSSIKCFKCLGRGHFTSQCSTKKTMIMRGQDIYSIHDEATTSPSSSESEEAKGEESSEEIYPQEEEQPLMVEEECKETLVSTATPLGLEVIPQVKELLDEVLVRKSLNPCALLVPKIGMLAQPGGSSGALSELILVEHILDNSSASRIFYTLSHKLLPLADGSLSHRIGLASGSKSALPLNLPN

SEQ ID NO: 117272 - protein, 175 aa, Glycine max
  Coding DNA Sequence Number=SeqID_494
MRGYRMVIRTFCHPETVSPMTWANKPVDAQRLTSSSAPYVNQGGSELVDAKSDDMRGYRMVIHTFCHPETASPMTCGGSEPDDMRGYRMVIHTFLQPGANKPIDAQRLTSSSAPFVNQEASEPVDMQRLTSSSAPLSSRDSESDEMQRYPSGYPYKTISVNPDPRSLGAGGNTPS

SEQ ID NO: 117273 - protein, 127 aa, Glycine max
  Coding DNA Sequence Number=SeqID_495
MSCLVIITPTFLCRSVSWCMPPTRHPLDLDKSNRALGFPALITGLCQSFGVPVTPSKLSLSQQGQGFAPFVYPTPVQFRAEVAWPGDWPEAQAGEAPAGALGDAEEAHNMDEEMTELLCFLGGSGAT

SEQ ID NO: 117274 - protein, 340 aa, Glycine max
  Coding DNA Sequence Number=SeqID_496
  Homolog annotation: Hit_ID=Q47522; Match level="QueryCoverage=19%, HitCoverage=87%, E-value=1e-21, Identity=73%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILPAGHRHAPPTAADWPRPASAAAAGPRAARPGSARYAPAGPARTRTNGHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 117275 - protein, 282 aa, Glycine max
  Coding DNA Sequence Number=SeqID_497
  Homolog annotation: Hit_ID=Q47522; Match level="QueryCoverage=20%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGEKSLELTLLEERRWPCGQCFPGMGLGTGPELLAGPKKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 117276 - protein, 182 aa, Glycine max
  Coding DNA Sequence Number=SeqID_498
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=82%, HitCoverage=63%, E-value=3e-33, Identity=45%"; Hit description =Protein ULTRAPETALA1
MILDFKRGEDYIEVLCGATNKKYGDYVGRLKINNEGQYFITCECCLECPLVNVTLEAFEKHALREGSGRWKRNIWVHCEDEDKVPLWKTPLIKYYTHQANVANRKDSAMRKQNFHRDEFLRCTRCGKERRFHLKSRPDIKNYHDASNNKCWNCSLWPYQNWYLVLQNTLYAGKRYWGLTMCQ

SEQ ID NO: 117277 - protein, 53 aa, Glycine max
  Coding DNA Sequence Number=SeqID_499
  Homolog annotation: Hit_ID=O22773; Match level="QueryCoverage=68%, HitCoverage=17%, E-value=6e-08, Identity=72%"; Hit description =Thylakoid lumenal 16.5 kDa protein, chloroplast precursor
QLINFGAYTDTSCFKHAVSKKDVESSKIAFVSSATAFEKWTSMTGLAAQLKGL

SEQ ID NO: 117278 - protein, 134 aa, Glycine max
  Coding DNA Sequence Number=SeqID_500
HQRVYVTVTHSGVTLSPLIGRLVAEEVIGDSPRDLLKEFRPQRMIGKTASAFAPIQRNFPAAQWRITLISPVPRWRVLCVIVARWKNCRCRRRLMTACRSPLAAGHAKRSGSFAIGYSAAAISAKRIQPVVLTG

SEQ ID NO: 117279 - protein, 169 aa, Glycine max
  Coding DNA Sequence Number=SeqID_501
  Homolog annotation: Hit_ID=Q7CID9; Match level="QueryCoverage=55%, HitCoverage=36%, E-value=3e-23, Identity=51%"; Hit description =Putative phage antirepressor
  Pfam annotation: Domain name=ANT; Domain location=41-155; Score= -45.5; E_value=0.029; Accession=PF03374.5; Description=Phage antirepressor protein
LNKRDSLLAVARLSPGFTAELLDRWQEREKFTHLPDFTNPAEAARAWAEQFEQRRAAEQQLALTAPKAEFFDRFVDVHESLGFRQLCKMLKVKEPEFRQFLLERNIMYRDKGALTPQQHHLQAGYFALRSGMGENQHAFSQARFTAKGVKWVASLWAGHVAARPNGVAA

SEQ ID NO: 117280 - protein, 87 aa, Glycine max
  Coding DNA Sequence Number=SeqID_502
MLRWHEASHEPEIYPKAHENPSAFSCISGSIFLESSIQCPCGVGLHQLLRELTSDPSHLFQEVSSDVVFMDDRVFTITSGKPIFKGL

SEQ ID NO: 117281 - protein, 222 aa, Glycine max
  Coding DNA Sequence Number=SeqID_503
GGPLGTSTLTFRGLHVLAIRGLHALAFRGLHVLTFRGLHVLAFRGLHTLSFSGLDVLTFKGSFLLSVPGPPPDIGGQPTVRAQPKREAITQLLYISGQDFTRATAKRRVDRARKTPSGPEEVQQGPGVSNSGITPTRHPVDPEKSNRVLELPALITGLCRFYGVPVAPSKVIRPPTNRAFIKKYCALKQAQGETPQQFEDGLQRATDAPPLPLEFTSAHPQK

SEQ ID NO: 117282 - protein, 260 aa, Glycine max
  Coding DNA Sequence Number=SeqID_504
  Gene Ontology: Mol. function=transporter activity; Cellular component= integral to membrane; Biological process=transport
  Homolog annotation: Hit_ID=Q5P375; Match level="QueryCoverage=78%, HitCoverage=45%, E-value=2e-29, Identity=37%"; Hit description =Conserved hypothetical transport protein,predicted major facilitator superfamily
  Pfam annotation: Domain name=MFS_1; Domain location=22-260; Score= -45.4; E_value=0.038; Accession=PF07690.6; Description=Major Facilitator Superfamily
  Subcellular localization annotation: CTP_CleavageSite=25; ConfidenceScore=5.13e-01
MSHTALSADSALRRSGFFLLLLLLTAANLRTPITATGPVLENIRLTFGLSASAAGVINFLPLLMFATLAPPAAWFGNRFGLERSLWGALLLIVLGSLLRISGSETALWLGTLILSSGIAAANVLLPPLIKRDYTAHTARYIGLYAMTMGITASIASGVAVPLAELSSAGWRLSLAVWLIPALIALLAWLPQLKNHATREQRATQVTVTRSPWRSAIGWQVSLFMASQSLLIMASVNSRRAACCSSIKLWRSPPIWPVCGR

SEQ ID NO: 117283 - protein, 477 aa, Glycine max
  Coding DNA Sequence Number=SeqID_505
  Gene Ontology: Mol. function=monooxygenase activity
  Homolog annotation: Hit_ID=Q98CB7; Match level="QueryCoverage=70%, HitCoverage=92%, E-value=1e-140, Identity=72%"; Hit description =Sulfonate monooxygenase
  Pfam annotation: Domain name=Bac_luciferase; Domain location=104-439; Score=-66.7; E_value=0.00022; Accession=PF00296.11; Description =Luciferase-like monooxygenase
MVTSIEQQCDIAGECAGRAGQSDAHGGRRAAGTGGGAQLRFAAARRIQINLNPSLAVPPLTMPPPEARCRLFSTRSSALFAGAAAIATAWRQRLLHPQQTFLILSFSGLVISQIEQRTRWDAEYNRELAKIAERAGFDYALTQIRFTAGYGADNQPESVTFSQDMLSHTTKLKVIAALLPGPWNPTLAAKQIATISHLYGPRIAVNIVSGWFRGEFKAIGEPWLDHEERYLRSEEFIRCLRGIWRESSFSFAGDFYRFRDYALKPKPLDPLPEIFQGGSSRAARDMASRVSDWYFTNGNTPQGVRQQVDDIRAKAAVNQHTVKIGLNGFVIARESEQEAQAVLQEIIAKANPDAVKGFQHEVKNAGSASPEGEGNWAKSSFEDLVQYNDGFKTNLIGTPQQIAERIMEQKRAGVDLLLLAFLHFHEEVEFFGREVIPRVRELERQEALNAVTRAYRQQHQQRELPATADIMQHAEAQ

SEQ ID NO: 117284 - protein, 408 aa, Glycine max
  Coding DNA Sequence Number=SeqID_506
  Gene Ontology: Mol. function=transporter activity; Cellular component= integral to membrane; Biological process=transport
  Homolog annotation: Hit_ID=Q8PQU2; Match level="QueryCoverage=94%, HitCoverage=93%, E-value=5e-40, Identity=30%"; Hit description=MFS transporter
  Pfam annotation: Domain name=LacY_symp; Domain location=17-408; Score= -318.3; E_value=0.047; Accession=PF01306.10; Description=LacY protonsugar symporter
  Pfam annotation: Domain name=MFS_1; Domain location=18-373; Score =83.4; E_value=6.9e-22; Accession=PF07690.6; Description=Major Facilitator Superfamily
  Pfam module annotation: Pfam domain module=LacY_symp::MFS_1; Domain location=17-408::18-373
MNANPIAHPAALRSLQALCLVNFFMADVRDGLGPFLGIFLTEHGWRADDIGWAMTAGGLAGLLATLPAGLATDATHHKKGLLILASLLITLATLMLWWFPYGGVVVGSQVVTGLAAALIAPLLTGVTLGLTGSQGFSQQMGKNEAFNHGGNMTAALFAGFAVWLWGTDAVFILMTAMALCACFAVAAIQRNAIDDRAARGGAGQQAAELPGFSALLRNPVLLITGLTLLLFHLGNAALLPMLGIRAAATHSGQLSPGVYTAATVVISQCVMIPVALFAARNASRLGFPLLITLALVVLPVRAGIASLFDGTYAMVPVQILDGLAAGLLGVAVPGYIVSVLDGSGHTNAGQSFVMLMQGVGAACSPALTGSIAAAWSYQVAFAVLGSIALAALMLWSLSQRIRWVKSRA

SEQ ID NO: 117285 - protein, 1157 aa, Glycine max
  Coding DNA Sequence Number=SeqID_507
  Gene Ontology: Mol. function=RNA-directed DNA polymerase activity; Cellular component=chromatin; Biological process=chromatin assembly or disassembly
  Pfam annotation: Domain name=Chromo; Domain location=1058-1107; Score= 29.1; E_value=1.5e-05; Accession=PF00385.14; Description='chromo' (CHRromatin Organisation MOdifier
  Pfam annotation: Domain name=RVP_2; Domain location=1-111; Score= -50.6; E_value=0.0087; Accession=PF08284.2; Description=Retroviral aspartyl protease
  Pfam annotation: Domain name=RnaseH; Domain location=491-612; Score= -25.2; E_value=0.013; Accession=PF00075.14; Description=RNase H
  Pfam annotation: Domain name=rve; Domain location=752-908; Score =107.3; E_value=4.4e-29; Accession=PF00665.16; Description=Integrase core domain
  Pfam annotation: Domain name=zf-H2C2; Domain location=697-734; Score =6.9; E_value=0.044; Accession=PF09337.1; Description=His(2)-Cys(2) zinc finger
  Pfam module annotation: Pfam domain module=Chromo::RVP_2::RVT _1::RnaseH::rve::zf-H2C2; Domain location=1058-1107::1-111::233 -402::491-612::752-908::697-734
MGSISGHPLLLLVDGGSTHNFVQQQLVTHLGLPCRETAPLRVMVGNGQYLECTSICDAINIHIQNQTFIVDLHILPISGANVVLGVQWLKTLGPVLTDYTSLTMQFFYQGNLIKLQGDPEATLSSLSSSQFRRLCQTQPSGLCFHITVLSEEHSTSSEPVDPSIQSLLTKYNILFRQPQTLPPERTTDHHIHLLPQATPVNVRPYRYPHFQKKEIEQQVETMLQKGLIQPSNSPFSSPVLLVKKHDGTWRFCVDYRALNSLTIKDRFPIPTIDELLDELGGAQCFSKLDLLQGYHQIRMHSADIPKTAFRTHHGHYEFRVMPFGLCNAPSSFQATMNLIFRPFLRRFVIVFFDDILIYSGTFEDHLRHLDITFQVLLDNQFVLKMSKCFFAKTQVEYLGHLVSGRGVEPMTDKVAAIVNWPRPQSIRAVRSFLGLAGFYRRFIRGYAMIAEPLVRLTTMETLQWTPHSQQAFENLKSALATAPVLALPDFQVPFTVETDASGNGMGAVLSQKGHPIAYFSKPFTPKLLSASTYVRELFAITSAVKKWRQYLLGHQFTIITDHRSLKELLTQVIQTPEQHTYLARLMGFDYQIQYRSGAHNQAADALSRSPENATPEYPASQFLILFVPCLTFLEELKHQVTINQQYCQKRQAILDSPDSHSDFTIHQNFILQKGRLWLPRDLPIIQSLLQEYHSTPMGGHAGVTKTLARLSENFIWPGLRADVVTYVANFRECQVTKYETKRIAGLLCPLPVPFRPWEDLSIDFVVGLPPFQGKTVLLVIVDRFSKGIHLGILPQVHTAHMVAQLFINIVVKLHGIPRSLVSDRDPLFISGFWQELFKLSGTHLRMSSAYHPQSDGQTEVMNRVIEGYLRAFVHRRPTSWGKFLPWVELSHNTSWNSSTGSTPYEITYGRKPFSFPDYIAGSSKIDAVDDLLLSRDEVFTTIRRKLLKAQASMKKTADAKRREVNYEPGSWVLLKLRPYQQSSVKGAQAVNGKLSKRFYGPFQIIERVGKVAYRLKLPDGARIHPVFHYSLLKPFHGDPILDSPNSLPTRFINGQPMLTPLAILDYRRHKERDTWEVLVQWHGLSPDESSWEDWEQLKQDHHLEDKVILQGPKEVDSSILTEVASKGQTGESINKEGVQLAKAKRKVTRPAYLKDYA

SEQ ID NO: 117286 - protein, 71 aa, Glycine max
  Coding DNA Sequence Number=SeqID_508
  Homolog annotation: Hit_ID=Q53K35; Match level="QueryCoverage=84%, HitCoverage=3%, E-value=3e-16, Identity=60%"; Hit description=HEAT repeat, putative
MNYRIANLFVRGLEVKAWRTKQSSVQVLGAMAYRAPEHLSRCLPKIVPKLIEVGNVIKSPEISGLVPTLLK

SEQ ID NO: 117287 - protein, 206 aa, Glycine max
  Coding DNA Sequence Number=SeqID_509
  Homolog annotation: Hit_ID=UPI000038CAEF; Match level="QueryCoverage =77%, HitCoverage=17%, E-value=9e-07, Identity=25%"; Hit description =COG2319: FOG: WD40 repeat
MRSDCLVQFSILHPFSEPMNRVFVHASSTFEFGAMHSDCLVQFSILHPFSEPMNCVFVHASSTFEFGAMRSDCLVQFSILNLFRSPMNCVFIHASSTFEFGAMRSDFLVQFSILNPFSEPMNCVFVHASSTFEFGAMRSDCLVQFSILNPFSEPMNCVFVHASSTFEFGAMRSDCLVQFSILNPFSETHELCFRSCVLHLRVWSHA

SEQ ID NO: 117288 - protein, 156 aa, Glycine max
  Coding DNA Sequence Number=SeqID_510
MKPWNEKPRRPERKNTTKTSFEGLYRAAIVSSSSEEVKGIITGNIWAIIDECKEKLNLAATHEQRLEDEYAKISAEREARERVIDSLHQEATMRMDRFALTLNRSQELPRLLAEAKAMADTYSAPEKIHGLLSYCHHMIDLMDHMIDLMDHMIRNR

SEQ ID NO: 117289 - protein, 914 aa, Glycine max
  Coding DNA Sequence Number=SeqID_511
  Gene Ontology: Mol. function=zinc ion binding; Cellular component =mitochondrion; Biological process=regulation of transcription, DNA -dependent
  Homolog annotation: Hit_ID=Q6Z3U3; Match level="QueryCoverage=99%, HitCoverage=97%, E-value=0.0, Identity=47%"; Hit description =VP1/ABI3 family regulatory protein-like
  Pfam annotation: Domain name=B3; Domain location=325-442; Score=72.5; E_value=1.4e-18; Accession=PF02362.12; Description=B3 DNA binding domain
  Pfam annotation: Domain name=GATA; Domain location=6-47; Score=4.7; E_ value=0.1; Accession=PF00320.17; Description=GATA zinc finger
  Pfam annotation: Domain name=zf-CW; Domain location=609-654; Score =59.0; E_value=1.5e-14; Accession=PF07496.5; Description=CW-type Zinc Finger
  Pfam module annotation: Pfam domain module=B3::GATA::zf-CW; Domain location=325-442::6-47::609-654
MESRSCMNVACATSTTIRWRKGWALRSGEFADLCDKCGSAYEQSTYCDMFHSNDSGWRECTSCDKRLHCGCIASMSQLELLDTGGVSCISCARNSGLQPIANNEKPNGSGTSKVQNVSTQQQYTSLANQLTVRGMQVGHYAENDGLRCWFKPHNVETDGPSAEMKPEILPSVGELGNTLISQFHCESNGSSKASKAENCKAETEMRDIYESLAQTNLSMTLAAPLGNSNPFHSAVVDEREQSKTSPLLLGSRSRHLLPKPPRSTIGTSLEANAGMVSQIRVARPPAEGRGRNQLLPRYWPRITDQELQQISGEYPAFSNSTIVPLFEKMLSASDAGRIGRLVLPKACAESGNLLKLKDESIVQAYFPPISQPEGLPLRIQDVKGKEWMFQFRFWPNNNSRMYVLEGVTPCIQSMQLQAGDTVTFSRMDPEGKLIMGFRKATNSTAVQETLPSNMPNGSHSSETSYSGVYENLPILSGYSGLLQSQKGCSETHLNALSKKWNSAGGDMNWHSIDMPESRKRDGLPLPPVMVPEKKRTRNIGSKSKRLLIDSQDALELKLTWEEAQDLLRPPPTVKPSIVMIEDHVFEEYEEPPVFGKRSIFVVRSTGVNEQWMQCDSCSKWRKLPVDALIPPKWTCVENLWDQSRCSCAAPNELNPRELDNLLRLNKDVDWNSQKSFPFKFGSDAVVDNSRNKDWQQARDWPWNGNLQDWMLWQMQQYWEMMQVTLAEHQLLPPQNILGIDLGALALSVSSHQKRQSEREAEIAQRNQLSWRTKDESEVDSTSRHLTPVDGLENEVRVQNELDSRSPDDAVAEAAKGQLDLNCQPDREDVQAGPNSLSMTSLLEEANLPLETYLKQNGLTSLITEQQTNSASNVQAQTTNDSEVKHNEDCGTASVIHAQESSPEENSGQDKEQNN

SEQ ID NO: 117290 - protein, 82 aa, Glycine max
  Coding DNA Sequence Number=SeqID_512
MEFLDESGLNKVGVKGFEVYDFISFSLMQYTNDLMMFGEAYWDNLWAIKAIQRIFELVSGLKVYCPGFTSDVASDATLSSPY

SEQ ID NO: 117291 - protein, 296 aa, Glycine max
  Coding DNA Sequence Number=SeqID_513
  Gene Ontology: Mol. function=protein-tyrosine kinase activity; Biological process=protein amino acid phosphorylation
  Homolog annotation: Hit_ID=Q94CI5; Match level="QueryCoverage=19%, HitCoverage=10%, E-value=8e-12, Identity=59%"; Hit description =Protein kinase AtSIK
MGCFTVLKYKKKKINKIRYSTYVSHKEHAPTVLPEPQTHPHSLQSAPPSFRNRVKSFQPINQVTNNRTRALSAPSALDVANQDTLTTVEFEEQEESRYHVGSLMEQRSSSPQPLPLPSRQGGGALNANGSFKSGIASVSLYASGLAPEVTEQDALASVDYEEQEELRHRVGLMKEQCSSIPQPLPLPSPQGGSGGVLKAIGSFKSGTASAPGPLPLPPTGLIRNFTYEEIAAACHNFSSDRCMSERLSSTIYSASFGDDASSAKKFEATVTRLHSSTQPCIERFMIFLPRQKSESS

SEQ ID NO: 117292 - protein, 50 aa, Glycine max
  Coding DNA Sequence Number=SeqID_514
MAIPCGSASTTKKPLTLMKSKKLSRMKKAEWWERIGLKRVGKSTQVVKMK

SEQ ID NO: 117293 - protein, 80 aa, Glycine max
  Coding DNA Sequence Number=SeqID_515
  Subcellular localization annotation: CTP_CleavageSite=48; ConfidenceScore=5.59e-01
MIYPNQQPTKPKSKAQNQQLMVNKLLVVPSFRVPSSPYVRTLCMVLPRSKKVYGIRIEIEGFNIGLGSEVGNWGSKGSKD

SEQ ID NO: 117294 - protein, 845 aa, Glycine max
  Coding DNA Sequence Number=SeqID_516
  Homolog annotation: Hit_ID=Q9SK32; Match level="QueryCoverage=38%, HitCoverage=66%, E-value=2e-18, Identity=27%"; Hit description =Expressed protein
  Pfam annotation: Domain name=DUF1723; Domain location=85-135; Score =30.1; E_value=7.9e-06; Accession=PF08330.1; Description=Protein of unknown function (DUF1723)
  Subcellular localization annotation: CTP_CleavageSite=19; ConfidenceScore=5.36e-01
SHSFLLNTSSLRRRRRNILSPMRKSTRLSAIGLSKPPEGPEPPKPFSTRFSLRSYAKRVQLLTPEQRSVVLRTGFGNLLLVPNHTLNKVFLTELMDAWSCERRAFVLRSGEEIPMTLLDAALILGLPVAGNPVNLTEEEPFSELEESYGATETKRKVAMSFLENRLDSIGEDVSEDFVRSFLLYTIGTFLASNDGKVDSRFLRFLEDLDEVSGFAWGGVVVDDLCQWLDKRKENNVQYVGGCLIFLQTWSYEHFDVAARPQVQDHDLTFPRVCRWDNTKPKRGTSWFKDLDDDQVIWKLQPTSGELQIEVIKEALELLGGNKELQSPESSSTSSTSSVPDVDSGLQLSINKEVHGVDEDDLENQVVEDTPTKSSTCDEEYREQINPENLIVLDTPPDLTICDKVGRGQGMNLENLAVVVEDTPTATSIAEEVSGDEEVNSEKLIVEDTPPDSICDKVCREQEMNLENLEVLVEDTPTADKVGGDQEFNGEKLIVEDTPPVLSFYDDDIRKKNVMLEVKNTELKMKIDQVMEENELLRTQILSNTRFEEQNAELKKELDLLREENRILRLSISDFADRIDRHPSDLAAATTLINPSSSAKYRIVGNQEEISSGMRGLKVSWFDECNSIAVGIFVVAGHIFLGHTVIVALFVFMVSVVQFYGLFEVKFVKVASERNLYCGCVEMGRKVCVGADLVGNVNPTVLGKVSSKVEIEVRVGEATVPNSVLDAVANSLAIWLLTTWPHDTSPCAIGIMVAPRASRHRRAIKKTLVCKLAMTKTIVGSTDCVLWVFFFLLGLGFGFEGVMCFEKLLCGGFRVGLIYWEKAMGLCVYGVQCRQKGHVGGAYLGS

SEQ ID NO: 117295 - protein, 130 aa, Glycine max
  Coding DNA Sequence Number=SeqID_517
  Gene Ontology: Mol. function=lipid binding; Cellular component =cellular_component; Biological process=lipid transport
  Homolog annotation: Hit_ID=Q43019; Match level="QueryCoverage=76%, HitCoverage=78%, E-value=5e-29, Identity=61%"; Hit description =Nonspecific lipid-transfer protein 3 precursor
  Pfam annotation: Domain name=Tryp_alpha_amyl; Domain location=8-97; Score=102.3; E_value=1.5e-27; Accession=PF00234.12; Description =Protease inhibitorseed storageLTP f
MAQGEVSCGQVVSNLTPCISYVLYGGATVPAQCCNGIRNLYGMAQTKPDRQAVCNCIKNAVRNSGFTYSHFNLNLAANLPKNCGVNIPYQISPDTDCTSFKFFQGAVRLVHDVYVSSVRIRGHVTRQGTG

SEQ ID NO: 117296 - protein, 58 aa, Glycine max
  Coding DNA Sequence Number=SeqID_518
MNIRPGETFSSRRIEDFRMKKAWVAQAIDYCLGKSWKMSTFIQSESSNKRLYTNIAHD

SEQ ID NO: 117297 - protein, 80 aa, Glycine max
  Coding DNA Sequence Number=SeqID_519
AAEDRSPSPHSQRDDSSSLMHNILDKLDGLHTFIGERFDSLDSRIDAMDARFAAMDTRITKLEEDVTYVRQCFDLPPPSS

SEQ ID NO: 117298 - protein, 95 aa, Glycine max
  Coding DNA Sequence Number=SeqID_520
  Gene Ontology: Mol. function=lipid binding; Biological process=lipid transport
  Homolog annotation: Hit_ID=Q8S2S8; Match level="QueryCoverage=66%, HitCoverage=69%, E-value=2e-12, Identity=52%"; Hit description=Lipid transfer protein 4-like protein
MASLKVAFLASLLCMVVLPGPMHRLPPEGRITAGAMLQLSEEPQRRRQDHHRPPTMPSCFPARQMWRQHPLHDHHQGLKRKSRTQETGNYLLAYQ

SEQ ID NO: 117299 - protein, 351 aa, Glycine max
  Coding DNA Sequence Number=SeqID_521
  Homolog annotation: Hit_ID=Q1SL66; Match level="QueryCoverage=92%, HitCoverage=57%, E-value=1e-116, Identity=62%"; Hit description =Aldehyde oxidase and xanthine dehydrogenase, a/b hammerhead; Membrane attack complex ...
  Homolog annotation: Hit description=component/perforin/complement C9
MFQQLSMNLYWEEFILVIKKSNYMSFMDVTVIFRRRGGDDLEQNHSKWISTIQSSPDIIEMTFCPITDLLDEVPAKEHLTRAISLYLEYKPPIEELRYFLEFQIPCVWAPLQDRIPGQQRKEPVCPSLQFSIMGQKLYISQEQITVGRRPVTGLCLCLEGSKQNRLSVHVQHLVSLPKILHPYWDSHVAIGAPKWQGPEEQDSRWFEPVKWKNFSHVSTAPIENPETFIGDFSGVYIVTGAQLGVWDFGSRNVLYMKLLYSRLPGCTIRRSLWDHVPNKPPKTVNAENTSNPDNSTLRENATANKLVKYVDLSKMTKGPQDPPGHWLVTGGKLGVEKGKVVLRVKYSLLNY

SEQ ID NO: 117300 - protein, 292 aa, Glycine max
  Coding DNA Sequence Number=SeqID_522
  Homolog annotation: Hit_ID=Q1SL66; Match level="QueryCoverage=81%, HitCoverage=36%, E-value=5e-58, Identity=49%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=157-285; Score= -32.9; E_value=0.0047; Accession=PF01823.10; Description=MACPerforin domain
MGEQVAAVHTASNALQALGRGFDVNFDTRLLYCKGVSGSRVVEIDEEHRRELWLYKDVAVPDVSRDIGCSPEAMVRQSSGVRSFPEYRGHIYGMFDEFDSGFELLFMIVEKRWSWCNEIEMVEYFNERANISGNFPIGSFNSAFSFTGSKHVDAAATKTLSSDGFYIPLAKVQLQKSHLTLQGNVKKAVPVNWDPPSLASFIENFGTHVITSITMGGKDVIYVKQHHTSPLSKLEMKNYIQDIGNQRVLMHFHSIVKGFTPNPRLQHILLGKKHRSIQCLRFYPIVGFTENL

SEQ ID NO: 117301 - protein, 408 aa, Glycine max
  Coding DNA Sequence Number=SeqID_523
  Gene Ontology: Mol. function=RNA-directed DNA polymerase activity; Cellular component=extracellular region; Biological process=RNA -dependent DNA replication
MMIRKQLQEELWIAAQSHESILRQKAKSRWIREGDCNSRYFHLLINASRRNNCLKGVMIDRSWIEEPTKVKEAVRSFFMQRFQEPDQDRPWLDGIFFRTIERHHNDKLLERFKEGEVTSAVWECGSEKSPGPDGLNFKFIKKFLHLIKPDVLRFLDEFYVNGKFPRGCNASFIALLPKVQEPQLLNDYRPISLIGCVYKIVAKLLVNQLKVMPLIIDERQSAFIEGKHMLRSTVIANEVVEEARRGHKSCIVFKVDYEKAYDSVSWNFLLYMIRRMGFCSKWIRWMEGCLKSASISILVNGSPSHEFIPQRGLRQGDPLAPLLFNIVTEALNGLVREAIGKNLYREFLEGSNNVNISILQYADDTIFFGEASMRNVKAIKAILRTFELVSGLKINFVKSSFGAFGMSE

SEQ ID NO: 117302 - protein, 183 aa, Glycine max
  Coding DNA Sequence Number=SeqID_524
  Gene Ontology: Mol. function=chromatin binding; Cellular component =chromatin; Biological process=chromatin assembly or disassembly
  Homolog annotation: Hit_ID=Q1SAV4; Match level="QueryCoverage=60%, HitCoverage=28%, E-value=1e-34, Identity=63%"; Hit description =Integrase, catalytic region
MGYDYQIHYRSRTHNQVADALPRLPEQESSSLMTLSVPSLTYVEELHRHLRDDIAQFVAQCVDCQHTKYETKKMVGLLCPLPVPYFPWEDLSLDFITGLPPYHGNSVILVVVDRFSKGIHLGMLPSSHTAHAVASLFMDIVGKIHGLPGSLVSDRDPLFVKYIAGSSKLDVVDDMLKDIEEIF

SEQ ID NO: 117303 - protein, 250 aa, Glycine max
  Coding DNA Sequence Number=SeqID_525
  Gene Ontology: Mol. function=RNA-directed DNA polymerase activity; Cellular component=chromatin; Biological process=RNA-dependent DNA replication
MYFHITVLSNDHPVSISHDLLLAIQALLNKFNSLFQAPHQLPPKRDTNHHIHLLPNSAPVDSMLQKGLIQPSTTPFSSPVLLVKKQDGLWRFCVDYRALNALTIREKFPIPTIDELLDELGDARCFLKLDLLQGYHQIRIHSEDIPKIAFRTHHGHYEFRVLLDNHFVLKLSKCFFAQPQVEYLSHLVSHQGVQPVASKVAAIHQWPVPQSTNDENPETGQIQAKGPSGEGRRPKWRRMKAQRQRHYQDY

SEQ ID NO: 117304 - protein, 49 aa, Glycine max
  Coding DNA Sequence Number=SeqID_526
MVKRWPSKYWRHFLTVEVIVNNSYTYVDAPFDKSAIELSEAQETPQGLC

SEQ ID NO: 117305 - protein, 532 aa, Glycine max
  Coding DNA Sequence Number=SeqID_527
  Homolog annotation: Hit_ID=Q10EW2; Match level="QueryCoverage=93%, HitCoverage=95%, E-value=3e-94, Identity=42%"; Hit description=Auxin- regulated protein, putative, expressed
  Pfam annotation: Domain name=DUF966; Domain location=32-441; Score =488.4; E_value=8.4e-144; Accession=PF06136.4; Description=Domain of unknown function (DUF966)
MEARMRKYRQVSPERAKVWTEKPPKYHQNRKVPVLYYLCRNRQLEHPHFMEVQLSSPNGLYLRDVIDRLNALRGRGMASLYSWSCKRSYKNGFVWHDLCEDDIILPAHGSEYVLKGSELFYESNSERSGPISNVKIQNLKQLPEPVSFRSHDEASTSSSMTEKETRNSLEDDLSPRQQAGSSDVSPQSRARKSDSLSLPSTECQIYKNDGLADASTQTEENVSKPETQNTYTRGVSTEDDGSLEPECHEICETQVLQLKDNSEICRDTVSPPPSTSSPSSSGGKTETLESLIRADVSKMNSFRIMEEERIRMQTNARLKASNLLMQLISCGSISVKNHSVGLIPSYKDRFSHSKFPSPLFSTSVMFGDFDCIAEKTNVMGLKLEDKEYYSGSIVESKVLKEGDGHSVMKRSSSCNAERTSEELKSQDTEESSSSGNPKCVPQSVKASLTKQLPSECMRSPVSDGSRNSMDKTDGSGISPVPSNGSSKRITEPSSGFGRKQSKRDLGVSSYSFQSLIDEFDFNSTGLLQELGL

SEQ ID NO: 117306 - protein, 90 aa, Glycine max
  Coding DNA Sequence Number=SeqID_528
MAYKYKKGRSTKRGRRAERVWCAERVWRVECDSPVLQFSSMLSVVSIQKEHILIKLLEAFCGMVTVHSKGTGIFDYDIYSSDLIMGIFFI

SEQ ID NO: 117307 - protein, 102 aa, Glycine max
  Coding DNA Sequence Number=SeqID_529
MALSVSCASEVIEGPQPYKERGRMGLFQGGVRRALQGLLPSSHFQVKVWATHNERSEGGVIGLGKGSAITHKSLRIILSSQNCLGGVGQEMDSIGNKCLNTT

SEQ ID NO: 117308 - protein, 341 aa, Glycine max
  Coding DNA Sequence Number=SeqID_530
  Subcellular localization annotation: CTP_CleavageSite=44; ConfidenceScore=5.77e-01
MEPRNPSPSPSPVRVLIRPPSSSSSSPSSSSDHPSPAPAPSLPRSSDGVVVVGFIARRHDDSAQLLNRVIDSNVFASGNLDTPLLVDDEEAREWFERRRISYFHDHDKGILFLQFSSTRCPVNHAAAAPSGFDSAVEEHEFGDLQGMLFMFSEGSHFGTGILRNFRVLQAAKHAMAPFVRYQTMGPLPSRSHPSPSSQPVSSVNNSSPGRGGGNLGRNMSAISLMSGLGSYASLFPGQCIPVTLFVFIDDFSSLSNSSANGEESLDGSSLNQSSSLSSAAKENLPAKGSGSVVVLARPASRSEGGFRKKLQLSLEAQIRFLVKKCRTLSGSEITHSGVRTG

SEQ ID NO: 117309 - protein, 151 aa, Glycine max
  Coding DNA Sequence Number=SeqID_531
  Gene Ontology: Mol. function=copper, zinc superoxide dismutase activity; Cellular component=chloroplast; Biological process =superoxide metabolic process
  Homolog annotation: Hit_ID=P07505; Match level="QueryCoverage=96%, HitCoverage=65%, E-value=3e-59, Identity=74%"; Hit description =Superoxide dismutase [Cu-Zn], chloroplast precursor
  Pfam annotation: Domain name=Sod_Cu; Domain location=23-151; Score =235.4; E_value=1.2e-67; Accession=PF00080.10; Description=Copperzinc superoxide dismutase (SODC)
  Subcellular localization annotation: CTP_CleavageSite=56; ConfidenceScore=5.50e-01
MAAHTILFSSFPAPQSIALPATTKKAVAILKGNSSVHGLVTLTQQQDNGPTTVTVRVSGLTPGPHGFHLHEFGDITNGCISTGPHFNPNKLKHGAPEDKIRHAGDLGNIVANADGVAEATTVDNQIPLIGPNSVVGRALVVHELEDDLGKG

SEQ ID NO: 117310 - protein, 179 aa, Glycine max
  Coding DNA Sequence Number=SeqID_532
MTYREHEKHSLEVAELVLFDGGIESRRRGGGVIHRTASGRELKEQNPLVVVVKVADSPPLEPLPRLLIVDEQRRVEVAGGEDVGVDDAVEELRGIIVPPCDEADDHHAVGGARERRRRCRRGMVGGGGRRRRRRRRRANEDSNRWLGFAVCSALFVTWTLEFDSSSSVSRIQLKISPHK

SEQ ID NO: 117311 - protein, 100 aa, Glycine max
  Coding DNA Sequence Number=SeqID_533
MADFITIGCIKKLNYKNYSTWKTCIESYLQGQDLWEVVNGNETTRPSDAESLTKWRIKSGKAMFVIKMTIEEEMLEHTRHTTTPKDAWDNFVSRSATKIK

SEQ ID NO: 117312 - protein, 65 aa, Glycine max
  Coding DNA Sequence Number=SeqID_534
MRKTCRENESDSDTYTVRESETCHESKSESDTVSETLSLFQCHKSESEIDKGGFMREMSREGSKM

SEQ ID NO: 117313 - protein, 82 aa, Glycine max
  Coding DNA Sequence Number=SeqID_535
MVGGRSGSEGEVQGTKTGSDTIFASTIVMLKRFRSLKEGLQKMVISHEWSTYKDDDVGKTNTNMVCLHLVYEMWDSMIEKIL

SEQ ID NO: 117314 - protein, 906 aa, Glycine max
  Coding DNA Sequence Number=SeqID_536
  Gene Ontology: Mol. function=zinc ion binding; Biological process =metabolic process
  Homolog annotation: Hit_ID=UPI0000196CCB; Match level="QueryCoverage =99%, HitCoverage=98%, E-value=1e-154, Identity=36%"; Hit description= protein binding / zinc ion binding
  Pfam annotation: Domain name=PHD; Domain location=646-704; Score=5.8; E_value=0.015; Accession=PF00628.19; Description=PHD-finger
MAKGADSDEFVVLSRVRTGLKREFAFAMKAQSEICGGSLGRTRASKNRVEAPVQPPSARKRSRKSEEAKTLEDAMSEEEVKSDVVDLQSDDEPKNNNHVGESESAAMQVCEEEPKSDVVLETLISEEQPKMLEPESVISEEEPKVLDDVINEEEAIVAETLKEQEPIVPETLKEEVVDEMAEQPLCIEESEEKDSNGVALALVNDGAKGKKSMKKRLERPQSERRFTRSALKVKSEETNDGEHVGVAGISDGVKRETEAGASLVMTTPSSVKFSNRGKLKKFPAKLRDLLATGILEGLPVMYMKGVKAGWKDGEKGLQGVIQDSGVLCFCKICKGVEVVTPTVFELHAGSANKRPPEYIYIHDGNSGKTLRDVMNACCCCDFPLESMDEAVQKLLGDFTMKKSSICLNCRGACKGVSRLVCDSCLVSPAQTAVASNKGISQPVQPRSPEPVVIQKSLDNEVQPNSLHNEVQPNKLDTGMQPNSLDNGMEPDSLNNSMKPKSFSNGMKHSASRGKSQGRLTRKDLRLHKLVFEADVLPDGTELAYYAHGQKLLVGYKKGYGIFCTCCNEQVPTVSYFTISDCVPLPCIPSGTWYCKYCQNVFQKDRHGQHEVNALAAAGRIAGPDILELMNKRCIRVVRTLEVDHGGCALCSRPNFSKSFGPQTVIICDQCEKEYHVGCLKDHNMENLEELPVGNWFCSGNCSQIHTALMDLVASKEKDVPDPLLNLIKKKHEEKSLDIGAGLDVKWRVINWKLDSDSVETRKLLSKAVAIFHERFDPIVDSTSGRDFIPAMLFGNIRGQDFSGIYCAVLTVNGDIVSAGVFRVFGLEIAELPLVATTADHQGQTLLGSLNVKNLVLPAADEAESIWTGKFGFTKLPQDEINKYKKFYRMMIFQGTSVLQKPVAEAL

SEQ ID NO: 117315 - protein, 157 aa, Glycine max
  Coding DNA Sequence Number=SeqID_537
  Gene Ontology: Mol. function=catalytic activity; Biological process =biosynthetic process
  Homolog annotation: Hit_ID=Q1S7I9; Match level="QueryCoverage=99%, HitCoverage=64%, E-value=7e-50, Identity=54%"; Hit description =Phenazine biosynthesis PhzC/PhzF protein
  Pfam annotation: Domain name=PhzC-PhzF; Domain location=2-157; Score=- 58.2; E_value=5.3e-06; Accession=PF02567.7; Description=Phenazine biosynthesis-like protein
MKVKLCGHATLAAAHTLFSSGLVDTNVIEFVTISGVLTAKKIPAIHITKFRFDESASQLSGALNGASIIDLKRTQIRDDLLVVVTSGKAVSELQPKLDAIVKCPERGDPVCGSAHCALASYWSKKLGKCDFNAYQITSEQASPRGGVLNIHLDEQIQ

SEQ ID NO: 117316 - protein, 257 aa, Glycine max
  Coding DNA Sequence Number=SeqID_538
  Gene Ontology: Mol. function=protein binding; Cellular component =apoplast; Biological process=response to biotic stimulus
  Homolog annotation: Hit_ID=Q1SSC0; Match level="QueryCoverage=57%, HitCoverage=71%, E-value=3e-47, Identity=57%"; Hit description =Thaumatin, pathogenesis-related
  Pfam annotation: Domain name=Mito_carr; Domain location=187-252; Score=-0.6; E_value=0.004; Accession=PF00153.17; Description =Mitochondrial carrier protein
  Pfam annotation: Domain name=Thaumatin; Domain location=68-225; Score= 2.3; E_value=2.1e-08; Accession=PF00314.8; Description=Thaumatin family
  Pfam module annotation: Pfam domain module=Mito_carr::Thaumatin; Domain location=187-252::68-225
MPLSSSQCLLSSFLGSREDASTTRIKPTLVGEQQIHTFAKQLLPLHTTILFLFIVLKVSTSSLVIFYNKCPHQVWPRIQPSAGKLVLARGGFKLSPNWAYSLQLPDLWFGRLWGRHDCTFDIGGHGRYTTATLAKLTLGVSLVDGYNLPISITPFKGSGKCSYEGCVSDLNTICLVDLLVCSCNNKHVVACKIHLFNPFQVIISFFQTAFYTQEGVGALWTGIGPYIARNGIINVVELGSYDQVKQVMKKTLDCIVE

SEQ ID NO: 117317 - protein, 78 aa, Glycine max
  Coding DNA Sequence Number=SeqID_539
MPPPHSSKHTTAPPPKNPLLPPTIMLHHSHIVLDGAIQWWVWCDEEVRVIVMCMAMTSDWVAMQCGHGHLGERQLGFT

SEQ ID NO: 117318 - protein, 133 aa, Glycine max
  Coding DNA Sequence Number=SeqID_540
  Gene Ontology: Mol. function=beta-N-acetylhexosaminidase activity; Cellular component=membrane; Biological process=carbohydrate metabolic process
  Homolog annotation: Hit_ID=Q1SU68; Match level="QueryCoverage=94%, HitCoverage=23%, E-value=4e-48, Identity=78%"; Hit description =Glycoside hydrolase, family 20
MQDSSTRCRRVLHPLHSPFLGHPHCKDHVGRHARTGDILPACMGQPYVDCSGGAGVGFPTLRPPWYYVGYFKELFSCEGLVEDSGSNEHEQAQRVPLARHGLTPALAEKGAYSSHMVYSPEDVKRVVEFGLDC

SEQ ID NO: 117319 - protein, 193 aa, Glycine max
  Coding DNA Sequence Number=SeqID_541
  Homolog annotation: Hit_ID=Q1SU68; Match level="QueryCoverage=40%, HitCoverage=13%, E-value=7e-26, Identity=62%"; Hit description =Glycoside hydrolase, family 20
MRDFSGGMFMEMFAPEGTSGWWCSDFTRFWYQATAAERCLLWWGAEVVMVNVEAMRVAWYGGAHVRFLGFGHKLIMVVECALFTVIRHDNMKSSSKKSVGSSFVIVMVLLTLPLFFIGDLSKKEQVKSNGLHPTRICRSKTALCSKAELCSKTRLCREQAQEEEYNTCVFEGLQPMLMWQTLSDACLPLGPHL

SEQ ID NO: 117320 - protein, 183 aa, Glycine max
  Coding DNA Sequence Number=SeqID_542
MKLWVLPPSTKITTGGVIFIPYQQEFPRQAFVSAMILLIAGEIGGLEKVRGGEVFGKVEDEPIQHPEPSSADGVLELLCESSETAPKRSNSGGNGRGLKKNGPGCKLPIARHPLEPSQRTTVHVERCNGQPFMLWGRVILEELVDLEDPTKWVRSIKPGNLELHAVTDELVNFVREVMQGIIE

SEQ ID NO: 117321 - protein, 930 aa, Glycine max
  Coding DNA Sequence Number=SeqID_543
  Gene Ontology: Mol. function=RNA-directed DNA polymerase activity; Cellular component=chromatin; Biological process=one-carbon compound metabolic process
  Pfam annotation: Domain name=Chromo; Domain location=832-880; Score =35.6; E_value=1.7e-07; Accession=PF00385.14; Description='chromo' (CHRromatin Organisation MOdifier
  Pfam annotation: Domain name=rve; Domain location=540-680; Score =45.5; E_value=1.7e-10; Accession=PF00665.16; Description=Integrase core domain
  Pfam annotation: Domain name=zf-H2C2; Domain location=481-522; Score =9.9; E_value=0.017; Accession=PF09337.1; Description=His(2)-Cys(2) zinc finger
  Pfam module annotation: Pfam domain module=Chromo::RVT_1::rve::zf -H2C2; Domain location=832-880::167-477::540-680::481-522
MVDLHLLPLSGANLVLRVQWLKALGPILTDYNTLSMKFFHGGNLVELKGDDASTLSLLSHPQVHRLLRKDGANTYLHIAITTTEPPSNPTIATLPSEIQPLITKFNSLFQPPQSLPPSRPTDHHIHLQPHSEPVNVRPYRYPHFQKHEIERQIKDMLERDLIRPSISPFSSPVLLVRKHNGSWRLCVDYRALNAITIKDRYLIPTIDELLDELGGANWFSKLDLLQGYYQIRMHEPDVAMTAFRTHHGHYEFKHLIHLEKAFETLLHNQFILKFSKCSFAQSQVEYLGHVVSGQGVAPIASKIQAIDQWPIPMTTKALCSFLGLAGFYRRFIRGYASIVAPLIKVTTKEPFEWTAEADKAFRVLKTALISAPVLVLPNFTLPFTLETDASGVGMGVVLSQKGHPIAFFSKPFTPKMLQASTYMRELCAITTAVKRWRQYLLGHQFTILTDHRSLKELLTQGNRIWLPQGIPFIQTLLTEYHSTLTGGHMGVAKTLARLTENFYWPGIRKDVKHFVAAYVDCQQTKFETKKVVGLLCSLPVPCRPWEDLSLNFIRGLPSFHGHTTILVVVDRFSKGVHLGMLPTQHSAYSVAILFMNITGKLHGMPRSLVSDRDPLFISKFWNELFRLSGTKLRMSSAYHPQIDRQTEKPSSWGKLLYRAEWSYNTSRHSGTGVSPFEITFGRKPPDWPQYITGTSKVEAVDEFLADRESIFSELRKKLQKAQLIMKHSADKKRRDVEFNIRDLVMVRLRPRRQASVTGHHRGFHKLDKKYYGPFKVLDRIGPVAYKLQLPDSSHIHPVFHVSMLKQFHQSALATDHSALALPQVAIDNELVVSPLAILNTRYIVDSDKPKLQVLVQWKGLLPEDTTWEDWEQLQAEYHLENKVSFEGPGDDSQQGYAEAKQHYAAKQDYAENRPKRKSTTRAYLKDYNLC

SEQ ID NO: 117322 - protein, 556 aa, Glycine max
  Coding DNA Sequence Number=SeqID_544
  Gene Ontology: Mol. function=ATP-dependent helicase activity; Cellular component=nucleus; Biological process=rRNA processing
  Homolog annotation: Hit_ID=Q8W4E1; Match level="QueryCoverage=99%, HitCoverage=99%, E-value=0.0, Identity=60%"; Hit description=DEAD -box ATP-dependent RNA helicase 47
  Pfam annotation: Domain name=DEAD; Domain location=137-335; Score =172.9; E_value=8.3e-49; Accession=PF00270.19; Description=DEADDEAH box helicase
  Pfam annotation: Domain name=Helicase_C; Domain location=434-510; Score=87.9; E_value=3e-23; Accession=PF00271.21; Description =Helicase conserved C-terminal domain
  Pfam annotation: Domain name=ResIII; Domain location=133-329; Score= -16.1; E_value=0.001; Accession=PF04851.6; Description=Type III restriction enzyme, res subunit
  Pfam module annotation: Pfam domain module=DEAD::Helicase_C::ResIII; Domain location=137-335::434-510::133-329
MPTLISYRFLLLVGESLHMRRALATSRSVLLHTSVKCMSQVEPHHGSLTVSGIGLQTETEPRNRSKTNKVKPLGSPSENRKSKGKPLGINEKKKKAFRVVEKQQIESAPFAAESFSELGLPHVLIERLEKEGFTVPTEVQSAAVPTILNNHDVIIQSYTGSGKTLAYLLPILSVVGPLRGKTPEGNSDGGESGKKLGIEAVIVAPSRELGMQIVREFEKVLGMDNKRVVQQLVGGANRTRQEDALKKNKPAIVVGTPGRIAELSASGKLRTHGCRYLVLDEVDELLSFNFREDMHRILEHVGRRSGADPNSDSRKAERQLIMVSATVPFSVVRAARSWGCDPLLVQANKVAPLETVSPSEPISLSRSSPSSSPSSAMPSPAAVESLPPALKHYYFVTRVQHKVDVLRRCIHALDAKFVIAFMNHTKQLKDVVFKLEARGMKAMELHGDLGKLARSTTLKKFKNGEVRVLVTNELSARGLDVAECDLVVNLDLPTDSIHYAHRAGRTGRLGRNGTVVTICEESEVFVVKKLQKQLAIPIAACDFAEGKFLVTEEEKT

SEQ ID NO: 117323 - protein, 238 aa, Glycine max
  Coding DNA Sequence Number=SeqID_545
MAQDDASNKVNYMGSHNHQGFHQRGPPGFYQSDNFLQDYDWRYYPSNNFNQGGSPYQHPSQGPSQEEKPINIEELLIQFMQETRSHMKRTDATIKNLEVQIGQLAELVAEKPTETFAVNAEMKPKEDCKVIFTEREEKEKKTEEDVHDEEGEKKEERERNEEKAQQWKKYSQVEIQKESILQVNTPPHQLIVKEERHGEHEKALSVIHSLITTTSLAIMWKVLPEYTSFMASLAKRRK

SEQ ID NO: 117324 - protein, 761 aa, Glycine max
  Coding DNA Sequence Number=SeqID_546
  Gene Ontology: Mol. function=zinc ion binding
  Homolog annotation: Hit_ID=Q6K9X4; Match level="QueryCoverage=81%, HitCoverage=71%, E-value=4e-40, Identity=26%"; Hit description =Ubiquitin-protein ligase-like
  Subcellular localization annotation: CTP_CleavageSite=54; ConfidenceScore=5.01e-01
MAVAGVHNVAVQSTFLRESHSQSSGRQGDGGRGGTRSPSVLQMWREIEDEQVVRQVQGRPGEVQRSDGLVVDLSQENVPNSSNQREEHMIEDAVLGENDSETWSQSQNEFHDEQEELNNSSRETSSDFGVVERERVRQIFREWMNSGSRGHASNNSQGNNSRGEWLGETEQERVSATREWVQMSSHQRGVSSGENREEQSSENGTQIECVRDGFVVNQNEGQCQTEHTRRGIRKLWGRQVFLDMLKKAEMERQREVQELEGFVFRKDNFGCSHATSNTSDTSSENDIDVNTIEDTGASSSQAVPTVHSQQSEPNNRVSDGLEISGDQICSKGTICENLDWQGSTAHVEARDLESSFSTRVERGDGTGGNVDMMPTENPSNDCSQLSLQIEDTEHDNMHEFSEVHTEQSQRGDINNDESNFSNHDDRVYSNIVDDVDLIESIALEGEQQEEVIIENDGSDWHQSVDDIQLSSTTNEWPQNILGSEDGENSRMQEQEVPEVWQEDGGFQEAVEIWLGGPSDNEVAPVGRIHGFYFPEDDNVYSVELRELLSRRSVSNLLRSSFRESLDQLIQSYVERQGHAHVEWELQETTPSSPLAEQVSGQRSRGPIVGPQATVNSSLNRPLPPTPPPQPLWDRHSRHDNWSQSDINNQRLGIVRSFAGHNCFSLADEWDIVNDLRIDMVRLQQRMNNMQRMLEACMDMQLELQRSIRQEVSAALNRSTGSSGQVGIFMTLEGESGWLDPFIYRPVLGQPVEGRTGPFFQV

SEQ ID NO: 117325 - protein, 113 aa, Glycine max
  Coding DNA Sequence Number=SeqID_547
MSTGSSERQGSPQTGEKDYLKPKLMIQPQRVMEEEEIEECKTPTWQSGNQITTMLECPPAPRKKKPTSPNMRKSSAIDDHGQLNFFEEIKPEEVSLSEAFLFKIQFDTKDELF

SEQ ID NO: 117326 - protein, 313 aa, Glycine max
  Coding DNA Sequence Number=SeqID_548
  Gene Ontology: Mol. function=beta-N-acetylhexosaminidase activity; Cellular component=cellular_component; Biological process =carbohydrate metabolic process
  Homolog annotation: Hit_ID=Q1SU68; Match level="QueryCoverage=99%, HitCoverage=55%, E-value=1e-160, Identity=83%"; Hit description =Glycoside hydrolase, family 20
  Pfam annotation: Domain name=Glyco_hydro_20; Domain location=1-264; Score=128.2; E_value=2.3e-35; Accession=PF00728.12; Description =Glycosyl hydrolase family 20, catalytic domain
MAGHTGSWALAYPEIVTCANMFWWPAEGDIIAAEPGTGHLNPLNPKTYQVLKNVIRDTTTLFPEPFYHSGADEIVPGCWKTDPTIQKYLSNGGTLSQVLEKFINNTLPFIVSLNRTVVYWEDVLLSETVHVPSTILPKEHVVLQTWNNGHNNTKRIVSSGYRAIVSSSDFYYLDCGHGGFVGNNSIYDQQNGGDKDSGGSWCGPFKTWQTIYNYDIAYGLSEEEEKLVLGGEVALWTEQADSTVLDGRIWPRSSALAESLWSENRDEKGMKRYAEATDRLNEWRSRMVSRGIGAEPIQPLWSVRNPGMCNTVH

SEQ ID NO: 117327 - protein, 147 aa, Glycine max
  Coding DNA Sequence Number=SeqID_549
MKRSEEFEFEFPAAVYVSGGVPNDVVFCGKVMTRRTEGETRALLRSETSNGFMAWLRSPSGRESRRYRRIESCRRRYNGMFGTVMKFPLQMELSDIKMRQERRELPPTMPKVAAKGDGGESCWELVQPLRRRGTLKNALFGCLVPVV

SEQ ID NO: 117328 - protein, 120 aa, Glycine max
  Coding DNA Sequence Number=SeqID_550
MGSFDGIPGVKGKEVLFRHGNKTRTHGYPPKSVLTLTGNTRVDRVWVRVRVFPDNQKSSTGTDWGYPIPDGYGDGTINSNASGIGYGYENMLMSREREVSAEARCSEIGRGDPFALELSG

SEQ ID NO: 117329 - protein, 50 aa, Glycine max
  Coding DNA Sequence Number=SeqID_551
MALNEKLGASGNEKEQLTSDDDVGVILRQKATRELRLRFHGDGGGGSLNL

SEQ ID NO: 117330 - protein, 87 aa, Glycine max
  Coding DNA Sequence Number=SeqID_552
MKTITSSFEGMSNQGAPRWVEPKSNVQSGGFECGYYVMHWMWCIVTAGLKDDWHKWFSDGSPLDVEAITTVRQKWATYFLTFRKSSC

SEQ ID NO: 117331 - protein, 237 aa, Glycine max
  Coding DNA Sequence Number=SeqID_553
  Gene Ontology: Mol. function=zinc ion binding
MCEAFNKCILELRGKPIINLVEGIKVYLMMRIVRIREMMLKYCGPTYPKIQLILANIEKDAKAWTLTLCVACLWHNNYKPEDYVADWYKYVYFGIRKTLIWPVIHTIFEHVMIQTSGQKSDLPPINHHDIRRAPGRPKKMRNKLNDESMDKFKLPRHQFSVVCANYGKFGHKKGPVNKSKKDATFESTHGESFGSAQARPTRITNSSARMQSSAPTLSQISSQSIDASAPQTQQSQV

SEQ ID NO: 117332 - protein, 130 aa, Glycine max
  Coding DNA Sequence Number=SeqID_554
  Gene Ontology: Mol. function=nucleotide binding; Cellular component =chloroplast; Biological process=intracellular protein transport
  Homolog annotation: Hit_ID=UPI00000482A1; Match level="QueryCoverage =41%, HitCoverage=3%, E-value=1e-13, Identity=80%"; Hit description =ATP binding / ubiquitin-protein ligase/ zinc ion binding
MKGSPSCALEAFILSSEPMNAVCTFESRICPAFCPMPQAKAKKLQTLACGQLKLHPCFKPNRAFTRGGKPERDAFIVENSEFLSGLLREWNIPHNVLNARPKQKKLKLLLKPDGNMPLPSLQIWQAGAQI

SEQ ID NO: 117333 - protein, 152 aa, Glycine max
  Coding DNA Sequence Number=SeqID_555
  Gene Ontology: Mol. function=protein serine/threonine kinase activity; Cellular component=plasmodesma; Biological process=protein amino acid phosphorylation
  Homolog annotation: Hit_ID=O82321; Match level="QueryCoverage=64%, HitCoverage=32%, E-value=6e-35, Identity=71%"; Hit description =Putative casein kinase I
MHSRAYVHGVVKPENVFLGTLANVEEKKLFLVDLGLETHWQDSSASLHLEYDQRPYVFRGTTRYASVLVHIGRTSRRRDDLESLAYTLIFLLHGWLPWQLKRGQLIVEEENDEQPKKKVRMGMLAIPWISVYNGHRPMKESYHFNVTDVHLS

SEQ ID NO: 117334 - protein, 164 aa, Glycine max
  Coding DNA Sequence Number=SeqID_556
  Gene Ontology: Mol. function=serine carboxypeptidase activity; Cellular component=extracellular space; Biological process =proteolysis
  Homolog annotation: Hit_ID=Q6JJ33; Match level="QueryCoverage=89%, HitCoverage=30%, E-value=1e-51, Identity=69%"; Hit description =Putative serine carboxipeptidase
  Pfam annotation: Domain name=Peptidase_S10; Domain location=13-163; Score=-175.2; E_value=0.00054; Accession=PF00450.12; Description =Serine carboxypeptidase
MDQKNGAMYKSDPKPTCSGWLYRSAHRVDNPSKPWPIILWLQGGPGSSGVGNFKEIGPLDDNLKPRNFTWLKKADLLFVDNPVGTGYSFVEDSRLLVKTDKEAATDLTTLLTELFNGDYSLQKSPFFIVAESYGGKFAVTLGLSVIKAIHKGKLKLKLGGIFLS

SEQ ID NO: 117335 - protein, 159 aa, Glycine max
  Coding DNA Sequence Number=SeqID_557
  Gene Ontology: Mol. function=magnesium ion binding; Cellular component=membrane; Biological process=metabolic process
  Homolog annotation: Hit_ID=Q1T1D0; Match level="QueryCoverage=98%, HitCoverage=28%, E-value=8e-68, Identity=75%"; Hit description =Terpene synthase-like; Terpenoid synthase
  Pfam annotation: Domain name=Terpene_synth_C; Domain location=34-159; Score=21.8; E_value=9.1e-07; Accession=PF03936.6; Description=Terpene synthase family, metal binding domain
MVHALELPSHWRVQWFDVKWNVEQYKKEKHMDPIFLELAKLNFNMIQAKLQIEVKELSRWWENLGIKKELSFARIRLVESFMCAVGVAFEPKYKSIKKWLTKVIIFVIILDDVYDIHASFEELKPFTMAFERWDDKELEELPEYMKICVHALKDVTNCL

SEQ ID NO: 117336 - protein, 106 aa, Glycine max
  Coding DNA Sequence Number=SeqID_558
MKEFIRDALEWTALDGSKARQTTGSVVDPIHAPAVRSLIFQMKEGFGSHAMVRYKEVTSKDAELRTTRQEAALTTMTIVQDDDNHVKRMKIMKAYSWCLAKRGLCA

SEQ ID NO: 117337 - protein, 73 aa, Glycine max
  Coding DNA Sequence Number=SeqID_559
MKKKQEAEEEAGSQRGRRSGKRHSGIVTRPYESLFVFIRIGESRLKGCDYCKRRKHDAAIAYFSSRLNANLYG

SEQ ID NO: 117338 - protein, 123 aa, Glycine max
  Coding DNA Sequence Number=SeqID_560
  Gene Ontology: Mol. function=serine-type peptidase activity; Cellular component=lysosome; Biological process=proteolysis
  Homolog annotation: Hit_ID=Q8LFB7; Match level="QueryCoverage=99%, HitCoverage=28%, E-value=4e-29, Identity=47%"; Hit description =Prolylcarboxypeptidase-like protein
HRYYGKSVPFGSREEALKNASTIGYFNSAQAIADYASVLIHIKKTLHAQKSPCLLHGLGSNIPTWLLVLWPHQLQSSTSIILPHKTEASETCYQTILKSWSEIDRVASQPKGLSILSQRFNTC

SEQ ID NO: 117339 - protein, 92 aa, Glycine max
  Coding DNA Sequence Number=SeqID_561
MELNKRTKHVRISTLISLEFKDWEPPKKKVLGFSSFPPSWKAFALCPNLPFDRRATRGLTGASSKGARRAELPPMFIRGKRQKNRKGVVYEL

SEQ ID NO: 117340 - protein, 83 aa, Glycine max
  Coding DNA Sequence Number=SeqID_562
  Gene Ontology: Mol. function=ribonuclease H activity; Biological process=DNA integration
MDPVKYIFEKPTLTGRIAWWQVLPSEFDIVYITQKAIKGSALADYLAQQPLNDYQPLHPEFPDEDIMALFEEKLDKDRDKWIV

SEQ ID NO: 117341 - protein, 64 aa, Glycine max
  Coding DNA Sequence Number=SeqID_563
MGSVVRHGLSGSSMWWHWVRLFDIGIHRPTLQTTCLAGCNSAEEMLLSRKKANRGGRGGDRKDS

SEQ ID NO: 117342 - protein, 672 aa, Glycine max
  Coding DNA Sequence Number=SeqID_564
  Gene Ontology: Mol. function=RNA-directed DNA polymerase activity; Biological process=RNA-dependent DNA replication
MASNGSLCWPLVVVGGGDEGTPLIPLAEDTYKFDTGDRGAYSNDDPSLMSVHSRFRRESPPENSNPLPTTMVDNDALRQLEARIAEMECHHEEELNRLKADHDEFKAHVDLPKVWKPLNLERYDRTTDSEDHLDTPYDLASLSTTYAKNLLVAWMSYESDLRAIFRWKKCRGFETKFDRLDKSVRNERLAQGPTHPSRTSDTNRTSVNLFQGDQGVEMLIKEGNKPRREGGRGVTRKGVNTNPNKSKKMNLPSRLGADFPMEGYLAIPYSIIPMPSEDDPMVFSNGIANFMVSKFLNDQGSSSDILYWKTFQRLEISPAMIQPQYGPFLGFSRERVETRGYNTLNELGAIVSTPHLKMKFHTLTREIVIVKADQKQARQCYNKSLKVASHSPIRELGKPHSSFDGSNSQVMSVNEDLSIKTLTVYEIARIDKLLKAQFIREVRYSTWPTNVVMVKKANGKCRTCTDYTNLNKVCPKDAYPLPSIDKLVDGTSGFQLLSFLDMYLGYNKIMRHPSDEEKTAFIIEGANFCYRVMLFGLKNCGQHVVDLEEMFRVIRKYDMCLNPEKYTFGVDGEKFLGFMITYWGIEANPNNYTIIQEMQNLTNVKEIQKLNDNRASLFRFLTKLAKKTKPFYRLLRKTESFLWDEASKQAFLAFKIANSKLTKARSTPTPLP

SEQ ID NO: 117343 - protein, 138 aa, Glycine max
  Coding DNA Sequence Number=SeqID_565
  Gene Ontology: Mol. function=RNA-directed DNA polymerase activity; Cellular component=mitochondrion; Biological process=RNA-dependent DNA replication
MISPKYAGKFLFPQALGLVNSRAQGFKDNLICCFHLVVCLRVLDRSYEEFFVGLSLELGAVVSDNGIGRIVSAYEVFPAQVVEVVGGCARNIYELLASFASPHEVEGVSLERQAIVAGTYYLGFQGVPPYMKAADSFM

SEQ ID NO: 117344 - protein, 370 aa, Glycine max
  Coding DNA Sequence Number=SeqID_566
  Gene Ontology: Mol. function=serine-type peptidase activity; Cellular component=lysosome; Biological process=proteolysis
  Homolog annotation: Hit_ID=Q8LFB7; Match level="QueryCoverage=90%, HitCoverage=66%, E-value=1e-112, Identity=59%"; Hit description =Prolylcarboxypeptidase-like protein
  Pfam annotation: Domain name=Abhydrolase_1; Domain location=126-352; Score=-5.6; E_value=0.021; Accession=PF00561.10; Description =alphabeta hydrolase fold
  Pfam annotation: Domain name=Peptidase_S28; Domain location=62-368; Score=19.0; E_value=7.3e-15; Accession=PF05577.2; Description=Serine carboxypeptidase S28
  Pfam module annotation: Pfam domain module=Abhydrolase_1::Peptidase _S28; Domain location=126-352::62-368
MGSVLPSFQWLSLFFLIISVNVCAFKIPRLGTWQRSTKERDPEISSSLHLSDDDLKTFYYTQRLDHFNYRPDSYHTFQQRYMVNFKYWGGAKSSAPIFAFFGAEGPVDEDAKYIGFLRDNAPQFNALIVFIEHRYYGKSIPFGSSEEAMRNASTRGYFNSAQAIADYAAVLLHIKKTLSAQNSPIIVIGGSYGGMLASWFRLKYPHIALGALASSAPILYFNGIAPQAGYYYIVTKDFKETSESCYQTIRKSWSEIDRVAKKPNGLSILSKRFKTCDKLNKSFDLKDYLDSLYTDAAQYNYPSEHPVKIVCGAIDAAAKKTDILGQIFEGVVAYKQHRSCYDMNEYNHPTESFLGWRWQFSLLVRCMVWF

SEQ ID NO: 117345 - protein, 236 aa, Glycine max
  Coding DNA Sequence Number=SeqID_567
  Subcellular localization annotation: CTP_CleavageSite=6; ConfidenceScore=5.55e-01
MNSLPSAVHASSTNESGGPRIDCLALFASSPFPTFIRSPMNLLPSAGHVSSTFESRAPRIDCLALVTNSPFSTFIRSPMNSLPSVVHVSSSFESGTPQIDFLALLANFPFSTFIQSPMNSLPSAVHVSSTFDSGAPRIDCLAKFASSPFSTFIRSPMNSLPSAGHASSTIESGAPQIDCLDLFANSPLSTFIPSPLNSLPSAMHDSSIDESGAPRIDCLKLFADSPFPTFMRRPLN

SEQ ID NO: 117346 - protein, 150 aa, Glycine max
  Coding DNA Sequence Number=SeqID_568
  Gene Ontology: Mol. function=serine-type peptidase activity; Cellular component=lysosome; Biological process=proteolysis
  Homolog annotation: Hit_ID=Q8LFB7; Match level="QueryCoverage=89%, HitCoverage=26%, E-value=3e-47, Identity=60%"; Hit description =Prolylcarboxypeptidase-like protein
TCSEIIMPIGHEKNDSMFPPAPFNMKTFVQECRSLYGVLPQPHWVTTYYGGPDLKLILHRFASNIIFSNGLRDPYSSGGVLESISNTVVAVTTVNGCHCLDIQSRKANDPQWLVTQRNTEVKIIKGWIAEYKADLIALTKQIKAPAEPKS

SEQ ID NO: 117347 - protein, 143 aa, Glycine max
  Coding DNA Sequence Number=SeqID_569
  Gene Ontology: Mol. function=ribonuclease H activity
  Homolog annotation: Hit_ID=Q1RYI2; Match level="QueryCoverage=76%, HitCoverage=16%, E-value=9e-09, Identity=32%"; Hit description =Ribonuclease H
MSIIRDITNVIKVDLSPIMVDLETNQVKTDGHYNVDASVRETCPVVGCEDILRDFVVETWMTTFTCKLGSCSIITTKDWGRFPALQHAWDMGKKSVSIESDSLTAVKILQQRVLANHSYFDLIRLGQSLVNRRWRMRITHIHR

SEQ ID NO: 117348 - protein, 50 aa, Glycine max
  Coding DNA Sequence Number=SeqID_570
MKDWGNFLHRILEEDSEDSTPITTFFLVWRFGGKQRRLMVATGGRGWWRR

SEQ ID NO: 117349 - protein, 142 aa, Glycine max
  Coding DNA Sequence Number=SeqID_571
MATSKLNLLFLRMRNPVQKLGNQFGSSWNAWEYEFKFGSVEGLSAAASKCAGTLFGCWGTSYIEKDIKFFTISENNPFFMKQTHPNLDDEALDIMIENVVTNESSASMSSSTSTNVPNFEKVFVGQRVTGGNDRSTGAGATE

SEQ ID NO: 117350 - protein, 153 aa, Glycine max
  Coding DNA Sequence Number=SeqID_572
MAFLGETSSQTVVNSTLGFIFPTESIVYNDSGVSFQASTPVPIRVPNGCDFQTLKTIIHNTLKLTDKQFLDEIYYRQPFTYAATMTPTYDALLYYNGRWNMSRKNEFVGYSFIGKNPKKFDIPIGCTMDELKDLIKQVVPPGISLYGIDETQM

SEQ ID NO: 117351 - protein, 530 aa, Glycine max
  Coding DNA Sequence Number=SeqID_573
  Gene Ontology: Mol. function=protein serine/threonine kinase activity; Cellular component=cellular_component; Biological process =protein amino acid phosphorylation
  Homolog annotation: Hit_ID=Q9FYB3; Match level="QueryCoverage=95%, HitCoverage=94%, E-value=0.0, Identity=68%"; Hit description=SRPK4
  Pfam annotation: Domain name=Pkinase; Domain location=40-467; Score =163.7; E_value=4.6e-46; Accession=PF00069.15; Description=Protein kinase domain
  Pfam annotation: Domain name=Pkinase_Tyr; Domain location=40-465; Score=-95.4; E_value=1.3e-06; Accession=PF07714.7; Description =Protein tyrosine kinase
  Pfam module annotation: Pfam domain module=Pkinase::Pkinase_Tyr; Domain location=40-467::40-465
MAEDRSEVSDYSSEDEGTEDYRRGGYHAVRIGDTFKNGSYVVQSKLGWGHFSTVWLAWDTHKSRYVALKIQKSAQHYTEAAMDEIKILKQIADGDPDDKKCVVKLLDHFKHSGPNGQHVCMVFEFLGDNLLTLIKYSDYRGVPLPMVKEICFHILVGLDYLHRELSVIHTDLKPENVLGGGSPIDPSKDPRRSGIPLYPSGALNGDLTKNQKKKLRKKAKKAAQGCAGKENAEEVEEDSKAPDEQDDCSNDVKPSVEPGEVKPNSPVRKDQSTKTSENKDIPQGSHGNRRGSRSTRKKLLEAVDLKCKLVDFGNACWTYKQFTNDIQTRQYRCPEVLLGSKYSTPADLWSFACICFELASGDVLFDPHSGDNYDRDEDHLALMMELLGMMPRKIALGGCYSRDFFNRYGDLRHIRRLRFWPLNKVLTEKYDFSEQEANNMTDFLLPLLDFVPEKRPTAAQCLQHPWFSAGPQTLEPSLTAVKHDAIEGEISEKMQREKAEQEAVEVGMGNMAIDGNPKPLKEFQSMKPSE

SEQ ID NO: 117352 - protein, 105 aa, Glycine max
  Coding DNA Sequence Number=SeqID_574
MTNSTTLATTIDDVATRSSIVRDFVASSGSISTKEAHSVKGFKKMVLLMGDWADKAVEIGGEEKIIIYVLGRGVGNDGEVVRVKVGEFSGLGSVMGDQGNWWEGE

SEQ ID NO: 117353 - protein, 333 aa, Glycine max
  Coding DNA Sequence Number=SeqID_575
  Gene Ontology: Mol. function=hydrolase activity, acting on ester bonds; Biological process=lipid metabolic process
  Homolog annotation: Hit_ID=Q9FFC6; Match level="QueryCoverage=93%, HitCoverage=98%, E-value=4e-98, Identity=57%"; Hit description=GDSL -motif lipase/hydrolase-like protein
  Pfam annotation: Domain name=Lipase_GDSL; Domain location=29-324; Score=140.8; E_value=3.6e-39; Accession=PF00657.12; Description=GDSL- like LipaseAcylhydrolase
MGSSSYFFTSLLLVVVFNLAKGQPLVPALFIFGDSVVDVGNNNHLYTIVKANFPPYGRDFKNHNPTGRFCNGKLASDYTAENLGFTSYPPAYLNLKAKGNNLLNGANFASAASGYYDPTAKLYHAIPLSQQLEHYKECQNILVGTVGQSNASSIISGSIYLISAGNSDFIQNYYINPLLYKVYTADQFSDILLQSYVTFIQASRKIGVTTLPPMGCLPATITLFGSDSNQCVVKLNNDAINFNKKLNTTSQSLQKSLSGLKLAILDIYQPLYDLVTKSSENGLLETSVLCNQKSIGTCANASEYVFWDGFHPSEAANKVLSDDLLAAGISLIS

SEQ ID NO: 117354 - protein, 275 aa, Glycine max
  Coding DNA Sequence Number=SeqID_576
  Gene Ontology: Mol. function=metal ion transporter activity; Cellular component=membrane; Biological process=metal ion transport
  Homolog annotation: Hit_ID=Q0WN74; Match level="QueryCoverage=88%, HitCoverage=76%, E-value=9e-76, Identity=62%"; Hit description =Magnesium transporter protein
  Pfam annotation: Domain name=CorA; Domain location=3-275; Score =111.9; E_value=1.9e-30; Accession=PF01544.9; Description=CorA-like Mg2+ transporter protein
MAQEGQEKCGLEQKAHRGLVTVFDFWAVNFQVVEAALLSRIQRLEQRLMELEPRVQALLEALPNRLTGDILEQLRISKQTLVELGSKAGALRQMLLDLLEDPHEIRRICIMGRNCTLSKGNNDMECSVPFEKQIAEEEEEEIEMLLENYLQRCESCHGQAERLLDSAREMEDSIAVSLSSRRLEVSRVELLLQVGTFCVAIGALVAGLTRFRIGRTQLDIRRNVTKEHAGIFGMNLKSYLEEHVLAFWLTTAGIIIGGIIAFFLMYSYLRARKIF

SEQ ID NO: 117355 - protein, 612 aa, Glycine max
  Coding DNA Sequence Number=SeqID_577
  Gene Ontology: Mol. function=signal transducer activity; Cellular component=membrane; Biological process=response to light stimulus
  Homolog annotation: Hit_ID=Q6JJ40; Match level="QueryCoverage=99%, HitCoverage=98%, E-value=0.0, Identity=66%"; Hit description =Putative non-phototropic hypocotyl 3-like protein
  Pfam annotation: Domain name=NPH3; Domain location=226-462; Score =307.3; E_value=2.8e-89; Accession=PF03000.5; Description=NPH3 family
MAPAGKLSGFRREGSDWFCNGGLPSDITVSIDGVTFHLHKFNFEIPAAYVELGVGQGQFPLLSKCGKIVRAHEESKNTDGALKMVLEEFPGGPDTFLIAAKFCYGYRVELTARNVVSVHCAAEYLEMTDEFGEGNLLSKSESFFHKNTLRNWKDCILALQSSEPVLPKAEKLHLVGKCLNALSMMVCTDPSLFGWPMMMYGSFQSPGGSILWNGINTGARIRSSESDWWFEDISYLSVSLFERLIKTMQARGIRPENLAGAIMYYSRKHLPGLGRWHGGQGGKARTVASFSLTPATVDQRVLLESIEKFLPDKKGKSYCRFLLGLLRVALILNVSQTCKDSLERRIGMQLELATLDSLLIPTYSDSDALYNTESSPSSSSESLRKVAKLMDSYIAEIASDVNLKPGKIRRLAEALPESSRLLHDGLYRALDIYFKAHPWLSDREKEELCNIIDYQKLSIHACAHASQNDRLPLRAVLQVLFFEQLHLRTALAGCLNALDGEIAPAAPVPITALGDTASEIVQRDGWVTVVRENQVLKVDMDRMSSRVGELEEEFSKIKQEMKSVTKSHSSRSSPRLVARKIGCKLVPRPSDAQPESLNRTGSTPRASIEWAR

SEQ ID NO: 117356 - protein, 114 aa, Glycine max
  Coding DNA Sequence Number=SeqID_578
MTELVRVAEKSEALAPTYPQMRNSDLRADNRNVSPRATRFLGHGNKKGGVIEKSEALAPTYPQMRNSDLHNRKVSPRATRFLGHGNTKGGVVDKSEALAPTYPQMRNSDLRSSG

SEQ ID NO: 117357 - protein, 217 aa, Glycine max
  Coding DNA Sequence Number=SeqID_579
  Gene Ontology: Mol. function=porin activity; Cellular component =integral to membrane
  Homolog annotation: Hit_ID=Q1N7H2; Match level="QueryCoverage=67%, HitCoverage=29%, E-value=1e-21, Identity=39%"; Hit description =Phosphate-selective porin O and P
  Subcellular localization annotation: CTP_CleavageSite=26; ConfidenceScore=5.04e-01
MNHSTVLPLAVLPVALGLLLASGHVGAQAVSSPPAPLSQAELSRLVQQQALQIQQLEARLRAVEGGRGTSGAAVATQAPALDTRIAALESSQAKAPKVTWSKGAPEFSSADGSVVFRPRGRLFVDASSTDGSSVSDRNISGTEIRSVRLGAEGRYGILGWAVEGDFADNAVAWKSVYTTVDHRLFGLPADLTVGNRLNDRGIDGSSSTSNTPFQDRN

SEQ ID NO: 117358 - protein, 123 aa, Glycine max
  Coding DNA Sequence Number=SeqID_580
MMTMIVDTLSVFYYGKWWAMHLQSFADLVFASERIDVGLKKGKFSHPAWTNEKTGTNEEGEDEGKARAVTAIPIQPSFPPTQPCCYSANNKSSPYPPPSYPQRPSLKSTTKPTYRTSNDKHHI

SEQ ID NO: 117359 - protein, 88 aa, Glycine max
  Coding DNA Sequence Number=SeqID_581
MVEEEEKKKAAEKNLTFETLKSYLGLRAVSLVPVPRVSLRPSGPVFKKISRMLQHVELHPSVKVAVIAVYHTVEVLAGTKNLSHALRC

SEQ ID NO: 117360 - protein, 101 aa, Glycine max
  Coding DNA Sequence Number=SeqID_582
  Homolog annotation: Hit_ID=Q6JJ39; Match level="QueryCoverage=28%, HitCoverage=2%, E-value=3e-08, Identity=96%"; Hit description =Putative adapitin protein
  Subcellular localization annotation: CTP_CleavageSite=16; ConfidenceScore=5.34e-01
MENKMRFQKSIVPQLNSSSSSSPLPFSFAFPQFGAEDQPPLKFAFGSDRIRNPIEFRDLKRKRREGSASAIGDGDVGDARTLRVHKRYSQLPEQGAGEAPR

SEQ ID NO: 117361 - protein, 972 aa, Glycine max
  Coding DNA Sequence Number=SeqID_583
  Gene Ontology: Mol. function=structural molecule activity; Cellular component=clathrin coat of trans-Golgi network vesicle; Biological process=intracellular protein transport
  Homolog annotation: Hit_ID=Q6JJ39; Match level="QueryCoverage=99%, HitCoverage=90%, E-value=0.0, Identity=77%"; Hit description =Putative adapitin protein
  Pfam annotation: Domain name=Adaptin_N; Domain location=2-536; Score =268.0; E_value=1.9e-77; Accession=PF01602.10; Description=Adaptin N terminal region
  Pfam annotation: Domain name=Alpha_adaptinC2; Domain location=700 -809; Score=11.6; E_value=0.00025; Accession=PF02883.10; Description =Adaptin C-terminal domain
  Pfam annotation: Domain name=Alpha_adaptin_C; Domain location=815 -929; Score=-5.5; E_value=3.4e-05; Accession=PF02296.7; Description =Alpha adaptin AP2, C-terminal domain
  Pfam annotation: Domain name=HEAT; Domain location=334-370; Score =13.7; E_value=0.7; Accession=PF02985.12; Description=HEAT repeat
  Pfam annotation: Domain name=HEAT; Domain location=80-118; Score=7.8; E_value=4.8; Accession=PF02985.12; Description=HEAT repeat
  Pfam module annotation: Pfam domain module=Adaptin_N::Alpha _adaptinC2::Alpha_adaptin_C::HEAT::HEAT; Domain location=2-536::700 -809::815-929::334-370::80-118
MLYIYMLGYDVDFGHMEAVSLISAPKYPEKQVGYIVTSSLLNENHDFLRLAINTVRNDIIGRNETFQCLALTMVGNIGGREFAESLAPDVQKLLISSSCRPLVRKKAALCLLRLYRKNPDVVNVDGWADRMAQLLDERDLGVLTSSMSLLVALVSNNHEAYWSCLPKCIKILERLARNQDIPQEYTYYGIPSPWLQVKTMRALQYFPTIEDPNARRSLFEVLQRILMGTDVVKNVNKNNASHAVLFEALALVYHGPLTPLFAGCLHFYTSGRIWWWCGVYGIHLVGSVMHLDAEKEMMSQCVALLGKFIAVREPNIRYLGLENMTRMLMVTDVQDIIKRHQAQIITSLKDPDISIRRRALDLLYGMCDVSNAKDIVEELLQYLSTAEFAMREELSLKAAILAEKFAPDLSWYVDVILQLIDKAGDFVSDDIWFRVVQFVTNNEDLQPYAAAKAREYLDKPAIHETMVKVSAYILGEFGHLLARRPGCSPKELFSIIHEKLPTVLLTHLLIFRYESSIEVEIQQRAVEYFALSRKGAALMDILAEMPKFPERQSALIKKAEDNEVDTAEQSAIKLRAQQQSQTSNALVVTEQSHVNGTPPVGQLSLVKVPSMSSNVDEADQRLSQENGTLSIVDSQPPSADLLGDLLGPLAIEGPPSSSVHLQPSSNSGVEGTVVEATAIVPAGEQANSVQPIGNIAERFHALCVKDSGVLYEDPYIQIGIKAEWRAHQGHLVLFLGNKNTSPLVSVQALILPPTHLKMELSLVPETIPPRAQVQCPLEVINLHPSRDVAVLDFSYKFGNDMVNVKLRLPAVLNKFLQPITISAEEFFPQWRSLPGPPLKLQEVVRGVRPLPLLEMANLFNSYHLTVCPGLDPNPNNLVVSTTFYSESTRAMLCLVRIETDPADRTQLRMTVASGDPTLTFEMKEFIKDQLVSIPAIATRVPTQPAPTSPPLAQPGSAPAALTDPGAMLAALL

SEQ ID NO: 117362 - protein, 68 aa, Glycine max
  Coding DNA Sequence Number=SeqID_584
MEQGGLFPAQDNSTLASLGNSVSCHKVHKIIRSTRAFKASDHRKYENIQSIEPRWIPGYQWEIVGEVL

SEQ ID NO: 117363 - protein, 1618 aa, Glycine max
  Coding DNA Sequence Number=SeqID_585
  Gene Ontology: Mol. function=zinc ion binding; Biological process =proteolysis
  Homolog annotation: Hit_ID=Q53PX0; Match level="QueryCoverage=97%, HitCoverage=90%, E-value=0.0, Identity=31%"; Hit description =Expressed protein
  Pfam annotation: Domain name=C1_2; Domain location=1570-1597; Score =13.1; E_value=0.1; Accession=PF03107.7; Description=C1 domain
  Pfam annotation: Domain name=C1_2; Domain location=390-415; Score =5.6; E_value=0.7; Accession=PF03107.7; Description=C1 domain
  Pfam annotation: Domain name=C1_3; Domain location=1569-1597; Score =4.1; E_value=0.17; Accession=PF07649.3; Description=C1-like domain
  Pfam annotation: Domain name=C1_3; Domain location=389-415; Score =5.2; E_value=0.12; Accession=PF07649.3; Description=C1-like domain
  Pfam annotation: Domain name=DDT; Domain location=183-242; Score =39.9; E_value=8.7e-09; Accession=PF02791.7; Description=DDT domain
  Pfam annotation: Domain name=PHD; Domain location=1297-1347; Score =6.6; E_value=0.012; Accession=PF00628.19; Description=PHD-finger
  Pfam annotation: Domain name=PHD; Domain location=390-435; Score =39.3; E_value=1.3e-08; Accession=PF00628.19; Description=PHD-finger
  Pfam module annotation: Pfam domain module=C1_2::C1_2::C1_3::C1 _3::DDT::PHD::PHD; Domain location=1570-1597::390-415::1569-1597::389- 415::183-242::1297-1347::390-435
MEEPPVVRSRGRPRKRRREDDATVTGDAKTLPEAKKMMPIALVGRYVLKEFRRNTVLLGKVARYASGLYRVVYESGGFEDLDSSEIRRILLLDSYFDDDLIRRKVELEESVLPKIAAEEPEKGSSELQGELSVENEEERAKTDDDESFGEARDSSSGSEMPETQIPPPLTLPPSSGTIGVPEPCVLNLFSVYGFLRSFSIRLFLSPFTLDEFVGALNCKVSNTLLDAIHVSLMHILKRHLENISPDGSRPATKCLSFISFVFDHAYRVIDRSVYLAIFGYTKGPEWKGFYDEIFYGEYYLLPASRKLTILQILCDEVLASEELKAEMNMREESEVGINYDNEDSLPAENGPRRVHPRYSKTTACKDAETKKYVSELNAEDDGDVDGNGDECRLCGMDGTLLCCDGCPAVYHSRCIGVMKMHIPEGAWYCPECKINLIGPTIARGTSLKGAEVFGKDLYGQVFMGTCDHLLVLNVKSDDFCLKYYNQNDIPRVLQVLYASEQHRPVYNGICMAMLEYWNISENFLPLCVSKLPPMIEEEHKAVSSVKADYSLTFGNGICSDNLVPSLDASLVTTRSPAPGSSGNARTTVNLKLHEETAMDSSVSTNHQSDPKCRNYVNRSAAVSPAKCSLVSSQFSNYGDANDIGLPMNLSLQTKGDQSGFGKCKSSLINDFVYMGCSYKPQSYINYYMHGDFAASAAANLAVLSSEDSRSEGHVSGNLGKATSGNTYLLAKAFSQTASRFFWPSSEKKLVEVPRERCGWCISCKAPVSSKKGCMLNHAAISATKSAMKILSGFAPVRSGEGIIPSIATYVIYMEESLHGLIVGPFLSEWYRKHWRKQVERAKSFSDIKPLLLKLEENIRTIAFCGDWVKLMDDWLAEFSTMQSAACTLGTTQKRATCGRRKKQLSINKVTAGGCQENFAWWHGGKFTKSVFQKAVLPKSMVRKGARQAGGLRKISGIFYADGSEIPKRSRQLVWRAAVQMSRNASQLALQVRYLDFHIRWSDLIRPEHNLQDVKGQDTEASAFRNANIRDKKIAEGKILYRVAFGSQKHLPSRVMKNVEIEQGPEGMEKYWFSETRIPLYLVKEYELRNGKVLSEKEYLHITSHVHKRRLKATYKDIFFYLTCKRDKLDMLSCSFFLRPQFFSWFNFRNALKCSACQGYCHTGCSVSSTVSTCEEVEFLATCKQCHHAKLLTQKESCNESPTSPLLLQGQERSTLAVLKGPRPKCDGQGLISTRTKNSRLDMKLVASDFPLETKGRSRSCSWGVIWKKKNNEDTGFDFRLKNILLKGGSGLPQLDPVCRLCHKPYRSDLMYICCETCKHWYHAEAVELEESKLFDVLGFKCCKCRRIKSPVCPYSDLYKMQEGKKLLTRASRKEHFGADSDSGTPIDTRTCEPATPIYPAGDVSRQDNDPLLFSLSSVELITEPQLNADVAGNTVSGPGLLKLPKRGRENNGSFRGNLHAEFSTSNENEMVSKSVKDLSPVEYGSADCNLLNNSEIVKFDALVDFEPNTYFSLTELLHTDDNSQFEEANASGDLGYLKNSCRLGVPGDCGTVNLASNCGSTNSLQGNVNNCRLCSQKELAPDLSCQICGIRIHSHCSPWVESPSRLGSWRCGDCREWR

SEQ ID NO: 117364 - protein, 887 aa, Glycine max
  Coding DNA Sequence Number=SeqID_586
  Gene Ontology: Mol. function=nucleic acid binding; Cellular component= nucleus; Biological process=response to DNA damage stimulus
  Homolog annotation: Hit_ID=Q9FNI6; Match level="QueryCoverage=99%, HitCoverage=100%, E-value=0.0, Identity=66%"; Hit description =Putative SWI/SNF-related matrix-associated actin-dependent regulator of chromatin subfamily A member 3-like 2
  Pfam annotation: Domain name=DEAD; Domain location=394-593; Score= -27.6; E_value=0.0012; Accession=PF00270.19; Description=DEADDEAH box helicase
  Pfam annotation: Domain name=HIRAN; Domain location=99-206; Score =63.0; E_value=9.5e-16; Accession=PF08797.1; Description=HIRAN domain
  Pfam annotation: Domain name=Helicase_C; Domain location=756-834; Score=80.8; E_value=4.3e-21; Accession=PF00271.21; Description =Helicase conserved C-terminal domain
  Pfam annotation: Domain name=ResIII; Domain location=326-588; Score= -33.3; E_value=0.029; Accession=PF04851.6; Description=Type III restriction enzyme, res subunit
  Pfam annotation: Domain name=SNF2_N; Domain location=332-718; Score =47.4; E_value=4.8e-11; Accession=PF00176.13; Description=SNF2 family N-terminal domain
  Pfam annotation: Domain name=UBA; Domain location=5-47; Score=21.2; E_ value=0.0038; Accession=PF00627.21; Description=UBATS-N domain
  Pfam annotation: Domain name=zf-C3HC4; Domain location=652-691; Score= 46.5; E_value=9.3e-11; Accession=PF00097.15; Description=Zinc finger, C3HC4 type (RING finger)
  Pfam module annotation: Pfam domain module=DEAD::HIRAN::Helicase _C::ResIII::SNF2_N::UBA::zf-C3HC4; Domain location=394-593::99 -206::756-834::326-588::332-718::5-47::652-691
MGSKVSDHHLSTVRSIVGSEFSDMDIIRALHMAKNDVTAAINIIFDTHTAPKFKATRPTNPPPVSPPEPTPPAPTVTANSNHRVGERHSDSNRDDWWFVSCGEMTGLSTCKGRTISSGETVVFKFPAKKLSASPSPGKGFGRAVACSEIVRFSTEQAGEIGRIPNEWGRCLLPLVRDHKVRIEGQCKYAPNVLGIMDSIVLSVSVFINSSMFDKHHQVSLKDAANSTDESVFHPLPTLFRLLGLNPFKKVVVGPVSPAELTPGDFYSNKRPLSQRVPLPRTKSEHPSQNGQENDNEDSISEIDVENIVGVGSSSELEEMDPPGNLMCELRPYQKQALYWMIQMEKGQSMDETATTLHPCWEAYHLADKRELVIYLNAFSGEASIEFPSTLQMARGGILADAMGLGKTIMTISLLVAHSGKGGSIASQPITQSFIEGGEVSDTVHNFSNIPKKATKFAGFDKPMKQKNVLMSGGNLIICPMTLLGQWKAEIETHVHPGSLSLYVHYGQSRPKDAKSLAQSDVVITTYGILASEFSSESAEDNGGLFSIRWFRVVLDEAHTIKSSKSQISLAAAALIADRRWCLTGTPIQIIVMITIDSFSRGDTQEFADLNKLAKRFLRGTYSASEGEVKDTPSRAYVQEVVEELRKGEQGECPICLEVFEDAVLTPCAHRLCRECLLSSWRNATSGLCPVCRKTISRQDLITAPTENRFQVDIEKNWVESCKVTVLLNELENLCSSGSKSIVFSQWTAFLDLLQIPFTRNNIPFVRLDGTLNQQQREKVIKQFSEDGETLVLLMSLKAGGVGINLTAASNAFVMDPWWNPAVEEQAVMRIHRIGQTKKVAIRRFIVKGTVEERMEAVQARKQRMISGALTDQEVRTARIEELKMLFT

SEQ ID NO: 117365 - protein, 283 aa, Glycine max
  Coding DNA Sequence Number=SeqID_587
MECGRKSSVRASKEDDELLKSTKKKSNVNLMMMNEAFTRRVRRLKVALKRIFILVQALEGVSHGDCVREASGIYDVGGQIELCMSSKYGYKEDACLEKKVALEEKVSGNDGAKVGVVPSVRVELPVQGVTSGSRFEILNKERDMESEETHGSIKQGRMKDFCPHFKNGSKPDSNNGPRGHDPKEIERGNADMETYVTVEVNEVIPRPLEATKTHSNGFKVDKTIKRILLDSSCVEEAYGHSGGIWISGTDNPSLQGILGFKLLAEYYDVIDAGFQGYPFTWKK

SEQ ID NO: 117366 - protein, 119 aa, Glycine max
  Coding DNA Sequence Number=SeqID_588
  Homolog annotation: Hit_ID=Q1SRT2; Match level="QueryCoverage=83%, HitCoverage=31%, E-value=2e-28, Identity=60%"; Hit description=Amino acid/polyamine transporter II
MSTLLPTSTTVREAENRIASQQHHRRDAGTLFVLKSKGSWIHCGYHLITSIVSPSLLSLPYALTFLGWKAGILCLVIGALHAQLGNRQLLYRDMARDILGTTLLPCIINTVVKKGFNYM

SEQ ID NO: 117367 - protein, 103 aa, Glycine max
  Coding DNA Sequence Number=SeqID_589
  Homolog annotation: Hit_ID=Q1SRT2; Match level="QueryCoverage=34%, HitCoverage=9%, E-value=9e-09, Identity=69%"; Hit description=Amino acid/polyamine transporter II
MYSVLYSPSCIVHREEHRALDYYSTVQIELAPPKTEPNVDLPSLSSGLVVTDACGAKHGKFLLYDTCPFSICFMGNIIKMDFFLLQYMWQKEKDFNAWSRGNG

SEQ ID NO: 117368 - protein, 79 aa, Glycine max
  Coding DNA Sequence Number=SeqID_590
  Homolog annotation: Hit_ID=Q94DE5; Match level="QueryCoverage=95%, HitCoverage=16%, E-value=5e-17, Identity=76%"; Hit description =Putative betaine/proline transporter
MTSSWMHCGYPLTTSIVAPPLLSLPYAFNFLAWSAGIFCLVIGALVSFYSYNLLSLVSLSTMLIWAIASYDLETWLVTF

SEQ ID NO: 117369 - protein, 37 aa, Glycine max
  Coding DNA Sequence Number=SeqID_591
MFLETVGILAYVASNVVTLMDRATDNEIDGHPEASNG

SEQ ID NO: 117370 - protein, 378 aa, Glycine max
  Coding DNA Sequence Number=SeqID_592
  Gene Ontology: Mol. function=small protein activating enzyme activity; Cellular component=nucleus; Biological process=protein modification process
  Homolog annotation: Hit_ID=Q8LKN3; Match level="QueryCoverage=96%, HitCoverage=99%, E-value=1e-123, Identity=61%"; Hit description=SUMO activating enzyme 1b
MVSWNRLRLGMDGDGEELTAQETALYDRQIRVWGADAQRRLSKSHVLVYGMKGTVAEVVPELVSLWYLKFDFDKHTYTKRSKKMGCVWSLSYLLHFCFPYIDVIMCEEFEFPVVGSLTLVDDRVATEEVLSSNFLIPPDENAYSGKTLGELCCNSLKDFNPMVRVSIEKGDLSSFDVEFFSKFDVVVVSCCSLSAKKLANDKCRKLSKRVAFYAVDCRDSCGEIFVDLQDYKYSKKKQDETVKCDLKYPSFEDALSVPWRALHRRMSKLYYAMRVIEKFEEAEGRSAGEVSIADLSGVLKLKKEICTAQSLNESHVPDTLLERLVTNAIEFPPVCAIIGGILGQEVIKAISGKGDPLKNFFFFDAFDGKGIIEDLSPK

SEQ ID NO: 117371 - protein, 159 aa, Glycine max
  Coding DNA Sequence Number=SeqID_593
  Homolog annotation: Hit_ID=Q8L5R5; Match level="QueryCoverage=52%, HitCoverage=29%, E-value=7e-09, Identity=52%"; Hit description =Tubulin folding cofactor B
MASSIQQVEGMFPLAFYSPLDGFRLHLPSHLVVVSKILHLSKNTLFLKNPIISDRACPHKTFFFIFIIGYFLKTLSENIKRNLLPRILQLQGQSTKLYYLIIEMSPSAAFWVFDNFIDLTFIAQIPDDCMEDLSADIKLLKLQGLGGKGGKLSGDTVNN

SEQ ID NO: 117372 - protein, 174 aa, Glycine max
  Coding DNA Sequence Number=SeqID_594
  Gene Ontology: Mol. function=transition metal ion binding; Cellular component=cytoplasm; Biological process=proteolysis
  Pfam annotation: Domain name=Transposase_21; Domain location=112-174; Score=-118.3; E_value=0.00017; Accession=PF02992.5; Description =Transposase family tnp2
MVQEVIEIVASGVKSEENTLSKSYYEAKKILCSMGMEHQKIRACSNDCILYKNEFEEMHKCPRCGVSQFKVQDDNECSSDASMKKGPPTKVLWYLSIIPRFKCIFANGDDAKDLTWHADGRIYDGMLCHSDDSSQWKKINHLYPDFKKEARNLRLGLATNRMNSFGSLSTKHSS

SEQ ID NO: 117373 - protein, 72 aa, Glycine max
  Coding DNA Sequence Number=SeqID_595
MVVILPKKNVVIWFCSLHNRPNNYLKGIINSALKVFDDTLQSKSKAAARWIVIKTKKEALSVGITSCIGCQL

SEQ ID NO: 117374 - protein, 128 aa, Glycine max
  Coding DNA Sequence Number=SeqID_596
  Gene Ontology: Mol. function=catalytic activity; Cellular component =small ribosomal subunit; Biological process=metabolic process
  Homolog annotation: Hit_ID=Q1RW27; Match level="QueryCoverage=88%, HitCoverage=52%, E-value=1e-41, Identity=60%"; Hit description =Octicosapeptide/Phox/Bem1p; CBS
  Pfam annotation: Domain name=CBS; Domain location=19-127; Score=82.4; E_value=1.4e-21; Accession=PF00571.18; Description=CBS domain
MAPLFSTWKWIREERTVKSLRLSKALTVPETTTVYEACRRMAARKVDALLLTDSNALLCGILTDKDIATRVIAREVNLEETHVSKVMTRNPVFVLSDALAVEALQKMVQGRFRHLPVVENGEVVAILT

SEQ ID NO: 117375 - protein, 354 aa, Glycine max
  Coding DNA Sequence Number=SeqID_597
  Gene Ontology: Mol. function=structural constituent of ribosome; Cellular component=small ribosomal subunit; Biological process =metabolic process
  Homolog annotation: Hit_ID=Q2RA11; Match level="QueryCoverage=90%, HitCoverage=80%, E-value=3e-68, Identity=44%"; Hit description=CBS domain-containing protein, putative, expressed
  Pfam annotation: Domain name=CBS; Domain location=33-151; Score=82.3; E_value=1.5e-21; Accession=PF00571.18; Description=CBS domain
  Pfam annotation: Domain name=PB1; Domain location=220-305; Score =58.6; E_value=2e-14; Accession=PF00564.15; Description=PB1 domain
  Pfam module annotation: Pfam domain module=CBS::PB1; Domain location =33-151::220-305
  Subcellular localization annotation: CTP_CleavageSite=59; ConfidenceScore=5.19e-01
IEKHWGTSTPGSNSTFMETLREQIFKPSLSTIIPQNSKVVTVSPTDSVLTTTKKMLELRASSAVVTVGDKLCGILTSKDILMRVIAQSLPPSSTLVEKVMTPNPECGTIDTPIIDALHTMHDGNFLHLLVVNRDGIVVATVDAIHITHAAVATASQVGNTPNFNSEAANSMIQKIWDSAMALAPNEEEEDSQSETSLKMISEGGETGRSISYLASSMQNAFSFKLQDRKGRLHRFTCDTRSLAEVITSVIQRVGDDIDPMDLPQILYEDEENDKVVLASDSDLAAAVDHAKTAGLKGLRLHLDYSGTHGYGTDSSSLSWKYANSEAWASAYSAIAAGAAVVAALGLLAFVRRSQ

SEQ ID NO: 117376 - protein, 122 aa, Glycine max
  Coding DNA Sequence Number=SeqID_598
MPVVVVVEMVAGVTADVDAYGGQSKRLRGNDADDDENDGCKKEPDRDRARDHDCEHSSGRHRKLPWEAAMTSDADLGAGLGGMIMRDFSTELPWEVAMGSDVDLGAGNGIGVDIRIGVDYKM

SEQ ID NO: 117377 - protein, 98 aa, Glycine max
  Coding DNA Sequence Number=SeqID_599
MGLPLATWQPLLLQRLRNPFDFHAMPPPMSMLGIPRDFQLFLSKFHVGVAPGVNGLIGTRRPEQHGGVGKVIDSRHDFNEAHLLSGEELQGRAGFATD

SEQ ID NO: 117378 - protein, 174 aa, Glycine max
  Coding DNA Sequence Number=SeqID_600
  Homolog annotation: Hit_ID=Q1T3B0; Match level="QueryCoverage=29%, HitCoverage=18%, E-value=9e-10, Identity=60%"; Hit description=RNA -directed DNA polymerase
MDVVNFHNDFHKFDTFPRGINASFITLIPNLVSILVNGSPTNEFIPQRDLRQGDSLAPFLFIIVVEGLSELMREATPKRLFSSLKGVVIPFGSIWWRDVKLVCGGENDVWFNNMVEWRMGDGKLTRFWEDAWGLWEVGIKGGELGNLGGNQGVTLRYQEDDTSIWLEDASNLFM

SEQ ID NO: 117379 - protein, 1123 aa, Glycine max
  Coding DNA Sequence Number=SeqID_601
  Homolog annotation: Hit_ID=Q9LTJ8; Match level="QueryCoverage=20%, HitCoverage=33%, E-value=6e-16, Identity=26%"; Hit description =Arabidopsis thaliana genomic DNA, chromosome 5, BAC clone:F17P19
  Pfam annotation: Domain name=MBD; Domain location=241-309; Score =24.5; E_value=0.00011; Accession=PF01429.10; Description=Methyl-CpG binding domain
  Pfam annotation: Domain name=MBD; Domain location=29-139; Score=25.8; E_value=8e-05; Accession=PF01429.10; Description=Methyl-CpG binding domain
  Pfam module annotation: Pfam domain module=MBD::MBD; Domain location =241-309::29-139
MENPDVEKSEETNRQIDSNTKSNSKQQSVEKANEHPDWLPDGWNVEVRTRKSGVHMGSGYKVCYIEPLKGYKFFSKPEVLRYLETVKDNSCTSKKGKKCSNMHSPKHNSCTSKKEKKCSNMHSPNDNNCTSKKEKKCTNMDSPDDNSCTLKKEKNCSNMDSPNDKSCTSKKEKNCSNLDSPNDNSCTLKEKNCGNMDSPNNNSFTPEKEKNCCNMDSPIDNSCSSKKKNCSNMDSPTDVVVEKSTVEDLPPGWVKELKIRKNSKGIRKDPFYIDPASGYVFRSKKDVLRYLESGDIRSCAFKPSRRQVQDEDNLTPPPAAKRQKLKQSAPEQQLSSATEILDKSNLELLDANSSRKGKNANVSSGMMVASVPMGESVEKMHSLEDGAANSSELKKTSDPSSSALLNESLKESEQVLSADDVQEKEHVVNMMENAIEKNHSNYSISKNRKEFNVPHRSSPRLAGSKPVQLANNVMNEQTLQVPKRNLRKSRNTLDIDISEDQTVSKEQPHQQEADKIEDKKPEIQISSNKSSKKKEYHLPRRASKRLAAIEHESMNSKAKLQQSECGPVTVLADQAPTNGKSANKRKKSEPQLGKRENEEMEDEKSESQLSFAFHYSWSDPSLEYAINTLTGVLPPAETDIPKTLVDNVTGKGATTIPETDIPKSLVDNATGKGTTTVPETDIQKTLVDNVTGRSGGSENNLLDTVAGSRDRKSQARSNKPKKKKEVKVPMRLSKRLAGLEPEVLPAERALEYSTRKSCKEEPTATATLTNGVSDHHDAGEETKLTPQASDSLKTEVLGESLNQSEKSYDAQTGHKEQLQKVEAENIGDARSEPQLPLPFGNSWSDPCLEFAIKTLTGALPVDAGDIMPALPPGFDNPPYKQLHGNVVTSINQEAHDNSNQSQNKKELNMVSQLVLRSSSTSYENAPKFTTRQSYLDQGNIIGNLNEEPRHTGNITPPVHHSRNINSLTHEEPLKQNGQVVEGGFVTTEQQLFETGTVNHDNSELQYCAPFMNSWSDPCLEFAFKTLTGVIPVEENLTLQGCFQEPVNYHERRDGGSMLPDLGSSCFSQSDFSFLHDTGVKSMPGQQPSISSSFLPLEKTSLQGFAGVDPQTQFSQCNNNFQRR

SEQ ID NO: 117380 - protein, 131 aa, Glycine max
  Coding DNA Sequence Number=SeqID_602
  Gene Ontology: Mol. function=calcium-dependent phospholipid binding; Cellular component=membrane; Biological process=transport
  Homolog annotation: Hit_ID=Q6H7E3; Match level="QueryCoverage=94%, HitCoverage=87%, E-value=3e-47, Identity=68%"; Hit description =Putative elicitor-responsive gene-3
  Pfam annotation: Domain name=C2; Domain location=6-87; Score=74.9; E _value=2.6e-19; Accession=PF00168.20; Description=C2 domain
MPQGSLEVFLVNAKGLENTDYLCNMDPYVILICRTQEQKSSVASGQGSEPEWNEAFVFNVSEGVSDLRLKIMDSDSTTAHDLVGEATIPLDGLFIEGNIPPTSYNVVKDGHYCGEIRIGLTFTPQACYHIC

SEQ ID NO: 117381 - protein, 331 aa, Glycine max
  Coding DNA Sequence Number=SeqID_603
  Gene Ontology: Mol. function=translation initiation factor activity; Biological process=regulation of transcription, DNA-dependent
  Homolog annotation: Hit_ID=Q8RU47; Match level="QueryCoverage=99%, HitCoverage=100%, E-value=7e-87, Identity=52%"; Hit description =Putative Transcription initiation factor IIE, beta subunit
MALQERLDKFKKQQEKCQTTLSTIAATKAAAATQKSATHASANGRNAAPAVKFSNDTERLQHINSIRKAPVGAQMKRVIDLLLETRQAFTPEQINEACYVDMKANKDVFENLRKNPKVNYDGQRLSYKSKYGIKDKTELLQLVRKYPEGLAVIDLKDAYPTVMEDLQSLQNLAVKGAASLNAVQSFLLFSHTLGLDFWGRVSIGRISNVVSCAGVQSEAMKAAGQIWLLSNFDSQEDIAYPNDPKVHIKVDDDLKHLFRSIELPRDMIDIEKDLQKNGMKPATNTAQRRSAAQIQGISSKPKPKKKKSEISKRTKLTNAHLPELFQNLNSS

SEQ ID NO: 117382 - protein, 438 aa, Glycine max
  Coding DNA Sequence Number=SeqID_604
  Gene Ontology: Mol. function=nucleic acid binding; Cellular component= intracellular; Biological process=regulation of transcription, DNA -dependent
  Homolog annotation: Hit_ID=Q8LJS2; Match level="QueryCoverage=67%, HitCoverage=98%, E-value=7e-61, Identity=48%"; Hit description =Histone deacetylase 2a
  Pfam annotation: Domain name=Nucleoplasmin; Domain location=134-351; Score=-82.7; E_value=0.049; Accession=PF03066.5; Description =Nucleoplasmin
  Pfam annotation: Domain name=zf-C2H2; Domain location=412-435; Score =20.8; E_value=0.0049; Accession=PF00096.16; Description=Zinc finger, C2H2 type
  Pfam module annotation: Pfam domain module=Nucleoplasmin::zf-C2H2; Domain location=134-351::412-435
PCLVPRAAAAARSRVTGGEGRRPSTASARSAEDAAEGDGAEKPRARAGADDAGIHRPRPDSGGGAAVREGRSPANLAVQRSLDRKEKLLELGSRNFFLCPRKPATTVEDGVTTSFASCAKEAEKEREGYGGGGASDTLFFDLGAEVKVGESVKVDPAEFEACIHLSQAALGEAKKDKSNEPVVLYLKVGQQKFVLGTLSREKIPQIPLELVLEKEFELSHNSKNASVHFCGYKAFYDAGDEYPYSEEDVPLLKAENGKPETKAEELKVPESKKAVAKASASAKQVKIVEPKKDNEEDSDDDSDEDDDFGSSDEEDADSDSDDESDDKEDDDEETHPKNKKADLGKKRPNESASKTPVSSKKAKNATPEKTDGKKGGHTATPHPAKKGGKTPSSEAKAKTPNNEAKTPMSGGLSCKSCSKSFNSESGLQQHNKAKHGGQ

SEQ ID NO: 117383 - protein, 74 aa, Glycine max
  Coding DNA Sequence Number=SeqID_605
MNDRERGSWELGIGQNPNYVASQEASSDDMQKERQEKLTANGSNQQGLCRYSVLLELTIESPLIIVSCAPSSCG

SEQ ID NO: 117384 - protein, 547 aa, Glycine max
  Coding DNA Sequence Number=SeqID_606
GEACHPARPGEQGYFLQKQQASGGRIWKAQVTNPYGLRIYSFLAFEEVTETHGLRKNTSFRLPPHYGISWIAQACFLLISETSRDFIYCATKDAKYLKAANQRLHVIKLGISELFGADNRKVFMHAPELLGRWIAKGKDAYDHIGLCVSSDFGFPNDEGADNRKPEDADSSRKSADDHIGLYLSLDLGCPNNETRGLRMTSVRIIVGCPYMPPDSWGADDHIGLSVSSYLGSPNDEVRRKYSRPEPIDISKKRADDHIRLCVSSDSGSPNDEDYHIGLCLSSNLGSPNDESMDNRKVSHHATGLSSHRIAKNFGSPNDEGSDNRMVSPYTTGLLDYHIGLCLSSNLGSPNDESVDNRKVSHHATGLSSHWMAKDADIFKKGADDHIGLCVSSDLGSLNDDKVSHHATGLSGRWIAKGADNRKVLYLPLDSWVAGQQEDDHIGLYVSLDSGSPNDEVLITVRKGADYHIGLCVSSNLGSPNEEHICSLTVNGSSFLGDPTAPSSKGKDGNSYPGSRFMADELRLGLKRLVERPDMMYVMVLVWPAVQG

SEQ ID NO: 117385 - protein, 233 aa, Glycine max
  Coding DNA Sequence Number=SeqID_607
MVICTRSKDDNIFRSRLFRSHLFAIQRPKSPVVYGDTIRLSEPSSFGDPKSDDTQRPMWSSAHFLEMSTASGREYFRLTFCYPVTRESGGMMRHLTRPKSPVAYGDTIRLSEPSSFGDPESDDTHRRMWSSARFLEMSIGSGREYFRLTFCYPATQESSGMLRCLSVIRTSSFGDPKYDDTERPMWSSAPFFKMSASFGRDYLVSPFAIQRPKSPVACRDTLQLSSHSSFEDP

SEQ ID NO: 117386 - protein, 375 aa, Glycine max
  Coding DNA Sequence Number=SeqID_608
  Gene Ontology: Mol. function=RNA-directed DNA polymerase activity; Biological process=RNA-dependent DNA replication
MGETEEVQERMKADTEAMKEQMATMMEAMMSIKKIMEVNVAAVTATIAVAGVDPTPPSGLKQINHPTSDVGGPHFVQIHNKHAFPPYDLPSNYTPPNLAHTPIENVNNSTPIPIESQQPQSDHAHVSQPMGETHEVPHHNLVDIEPCLGYTIEGQAVGGVPLPNTLEGPQISPQPQPLHFAVGRVPPAMVKTEKLDHLEERLRAVEGGGDYASANLEELFLVPNFVIPPKFKVPYFDKYKGTTCPKNHLKMYCRKMGAYAKDEKLLMHFFQESLTKAAVTWYTLEPSRVHSWKDLEVAFVRQYQYNSDMAPNRIQLQNMGKKGHESFKKYAQRWSDLPAQVAPPMMERKMITMIVDTLPVFYYEKMVGYTPSSFC

SEQ ID NO: 117387 - protein, 132 aa, Glycine max
  Coding DNA Sequence Number=SeqID_609
  Subcellular localization annotation: CTP_CleavageSite=44; ConfidenceScore=5.20e-01
MDASEPYTGAMKGTMHKPQANLGADQKFSPSRFPTTRTKEDLLRDSVGTTPSPKRKARDRQIIVMRPDQDIKEALLGGSLEMGPKKLPAKKPKKMKTWLICSTSLEEAEPYGWNRQTCDLTLSSSNYYIHCV

SEQ ID NO: 117388 - protein, 174 aa, Glycine max
  Coding DNA Sequence Number=SeqID_610
DRTHMTPSGPEEVQQGPGVSSSGYGPLSVLQGARPPARSCHRDIGKDRAHKTPSGPEEVQQGPRVSSSDYGPLSALRSARRPQQGIVPVRHLVDPKKSNRVLELPALITGLCQFCGVSVTPSKVIRPPTNRAFIKKYCAPRQAQGETPQQPGDGQQRAADAPPPPLEFTSAHPQ

SEQ ID NO: 117389 - protein, 111 aa, Glycine max
  Coding DNA Sequence Number=SeqID_611
FFRKCASSGILPDEPLLPESSRKRFSGSLPEEVFFRKTFGYFWKNTSSGNFPEKVLPKLSEEPLTVHNKTKAKKKATYLESKWVQGLSEKLAEKKLVGEERREEAFAEETQ

SEQ ID NO: 117390 - protein, 204 aa, Glycine max
  Coding DNA Sequence Number=SeqID_612
  Gene Ontology: Cellular component=chloroplast thylakoid membrane
  Homolog annotation: Hit_ID=Q9FNJ7; Match level="QueryCoverage=82%, HitCoverage=17%, E-value=9e-75, Identity=74%"; Hit description =Arabidopsis thaliana genomic DNA, chromosome 5, P1 clone:MDJ22
  Pfam annotation: Domain name=MORN; Domain location=138-159; Score =21.8; E_value=0.0024; Accession=PF02493.10; Description=MORN repeat
  Pfam annotation: Domain name=MORN; Domain location=44-65; Score=2.4; E_value=4; Accession=PF02493.10; Description=MORN repeat
  Pfam module annotation: Pfam domain module=MORN::MORN; Domain location=138-159::44-65
MAVSQFQPQPQGFESVGQLIISTSVSIYSSSPIRCISTSLLDMYEGEWFQNDVEGHGVVEVDIPVIEPAPGSKLEAKMRAQGKIIARDFLSPEDREWLEKDIEDMYYLADGNYEIPFYENEEWVRQFGRKPEKGRYRYAGQWKHGRMHGCGVYEVNERILYGRFYFGEYVDDISGCDEDISAMHAGIAEVAAAKARMFVNKPDG

SEQ ID NO: 117391 - protein, 212 aa, Glycine max
  Coding DNA Sequence Number=SeqID_613
  Gene Ontology: Cellular component=chloroplast thylakoid membrane
  Homolog annotation: Hit_ID=Q9FNJ7; Match level="QueryCoverage=71%, HitCoverage=16%, E-value=1e-46, Identity=54%"; Hit description =Arabidopsis thaliana genomic DNA, chromosome 5, P1 clone:MDJ22
MANDQDQQDSPQQNAPFSDSDSDSDSDYDSDYSYDEAEDEAFRRAFGQRDDGDDSSSPENPKREDPEANFRAFSEALESPAMKELHEELDPLIAEKKNPYDFPRDPEEWTEQDLREFWADGPYEIGGTGWDPVWATDDEWRYVKEQIADGEEPPIAPFYLPYRKHYPPIPDNHYDIATPKDAIEELDRIEEFLKWVSYIFEDGSTYERDCLG

SEQ ID NO: 117392 - protein, 157 aa, Glycine max
  Coding DNA Sequence Number=SeqID_614
MASKAANYNKLPSPIVRSPERLRSQDYLGEATKERIEGFFSTKSLRWILRILIQLKCSSWCGGSAASSSDSWWPLVVVGGGEEGVRVWISLCELVSLSRSGILTKHDNSRSMKFPLGLEFALSATILVEHNSSCAKHNNSHSMQLPLGLELRLACFS

SEQ ID NO: 117393 - protein, 314 aa, Glycine max
  Coding DNA Sequence Number=SeqID_615
  Homolog annotation: Hit_ID=Q9LU00; Match level="QueryCoverage=64%, HitCoverage=53%, E-value=2e-18, Identity=32%"; Hit description =Arabidopsis thaliana genomic DNA, chromosome 5, TAC clone:K15C23
MEKGHKEHIMVKAQSQKKEEACHVSTTLAATDLHRPSLQPPKPKFLSLSLPNSANSSPSTLMEKKPKHRSIESPCQASTLIHQQQQTLIPLDEVGYMDQMQDDQLQDMQLRRSKSCGEGRASCAPSDEFDLWWAKPGAVERNNMHRNSFSKTEAILVSGKNVETCEDEGFKCTALCMYLPGFGKAKAVKTRKELGSEVEGCAVISRTVSLEKFECGSWASSALFHEINIEGDPINSSYFDLPLELIKCSANDVHSPVTSAFVFEKDLKTGFSTKSPRHVRFSTPSKPASPASCITPRLRKAREDFTAFLEAQSA

SEQ ID NO: 117394 - protein, 45 aa, Glycine max
  Coding DNA Sequence Number=SeqID_616
MEKRVWRVAVAGAHRIFGPWIEQFHQVRPVRCKDYKNMEFVMAVP

SEQ ID NO: 117395 - protein, 225 aa, Glycine max
  Coding DNA Sequence Number=SeqID_617
  Gene Ontology: Mol. function=nucleic acid binding
VMLNSKAKFKVWNFNGAKNFELWQRCVKDLLAHKGFLKALCDAKPNKMDDLGWEELQERVATIICLCLEDEVLYHVMELTSPGEIQEGLDLQQHVNVFNKIIIYLERLEVKIEDEIRHGKQEHGRTQGKGSDGSQRKSPKSSEGHPAQQVWQILMIQTTRVRQIFSQVQIAMDDDGANGFSYRTDGDQDTLGVELHLLNLMMMLQDCDIYVWVISVSMGWWSFIR

SEQ ID NO: 117396 - protein, 242 aa, Glycine max
  Coding DNA Sequence Number=SeqID_618
  Gene Ontology: Mol. function=nucleic acid binding; Biological process= DNA integration
MGLEKVDRVEEVFVWIEVVSMVVGDPSIVGLVNTDYASDHDNKRSTTGYIFTLVAEYMATAEASKEFVWLVVLVKELGIAIDKFHRFDKELAYKGHLLLGYEAGWGARTGYDTCCKPNLQVYVGLKEVTFGNSEVDLESIIQSLEAMSTTEVKYITVAMASKETVWLERTQLYHSRTNHIDVMFHKIRELITSSQVLLWKVHTTENAVNILTMIVKTNKCKLCLDLLNVAHARCDRTLNPGD

SEQ ID NO: 117397 - protein, 564 aa, Glycine max
  Coding DNA Sequence Number=SeqID_619
  Gene Ontology: Cellular component=cytoplasm
  Homolog annotation: Hit_ID=Q9LTZ9; Match level="QueryCoverage=93%, HitCoverage=93%, E-value=1e-123, Identity=60%"; Hit description =Arabidopsis thaliana genomic DNA, chromosome 5, TAC clone:K15C23
  Pfam annotation: Domain name=DUF23; Domain location=243-474; Score =45.3; E_value=2.1e-10; Accession=PF01697.17; Description=Domain of unknown function
MAMANKEREKKFFFVGSLVNYAAELKLLLATLFLLCGVATLLQFLPSRFTISSSDLRFCISRVSLTPPPPSTPPPPFTSLSTPPTPLSSTQKHLPNGTIKRVFNPHGSAAYNFITMGAYRGGLNTFAIVGLSSKPLHVYGKPTYVCEWIPDLPSLQNSSKPIITKGLKYLPDWGYGHVYTVVVVNCTFNGTAVNGDNTGGKLVLHASTSGAGDTGFNVTDRIEVLHEAPGALNASLFMSKPKYDYFYCGSSLYGNLNPQRVREWIAYHVRFFGPKSHFVIHDAGGVHEEVLEVLKPWMELGFVTLQDIRDQERFDGYYHNQFMVVNDCLHRYKFMAKWMFFFDVDEYIYVPPKTTIKSVLHSLSEYDQFTIEQMPMSSKICLSEDYGKTYRILSGWTLFISYEERDDRKLHYCGCMHLELLAHPFSIHSVFPSDPGQLVLQHLGIMLYKGKWGFEKLVYRDSITGIRRDRKYAVQPRSLYATGVHMSMDLSGKTTHKTEGRIKYFHYHGTISERRETCKILVNTTQVTQNKIPYVMDTTMRDTAGVIKKFELKMIGTRLQKTRQ

SEQ ID NO: 117398 - protein, 106 aa, Glycine max
  Coding DNA Sequence Number=SeqID_620
MHTKSPRDSDHMDSVDWEAVHKSVKLLKPSNLVDNTTLLQEGYSYMLPDKHPLLAECIPRELDDPSPYLLVEWTTGLSMMRIRDCFWSGFICVRAMDAKTKASRPI

SEQ ID NO: 117399 - protein, 1132 aa, Glycine max
  Coding DNA Sequence Number=SeqID_621
  Gene Ontology: Mol. function=RNA-directed DNA polymerase activity; Cellular component=chromatin; Biological process=one-carbon compound metabolic process
  Homolog annotation: Hit_ID=Q947Y6; Match level="QueryCoverage=96%, HitCoverage=86%, E-value=1e-163, Identity=32%"; Hit description =Putative retroelement
  Pfam annotation: Domain name=Chromo; Domain location=1063-1114; Score= 24.5; E_value=0.00037; Accession=PF00385.14; Description='chromo' (CHRromatin Organisation MOdifier
  Pfam annotation: Domain name=RVP_2; Domain location=203-316; Score= -60.6; E_value=0.053; Accession=PF08284.2; Description=Retroviral aspartyl protease
  Pfam annotation: Domain name=rve; Domain location=767-923; Score =95.4; E_value=1.7e-25; Accession=PF00665.16; Description=Integrase core domain
  Pfam annotation: Domain name=zf-H2C2; Domain location=708-749; Score =24.7; E_value=0.00019; Accession=PF09337.1; Description=His(2) -Cys(2) zinc finger
  Pfam module annotation: Pfam domain module=Chromo::RVP_2::RVT _1::rve::zf-H2C2; Domain location=1063-1114::203-316::369-543::767 -923::708-749
MATNGQLTSWPAFIQALQTRFAPSHYDDPTGNLFKLTQRGSELANRIVGLPPQFLLSCFISGLTPEIRREVQSLQPLTLVQAAGLARLQEENLLDTRSTFRNRTPPVLSIPQPRPIPMPALLQDPSSPAPSSRPPPSVKRLSPAEIASRRERGLCFTCEEKYHRGHRCASRVFLLVAAEDDNPDPYIEDLDPGPDPPDSPNPTAAQISFNSLASNLAPETLRLLGLASGHHVVVLVDGGSTHNFIQEDLDTTPLRVLVGNGQHLACSRWCPRVTLTIVDFTCDVDLYVLPIVGANIVLGVQWLKTLGPVLTDYSLMTMKFFYDQRLIELRDDNDLTINMLTPPQLRQFLKHNEHASCYHIAGLIRPSTSPFSSPVLLVRKHDDLWRFCMDYRALNAITIRNRFPIPIIDELLDELGQACWFLKLDLLQGYHQIHMHSSDIAKTTFRTHHGHYEFKVMPFGLCNAPSTFQATMNMLFRPFLRRFLIIFFDDILIYSITFNDHVLHLQQAFQRGVEPVSSKVDVVRQWPTPHSAKALCSFLGLAGFYRRFIKGYATIATPLVVATITDPFQWTTPAQLAFEQLKQALSEAPVLTLPDFQLPFTVETDASGIGIHDDDQEVAPVSSWPPLHDHHGPPQLEGFRSGTTNQAADALSRLPDEESSLSHILSAIQTTPAKFPDFNISNNLILRKGRIWLPPLLPLITTLLTEYHATPTGGHLGIAKTIARLMENFYWDGLREDVAKFVSNCLDCQHSKYETKRVVGLLCPLPIPHRPWKDLSLDFITGLPAFQGNTTILVVVDRFSKGIHLGMLPTSHTAYTVAALFMNIVDKIHGLPRSMISDRDPLFLSRFWQELFHLSGTHLRMSSSYHPQSDGQTEALNRAIEQYLRAFVHRRPSSWGKLLMWVEWSHNTSWNAATGSTPYEITFGRKPFNYPEYLARDSKLEAVDDMLTNREDTFRLIRKKLLKAQELMKKCADGKRRDVEYQAPSSNLGKPQSSISRKLSKRFYGPFEITERIGPVAYRLKLPEGARIHPVFHCSILKPFKGPPTPANSVSLPAQFAHDQPIISPLAILDYRRNSDIPGSPWEVLVQWSGLAPDEMSWESWSQLSRDYHLEDKQVTEVQQAIEGHGANINKE

SEQ ID NO: 117400 - protein, 97 aa, Glycine max
  Coding DNA Sequence Number=SeqID_622
MVPLEVAPCGETFSKCFPQEIDNFWWDFQVAQAQALFPKAMDLLNITSLERMIEYFTEALHSEIGLSSFIGDGLSHFRMRVMFVQLKPCLPHLKYTV

SEQ ID NO: 117401 - protein, 261 aa, Glycine max
  Coding DNA Sequence Number=SeqID_623
  Gene Ontology: Mol. function=DNA binding; Biological process=DNA integration
  Pfam annotation: Domain name=ABC_tran; Domain location=120-240; Score= -46.3; E_value=0.0022; Accession=PF00005.17; Description=ABC transporter
MHSVCICVKFQANPKETHLVLVKRILKYIKDTLKVGFWYPKGASISLVRYSNSNYARCKVDRKSTSRTCHLLSSALVFWHSKKQVCMALSTSEAEYLVVGSCCAKIPWMKQQIEDFVYRLKSISKPERLAYKVLLDTFSNCLLYLYCLIELNLLREALVGLPGVSGLSTEQRKRLTITIEVVGSPSIIFMDEPTSGLNARTATIVMRTVRSIVDTGRTIVCTIHQPSIDVFEAFDEVSAVVDHMILHFLTFLIGLANCHTT

SEQ ID NO: 117402 - protein, 125 aa, Glycine max
  Coding DNA Sequence Number=SeqID_624
  Gene Ontology: Mol. function=transporter activity; Cellular component= membrane; Biological process=transport
  Homolog annotation: Hit_ID=Q9ZUY2; Match level="QueryCoverage=52%, HitCoverage=9%, E-value=3e-13, Identity=62%"; Hit description =Putative membrane transporter
KLFPEHNLFTTHGGSFSCGRYLGHYCAWQQAGTWRQRLAEPEVARREPAVANDYELPLRVGVSARWSHFPRSNSMVELAKENPLLQQFFLKAVITINVRLNSVEEKASSDIIKPIIRGFKGMTTN

SEQ ID NO: 117403 - protein, 54 aa, Glycine max
  Coding DNA Sequence Number=SeqID_625
MGAKHLTRTKEWSHVIEQRPPDEIRAPHTPVSPLSIKHERKLGSEAINRTRSVH

SEQ ID NO: 117404 - protein, 104 aa, Glycine max
  Coding DNA Sequence Number=SeqID_626
MVEREKFDHIKERLRAIEGGGDYAFANITKLGLVPDVVIPPKFRVSDFNKYKGTTCPKNHLKMYNSKMGAYSKNERLLMHFFQESVTGAAVTWYTNLEPSRVHS

SEQ ID NO: 117405 - protein, 93 aa, Glycine max
  Coding DNA Sequence Number=SeqID_627
MVVSNTKGPAKCLPRVHHKTPTPQWHIRDWECWLSMGMGAELYVLVATYPSVGGRRVTRGCVFRERNTCGVATNVYLRKTSEKSKKTWSTNFK

SEQ ID NO: 117406 - protein, 188 aa, Glycine max
  Coding DNA Sequence Number=SeqID_628
  Subcellular localization annotation: CTP_CleavageSite=44; ConfidenceScore=5.14e-01
MRRHLTVICTSSFRDPSSIDKQRPMWSSAPFPEMSASSGYVGAKASLLSTAPPFAIVTCESDDMRRYPSGYPYKWFLLILTREVRRRYPSGYPYKHSFAIRQTQSPIPKRLFVQTISVNPDPRSQVAGGGTIWLSAPFINQGQTSPLTRRDKRRLLHLLSSRDSESGGRRRYLMVVCTFRQPRQKSLT

SEQ ID NO: 117407 - protein, 91 aa, Glycine max
  Coding DNA Sequence Number=SeqID_629
  Subcellular localization annotation: CTP_CleavageSite=44; ConfidenceScore=5.49e-01
MWPHMPPVSWDTVTKSGVVDKSRAFAPTYPQFVMRNSDLRSSSYCETKNSLGAFFTKMRTCFSKETKLLTDQSNICFLDEKQCVYRGRRVC

SEQ ID NO: 117408 - protein, 44 aa, Glycine max
  Coding DNA Sequence Number=SeqID_630
MVMPFGLTNAPGTLMSSNRISADEEKVKAIREWPVPKNANEGLY

SEQ ID NO: 117409 - protein, 672 aa, Glycine max
  Coding DNA Sequence Number=SeqID_631
  Gene Ontology: Mol. function=transporter activity; Cellular component= integral to membrane; Biological process=transport
  Homolog annotation: Hit_ID=Q9ZUY2; Match level="QueryCoverage=98%, HitCoverage=88%, E-value=0.0, Identity=62%"; Hit description =Putative membrane transporter
  Pfam annotation: Domain name=Xan_ur_permease; Domain location=166 -634; Score=134.9; E_value=2.2e-37; Accession=PF00860.11; Description= Permease family
MSDSVPKTRNRPGPWPPAPDAKAMPPASWAKKTGFKPKFSGEANASDSGQISLQPKPREPDANVDLEAGRPGAPANGVTHQNKAPPLPPSKDQVVKKRKDSDGLPKSSVPITNGQAVTAPPPPPPPPPRRTARHEEVVDAPPQEDDGFVSRHSHMKYELRDSPGLVPIGVYGIQHYFSILGSLILIPLVIVPAMGGSHEDTSAVASTVLFVSGVTTLLHTSFGSRLPLIQGPSFVYLAPVLAIINSPEFQGLNANLFVRCHGLLYYVYCEVFDGKFKHIMKELQGAIIIGSAFQTFIGYSGLMSLLVSMVIFTSEYPRVPDVSTLWLINPVVVSPTIAAVGLSFYSYGFPLVGTCLEIGAVQILVVIVFSLYLRKISVLGHRIFLIYAVPLGLAITWAVAFLLTEAGVYNYKGCDINIPASNMVSEHCRKHVSRMKHCRVDTSNALKSSPWFRFPYPLQWGTPIFHWKMALVMCVVSLISSVDSVGSYHASSLLVASRPPTPGVLSRGIGLEGLSSVLAGLWGTGTGSTTLTENVHTIAVTKMGSRRAVQLGACFLIVLSLVGFRRIFWWGKVGGFIASIPEVMVAGLLCFMWAMLAALGLSNLRYSEAGSSRNIIIIGLSLFFSLSIPAYFQQYGISPNSNLSVPSYFQPYIVASHGPFHSKYGGVYLLLL

SEQ ID NO: 117410 - protein, 269 aa, Glycine max
  Coding DNA Sequence Number=SeqID_632
  Gene Ontology: Mol. function=transcription factor activity; Cellular component=nucleus; Biological process=regulation of transcription, DNA-dependent
  Homolog annotation: Hit_ID=Q3L8J2; Match level="QueryCoverage=90%, HitCoverage=96%, E-value=3e-45, Identity=44%"; Hit description=CBF -like transcription factor
  Pfam annotation: Domain name=AP2; Domain location=61-124; Score =126.7; E_value=6.3e-35; Accession=PF00847.10; Description=AP2 domain
  Subcellular localization annotation: CTP_CleavageSite=45; ConfidenceScore=5.42e-01
MNFEIESPFSFPIQSSSPISQSSPCTAPNNNPNLISQLPSLSQLVSHKRKGGRKKFKETRHPIYRGVRQRKGKWVCELREPKKTTRIWLGTYPTPEMAARAHDVGALAIRGTSAILNFPNSVSLLPIANSLSSRKDIRAAAVEAAESLRPISNSHHKKISRKSKSTRAKKVPSLEETTKETVLDSSLHLKSMHSLLDREKCDVINSTSGTEKNNLDLSSTMFFDEEALFNTPGLLDRMAESLDIFPLLPSMDYYWDDHAYCTDFNLWTD

SEQ ID NO: 117411 - protein, 188 aa, Glycine max
  Coding DNA Sequence Number=SeqID_633
  Gene Ontology: Mol. function=zinc ion binding; Cellular component =intracellular; Biological process=regulation of transcription
  Homolog annotation: Hit_ID=Q6H630; Match level="QueryCoverage=65%, HitCoverage=48%, E-value=6e-40, Identity=58%"; Hit description =Putative zinc finger protein
  Pfam annotation: Domain name=zf-B_box; Domain location=113-160; Score= 51.0; E_value=3.9e-12; Accession=PF00643.14; Description=B-box zinc finger
  Pfam annotation: Domain name=zf-B_box; Domain location=60-107; Score =43.5; E_value=7e-10; Accession=PF00643.14; Description=B-box zinc finger
  Pfam module annotation: Pfam domain module=zf-B_box::zf-B_box; Domain location=113-160::60-107
MDGSLIIVVPPLPFDHIYPSQSLPTFYEALATPSFILSSQTFHFKLQVFKLPTHCSYSHPMKIQCDVCNKHEASVFCTADEAALCDGCDHRVHHANKLASKHQRFSLLRPSHKQHPLCDICQERRAFTFCQQDRAILCKECDVSIHSANEHTLKHDRFLLTGVKLAASAMLRSSQTTSDSNSTPSLLN

SEQ ID NO: 117412 - protein, 123 aa, Glycine max
  Coding DNA Sequence Number=SeqID_634
MSKKETTTVHTILIGNQGAHIDNQGGPRFRQRILILYRSNQMHPKYIHLDFKKINPGMWTQSDMYVLCSYASGQYIWWMGKWCYKSMNQFSNIPIPRAMKEPQDKIGFVMFEGSLNKFFYKHF

SEQ ID NO: 117413 - protein, 99 aa, Glycine max
  Coding DNA Sequence Number=SeqID_635
DETPILIEEQHGTTSKNDEVLPRLDADVEGHMGSFSTENMGIWVPQAPPPLVCSSQMDRVIVQSETNIKGSSISRLKDDTFTVPQISPPSNSKRARFLW

SEQ ID NO: 117414 - protein, 265 aa, Glycine max
  Coding DNA Sequence Number=SeqID_636
  Gene Ontology: Mol. function=heat shock protein binding; Cellular component=integral to membrane; Biological process=protein folding
  Homolog annotation: Hit_ID=Q7XAR9; Match level="QueryCoverage=61%, HitCoverage=20%, E-value=1e-41, Identity=54%"; Hit description =Division protein
GGSNSPLAAAAAIAKIGAEATAVISQVQASVINALKKAFPVGSEDQIVKHQVNGVNEDFGFSESENPLILSDQDSPVNAEIMCAGVVIGLVTLVGLKFLPTRNGSPILRKMTGSAMVSDTINLGSLGDEEKVEQLPKMDARVAEALVRKWQSVKSEAFGPDHCLGRLHEVLDGEMLKIWTDRAAEIAERGWSYDYTLEDLNIDSVTISQNGRRAVVETTLKESTHLNAVGHPQHDASNSRTYTTRYEMSFTGAEWKIVEGAVLES

SEQ ID NO: 117415 - protein, 110 aa, Glycine max
  Coding DNA Sequence Number=SeqID_637
  Gene Ontology: Mol. function=ribonuclease H activity
  Homolog annotation: Hit_ID=Q1S4N4; Match level="QueryCoverage=89%, HitCoverage=29%, E-value=2e-10, Identity=34%"; Hit description =Ribonuclease H
MAKIAYKWLTRARSTHGATAVNGTWVWSLQLLENIKHYLWLLDHKSILTNLFRLRRHICFDCSCCRCGDPEESILRLLLIASGSSKWFHDLIGDWVLEAYWSRFLIVPRN

SEQ ID NO: 117416 - protein, 189 aa, Glycine max
  Coding DNA Sequence Number=SeqID_638
  Homolog annotation: Hit_ID=Q69T79; Match level="QueryCoverage=31%, HitCoverage=25%, E-value=4e-11, Identity=54%"; Hit description =Putative glycine-rich cell wall structural protein
  Pfam annotation: Domain name=GRP; Domain location=39-130; Score= -22.4; E_value=0.015; Accession=PF07172.2; Description=Glycine rich protein family
MVALRNFRLLCFILVVTIVELKAEELKNVTNHSQGNATLASLSHQGEKHELKGKHNVFKNEVLFNTSKDSWYYRGGGGGGGGGGGFRWGGGGGGGGGGGAGGGGSGWGWGGGGGGWWKWGCRREARHGKGKQRVRHYHTSTNEDYRMGEFAQCMARTRCRGLRLDCPLHCGGPCFYDCHHMCKAHCRRP

SEQ ID NO: 117417 - protein, 204 aa, Glycine max
  Coding DNA Sequence Number=SeqID_639
  Gene Ontology: Mol. function=heat shock protein binding; Cellular component=integral to membrane; Biological process=protein folding
  Homolog annotation: Hit_ID=Q7XAR9; Match level="QueryCoverage=97%, HitCoverage=25%, E-value=1e-69, Identity=73%"; Hit description =Division protein
MEAGETELVLEIGQGLLRERLPKTFKQDVVLAMALAFVDVSRDAMALSPPDFIAACEMLERALKLLQEEGATSLAPDLQAQIDETLEEITPRCVLELLALPLDDEHRARREEGLLGVRNILWAVGGGGAAAIAGGFTREDFMNEAFLHMTAAEQPHQVLFQLKVLKHMELHLHWLHKLLWVKSRILFKMLITCSNNFNRLRLQL

SEQ ID NO: 117418 - protein, 71 aa, Glycine max
  Coding DNA Sequence Number=SeqID_640
  Subcellular localization annotation: CTP_CleavageSite=37; ConfidenceScore=5.09e-01
MGEKLATQLAQASKVASSRSNSLLEESSGGPKWACFRRSYGNSGIAQKHLFSTSATLRNFTDRASLLPFDF

SEQ ID NO: 117419 - protein, 73 aa, Glycine max
  Coding DNA Sequence Number=SeqID_641
MLLGDDAIKHHIHLCLVWILFVIKTWLCSVFHRRRRPPPHPPPHPPPPPKPPHPKYTLTMFHGSMLQPHHSLS

SEQ ID NO: 117420 - protein, 85 aa, Glycine max
  Coding DNA Sequence Number=SeqID_642
MYPPLFSLNLVDVPSTRTDPQEMYLLLFSVNNPSRCTLYLYDKGCTLQCVKTKISGGRRETQKEFRQLVLDEFFLAKGEGNEKDK

SEQ ID NO: 117421 - protein, 126 aa, Glycine max
  Coding DNA Sequence Number=SeqID_643
MEERRGSLNMKIGGVEMIEINSFIQNMELEDIPLVGRRWKIQILCVGILERTKESIMHQNAECKWLKEWNENIRFFHAMVEGGRKRNSLRGLHVEGVWEEDPTKVKRCKEIFSRKIHRRRMKKTTT

SEQ ID NO: 117422 - protein, 109 aa, Glycine max
  Coding DNA Sequence Number=SeqID_644
MQSSQRDVYLGAYLNGPDNYLKGIINSALKGLDDAPQPKSKASARWIVVKARSTECGYYVMHWMSIIILGTFRNNWEAYFNDPRPLEPERLKALWIQWAQFYLRVRDQA

SEQ ID NO: 117423 - protein, 112 aa, Glycine max
  Coding DNA Sequence Number=SeqID_645
  Subcellular localization annotation: CTP_CleavageSite=41; ConfidenceScore=5.42e-01
AAPRGLSAITCGMHKAKPVLLAKPLVEMASRKRKSTTSRPVAQYDTRNGSNSSRLEFPALITALYRARGVTSDRARKARARPTNVPSSSTPPAPSISVTPTPATPGPSTQDF

SEQ ID NO: 117424 - protein, 199 aa, Glycine max
  Coding DNA Sequence Number=SeqID_646
  Homolog annotation: Hit_ID=Q84VH5; Match level="QueryCoverage=46%, HitCoverage=13%, E-value=1e-31, Identity=79%"; Hit description =Envelope-like protein
MLSQHPNILNNIDSVKKRESPLSLHYKLFEGTHVPDIVSTSGKAAASGAVSKDALIAELKDTCKVLEATIKATTEKKMELEHLIKRLSDSGIDDGEAAEEEEEAAEEEEDAADDTESDDDDSDATPMTIRPLFWLLLLLLIEDAAVNCFTAVGAWRQGEQKADVTILLSPLQIPLCLITLIMKVADPTCITARTCSGSV

SEQ ID NO: 117425 - protein, 38 aa, Glycine max
  Coding DNA Sequence Number=SeqID_647
MEVKKRLSHEVLKVTFELSSLVRLSAHPPLSAASAHLA

SEQ ID NO: 117426 - protein, 58 aa, Glycine max
  Coding DNA Sequence Number=SeqID_648
MATARWALKHPVYGIVILWLGIYTDRPNVSKTTFLNEKFYAISEFQQTLLTTTKQVPT

SEQ ID NO: 117427 - protein, 341 aa, Glycine max
  Coding DNA Sequence Number=SeqID_649
  Gene Ontology: Mol. function=transporter activity; Cellular component= integral to membrane; Biological process=transport
  Homolog annotation: Hit_ID=P37621; Match level="QueryCoverage=72%, HitCoverage=59%, E-value=2e-75, Identity=60%"; Hit description =UPF0226 protein yhhS
  Pfam annotation: Domain name=MFS_1; Domain location=101-341; Score= -29.9; E_value=0.0074; Accession=PF07690.6; Description=Major Facilitator Superfamily
  Subcellular localization annotation: CTP_CleavageSite=34; ConfidenceScore=5.11e-01
MKITVITSEIATPRRRPRRISRVTSGLSTIARKLASKKGTRISDAARMPARIITNIASLTRMFWPIFSCGFSFIPSPEWWFAVESVVERHRFRLNLQILSIVKFNFATYLTIGLPLAVLPGFVHDGLGYSAFWAGVVISLQYVATLLSRPHAGRYADSWGPKKVVVLGLFGSLVSGLCILLSALIEEQEVLSLALLCLGRVLLGVGQSFCGTGTSLWGVAKVGSLHIGRVISWNGIVTYGAMAIGAPLGVMIFRSGGLLLLSSVIIAISVLAIVLALPRAPVKGSKAKPLPFRAVLGKVYGFGLLLAMGSAGFGVIATFITLFYQEQGWDGAAFALTLFSA

SEQ ID NO: 117428 - protein, 262 aa, Glycine max
  Coding DNA Sequence Number=SeqID_650
  Gene Ontology: Mol. function=heme transporter activity; Cellular component=mitochondrion; Biological process=cytochrome c oxidase complex assembly
  Homolog annotation: Hit_ID=Q9XML4; Match level="QueryCoverage=82%, HitCoverage=87%, E-value=1e-107, Identity=92%"; Hit description =Cytochrome c biogenesis protein
  Pfam annotation: Domain name=Cytochrom_C_asm; Domain location=19-191; Score=105.4; E_value=1.6e-28; Accession=PF01578.11; Description =Cytochrome C assembly protein
  Subcellular localization annotation: CTP_CleavageSite=41; ConfidenceScore=5.39e-01
MGVPGFRSLNGSAIATRSRSNGFGSVSTSGISVTGYGTQYRSETGRAMAIHLSLRVAPLDLQQGGNSRILYVHVPAARMSILVYIATAINTFLFLLTKHPLFLRSSGTGTEMGAFFTLFTLVTGGFRGRPMWGTFWVWDARLTSVFISFLIYLGALRFQKLPVEPAPISIRAGPIDIPIIKSSVNWWNTLHQPGSISRSGTSIHVPMPIPILSNFANFPLSTRILFVLETRLPILSFPESPLRDEIEAREGIAKPSLLPSSN

SEQ ID NO: 117429 - protein, 132 aa, Glycine max
  Coding DNA Sequence Number=SeqID_651
MERVLADVLRDQRNLGNKGDRGWKRLALNAAAAVLSTSFIVNVTSVNVKKPYQIMEIVSHKSAKPFRFKVLQNWDDIVDLCAKDRVTGHGAETAMDADEAMSRETNEVEFMGLGATAIDLEEPSSNTKGKRQ

SEQ ID NO: 117430 - protein, 120 aa, Glycine max
  Coding DNA Sequence Number=SeqID_652
  Gene Ontology: Mol. function=transcription factor activity; Cellular component=nucleus; Biological process=regulation of transcription, DNA-dependent
  Homolog annotation: Hit_ID=Q9LYD3; Match level="QueryCoverage=95%, HitCoverage=45%, E-value=5e-33, Identity=63%"; Hit description =Transcription factor like protein
  Pfam annotation: Domain name=AP2; Domain location=26-90; Score=99.1; E_value=1.3e-26; Accession=PF00847.10; Description=AP2 domain
MLETEPKSKKIKRIHGGVDEDLSNKHPLHHDVRMRNWGKWVSEIREPWKKSRIWLGTFPTPEMAVWAHNVAALSIKGSAAILNFLHFANSLPCPTYLTPQDVQAATAKVVHMDPSSLSSL

SEQ ID NO: 117431 - protein, 91 aa, Glycine max
  Coding DNA Sequence Number=SeqID_653
MENQMRARRKKGISQYRGRRSTNGDCWVHGEEETSAEARGRRNRRGRRSYFGYFLELLGAPAILLGAPSNTLNKGVGTDNNGLEVRIVQID

SEQ ID NO: 117432 - protein, 119 aa, Glycine max
  Coding DNA Sequence Number=SeqID_654
MSEWFTGKHCIFYPAVVKFNYAKDNETKDKSIAGRKELSRKKDMGYMNSATIVKIGGWLKKYKNEVNTIYATAVSKHNIREGSWQWQVKKLYACDPRKKKRKEKLHFTCMQNENNLFLE

SEQ ID NO: 117433 - protein, 39 aa, Glycine max
  Coding DNA Sequence Number=SeqID_655
MKRCMMRSRYKPERACFVPLNQEPNGKGSSSPLLVTTPK

SEQ ID NO: 117434 - protein, 103 aa, Glycine max
  Coding DNA Sequence Number=SeqID_656
MKVSSAVDITTTEDVFRETPRKKVSSTVDITTAEDCFFHGISRKTLSARLHGRSRLPQLSLQLRKNTSSMESREKCLPRDSKDEVFSFAIVMSSAEENFLRRI

SEQ ID NO: 117435 - protein, 79 aa, Glycine max
  Coding DNA Sequence Number=SeqID_657
MWGKAISSFKEVAQPGNTYIRMQKDMKIMVTKLGLLSVRKDTMLVGTVKQIKYRLCLKFKAIESINNFFTTTKRSFYIG

SEQ ID NO: 117436 - protein, 49 aa, Glycine max
  Coding DNA Sequence Number=SeqID_658
MSGLASHCHERPNYTKKDENVWRNGRKMGVEVFVVPVFLFDSQLKTILV

SEQ ID NO: 117437 - protein, 281 aa, Glycine max
  Coding DNA Sequence Number=SeqID_659
  Gene Ontology: Mol. function=zinc ion binding
  Homolog annotation: Hit_ID=Q5VNV0; Match level="QueryCoverage=92%, HitCoverage=82%, E-value=2e-43, Identity=40%"; Hit description =Glycine-rich protein-like
MQKGREVRDNNIFEPRRFEDFGDFGFHRSRMPSLFGGRDPFDDPFFTDPFDSLFGPSSASRAMQKTNREKGIVIEEIDSDDEGADNGPETGEKDFDKKKSKSTMEPSIEYPDDDVNGISEVLNCGCDRDFVAFNERKNSDVTYKNDHCMAEPKARKFSFQTSRVTYGGIDGAYYTSTRIRRMGANGEVMEENKEADTTTGQASHRRITRGIHDKGHSVLRKLDSDGKVDTTQTLHNLNEDELAGFEEAWKGNNMAQLPGFDVHRKEVLVQLQKFLDKFLVR

SEQ ID NO: 117438 - protein, 231 aa, Glycine max
  Coding DNA Sequence Number=SeqID_660
MSSLFPYLFLPESVLLSQVSNTDTNTEGNHKETGDYAITSSRPNRAIVKPTYLQDYIYFLFISLSPLSTGPTMPEHHTRQVTTDKLEEAISRLSLGHTNLNTRVESIHTTLTTKINSLIERFASIPTAKIDSLIERFASIPMPPHLLSPSPFPPLSPAHRHHMKLDVSRFDSNDPLGWIFKISQFFDYQGIPDHERLTIASFYMDDPALSWYQWMLIPMQKAITRKQGTTQ

SEQ ID NO: 117439 - protein, 176 aa, Glycine max
  Coding DNA Sequence Number=SeqID_661
RIQGTNRLKILCPNTLDGTSFVAQVEGTSTWVVILRTREGTSLVNQFKWRVHPLGCSKRTREGTSLVDLWLVKDFTRLKEISRTVGCLGTGCRHELWPNQQYSIFHMLPHIFVEAMSSKVILIMPKNQELSKFQRFKNQVSRIKIQDSRIKFQDSRFKNNQDQDSRIKRRLNQDKY

SEQ ID NO: 117440 - protein, 184 aa, Glycine max
  Coding DNA Sequence Number=SeqID_662
MDEFIGSLKVHEQKLMDEIQLLKEKVIALKTSQKTKTRHQSKALNSVATSNVKNSDDEFSEEDEEKLAFLNKKFQRLLKMKKRVKKKFMKKRFSARRKLQASNDGYMDGTNSSSSEKDEEHAVNICLIADSDKEELSSASHLKEVSLAIREILKEVFSKKLLKEVFSRKLLKEVFSRKLLKEDT

SEQ ID NO: 117441 - protein, 85 aa, Glycine max
  Coding DNA Sequence Number=SeqID_663
MRTMIVDTLPVFYYEKMVGYTPSSFADLVFAGFPQPPFFQGYDLNTTCAYHGGALGHSIEHCMTLKHKVQSPIDAGRLKFEENRV

SEQ ID NO: 117442 - protein, 198 aa, Glycine max
  Coding DNA Sequence Number=SeqID_664
  Homolog annotation: Hit_ID=Q5H231; Match level="QueryCoverage=35%, HitCoverage=9%, E-value=7e-25, Identity=78%"; Hit description =ATP:GTP 3'-pyrophosphotranferase
  Pfam annotation: Domain name=RelA_SpoT; Domain location=1-72; Score =38.0; E_value=3.3e-08; Accession=PF04607.7; Description=Region found in RelA  SpoT proteins
MQKKRLAFDQLYDIRAVRVMVDDVAACYAALGVVHALWAPVPSEFDDYIARPKANDYRSLHTAVVGPEGRAGRGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 117443 - protein, 102 aa, Glycine max
  Coding DNA Sequence Number=SeqID_665
  Subcellular localization annotation: CTP_CleavageSite=20; ConfidenceScore=5.11e-01
HALRFTLSLPLIVTCPPHVVASRPPNRPPFFCNCSIYSNSHITDVSARVEHADELGLPFLAPTILRPKEKFSLTPQWAPNFPTEFRQALNKLPNSPHSQQSL

SEQ ID NO: 117444 - protein, 119 aa, Glycine max
  Coding DNA Sequence Number=SeqID_666
MRLRSRRRTKKRLRARNRQGRMTPPTAAEQDVRNADGRVNARAQGVATQRWRRRYYRRTSPSPPFGTLRVTRPDTPAYSCFLGGASAGDGVGRSRRSDSPSPCEPDEENGRTERQQHPS

SEQ ID NO: 117445 - protein, 240 aa, Glycine max
  Coding DNA Sequence Number=SeqID_667
  Gene Ontology: Mol. function=metal ion transporter activity; Cellular component=membrane; Biological process=metal ion transport
  Homolog annotation: Hit_ID=UPI0000526C8D; Match level="QueryCoverage =100%, HitCoverage=71%, E-value=5e-82, Identity=63%"; Hit description= magnesium and cobalt transport protein CorA
  Pfam annotation: Domain name=CorA; Domain location=31-239; Score= -18.9; E_value=2.5e-05; Accession=PF01544.9; Description=CorA-like Mg2+ transporter protein
MALIDNGVYVHGRRVETPKNLDETYRMLDAAGGIAWIGLYRPSPEEVTSVAREFDLHPLAVEDALSGHQRSKVERYGDTLFAVLRPARYRDKEESIEFGELHLFVGPDFVVTIRHAESPNLAAVRARMEANPELLAMGPEAVLYAILDEVVDGYEPIVAGLLNDIDEIEDQLFGDGADDSALSRRIYELSREVINFQRAVHPLNGMLEWLRRGSAKYRIDEELQRSLRDVLDHTIRVNER

SEQ ID NO: 117446 - protein, 209 aa, Glycine max
  Coding DNA Sequence Number=SeqID_668
  Gene Ontology: Mol. function=protein transporter activity; Cellular component=outer membrane; Biological process=protein secretion
  Homolog annotation: Hit_ID=P34749; Match level="QueryCoverage=99%, HitCoverage=50%, E-value=4e-94, Identity=84%"; Hit description =Protein transport protein hofQ precursor
  Pfam annotation: Domain name=Secretin; Domain location=19-208; Score =149.7; E_value=7.8e-42; Accession=PF00263.11; Description=Bacterial type II and III secretion system protein
MDTLVRWATQMDIPVEQVELAAHIVTMTEKSLRELGVKWALADATDAGKVGQLTTLGSDLSVASATSHVGFNIGRINGRLLDLELSALEQKQQVDIIASPRLLASHMQPASIKQGSEIPYQVSSGESGATSVEFKEAVLGMEVTPVVLPGGRVRLKLHISENMPGQVLQQADGETLAIDKQEIETQVEVKSGETLALGGIFSQKNKNRQ

SEQ ID NO: 117447 - protein, 94 aa, Glycine max
  Coding DNA Sequence Number=SeqID_669
MVLTAAIAAALTSIYLLHAHHGLHHCDHLLFHGLYVGLLMLLRLLYFTHYSSSSTGSDMGLNPFRFFNMVRDIFVKAKLEVTRTSTILNVFGSR

SEQ ID NO: 117448 - protein, 181 aa, Glycine max
  Coding DNA Sequence Number=SeqID_670
MGLVLSDPQRPLVGEQKLMVEKTKKKLEEATQFGSTEGVIDPPSPIRRHEKWKMACTKKTGQMTSEATKEIVEKIISHFQLRIGLLVPHARHHAHQDLLTAAIGRPEHPGRVRAAGAGITIKQFFGLAPQTSRSSSSMAPEELEQLTQQIRDQLEESITKNGLALPLEPEVGPSAARVNTK

SEQ ID NO: 117449 - protein, 118 aa, Glycine max
  Coding DNA Sequence Number=SeqID_671
MTTKFCRGVIGETCYNFLNLHEFHLIMDERLFYNPYDIVMFMKHCPLQEKLFINVQSSILWVHDEQLSEKVHYEFEMVFHEGLSCFCFETRSHKRDRERKRGFRTRRFMRMEQREFCA

SEQ ID NO: 117450 - protein, 175 aa, Glycine max
  Coding DNA Sequence Number=SeqID_672
  Homolog annotation: Hit_ID=Q5VNV0; Match level="QueryCoverage=44%, HitCoverage=26%, E-value=3e-13, Identity=50%"; Hit description =Glycine-rich protein-like
MRNCTKPTILLGDSHSAPSILLQQNYSPPVHLYQHLLADVMDPFDSLFGPSSASRAMQKTNREKGIVIEELDTDDEGADNGPETGEKDFDKKTKKLTQQLARQHIGSLEESMTRRLDSDGNVDTTQTLHNLNEDELVGFEEAWKGNNMAQFPGFNVHRKEVLVQLQKFLDKYLVC

SEQ ID NO: 117451 - protein, 106 aa, Glycine max
  Coding DNA Sequence Number=SeqID_673
MEEGTGWGGKNKCSTEELATAVAVVAAPKKANEIEFEKHGDLDCGKTKLRCMEIGIHGSLGYGEVALGCGEVGHGGLQAIQAGGGRFNICHLRAVEKGQAYIAIDT

SEQ ID NO: 117452 - protein, 286 aa, Glycine max
  Coding DNA Sequence Number=SeqID_674
MASRKRKSTASRPQAQYDTRRFHSLDAWNRYTDNILGWNILPERNVQIYHTEFDEFKVELERRNLHKGLANLQDGSIDVAVVKEFYANLYTTEEQAPKQAKIEARLCIPRKGFVLNAEGQPWKLLRKDLMTLAQTWSVFFYSNLAPTSHTSDLNMDRARLVYGLVTKMDMNIGALISGQISFIAQSNSTRLRFPALITALCRVRGVTSDSLTYENLSPTINLAYIKKNCWNVDDLTVNFRGVRKARVRPADVPSSTTLPAPSTSATPTPAPPSSSTQDSQCYEAML

SEQ ID NO: 117453 - protein, 91 aa, Glycine max
  Coding DNA Sequence Number=SeqID_675
MLKALVTIIVFLMIMCVQDGLSEEDYLGGEETIVRDYNWMNDSIPVYLHCQSKDDDLGQQVLVVGEHQEWSFKDQVAEIKNITSAPPAIAN

SEQ ID NO: 117454 - protein, 227 aa, Glycine max
  Coding DNA Sequence Number=SeqID_676
  Gene Ontology: Mol. function=zinc ion binding; Biological process =metabolic process
  Homolog annotation: Hit_ID=Q10BU5; Match level="QueryCoverage=90%, HitCoverage=96%, E-value=3e-26, Identity=54%"; Hit description=DHHC zinc finger domain containing protein, expressed
MAWNVFKFCTALRGLGSIMILLVLGVVGVTYYAVVLTNYGPALYAGGLDSLVALAVLILFHSLEFILTSAFCRMLERGLKLYSWFDGLMSYFSVVFTDPGSVPPNWKPMIDEERGEADPLVGTEFSNVLSDPNQRFYTFLETTLVTASLLPHFITFFSDGEIPGTPGSLATTFLAFVLNLAFALSVLGFLIMHISLVAANTTTIEAYEKKTTPKWRYDLGRRKNFEQ

SEQ ID NO: 117455 - protein, 103 aa, Glycine max
  Coding DNA Sequence Number=SeqID_677
MKKMSFIHSAPFDYIVIALYRPNRKKIHEDSILTELQSSWDNSLMDHSMPRQLPFPLDNKVLQNSSQPDVAAAHRTTRRDRSGFDEAEIGESGSNERGKAQKE

SEQ ID NO: 117456 - protein, 462 aa, Glycine max
  Coding DNA Sequence Number=SeqID_678
  Homolog annotation: Hit_ID=Q2HRX8; Match level="QueryCoverage=46%, HitCoverage=38%, E-value=3e-19, Identity=29%"; Hit description=IMP dehydrogenase/GMP reductase
  Pfam annotation: Domain name=DUF1723; Domain location=162-211; Score =61.1; E_value=3.7e-15; Accession=PF08330.1; Description=Protein of unknown function (DUF1723)
MVRTGGLGPVLSRVSGRGLGRGDRDDSDDAPLQRRPTTSERRQRVPVIVVNTEPVVPATEADVAVAEADIAAAEVDVAVDEPMIEADVQDIGVDTVADTSAQAATDEPEGFPAGVWTGEERPELKLSSHGRKVHNLGRPVPAIKVLVVGTGLSPLIACSVDTDDRGLLSSFVERWHRETSSFHLPVGEVTITLDDVASLLHLPVVGDLHTFQPLHVNEAAGHWTAAARAYLLHLLGCTLFANKSVTHVHVVFLDALCDLSQTRRYAWGAAVLVHMYDHLNDACISTSRQLAVVECNAGPDYDEASPCACRWITTKKTVKSIYTGTYGQRLDRVRIPDFGYVQSIPAPPVNSWCAPDYIDWFFRISHLFMTVVQPSYPPPDAPAMQPRHVHQVPEPGIPQVPKPAAPSTFVRSNVDEPRHAVEACDAISKRLEHHLNIGVVMPGTSTHEAMHGSTIVSLHISY

SEQ ID NO: 117457 - protein, 87 aa, Glycine max
  Coding DNA Sequence Number=SeqID_679
MENEQFLIEQTWRSTQEPRPHQLDFAPYVSRSYNAQWNAPRLLHDEFMLHSSCILEKWRLLCWKILSLVGVLGVAFVDDWVFLVDRM

SEQ ID NO: 117458 - protein, 135 aa, Glycine max
  Coding DNA Sequence Number=SeqID_680
  Subcellular localization annotation: CTP_CleavageSite=75; ConfidenceScore=5.25e-01
PTKVKAHDPLTARTCSPLKLKVHDPLKARTCSPLKVKARTYSPLEVRACSPLVVRTCSPLKARTCSPFNGEGRVVLSRRGRVVLSTVRVTSTQVLSLVRVVRACFPLKARTCSPLKVRACSPLKVRTFSPLRASQ

SEQ ID NO: 117459 - protein, 88 aa, Glycine max
  Coding DNA Sequence Number=SeqID_681
MGSFLEKQGRVPYKPKIRQNTRPKRRKTYSNIYKEKWTQPWLMGSEIYPEIQKNPRALFSISSSILLESLARGSGNWSIPREDYIKIP

SEQ ID NO: 117460 - protein, 103 aa, Glycine max
  Coding DNA Sequence Number=SeqID_682
  Gene Ontology: Mol. function=structural molecule activity; Cellular component=flagellin-based flagellum; Biological process=ciliary or flagellar motility
  Homolog annotation: Hit_ID=P26462; Match level="QueryCoverage=98%, HitCoverage=99%, E-value=2e-19, Identity=50%"; Hit description =Flagellar hook-basal body complex protein fliE
  Pfam annotation: Domain name=FliE; Domain location=4-103; Score =114.4; E_value=3.3e-31; Accession=PF02049.8; Description=Flagellar hook-basal body complex protein FliE
MSIQAIDGVLQQLQLTSLQASGKPTESASQLDFGATMKAALDKISATQTAARSQAQDFELGKPGIQLNDVMVDLQKSSISMQMGIQVRNKLVNAYSEIMSMQV

SEQ ID NO: 117461 - protein, 105 aa, Glycine max
  Coding DNA Sequence Number=SeqID_683
MDTGFYWVGSSTTEPEVWYWDAGRGFYRPMEPIPLSLPRFKSAGFKLLSGKLMPPEERGAEQPEVWFFSTSGEGAWFEPTKNDAISKQRFAEQGYRTISEKLSLP

SEQ ID NO: 117462 - protein, 94 aa, Glycine max
  Coding DNA Sequence Number=SeqID_684
MEESKWENNKDHISQSRGSALDGEEHIGEWRNPIGKITKITFPSQEGPLLTVKNTFGEYRNPIGKITKITFPSQEGPLLTVKNTLENGGFQSGK

SEQ ID NO: 117463 - protein, 287 aa, Glycine max
  Coding DNA Sequence Number=SeqID_685
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=99%, E-value=1e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.24e-01
RATLPQLQRTTCPRLQRATCPHLQRGTRPHLQRITRPRHQRAARPRHQRTTRPHLQRATRPHLQRTTCPRLQRTARPLLQRTTCPRLERAARPRLLRTKCPPLQRTTRPHLQRTTRPHLQRATPPHLRGLHALPLRRLHVLTFRGLHVLAFRVLHALTFRGLHTLTFRGLHVLAIRGLHTLSIRGLHVLAIKGLHALTFRGLHVLDFRGQHVLPCRGLHALAFRELHVLTFRGLHVLAFSGPYVLTFQRVERPHLERVALPRLHRARRPHLQREKCPRFQGTTFPYI

SEQ ID NO: 117464 - protein, 443 aa, Glycine max
  Coding DNA Sequence Number=SeqID_686
  Gene Ontology: Mol. function=drug transporter activity; Cellular component=membrane; Biological process=multidrug transport
  Homolog annotation: Hit_ID=Q1SB90; Match level="QueryCoverage=99%, HitCoverage=82%, E-value=1e-131, Identity=50%"; Hit description =Multi antimicrobial extrusion protein MatE
  Pfam annotation: Domain name=MatE; Domain location=1-158; Score =128.8; E_value=1.5e-35; Accession=PF01554.9; Description=MatE
  Pfam annotation: Domain name=MatE; Domain location=220-383; Score =132.8; E_value=9.7e-37; Accession=PF01554.9; Description=MatE
  Pfam module annotation: Pfam domain module=MatE::MatE; Domain location=1-158::220-383
MTSLMMYSRSAVSMLFLGRQGKVELAGGSLALGFANITANSVLKGLTMGMDPICCQAYGAKRWSVLNQTFLRTLCLLLLVAIPISVLWLNMEPILQMLGQDPEVTKVAQVYMVFSIPELLAQAHLNPLRSFLRTQGLTTPVTIAASCAALLHLPINYFLATYLNLGVKGIALATGLNSINMTLGLLLYILFSKKPLKPWQGATLLSAFHGWKPLLSLALPSCISVCLEWWWYEIMLFLCGLLSNPQATVATMGILIQTLGFLYVFPFSLSIALTTRIGHSLGAGQASKAQSTAMIGFFTAFTLGITAFILLFFVRKSWGKLFTNETQIIELVTTILPILGLCEVSNWPQTVSCGILSGTARPYLGARINLCAFYLVGLPVSVFATFIYKYELVGLWSGMVAAQASCLCMMVYTLIQTDWGQQCKRALELAQKATEQENKNDEE

SEQ ID NO: 117465 - protein, 72 aa, Glycine max
  Coding DNA Sequence Number=SeqID_687
MCTGAESRGDINGDPVISKVGGGDYEDRMRTIELEGGGEERACNCGTFVQGLLQGIHHHLTALNLPTLSASE

SEQ ID NO: 117466 - protein, 756 aa, Glycine max
  Coding DNA Sequence Number=SeqID_688
  Gene Ontology: Mol. function=RNA-directed DNA polymerase activity; Cellular component=chromatin; Biological process=chromatin assembly or disassembly
  Pfam annotation: Domain name=Chromo; Domain location=663-713; Score =16.6; E_value=0.011; Accession=PF00385.14; Description='chromo' (CHRromatin Organisation MOdifier
  Pfam annotation: Domain name=rve; Domain location=422-582; Score =34.2; E_value=4.5e-07; Accession=PF00665.16; Description=Integrase core domain
  Pfam module annotation: Pfam domain module=Chromo::rve; Domain location=663-713::422-582
MAEDDIHKMAFRTHLGHYEFRVMPFGLCNAPSMFQSAMNDTLLPYLRKYVAVFFDDILVYSSDLASHVTHLESVLATLSEMQFLLQQSKCLFAPNQLNYLGHIISASGIAPDPDKISAMLAWPIPSSPTALRGILGLTGFYRKFIKGYAAIASPLTSLLRKDKFCWSPEAHIAFTTLQQAMVSAQVLSNPNFSLPFTIETDASVAAMGAVLLQEDHPIAFYSKVLCPRLQKASAYIRELHAITSSVRKWRHYLLGTSFTILTDHRSLKDLMTQIIQTPEQQTYLSKLLGFDYTIKYKLGTINVVADALSRIVPTDATCLALTMPHFTFLNQLRHSLLQDARYVNLLKDIQAKPKNHSGLGLHQDLIVRQGCIWIPFPCFFIENFDWPTVHADVHRFVAQCLVCQQTKYETRKPAGLIQPLPIPLTIWEDLALDFITGLPSSHGFTIIMVVVDRYSKAAHFGALPTHYSAYKVAILFLDTICKLHGFPRSLVSDRDPIFVSNFWRELFKLSGTKLRMSTAYHPQTDGQTKGSFSVEAVDHLLASRQTMHESLQRRLRKVQESMKLTADKHRRDLSFVVGDWVYVRLRPYRQTSLAPSYSKLGKRFYEPFEVIERIGLVAYKLLLPESSCIHPVFHISLLKLHKGPLPEISMTLPVASTDNHPLPTPLHILDWKRDHSISPPVTQALVQWEGLAPEESTSERWDELRRIHNLEDKVAFGDGCVDSNARLDKDQKTGNMALASSSNRPRRVIRKPTYLQ

SEQ ID NO: 117467 - protein, 168 aa, Glycine max
  Coding DNA Sequence Number=SeqID_689
MNDYHGGDPTFYLLVIVRVQSPGVRRVAGEPEPRGAAPPESPICESLEFREDGENRDSSAYNIVDQEWKKSFRAIHWYQDSTGPSITLWPSKRGTSSFMWWRCASGGGGTGDDDDDCVGTGMAENRSMRESNFAISRCSGMADVVVVTMAIGGCGGGGRSDQLIEDWD

SEQ ID NO: 117468 - protein, 90 aa, Glycine max
  Coding DNA Sequence Number=SeqID_690
AYKLHMELHQVAALQAEREARERVIESLHGEVMKWMDRFTLTLNGSQELPRLLARAKAMSDVYPAPEEVHGLLYYCQHMVELMSHIIRNC

SEQ ID NO: 117469 - protein, 40 aa, Glycine max
  Coding DNA Sequence Number=SeqID_691
MVAFTLTWQRFEQLKNPRKKSVPHTSNSMINNEDLLTIYI

SEQ ID NO: 117470 - protein, 203 aa, Glycine max
  Coding DNA Sequence Number=SeqID_692
  Homolog annotation: Hit_ID=Q9AVH2; Match level="QueryCoverage=40%, HitCoverage=40%, E-value=8e-36, Identity=66%"; Hit description =Putative senescence-associated protein
MTEGCGEGFCLANLPGDAFSLWGNFFEAKKQMMADAKFVGLLGLGKPLVEILPPGQVRGFCPLLAWLGLMVLGYGPVLSFGLVGPLLPPVISFARILPTLACAPLAKSAKGGGVAWSSVRPGTRVASSPDSDLEAFSHNPTHGSFAPLAFQPSAMTNSHVPYWWVNNPTLGEFYFTMIGRADIERSKSNVAMNAWLPQASYPC

SEQ ID NO: 117471 - protein, 296 aa, Glycine max
  Coding DNA Sequence Number=SeqID_693
  Homolog annotation: Hit_ID=UPI0000E5D5AC; Match level="QueryCoverage =23%, HitCoverage=16%, E-value=2e-16, Identity=57%"; Hit description =protein of unknown function DUF58
  Pfam annotation: Domain name=DUF58; Domain location=77-185; Score =16.0; E_value=0.00015; Accession=PF01882.8; Description=Protein of unknown function DUF58
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSRTILFDGQSLGFLRDLEGMPASDLSRDDVSFHALLEYQPGDDLRHVHWKSTARTGTMMVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 117472 - protein, 138 aa, Glycine max
  Coding DNA Sequence Number=SeqID_694
  Subcellular localization annotation: CTP_CleavageSite=60; ConfidenceScore=5.16e-01
MSSVIYTFKDYNVFSHLRFLKTSMSSVFYISKITMSSVFYIFKDYNVFSHLCFQRLQCLQSFTLSKTTMSSVIYTFKDYNVFSHLHFQRLQCLQSFTLSKTTISSVIYISKITMSSVIYAFKDYNVFSHLRFQRLQCL

SEQ ID NO: 117473 - protein, 231 aa, Glycine max
  Coding DNA Sequence Number=SeqID_695
  Gene Ontology: Mol. function=chitin binding; Cellular component =extracellular region; Biological process=chitin metabolic process
  Homolog annotation: Hit_ID=UPI00006A17C9; Match level="QueryCoverage =52%, HitCoverage=100%, E-value=3e-16, Identity=32%"; Hit description= UPI00006A17C9 related cluster
EATTNIHSHRGLHVLTFIMLHALTFRGLHVLTFKGLHALAFRGLHFLTVIGLHALTFRGLHVLALRGLYALAFRGLHVPTFRGLQVFAFRGLHLLTFRGLHVLPFRGLHVLAFKGLHALAFIGLDALAFIGLHICAFKEFKSLGHPPDLGGGPTGACPPQQGITPVRHPVDPEKSNRVLGFPALITGLCQFYGVPVASSKGETPQQQGDGQQRATNAPPPPPKPLSSSTKA

SEQ ID NO: 117474 - protein, 66 aa, Glycine max
  Coding DNA Sequence Number=SeqID_696
MIMRGQEIYSSQDEATTSPSSSESEEEKGEESRINEALGLNPELGLGLNPELGLDLKRADYFILQN

SEQ ID NO: 117475 - protein, 291 aa, Glycine max
  Coding DNA Sequence Number=SeqID_697
MLLDQKGVSKDKEQRRFGSLVRQQQSSCHCGFLEFKNQESTQFQCVGPRIPSGGGGGGARYRFPKEPSQGFCSDYGITLQSRRDPRCKFWEIANNASLHLSSKRSIGNVLCTSSHAPSVNNGEKPYSREQCHHNNNNNNNNNNNNNNNNKNYERESSSMKRRIDDLLSTPSHACSMNTREKLNFREQCHDNNKKNYERKGSLGWKPLNKGNNTSERFYSRSTVNGRDRNMNIVESSANSVTEETRKRPRLSWGEGLAKFEKKKTEGDGVSAATTATPASCACNSFSGVSQF

SEQ ID NO: 117476 - protein, 130 aa, Glycine max
  Coding DNA Sequence Number=SeqID_698
MAAKSTWVWLENEDLRALNVDLMEASGVAEGVVGVVVERGFEGFDAVEEGGHGGMRLALRVMVLSGKVEILVGVVLLGGNGNGNRVWCKKGGGVEGGCGGGDGGERPFSVCPVEPTSTTVKEKGFLVLVL

SEQ ID NO: 117477 - protein, 109 aa, Glycine max
  Coding DNA Sequence Number=SeqID_699
MWDKFVTLKNTGFNWNFPSLKPHEREVEDIVGEVEESMAEVEVGEEWRRPNQEQWVMEVFRENGVLSVMVALIFTKMVVPKSVFHVNCSLSTMHVLPSWEWLKERTMNL

SEQ ID NO: 117478 - protein, 268 aa, Glycine max
  Coding DNA Sequence Number=SeqID_700
  Homolog annotation: Hit_ID=Q9LIB3; Match level="QueryCoverage=80%, HitCoverage=43%, E-value=1e-12, Identity=28%"; Hit description =Arabidopsis thaliana genomic DNA, chromosome 3, P1 clone:MUO10
MNLLLELDSIQGCDPMIVDGKRSISRDLVQFLDSVEEVALKKHVLYVKAAKPVRSGGKKVQKHRNSDDDERRKLLQNLRGRVEKLSKLCKVSANDEEDSESEEGIHDNGVTNVLIGGRNEVPQNKNGVFLPRQGAQPGVKKSVRFAKNRNICEVYSGDVACSDGSCSSSDELGDVLENVSGAVEDDSVGSSQGAEDDEEVLVVESGGSPRSSDDGERNTRRVLVNDGRNVVKEQLQAHREKLLFSAPLPLKMENRSGSRNSKGVKILT

SEQ ID NO: 117479 - protein, 171 aa, Glycine max
  Coding DNA Sequence Number=SeqID_701
  Homolog annotation: Hit_ID=Q7XDY9; Match level="QueryCoverage=65%, HitCoverage=31%, E-value=2e-08, Identity=32%"; Hit description =Expressed protein
IDKISLFSTAKTNTTTIELASITSPILSLTTRTCATPPGSIISPSWFHHIHALAREILHGMCKLLCGLLVARILDKEAWGDDTLQGIEETNLVDELGTASLEGGKEIVVGLGVDEGVVDLHVDDEAVLLDAENAGGCFDCQTKGVEWPGEGHQGMAKGLVDLMLTKAAGTS

SEQ ID NO: 117480 - protein, 337 aa, Glycine max
  Coding DNA Sequence Number=SeqID_702
  Homolog annotation: Hit_ID=Q7XFT9; Match level="QueryCoverage=42%, HitCoverage=45%, E-value=4e-30, Identity=44%"; Hit description =Expressed protein
  Subcellular localization annotation: CTP_CleavageSite=41; ConfidenceScore=5.22e-01
MEYSNWAESLQTETPLPSFPQPSSSYPPTYYPSYPQNPNPSSSSSSSSLPINPPGVDPQTPLNPISYAAHEPVPALIYAQRLVGDNSSSGYCLDQNWAARDAVRQFGTDPTLYAPGRAHNRACEIGPLGNSCCPGGGDPKVLENTAKIAVGISLPSNGSEQLAMANPSSSLWWTNTTTLPHVNGILKKNQKKAKTKIVQPAFCEVCKIECTSKDVLDQHKLGKKHKKNVEKLRESLTPTQVQPSVSSKPLIGPQLPDDKSKSTSGNKSKRKKVETAEDLEKKKMKVLEGGAAASAVKICAICNVVCNSETVYNYHLAGQKHAAMLKKASGHMQSSAS

SEQ ID NO: 117481 - protein, 97 aa, Glycine max
  Coding DNA Sequence Number=SeqID_703
  Gene Ontology: Mol. function=RNA-directed DNA polymerase activity; Biological process=RNA-dependent DNA replication
MEEERRKVVKKEVDKLLHANFIKEGVPQRCIPLPSIDRLVDRTSGFQVLSFMDAYSGYDQIKMHPPDEEKMAFITEDANFCYSVMPFGLKNTSATYQ

SEQ ID NO: 117482 - protein, 230 aa, Glycine max
  Coding DNA Sequence Number=SeqID_704
MVLPSGSLHSTVQDICGTALVDENPEHHEICNDDKDNHKVVLVDGVDAIEVVTYAAIAGVFIYLDLLLFFYLPSGSCAAPLDVFRVVHHVAHVSPPISNTWWLSGLLTNWAKYPYLAASNPVLGGFVWGSRMGTSRLNASSRIMEHGMQRFLEVKILDLDDCLPKSIHEFFEGLVVCLSQTGQGGQGHAVRPIGGILRTKSFDRGVEAVYGPRFACVRKASRYSSGSIVP

SEQ ID NO: 117483 - protein, 217 aa, Glycine max
  Coding DNA Sequence Number=SeqID_705
  Homolog annotation: Hit_ID=Q5DMV1; Match level="QueryCoverage=40%, HitCoverage=13%, E-value=4e-19, Identity=57%"; Hit description =Receptor lectin protein kinase-like
QFLLVDWVLENCQLGQILEVVDPKLGSAYDEEEMELVLKLGLLCSQYKAEYRPSMKQVARYLNFDDSLPDISDWRYYDSQSSTNSLSFLEAMSTGKIASSYSLSSIGSRSTLPIKTVPVTQKQTLGRYKACTEGVMTCKNRSRLLNRFATDSHEGTTPLLFASSDPTRFVSDGARRGDITVDPTKLVILHGVKRSASLRRRIESILAVAASAPEVQA

SEQ ID NO: 117484 - protein, 109 aa, Glycine max
  Coding DNA Sequence Number=SeqID_706
  Subcellular localization annotation: CTP_CleavageSite=28; ConfidenceScore=5.30e-01
MASPMTCGGTAWLSAPFVNQGQTSPLTRANEPVDAQRLTSSSSPFVIQGQQVRWQAEIPYGDSHLSSTRGIKPVDAQGLTSFSAPFVNHGRSKPVDPQRLTSSSAPFVI

SEQ ID NO: 117485 - protein, 306 aa, Glycine max
  Coding DNA Sequence Number=SeqID_707
  Gene Ontology: Mol. function=protein binding; Cellular component =integral to membrane; Biological process=protein amino acid phosphorylation
  Homolog annotation: Hit_ID=Q1SWI7; Match level="QueryCoverage=90%, HitCoverage=85%, E-value=8e-44, Identity=35%"; Hit description =Leucine-rich repeat
  Pfam annotation: Domain name=LRR_1; Domain location=118-140; Score =14.8; E_value=0.32; Accession=PF00560.23; Description=Leucine Rich Repeat
  Pfam annotation: Domain name=LRR_1; Domain location=142-164; Score =9.3; E_value=5.2; Accession=PF00560.23; Description=Leucine Rich Repeat
  Pfam annotation: Domain name=LRR_1; Domain location=166-188; Score =11.7; E_value=1.8; Accession=PF00560.23; Description=Leucine Rich Repeat
  Pfam annotation: Domain name=LRR_1; Domain location=190-212; Score =18.3; E_value=0.027; Accession=PF00560.23; Description=Leucine Rich Repeat
  Pfam annotation: Domain name=LRR_1; Domain location=214-236; Score =18.5; E_value=0.024; Accession=PF00560.23; Description=Leucine Rich Repeat
  Pfam annotation: Domain name=LRR_1; Domain location=243-265; Score =9.6; E_value=4.6; Accession=PF00560.23; Description=Leucine Rich Repeat
  Pfam annotation: Domain name=LRR_1; Domain location=267-290; Score =10.5; E_value=3; Accession=PF00560.23; Description=Leucine Rich Repeat
  Pfam annotation: Domain name=LRR_1; Domain location=41-62; Score =11.7; E_value=1.8; Accession=PF00560.23; Description=Leucine Rich Repeat
  Pfam annotation: Domain name=LRR_1; Domain location=67-89; Score=3.6; E_value=61; Accession=PF00560.23; Description=Leucine Rich Repeat
  Pfam annotation: Domain name=LRR_1; Domain location=91-116; Score =3.4; E_value=67; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=118 -140::142-164::166-188::190-212::214-236::243-265::267-290::41-62::67- 89::91-116
MGKIPSQIGNLSNLLYLGLGGHSSLEPLFVENVEWVSSMWKLEYLYLSNANLSKAFHWLHTLQSLPSLTHLYFSECTLPHYNEPSLLNFSSLQTLHLYNTSYSPAISFVPKWIFKLKKLVSLQLQGNEIQGPIPGGIRNLSLLQNLDLSENSFSSSIPNCLYGLHRLKFLDLRLNNLHGTISDALGNLTSLVELHLSSNQLEGTIPTSLGNLTSLVELDLSRNQLEGTIPTFLGNLRNLREIDLKYLYLSINKFSGNPFESLGSLSKLSTLLIDGNNFQGVVNEDDLANLTSLKEFDASGNNFTLK

SEQ ID NO: 117486 - protein, 230 aa, Glycine max
  Coding DNA Sequence Number=SeqID_708
MTTERDGLAKIIVDLEAKLKELESRLEESNLRATKYRESSKEPEEELLLYKKETVEYHEKVDEEDIAVEEKVVDEWQGVAEQGDDACVYVAFVFIFFSSFSGFDHLKVLSPIWWGFHCALRSFSPDGYRELCLTCPWLKVLPTSRGRGGQITVRNKEYCQGHTCVPSVPVEMELSKRKGSPRMNLGFDETWTRDVFALGFVKPSELCRGLPMRGVGFCEPVSITKCGALV

SEQ ID NO: 117487 - protein, 68 aa, Glycine max
  Coding DNA Sequence Number=SeqID_709
MRHHIKHHPFVQPSFEDLRPGQSWPTELNVTIAKTGKKQQKAGHETHQKQEMGVSELYLGRRTMNPFD

SEQ ID NO: 117488 - protein, 555 aa, Glycine max
  Coding DNA Sequence Number=SeqID_710
  Gene Ontology: Mol. function=oxidoreductase activity, acting on the CH-OH group of donors, NAD or NADP as acceptor; Cellular component =glycerol-3-phosphate dehydrogenase complex; Biological process =electron transport
  Homolog annotation: Hit_ID=Q96558; Match level="QueryCoverage=83%, HitCoverage=96%, E-value=0.0, Identity=97%"; Hit description=UDP -glucose 6-dehydrogenase
  Pfam annotation: Domain name=UDPG_MGDP_dh; Domain location=209-306; Score=192.6; E_value=9.3e-55; Accession=PF00984.10; Description=UDP -glucoseGDP-mannose dehydrogenase family, central domain
  Pfam annotation: Domain name=UDPG_MGDP_dh_C; Domain location=328-452; Score=185.7; E_value=1.1e-52; Accession=PF03720.5; Description=UDP -glucoseGDP-mannose dehydrogenase family, UDP binding domain
  Pfam annotation: Domain name=UDPG_MGDP_dh_N; Domain location=2-200; Score=351.8; E_value=1.1e-102; Accession=PF03721.5; Description=UDP -glucoseGDP-mannose dehydrogenase family, NAD binding domain
  Pfam module annotation: Pfam domain module=UDPG_MGDP_dh::UDPG_MGDP_dh_ C::UDPG_MGDP_dh_N; Domain location=209-306::328-452::2-200
MVKICCIGAGYVGGPTMAVIALKCPSIEVAVVDISKSRIAAWNSDQLPIYEPGLDGVVKQCRGKNLFFSTDVEKHVFEADIVFVSVNTPTKTQGLGAGKAADLTYWESAARMIADVSKSDKIVVEKSTVPVKTAEAIEKILTHNSKGIKFQILSNPEFLAEGTAIKDLFNPDRVLIGGRETPEGQKAIQTLKDVYAQWVPEERILTTNLWSAELSKLAANAFLAQRISSVNAMSALCEATGANVQQVSYSVGTDSRIGPKFLNASVGFGGSCFQKDILNLVYICECNGLPEVAEYWKQVIKINDYQKSRFVNRVVASMFNTVSNKKIAILGFAFKKDTGDTRETPAIDVCQGLLGDKANLSIYDPQVTEDQIQRDLSMNKFDWDHPIHLQPTSPTTVKKVSVVWDAYEATKDAHGLCILTEWDEFKTLDYQKIFDNMQKPAFVFDGRNIVDADKLREIGFIVYSIDLTCRLGEAPLIGGETCKTKDFDAQGTVIAFVDNSWLVDSSRELIDNVKGCHMYFVAPVQYISPPSSEPACGQKRLSNAERICPVSRESV

SEQ ID NO: 117489 - protein, 90 aa, Glycine max
  Coding DNA Sequence Number=SeqID_711
MEQRSMAGRTSTTGGRRFTNLENGRRRGHNSEEEVTKPTKKKRPQHTVESSREEEEEEAVQMRRRILGRRSFLSEEEEEAFSKMNSDSYE

SEQ ID NO: 117490 - protein, 302 aa, Glycine max
  Coding DNA Sequence Number=SeqID_712
  Homolog annotation: Hit_ID=Q1S0W6; Match level="QueryCoverage=97%, HitCoverage=66%, E-value=7e-43, Identity=39%"; Hit description=EGF -like
NKVKYFSPQNKIRQRKFLVAKKKKETKKEEKEGSGAADSCKCKATGANANKNHKCVCVAYNNLRKSQEEFFKNKDDGVVEEGGFESETESVVVEEEKEGESLLGNGLVVKRRRERLMEEARKSVPQSGSGKVMHLVKAFEKLLSIPKTEEEEDEEEGSKYQEKDDNKMVGKWALPGLQQHDSEVSFCPPNCVLTLQNLGLDPGASVSASWDSSRASVSSRTSTGGRRSRRNSLESSSTFGRRRLKKKQQKVTSQKPFKLRTEQRGKLKEEEFVKKIQEMAAVEEKQRIPVAQGLPWTTDEPE

SEQ ID NO: 117491 - protein, 199 aa, Glycine max
  Coding DNA Sequence Number=SeqID_713
  Gene Ontology: Mol. function=RNA-directed DNA polymerase activity; Cellular component=nucleus; Biological process=RNA-dependent DNA replication
MLFRIHNLLWPMGGTKSRLDGYNFRILKEFWGLLKGDIIEFLGDFHASEKFPRGASASFIALIPKIYEPQGELHGVIDGRQSVFLGGRNLLHNVLIANEVVDEVRRKKRKCLLFKVNYEKTYDSLGIGTCECNPTKEFMLQMELRYGDPLAPFLFTIMAEGLSDLMREAVSRNLYRGFNVGTMKVEEIGEDSKEVFVGL

SEQ ID NO: 117492 - protein, 942 aa, Glycine max
  Coding DNA Sequence Number=SeqID_714
  Gene Ontology: Mol. function=nucleoside-triphosphatase activity; Cellular component=mitochondrion; Biological process=protein metabolic process
  Homolog annotation: Hit_ID=Q4LDR0; Match level="QueryCoverage=94%, HitCoverage=91%, E-value=0.0, Identity=90%"; Hit description=Heat shock protein
  Pfam annotation: Domain name=AAA; Domain location=247-441; Score =53.2; E_value=8.9e-13; Accession=PF00004.19; Description=ATPase family associated with various cellular activities (AAA)
  Pfam annotation: Domain name=AAA_2; Domain location=646-815; Score =365.9; E_value=6.2e-107; Accession=PF07724.4; Description=ATPase family associated with various
  Pfam annotation: Domain name=AAA_5; Domain location=247-387; Score =9.9; E_value=0.00031; Accession=PF07728.4; Description=ATPase family associated with various
  Pfam annotation: Domain name=AAA_5; Domain location=650-795; Score =23.7; E_value=2.8e-05; Accession=PF07728.4; Description=ATPase family associated with various
  Pfam annotation: Domain name=Clp_N; Domain location=140-191; Score =51.4; E_value=3e-12; Accession=PF02861.11; Description=Clp amino terminal domain
  Pfam annotation: Domain name=Clp_N; Domain location=63-115; Score =64.2; E_value=4.2e-16; Accession=PF02861.11; Description=Clp amino terminal domain
  Pfam annotation: Domain name=Torsin; Domain location=604-848; Score= -164.4; E_value=0.004; Accession=PF06309.2; Description=Torsin
  Pfam module annotation: Pfam domain module=AAA::AAA_2::AAA_5::AAA _5::Clp_N::Clp_N::Torsin; Domain location=247-441::646-815::247 -387::650-795::140-191::63-115::604-848
MGFRQFGEIPHLSPFAVKLQVEGLFTILNVCGFGLYGGCWRLWGAVITQQEFTEMAWQAIVSSPEVAKENKHQIVETEHLMKALLEQKNGLARRIFSKVGVDNTRLLEATDKYIQRQPKVLGESSGSMLGRDLEALIQRARDHKKKYGDSFVSVEHLVLAFTQDQRFGKQFFRDFQISEPALKSAIESVRGRQSVIDQDPEGKYEALEKYGKDLTAMAKAGKLDPVIGRDDEIRRCIQILSRRTKNNPVLIGEPGVGKTAISEGLAQRIVHGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLEAELSLLKEKQAELTEQWEHEKSVMTRIQSIKEEIDRVNLEIQQAEREYDLNRAAELKYGSLNSLQRQLESAEKELDEYMNSGKSMLREEVTGNDIAEIVSKWTGIPVSKLQQSEREKLLYLEEVLHKRVVGQDPVVKAVAEAIQRSRAGLSDPHRPIASFMFMGPTGVGKTELAKALAAYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTDDDTTPKELAYETIKQRVMDAARSIFRPEFMNRVDEYIVFQPLDREQISSIVRLQLERVQKRIADRKMKIQVTDAAVQLLGSLGYDPNYGARPVKRVIQQNVENELAKGILRGEFKEEDAILIDTELTAFTNGQLPQQKLVFKKLAADSESTPQGTLEPFPQAP

SEQ ID NO: 117493 - protein, 82 aa, Glycine max
  Coding DNA Sequence Number=SeqID_715
  Homolog annotation: Hit_ID=Q2HVC0; Match level="QueryCoverage=53%, HitCoverage=5%, E-value=5e-12, Identity=77%"; Hit description =Protein kinase
MGTGMGGALLILQDQSLKTMIEICVRCLVKELAYRSSIKDVLRNLQFASQVQDAWRGILKVVKDQLAQNLEGYPSKLILKFT

SEQ ID NO: 117494 - protein, 193 aa, Glycine max
  Coding DNA Sequence Number=SeqID_716
  Gene Ontology: Mol. function=hydrolase activity, hydrolyzing O -glycosyl compounds; Biological process=carbohydrate metabolic process
  Homolog annotation: Hit_ID=Q2HTU0; Match level="QueryCoverage=95%, HitCoverage=60%, E-value=8e-16, Identity=40%"; Hit description=Ricin B lectin; Glycoside hydrolase, family 5
MDSGRVREKDEDALCELVKSPQFNVGGSHKVGETLDSLKLHGIRLGLRPYNPSLENATLVEAFDAVIDEFGRQGMMVLADNHVSDPKWCCGDNDGNGFFGDEHFNPEEWLQGLSMIANRVKGKSQHPGFLMRGQNPGALVMSEFGMNMTKRDEKNNRFMSCMLAYLARVDLDWALWTAQGGYYVKEQDRILGV

SEQ ID NO: 117495 - protein, 251 aa, Glycine max
  Coding DNA Sequence Number=SeqID_717
  Homolog annotation: Hit_ID=Q8LCS8; Match level="QueryCoverage=39%, HitCoverage=79%, E-value=8e-36, Identity=71%"; Hit description =Membrane-anchored ubiquitin-fold protein 2
  Pfam annotation: Domain name=ubiquitin; Domain location=13-95; Score =7.0; E_value=0.051; Accession=PF00240.13; Description=Ubiquitin family
MAGNQDQFEIKFRLTDGSDIGPKSFPAATSIATLKESVLAQWPKDKENGPKTIKDVKLISAGKILENNRTVGECQSPLCDTPDTVTTMHVVVQHPATEKVASGAKDYLHREESCQQSNTEQMHPLCSYSIVRELHRSHMSEDAPNRETIFPDLSLSLHLQPELLFPLSHPITTPPFKLQLRHCEQASPPLHLRVLSWIWYMGLGLVGFFQGDSDLSMASENSKRGHVTRTFFLTIAFMKVAAPSFKDYPRR

SEQ ID NO: 117496 - protein, 166 aa, Glycine max
  Coding DNA Sequence Number=SeqID_718
MLRKILNEEVDSHAYQQDKNSMEGSGLEFSETNASSWARKVELPSFDRSIEGGIELKGSNFEWDSDPMQFLKSENRSKVMKEEVDPSIKREKHKENGVMNVGCEDDFLDNLITDLIKKEAEVGDSTKPHCFQDLDFHKKIVMVKQKSFMKVVGTTMELKSWNVNLL

SEQ ID NO: 117497 - protein, 244 aa, Glycine max
  Coding DNA Sequence Number=SeqID_719
  Gene Ontology: Cellular component=extracellular region; Biological process=cellulose and pectin-containing cell wall organization and biogenesis
  Homolog annotation: Hit_ID=Q5MAJ7; Match level="QueryCoverage=92%, HitCoverage=87%, E-value=5e-78, Identity=61%"; Hit description=Alpha- expansin 19
  Pfam annotation: Domain name=DPBB_1; Domain location=54-140; Score =139.0; E_value=1.3e-38; Accession=PF03330.8; Description=Rare lipoprotein A (RlpA)-like double
  Pfam annotation: Domain name=Pollen_allerg_1; Domain location=151 -229; Score=127.0; E_value=5.1e-35; Accession=PF01357.11; Description= Pollen allergen
  Pfam module annotation: Pfam domain module=DPBB_1::Pollen_allerg_1; Domain location=54-140::151-229
MVLFVPALSHGSRHRRSGWHLAHATFYGDMQGGDTMQGACGYGDLYQQGYGLETTALSTALFNNGLTCGACFEIMCVNEPQWCIPNAGSIKVTATNFCPPNYNPPNFDHWCNPPQEHFDLSMKMFTKIAIYRAGIIPVMYRRVPCNKSGGVKFEMKGNPYWLLVLLYNVASAGDVTQVSIKGSSNTGWKSMSRVWGQNWVTGSNLVGQALSFQVTTSDGKMMEFDNVAPSNWQFGQSYETYQNF

SEQ ID NO: 117498 - protein, 105 aa, Glycine max
  Coding DNA Sequence Number=SeqID_720
  Subcellular localization annotation: CTP_CleavageSite=51; ConfidenceScore=5.19e-01
MVHSTYVCLLLQIDLNSSSPTSNRHPRRCSRSRPIGVTSTIREHDEGGAVRCEQRHFAAAVSEDEAVSHCSDNVVLSTMVRRKTWFQFFWVSVVVISNGVTKDID

SEQ ID NO: 117499 - protein, 250 aa, Glycine max
  Coding DNA Sequence Number=SeqID_721
  Subcellular localization annotation: CTP_CleavageSite=26; ConfidenceScore=5.00e-01
MRKPLPSCCAHRGRISPWTTAGRRVRIMHTSMTTLTQTWMTLLLSNVLPSDHNSDLPLPKCQQVYAILTRISVHVAQVIADAIYLFAGMAPTRHPLDPNKSNRALGFSALITGLCQSYEVPVTPSKVIRPPITRAFIEKYCTPRQAQGDADQAADAPPPPRQADPVGSLGMERHLQRLVCQQAANHHEQGSTPFVCPTPEQFGAEVAWPGDWPNAQAGQEPAGSPGEADESHMDEDMTDLLGFLGGSRAT

SEQ ID NO: 117500 - protein, 531 aa, Glycine max
  Coding DNA Sequence Number=SeqID_722
  Gene Ontology: Mol. function=binding
  Homolog annotation: Hit_ID=Q10GR2; Match level="QueryCoverage=48%, HitCoverage=30%, E-value=7e-44, Identity=39%"; Hit description=HEAT repeat family protein
MLEAYGDILFWAWPAAQGDSRTEIKNGFLQEMIEAAIHASFGAFASYIMRVLEAFINHRTTDGVEKILYRLAEPVIFRSLQATYRYDCLEVRTIVVEGSCRILHLFWEVIPSLIITKMITKIVDDISHDGCNETSAPNVGQSPSNTSCCSGSLTPSKGCSRFSVQQGGGARCAIVCAYKAPMAGARFFQFAILERASKSHLMELVKVFLSLILSPDKLDANQINGFLVATSYVCDSLACEPCYKNALKELLDGEKMKEPEHNGTWKAAGRGALTTYKNIPNLAIGFEEGLQAKAMEKDETFETGPASFRWPEGDAWTSRTGNEALQWRRVAALLVTRLAGVDCAPRGTPNPDDVARLLEECMGVVTNCSGLPEDVDRQIEIRSAHKLLLSLGGFDDLIEALTASLHKVAYRCHIKFGVDMPSHSVSFAKRKKSKSSGKFSIKSKIINRKQSFEDDYLVAVGVTWQVRDLLLQEDTRKAILESPSLEMSFVSLKVISEVSIMHCGHHEYIDICPVLAYVAFAVQMTVDNWQK

SEQ ID NO: 117501 - protein, 199 aa, Glycine max
  Coding DNA Sequence Number=SeqID_723
  Gene Ontology: Mol. function=pyruvate kinase activity; Cellular component=chloroplast; Biological process=glycolysis
  Homolog annotation: Hit_ID=Q1RYJ8; Match level="QueryCoverage=61%, HitCoverage=21%, E-value=1e-41, Identity=69%"; Hit description =Pyruvate kinase
MGKTVIVATNMLDNMIVHPTLTRIEVSNLVIVVQEGSNGIMLSRETAYEKFPLKVVQVRHIVALQTKATIPSGKMPPNIGQVLKNHMSEMFAYHATMMSNTLGTSIIVSTGTGFMTQVVFLDHILIVKDREKTAENVKGLNLVLSWQLDNNYHLEDKMFFNGIRDVRKGIMAQQDTIGIGMNDRPKRKINPPRHLKDFI

SEQ ID NO: 117502 - protein, 182 aa, Glycine max
  Coding DNA Sequence Number=SeqID_724
MKMKASKTRNELKASDSSTYRMKTEEGTKNAEMHSIGVRNPLKQLRKNYGSVADLIFLLFLFLFTNPKLNMLSQGYGNFTKTLRKPRMPFFNKMGEVVAAQLSHASLTRPGELDCFHLKEEKVQNPLDGPRFGSFYLDSHLDKFTPYFCVFLAVFFPKPHGTLRIPRRWVLSLPKRSKMVLG

SEQ ID NO: 117503 - protein, 200 aa, Glycine max
  Coding DNA Sequence Number=SeqID_725
  Gene Ontology: Mol. function=o-succinylbenzoate-CoA ligase activity; Cellular component=membrane; Biological process=metabolic process
  Homolog annotation: Hit_ID=Q10ML0; Match level="QueryCoverage=49%, HitCoverage=16%, E-value=7e-48, Identity=81%"; Hit description=AMP -binding enzyme family protein, expressed
MRVHTTKALKYALGKGAVDYEDFLQSGDPEYAWKPPEDEWQSNSLGYTSGTTASPKGVVLHHRGAYLMSLSGALIWGMTEGAVYLWTLPMFHCNGWCYTWILAALCVLIQHTKIEYFPEPEKFDPSRYERIGPAYTCVPFGGGPRMCHGKEYARMELLVFMHNLVKRFKCENFIPNGKITYNPMPIPANGLPDRLIPHRS

SEQ ID NO: 117504 - protein, 208 aa, Glycine max
  Coding DNA Sequence Number=SeqID_726
  Gene Ontology: Mol. function=glucose-6-phosphate 1-dehydrogenase activity; Cellular component=cytoplasm; Biological process =carbohydrate metabolic process
  Homolog annotation: Hit_ID=Q5H0F3; Match level="QueryCoverage=98%, HitCoverage=39%, E-value=1e-63, Identity=63%"; Hit description =Glucose-6-phosphate 1-dehydrogenase
MCTDFEVVAVPHCLQQRIDKAQRDQVKHCRLAQVVVEAEHAVLVDPLADGRDDLLGALAVAADRLLQHQACRCGKCAALGQAFAGGDVQTRRDGQVADALAVHQVGDRGGNRVDVAQVHRTVVDAAQQGTDVVLRGHRHGLLQARAQDVMEGFGVMPGQGQCADAEVLRQQAVAKQAKQRREQVALGQITCGTEQEEGVVHRSSFRSG

SEQ ID NO: 117505 - protein, 97 aa, Glycine max
  Coding DNA Sequence Number=SeqID_727
  Homolog annotation: Hit_ID=Q1SDG1; Match level="QueryCoverage=54%, HitCoverage=4%, E-value=2e-10, Identity=58%"; Hit description =Integrase, catalytic region; Zinc finger, CCHC-type
MVVGNATIEKPKEQWDEEERKRVQYNLKAKNVITSALGMDEYFRVTNCRNAKETWDTLQEHEMELMRLNQHEENDKKKKGITLKVSLQFKKKVTKRT

SEQ ID NO: 117506 - protein, 117 aa, Glycine max
  Coding DNA Sequence Number=SeqID_728
MRLHYNPASRGPCMTTYRPPLPMANTNPGCVTLAPTYPQGKLTQANWFLKLEGISSPSQAGCLRLKLSHGPSEFRSKEFQKMIILSLSLWLFVFGSGNQTSTLSDPVSLRCNGCQTP

SEQ ID NO: 117507 - protein, 141 aa, Glycine max
  Coding DNA Sequence Number=SeqID_729
  Gene Ontology: Mol. function=methyltransferase activity; Biological process=metabolic process
  Homolog annotation: Hit_ID=Q8L9U0; Match level="QueryCoverage=73%, HitCoverage=29%, E-value=5e-29, Identity=66%"; Hit description =Coclaurine N-methyltransferase
  Pfam annotation: Domain name=Methyltransf_11; Domain location=34-128; Score=1.1; E_value=0.042; Accession=PF08241.2; Description =Methyltransferase domain
MAAFRKALPENQPDAVGNIVVGATDWASLVTLAIRLLGTISWTVDNRLIVIWVTRICNSMTQKAYIDEKCRDLQLQNLNIIVADISTFEMEASYDRIFSIEMFEHMKNYKDPLKKISKWMKKDGLYLFITFATKHLSTSLR

SEQ ID NO: 117508 - protein, 112 aa, Glycine max
  Coding DNA Sequence Number=SeqID_730
  Homolog annotation: Hit_ID=Q9SGA8; Match level="QueryCoverage=61%, HitCoverage=15%, E-value=5e-08, Identity=38%"; Hit description =Putative UDP-glucosyl transferase
MGIPHFLAIPYPILGHMNPLLQFALVLAQYGCRITFLSSDENYDKLKSASGGGNGKVIMDSHIKLVSLPDVGHQLGIKGALFWPASTTSLASFNSIQRLINEGAKDSKNGKN

SEQ ID NO: 117509 - protein, 119 aa, Glycine max
  Coding DNA Sequence Number=SeqID_731
  Homolog annotation: Hit_ID=Q1S312; Match level="QueryCoverage=69%, HitCoverage=14%, E-value=1e-25, Identity=67%"; Hit description =Quinoprotein amine dehydrogenase, beta chain-like
MWFMFTMKLLSIAPKATTLRRRHPPRWNWWYVSSEVEFVGPNVVGYEIDATLVVEHLQLHFGGIPSANLGTYNEEPNGVVFIVLVFEKGVRGAFVGEDPFSVGSVVADVKVEVNSVLGK

SEQ ID NO: 117510 - protein, 134 aa, Glycine max
  Coding DNA Sequence Number=SeqID_732
  Homolog annotation: Hit_ID=Q1S7U5; Match level="QueryCoverage=63%, HitCoverage=10%, E-value=1e-07, Identity=65%"; Hit description =Calcium-binding EF-hand; Tesmin/TSO1-like, CXC
MDLVDWKQIVSGSLGYDPPPCGDEANSVLELLGEATTNAGYVKEGSKTNLLVSAMHCSIRRHCIDFEMANVQRKNSDENSNIGLVHLSLMRRMFIMKSNFFLQNAMRIYRGEFARNWSTLECTCCLKRIQGHTN

SEQ ID NO: 117511 - protein, 262 aa, Glycine max
  Coding DNA Sequence Number=SeqID_733
  Homolog annotation: Hit_ID=Q5NA81; Match level="QueryCoverage=13%, HitCoverage=8%, E-value=1e-07, Identity=71%"; Hit description =Putative zinc finger protein ID1
MTVSTNPDINSHGVSTVAPLPKKKNEEEGIAEDVKGNLLPKREELVGRGWQGAFGLKYEITKNEHQQQQQVGVEENICNLTSASGEASAASSGNKTEIGTNYMAPPPSQTQQPKKKRNLLGNPDIYAEVIALSPKSLLATNRAQFSLETEVENKQRGEEEESTVRRSANVTSAPRSMPFNQIGKLTPNPVALGSTHVTVKPTSQVPRRLSLSDIKYTTMEFNRDRLVGEGASAKVYKGFKDEDGNSSTGMGVNLPVDIVDQN

SEQ ID NO: 117512 - protein, 686 aa, Glycine max
  Coding DNA Sequence Number=SeqID_734
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=90%, HitCoverage=69%, E-value=1e-95, Identity=47%"; Hit description=D -galactoside/L-rhamnose binding SUEL lectin; Integrase, catalytic region; ...
  Homolog annotation: Hit description=Galactose-binding like; Peptidase aspartic, catalytic
MIDSSSATSDDQNKEKKIVTPNLSSATSDDQNKEKKIVTPNLSSCIFVAEENSDTSMEDISKNYMCYSTAKELWDSVTEMYSDLGNKSQIYELTLQAKEIRQGGNNVTKYFHSLKQVWQDLDLFNTYKWNSAKDAKHHQQTMEEGRIFQFLAGLNEELDEVRGRIIGRATLPSLGEVFAEVRREETRRSVMIGKIKIVLPPPETNVLATETTTLKSSTNQKNFSNLWCDHCNKPLHEAENTSLRKEQVKELIRLLNSNFLSGSPSGSVAQTGKRDITLSKNIDLKNVLHDRTSGKMIGSAKIMDGLYYFENNFKNKEAQGLSGMSYVPGKKYHNQIKSVVFILRNILKGSKNNPSSQHQTKHNFWRKAKEKYQEKVECKADGSVERYKARLVAKGFTQTYGVDYQETFAPVAKLNSVRIFLSLVANCNWPLHQLDVKNAFLNGELEEEVFMSLPPGFEEELGRNKVCRLKKSLYGLKQSPRAWFERFGTVVKGLGYIQSQADHTLFYKHSTNNKIVILIVYVDDIILIGDDSLELKNLREKLAKVFDIKELGPLKYFLGLEFARSKEGIFMNQRKYILDLLKETGLLGCKVAETPMEPNLKLQPAEIENMVDKGRYQRLVGRLIHLSHTRPDMPLLGLLYKNHGHLQVEGYTDADWVGSVTDRRSTSGYCTFVGGNLVGEAKNRVL

SEQ ID NO: 117513 - protein, 370 aa, Glycine max
  Coding DNA Sequence Number=SeqID_735
  Gene Ontology: Mol. function=xanthine dehydrogenase activity; Cellular component=integral to membrane; Biological process=electron transport
  Homolog annotation: Hit_ID=Q396F6; Match level="QueryCoverage=99%, HitCoverage=38%, E-value=1e-159, Identity=71%"; Hit description =Aldehyde oxidase
  Pfam annotation: Domain name=Ald_Xan_dh_C2; Domain location=10-369; Score=-207.0; E_value=1.3e-05; Accession=PF02738.8; Description =Aldehyde oxidase and xanthine dehydrogenase, molybdopterin binding domain
LKDTPIFPVSMKKHLPVWPEGREGGKLDQEGMRYAGLIADEMANPPADWLVMSRRYTTQSIDTSALEPDNANGWFDAETQTLHLVVPTQSPQEVADEMPRMLAKRNPPVKQLILHPCYTVGYGSKDHYNFPYYGAVAAMYGDGHPVRLANDRFEQFQTALKRHAFDMNYRIAVNKQTGVMQSFLGDMTADGGGRSNFTPSVVMVGATAAQSIYYFPKSDLSSVGLASRAIDAGSARGYGTLQSMAATEMMVDELAAELKIDPIEFRLRNVLKSGMKNTQGAIPAGAIRADEVLEKAAKHEMWLKRAERKAEFESRHPGKRYGVGFGCVQKDFGTGAETSFARVELSEDGRITLHHSGAEMGTGMSTSQSV

SEQ ID NO: 117514 - protein, 73 aa, Glycine max
  Coding DNA Sequence Number=SeqID_736
MDKSLKVGEDEWREREKRGTKFMPQMSNINEIREERNEISIYTGSTTSCAYVQSSSNPLEIFHYLCKSPFYNF

SEQ ID NO: 117515 - protein, 141 aa, Glycine max
  Coding DNA Sequence Number=SeqID_737
  Gene Ontology: Mol. function=RNA-directed DNA polymerase activity; Cellular component=chromatin; Biological process=chromatin assembly or disassembly
  Homolog annotation: Hit_ID=Q94I07; Match level="QueryCoverage=55%, HitCoverage=36%, E-value=1e-28, Identity=60%"; Hit description =Putative retroelement
MVVSLFLTHLLLEVASPITFTPSLFHCHDLKEAKDSIDEEDPRPTSSTWSYITLLRGIEHQIDISMDFFLGLSRTKRGLNFIFVVVDRFSKMAHFIPCHKVEDASYISKLFFRDVVRLHGLTRIIVSDRDAKELSHFWKTL

SEQ ID NO: 117516 - protein, 85 aa, Glycine max
  Coding DNA Sequence Number=SeqID_738
MGDEVEQGWDGTVETVAFKAEAVELGEGGEVENGVGEVEVFKDEAGNMVVVVVVEVGDIVSGLLAVQRTTCFLGFISLKVLVLAN

SEQ ID NO: 117517 - protein, 226 aa, Glycine max
  Coding DNA Sequence Number=SeqID_739
ICDEITLILHHNGKLIQNANEALDGLQRLENDYDVLSLCKIGLANPKKKVHVYLEHVEPEGGLVIEIGLEIEIDVLPLNCNAEKVVVLEDSTQNVIEDMDVDGANNVGKGGLDGETGVVGVETQVDVQDAKTKVVGVETQVNNGVDDDEVKEHDKDANFFYHSESDLDYMLAIKDSRLVANLLLVLMVVFLKGYYGGHLLAAMGQDANNVIFVIAYAIVNAEDEDN

SEQ ID NO: 117518 - protein, 470 aa, Glycine max
  Coding DNA Sequence Number=SeqID_740
  Gene Ontology: Mol. function=transferase activity, transferring hexosyl groups; Cellular component=integral to membrane; Biological process=carbohydrate biosynthetic process
  Homolog annotation: Hit_ID=Q10Q30; Match level="QueryCoverage=94%, HitCoverage=77%, E-value=0.0, Identity=67%"; Hit description =Glycosyl transferase family 8 protein, expressed
  Pfam annotation: Domain name=Glyco_transf_8; Domain location=110-443; Score=403.4; E_value=3.3e-118; Accession=PF01501.10; Description =Glycosyl transferase family 8
MIGSAHFDCLGRRLGPRLLGRVDDSGRLVRDFYKILNEVKAGEIPPDLKLPDSFDQLVSDMKNNQYDAKTFAFMLRGMMEKLEREIRESKFAELMNKHFAASSIPKGIHCLSLRLTDEYSSNAHARKQLPPPELLPLLSDNSYHHFILSTDNILAASVVVASTVQSSLKPEKIVFHVITDKKTYAGMHSWFALNPVTPAIVEIKSIHQFDWLTRENVPVLEAVENQNGIRNYYHGNHIAGTNLSDTSPRKFASKLQARSPKYISLLNHLRIYLPELFPNLDKVVFLDDDVVIQRDLSPLWEIDLEGKVNGAVETCRGEDEWVMSKRFRNYFNFSHPLIARNLDPDECAWAYGMNIFDLHAWRRTNIREIYHSWLKENLKSNLTMWKLGTLPPALIAFKGLVHPIDPSWHMLGLGYQNNTNIESVKKAAVIHYNGQSKPWLQIGFEHLRPFWTKYVNYSNDFLRNCNILES

SEQ ID NO: 117519 - protein, 124 aa, Glycine max
  Coding DNA Sequence Number=SeqID_741
MVFLTRHEESIKIQRTNRLRILCPNTLEGTTFVAQVEDTSTWVVILRTREGTSLVDQFKWRVHPVGCSKRTREGTSLVDLWLVKDFTRLKEISRTVGSLGTGCRHGLLSNQYKSCVCLLLPYTL

SEQ ID NO: 117520 - protein, 82 aa, Glycine max
  Coding DNA Sequence Number=SeqID_742
MGLVIRFEVGGWMKSARQFISGAPYSMVQRLAINSWGSRLGGGGCMNDNQFMGLGLRFVGGGYTNSARESVRGAPESMVEDA

SEQ ID NO: 117521 - protein, 360 aa, Glycine max
  Coding DNA Sequence Number=SeqID_743
  Gene Ontology: Mol. function=transporter activity; Cellular component= integral to membrane; Biological process=transport
  Homolog annotation: Hit_ID=Q5FU09; Match level="QueryCoverage=99%, HitCoverage=81%, E-value=7e-69, Identity=39%"; Hit description =Putative sugar/polyol transporter
  Pfam annotation: Domain name=MFS_1; Domain location=23-356; Score =67.5; E_value=4.3e-17; Accession=PF07690.6; Description=Major Facilitator Superfamily
  Pfam annotation: Domain name=Sugar_tr; Domain location=22-360; Score=- 159.6; E_value=0.071; Accession=PF00083.14; Description=Sugar (and other) transporter
  Pfam module annotation: Pfam domain module=MFS_1::Sugar_tr; Domain location=23-356::22-360
MTTSPATHPWLIRLGIPPALAWGYLAVLLFMIGDGVESNYLAPYLHENGFSLNIAAWVIAFYGVTVTLGSWLAGSLSTLIGPRKVMLAGGLIWIVFEVLFLAVALPSHSVLLLALTYGLRGVAYPMFAYAFLVWIQSAAPAEMRGSATGWFWLAFTGGLPTLGSLVAIFSIRLVGEYATFWLSLGLVAIGLLVMLLALKERSGYQSLLDAEHRQQGTLRTLMGGIDILWREPRIAAAAVVRIINTTPYFGFFIFLPGFFTEQIGFSQTEYLSLITIMGLVGMSFNPIVGKLSDRIGWRKVLTVFGGLGSGVSMLLMYFVPQWSHGSFVLSVICACLYGITLCGYVPAAALFSSLCQPKDK

SEQ ID NO: 117522 - protein, 92 aa, Glycine max
  Coding DNA Sequence Number=SeqID_744
MGFLVPVFVPISQISPYLFEIKLVPNDAVYCFCSILSVSSSSHTFKGGVVEAAGGEGARNCNGNSKAAAFKGGSVEDAVTAFFQSLLLLIQF

SEQ ID NO: 117523 - protein, 452 aa, Glycine max
  Coding DNA Sequence Number=SeqID_745
  Gene Ontology: Mol. function=protein disulfide oxidoreductase activity; Cellular component=membrane; Biological process=glycerol ether metabolic process
  Homolog annotation: Hit_ID=Q6CYX1; Match level="QueryCoverage=66%, HitCoverage=99%, E-value=1e-94, Identity=61%"; Hit description =Probable amino acid metabolite efflux pump
  Pfam annotation: Domain name=DUF6; Domain location=158-291; Score =60.9; E_value=4.3e-15; Accession=PF00892.11; Description=Integral membrane protein DUF6
  Pfam annotation: Domain name=DUF6; Domain location=16-134; Score =54.7; E_value=3.1e-13; Accession=PF00892.11; Description=Integral membrane protein DUF6
  Pfam annotation: Domain name=TPT; Domain location=149-291; Score= -31.1; E_value=0.037; Accession=PF03151.7; Description=Triose -phosphate Transporter family
  Pfam annotation: Domain name=UAA; Domain location=43-297; Score= -172.8; E_value=0.089; Accession=PF08449.2; Description=UAA transporter family
  Pfam module annotation: Pfam domain module=DUF6::DUF6::TPT::UAA; Domain location=158-291::16-134::149-291::43-297
  Subcellular localization annotation: CTP_CleavageSite=66; ConfidenceScore=5.07e-01
MRMSVKDMLLALCVVVAWGVNFVVIKLGLQGMPPFLLAGLRFTLVAFPAIFFVRRPAIPLRWLVVYGMTISFGQFAFLFLAIKLGMPAGLASLVLQAQAFFTLLLGALLLAEKLRWNHIAGILVATLGMFMLATAGMEGQTTAGITLTTMMLTLAAALSWGLGNITNKIILRNRKVPVMSLVVWSALVPIAPFFACSWWFEGESAIVTSLLDISLQTVLALLYLAFFATIIGYAIWGNLLSRYETWRVAPLSLLVPVVGILSAALILGETLSAQEILGASVIILGLLVNVFGGMVSQRLLDFNPAWFRLFRDDAFQIDTQQAQFETRIAHHDVIGQLEFAFEVTFCDALHVVMGGDIQFALRKAGDGNGDAIVVFVYQLDVVRRVAAVSLVLVGLKQVKQTVETNSRTIKRREIKVTHNKTPDNQQVLATFHHGQVVRPVGVPVGDRVVTVA

SEQ ID NO: 117524 - protein, 184 aa, Glycine max
  Coding DNA Sequence Number=SeqID_746
  Homolog annotation: Hit_ID=UPI00005F94D0; Match level="QueryCoverage =45%, HitCoverage=79%, E-value=2e-26, Identity=65%"; Hit description =COG5645: Predicted periplasmic lipoprotein
  Subcellular localization annotation: CTP_CleavageSite=43; ConfidenceScore=5.56e-01
PADSVRALQRAARNRRAATRWCGRRTGSRSPTCARLTAGDSCSASVRFRRHSRRSGQAGLGASHLLALQHAFARRIFGFIVVGAEVIPRQQQRIHHRREGQIDQRQRFNRPAGIVIGQHLCAGARAGVVTLAGTGMRHHAGAACCGTGAADQQASERKAFHHFHHHHPYSHGMALAGVCHLTSA

SEQ ID NO: 117525 - protein, 253 aa, Glycine max
  Coding DNA Sequence Number=SeqID_747
MFVESTWLDDIVTARVPLLVLRNFLTPEVRNAVVADLQQCREQVRVSHYPNGALTTLGPYLAKHTAAPENYFTELRDIQPALPASLHALRAQIYHWVQHALRLESLQTATEPALGDYAGSIVRFHADGVANPLHNDNIVRDAAGSGLAVTHILHQLSCVVCLQECNAGGALRIFNKKWQPEDERFKTPGELGYQSGVIAGSETCEFAPRSGDIYLFNPAFYHEIDRVEGDTRITMGFFFGLTDKKMKHAIAWS

SEQ ID NO: 117526 - protein, 140 aa, Glycine max
  Coding DNA Sequence Number=SeqID_748
  Homolog annotation: Hit_ID=Q4ZSC7; Match level="QueryCoverage=68%, HitCoverage=22%, E-value=4e-10, Identity=35%"; Hit description =Conserved domain protein
MAIEGTNLQPVGHQALGERVVMDTQRTIDAIDVFHHAIVHGGMAVSADAQLKRHHIAAVFAAAIGQQDAVTFGMVGIGQGGEQSLSTVLGGIENRGRQVFFNFTHHRGQIIHFSLHPLANKIAAAVRATTGWKTGHEGAA

SEQ ID NO: 117527 - protein, 420 aa, Glycine max
  Coding DNA Sequence Number=SeqID_749
  Gene Ontology: Mol. function=transferase activity, transferring nitrogenous groups; Biological process=biosynthetic process
  Homolog annotation: Hit_ID=P09053; Match level="QueryCoverage=77%, HitCoverage=93%, E-value=1e-128, Identity=61%"; Hit description =Valine--pyruvate aminotransferase
  Pfam annotation: Domain name=2-Hacid_dh_C; Domain location=1-62; Score=-45.2; E_value=6.3e-06; Accession=PF02826.9; Description=D -isomer specific 2-hydroxyacid dehyd
  Pfam annotation: Domain name=Aminotran_1_2; Domain location=121-397; Score=-71.0; E_value=0.00081; Accession=PF00155.11; Description =Aminotransferase class I and II
  Pfam module annotation: Pfam domain module=2-Hacid_dh_C::Aminotran_1 _2; Domain location=1-62::121-397
MKPSAILINAGRGPVVDEQALTAALKDGTIHAAGLDVFEVEPVPADAEILTLPNVVALPHIGSATHETRYGMARDAVDNLIAALSGKVEKNCVNPQFGDKFTQHSGISRLMEDMGEGLRTPGTIMLGGGNPAQIPAINDYFSQLLLQMHQDGKLNEALCNYDGPRGKALLLEALATLLREELGWPEDLFISAKPNIELLPEGQFKYHVDFDHLPLNDETGLICVSRPTNPTGNVITDDELLQLDALAQQHGVPLLIDNAYGVPFPGIIFSEARPLWNPNTILCMSLSKLGLPGARCGIIVADESTISAIGNMNGIISLAPGSIGPAIATEMIVRGDLLRLSQEVIKPFYQAKRRSLPDPQTGRRHLPVAVVPRPADQHRSAVSASESARRADGAGPLLLPGAGTGLAAHPSVHAHELRTG

SEQ ID NO: 117528 - protein, 481 aa, Glycine max
  Coding DNA Sequence Number=SeqID_750
  Gene Ontology: Mol. function=transferase activity, transferring nitrogenous groups; Cellular component=intracellular; Biological process=regulation of transcription, DNA-dependent
  Homolog annotation: Hit_ID=Q6ZEP4; Match level="QueryCoverage=95%, HitCoverage=96%, E-value=4e-79, Identity=36%"; Hit description=GntR family transcriptional regulatory protein
  Pfam annotation: Domain name=Aminotran_1_2; Domain location=116-470; Score=33.9; E_value=4.6e-09; Accession=PF00155.11; Description =Aminotransferase class I and II
  Pfam annotation: Domain name=Aminotran_5; Domain location=146-470; Score=-186.4; E_value=0.0073; Accession=PF00266.9; Description =Aminotransferase class-V
  Pfam annotation: Domain name=GntR; Domain location=14-77; Score=64.8; E_value=2.8e-16; Accession=PF00392.11; Description=Bacterial regulatory proteins, gntR f
  Pfam module annotation: Pfam domain module=Aminotran_1_2::Aminotran _5::GntR; Domain location=116-470::146-470::14-77
MAGETQEQESQSSRYRQIAEQIKQAIHSGSLPPDSRLPSVRTLATQYRVSMTTALKTLRTLEDEHYAVARPKSGFFVAPRPTEKKVPAVFSEQPREVAPLDEQTELHLAMLGSDCRVRLDLANGDISLYPVKKIGLLMRQMGYSKPALLGNTVKGTGYAPLKAEIARRAVDYGCNISADDILVTNGCIEAISLALRATTRPGDIVAVESPCYFVLLQMLHNLNLRVIEVEAGPEGYVNVAKLTGLFRRKAVQAYLTINNINNPLGKSIPNEHKAYIARQADENDVVIIEDDIFGDTAFGERRPFPMRAFSPNAILCSGFSKTVAPGIRIGWVHSTKYMRKIASLKYTTSMGTSVLSQAAIAELLRSGGYDAHLRKLRRELKNQIHHMRQAVLRYFPAGTRVSEPEGGYVLWVEMPQQALNVRALFLKARNAGIGIAPGHIFATDHRYDHCFRLNAGFGWNAEVEQAIQQLAQWCQLSLSAD

SEQ ID NO: 117529 - protein, 358 aa, Glycine max
  Coding DNA Sequence Number=SeqID_751
  Homolog annotation: Hit_ID=Q4ZSC7; Match level="QueryCoverage=98%, HitCoverage=71%, E-value=8e-55, Identity=36%"; Hit description =Conserved domain protein
MPQSVRQQNRDDVLMNGHRFRADARSTFCNACNLSMVNSFGLAAHYDGGVDVIITGDSPQEQTAYLAWARHLSKLFDAPMADKSRGFSGFLHTLDGVAARYFADIYGADQVTPAHRITWQLARDPLFFNIYQDTAYEAGAHWALLTEFMHFRFDELMFSFSESDCGNPTLMAHIRGLRAETLLQRSYAEGIREYVRFALGLMVQKDFPPQLIDEMAARYQDDAAIARARQRAAQFALDAFGLSETQLVCMIYSPFIAAGQQLKAWLLQLPAAPEEAAVRALLSGESEDVALAQQLTQLSGLSVAQMRHCWRSAAVSSLLDGARGDALSRVLRFDPHKAVIQVNNGALQDIVTEVISGR

SEQ ID NO: 117530 - protein, 69 aa, Glycine max
  Coding DNA Sequence Number=SeqID_752
MPLSRQLQRRDCPRRHVPPGEMAVHVLPLTCPAVATGGIHYPAIGTGGSSFPPVSMAKQIPRVGGLGAS

SEQ ID NO: 117531 - protein, 73 aa, Glycine max
  Coding DNA Sequence Number=SeqID_753
MVVSFFLTHLLLKVASPIISFFLLHFAVIHLQEAKDSIDEEDPRLTSSNGATSCGIRASSSRFYHFSVIIFLY

SEQ ID NO: 117532 - protein, 94 aa, Glycine max
  Coding DNA Sequence Number=SeqID_754
MKGEEKAQQWEEYLQQDMQQESMLQINTLPHQLIVKKQRQGEQKRALSVFLFRITNPSPIMSWHTLPKYVKFMEFLAKRWNCKDDVFFVTFMPP

SEQ ID NO: 117533 - protein, 310 aa, Glycine max
  Coding DNA Sequence Number=SeqID_755
  Gene Ontology: Mol. function=hydrolase activity, hydrolyzing O -glycosyl compounds; Cellular component=cell wall; Biological process= carbohydrate metabolic process
  Homolog annotation: Hit_ID=Q9AT33; Match level="QueryCoverage=83%, HitCoverage=86%, E-value=1e-119, Identity=71%"; Hit description =Endoxyloglucan transferase
  Pfam annotation: Domain name=Glyco_hydro_16; Domain location=33-218; Score=314.1; E_value=2.5e-91; Accession=PF00722.11; Description =Glycosyl hydrolases family 16
  Pfam annotation: Domain name=XET_C; Domain location=226-266; Score =45.1; E_value=2.3e-10; Accession=PF06955.3; Description=Xyloglucan endo-transglycosylase (XET)
  Pfam module annotation: Pfam domain module=Glyco_hydro_16::XET_C; Domain location=33-218::226-266
MEGSHMGLLLFFSSMLFAAFPSASSRNLPVIPFDEGYAPLFGDSNLVIHRDGKSVHLSLDERTGSGFVSHDLYLHGYFSASIKLPSDYTAGVVVAFYMSNGDMFQNNHDEIDFEFLGNIRGKDWRIQTNVYGNGSTNIGREERYGLWFDPADDFHQYTIVWTDSQIIFYVDNVPIREVTRTESMGGDFPSKPMTLYATIWDASDWATNGGKYRVNYKYAPYVAEFSDLVPARLCTQRIKMENFRKKHMTYSYCYDKVRYKVPPSECVINSQEAERLRRFDPVTFGGGRRHHGKRHRRSRGSQTETSASSF

SEQ ID NO: 117534 - protein, 184 aa, Glycine max
  Coding DNA Sequence Number=SeqID_756
  Subcellular localization annotation: CTP_CleavageSite=43; ConfidenceScore=5.03e-01
PEMDGAKARDLYRPSGQGPSPMSRRARRSLQNQGASPGGAVVGADLGGSSKYSNENFERPKRGKGIGLKFLNRDVAADGNVRESGDVGGGPGKSYLFCLTACPPWKRLSRRTECLPRPVVLITASGLQGEQPLVDGTIPEPVGCRWTARAASAARAGRRVPVGGRIGNGPSGPLPRASNSQLRT

SEQ ID NO: 117535 - protein, 99 aa, Glycine max
  Coding DNA Sequence Number=SeqID_757
MGIFTHWIPRCMILWKSRGSSILAVHLQTKIFSLKIVHAEVSVLEDKAKQRVLRACLAEGVQPTRISATSSGHSRGSRHLYSYYYICGFIYSHPFKTNL

SEQ ID NO: 117536 - protein, 50 aa, Glycine max
  Coding DNA Sequence Number=SeqID_758
MVGGGNSKSDISFAGTYASSAFAACFAETRYLLLRIVTGPTTVFTAMDFV

SEQ ID NO: 117537 - protein, 33 aa, Glycine max
  Coding DNA Sequence Number=SeqID_759
MIMMFEVDKTWRLAIREILQHSGSRKEALLRNP

SEQ ID NO: 117538 - protein, 111 aa, Glycine max
  Coding DNA Sequence Number=SeqID_760
  Gene Ontology: Mol. function=nucleic acid binding; Biological process= DNA integration
MSIMGELNFFLGLQVKQIEHGTFLYQTKYCAELIKKFSMEECKETSTPMSTSTYLDLDEKGCKLDRKSTSETCHLLASSLVSWNCKKEACVALSTVEAEYIATGSCCAQSL

SEQ ID NO: 117539 - protein, 211 aa, Glycine max
  Coding DNA Sequence Number=SeqID_761
  Gene Ontology: Mol. function=cobyrinic acid a,c-diamide synthase activity; Cellular component=membrane; Biological process=cobalamin biosynthetic process
  Homolog annotation: Hit_ID=Q4BW58; Match level="QueryCoverage=98%, HitCoverage=92%, E-value=3e-40, Identity=42%"; Hit description =Cobyrinic acid a,c-diamide synthase
  Pfam annotation: Domain name=CbiA; Domain location=3-178; Score=35.7; E_value=8e-08; Accession=PF01656.13; Description=Cobyrinic acid a,c -diamide synthase
  Pfam annotation: Domain name=MipZ; Domain location=41-211; Score= -130.3; E_value=0.059; Accession=PF09140.1; Description=ATPase MipZ
  Pfam annotation: Domain name=SRP54; Domain location=2-163; Score= -128.3; E_value=0.067; Accession=PF00448.13; Description=SRP54-type protein, GTPase domain
  Pfam module annotation: Pfam domain module=CbiA::MipZ::SRP54; Domain location=3-178::41-211::2-163
MIVLIGSQKGGVGKSTKAVNIAGYLILKQGKTAIIVDADDQKSIMTWYNDRQNVEGLPHIPVVAASGKIKETLLELDRHYDYVIVDTAGRDSAELRSGLLAADLFLSPLRPSQMDLDTIGYLSEMFSTAQEYNEKVKGYIVLNMCPTNIFINEANEAAQVLSEYPEFTLVSNRLCDRKIYRDAWGEAITVHEANNEKAQSEIECLVKEVIL

SEQ ID NO: 117540 - protein, 96 aa, Glycine max
  Coding DNA Sequence Number=SeqID_762
MGKLTGCHELHDDGGLIIEYVICIKPGIENLEDEMLWLKVKVWRKDGEMKFAGEHRLFGNGANSVVASKAPKLVGISAVVKGLYDWTLVVEVDDYH

SEQ ID NO: 117541 - protein, 230 aa, Glycine max
  Coding DNA Sequence Number=SeqID_763
  Gene Ontology: Mol. function=nucleic acid binding; Biological process= transport
  Homolog annotation: Hit_ID=Q8H6Q8; Match level="QueryCoverage=90%, HitCoverage=44%, E-value=3e-34, Identity=44%"; Hit description=CTV.20
MVAMTYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLAYFRWYRDTFLTRVYTREDSQQPFWKEKFLAGLPRSLGDKVRDKIRSQSANGDIPYESLSYGQLISYVQKVVLKICQDDKIQRQLAKEKAQTKKDLGSFCEQFGLPACPKQKKKQSSRKEIHENKP

SEQ ID NO: 117542 - protein, 109 aa, Glycine max
  Coding DNA Sequence Number=SeqID_764
MLADVGQEKMTDRGLKKKHDRMTPIEHFQIDIVQVLFRGGIEKTVASIGSETAPTDVFQPTLRNFFTSAGRQRFFTVRLGFFVRAQPKLYFGRSRHFVGQENFSPPRPM

SEQ ID NO: 117543 - protein, 103 aa, Glycine max
  Coding DNA Sequence Number=SeqID_765
  Gene Ontology: Mol. function=hydrolase activity, hydrolyzing O -glycosyl compounds; Cellular component=peroxisome; Biological process=carbohydrate metabolic process
  Homolog annotation: Hit_ID=Q1RYZ6; Match level="QueryCoverage=77%, HitCoverage=16%, E-value=2e-21, Identity=60%"; Hit description =Glycoside hydrolase, family 1
MSIKHQVWVPNHPLPKIFERSSKVTCELETNTVSPIIDISLSRKSFPKEFIFGVGSSSYQFEGAAKEGGREASVWDTFTHNYPGKVMERSNGDMAIDICKKIK

SEQ ID NO: 117544 - protein, 92 aa, Glycine max
  Coding DNA Sequence Number=SeqID_766
  Subcellular localization annotation: CTP_CleavageSite=65; ConfidenceScore=5.05e-01
MRYSQFKFHEPYSKFVTTYFSLFHQLSASTQKLEELALKQSRLLIPVTPSTPRSLMMSFFSLLCKGKYVTPDTTGFYNYREVMKLIVVVYMT

SEQ ID NO: 117545 - protein, 52 aa, Glycine max
  Coding DNA Sequence Number=SeqID_767
MEKKESYEDNTNGGFNPFSVSPTFGNSIGAVEGKNWRNLKEPLEMLLSLAED

SEQ ID NO: 117546 - protein, 44 aa, Glycine max
  Coding DNA Sequence Number=SeqID_768
MVALLEAHQTLLSPEKNGSGRRRRRQRHGGEPGSDAKLKLEIFK

SEQ ID NO: 117547 - protein, 177 aa, Glycine max
  Coding DNA Sequence Number=SeqID_769
  Gene Ontology: Mol. function=DNA binding; Biological process=DNA integration
  Homolog annotation: Hit_ID=Q1S785; Match level="QueryCoverage=93%, HitCoverage=35%, E-value=8e-20, Identity=47%"; Hit description =Integrase, catalytic region
MFNSRTLVVEESNRVKLNDGQTTSSKLSDLEDDSLDMHIGLSVALKIRDSSSQKLQMEDLKFIKCHPQDQIIGDQIDKRKNSTRNDVWTLVPKPKNKIIIRTRWVFRSKVDEQGKVVRNKARLVAYGYNQQEGDIIFGATNESLCKDFSYMMKCEFEMSMVGELKFQRSSRWKVPNQ

SEQ ID NO: 117548 - protein, 127 aa, Glycine max
  Coding DNA Sequence Number=SeqID_770
MVCPWTREFHVVSDRSFSFVMFYPYSRFTFTHHVKPIIQEVDFDVDTTIDPDALAIEVYDPPPLREYVHLVEVELLNKREALSQALEDRAYVEKEARKCDEFLRKLDEEVANKKRREKVKAKANNII

SEQ ID NO: 117549 - protein, 298 aa, Glycine max
  Coding DNA Sequence Number=SeqID_771
MMRAEMDELDRVQFVVELTIEILSIDDAKRQEKMEAIIVLEDMDLAEKGDLEEAMLQSVIEASLAKIKDDIVETDTGTVLVRPRLVFDANEQLIDVVQSNKIDGNIHRHLEEIYRAPKSVSIEVMIEHLEQRKIMPSIQKEPDVTIHPSLNIRLYNGLRGYIVLKWQTCNKVWKEKDDIGSHILHPEMQQLELDKLNLTKLWKEGFLQLSFIGNSGEANKQSFFGMPFSTPLDLQQLLGLMWMMNMVFPRDRTSSCETFQTKDITLEEPEANPSFQDWEKSNYDLKLRMKLSAYREEI

SEQ ID NO: 117550 - protein, 184 aa, Glycine max
  Coding DNA Sequence Number=SeqID_772
MLTSNMIKQLKTLIPSNSQNFVSLKGTKWRPLNEIELKYERDTKKQRNSPIEAQETDHSPSRGIEHQVDLLLGASLPNKPTYKSNPQKTQRKDAHAKVEFVKRLYDQVKVQIAKKNESNAKQANKKRKEVVLEPGDDPGHLRTNVFQEGGNDENHETGQIQAKGPSGEGQRPKWRRTKPPSGEG

SEQ ID NO: 117551 - protein, 466 aa, Glycine max
  Coding DNA Sequence Number=SeqID_773
  Gene Ontology: Mol. function=oxidoreductase activity; Cellular component=cellulose and pectin-containing cell wall; Biological process=lignin catabolic process
  Homolog annotation: Hit_ID=Q7XIF0; Match level="QueryCoverage=99%, HitCoverage=78%, E-value=1e-158, Identity=59%"; Hit description =Putative pollen-specific protein NTP303
  Pfam annotation: Domain name=Cu-oxidase; Domain location=78-255; Score=162.2; E_value=1.3e-45; Accession=PF00394.12; Description =Multicopper oxidase
  Pfam annotation: Domain name=Cu-oxidase_2; Domain location=335-458; Score=140.8; E_value=3.7e-39; Accession=PF07731.4; Description =Multicopper oxidase
  Pfam annotation: Domain name=Cu-oxidase_3; Domain location=2-68; Score=35.2; E_value=7.9e-09; Accession=PF07732.5; Description =Multicopper oxidase
  Pfam module annotation: Pfam domain module=Cu-oxidase::Cu-oxidase _2::Cu-oxidase_3; Domain location=78-255::335-458::2-68
MERNGIKQRKNSWQDGVLGTNCPIRPNSNYTYKFQAKDQIGTYTYFPSTSLHKAAGGFGGLHVYHRSVIPVPYPYPDGDFTLLIGDWYKTNHKVLRESLDSGKSLAFPDGLLINGQAHTTINGDQGQSFKNDIYNPTSFCNFQVINFNFIKFVSPNTIHALAFSLSGKTYMFRISNVGLSTSINFRIQGHTLKLVEIEGSHIVQNTYDTLDVHVGQSAAMLVTLNQPPKDYYIVASTRFSRKVRVATAVLHYSNSKSPASGPLPSSPIYQYHWSVKQARTYRWNLTANAARPNPQGSYHYGKITPTKTIVLSNSAPLINGKLCYAVNKVSYVNPDTPLKLADYFNIPGIYSVDSIQSIPSDNTPTSIATSVVPTSLHDFIEVIFQNNENTMQSWHLDGYDFWVVGYGFGQWTPAKRRTYNLVDALTRHTAQVYPNGWTTILVSLDNQGIWNLRSAIWERQYLGQQI

SEQ ID NO: 117552 - protein, 127 aa, Glycine max
  Coding DNA Sequence Number=SeqID_774
MENWRTALGNRFAGLQTRWWRMHERQSIHGAPNKSGEWRIALGNHFAWLQTHWWRMHKRQSIHGAPNKSGEWRIALGNHFAWLQTHWWRMHERQSIHGAPNKICWQNRLVHRVFSTYKGKHAFCKEK

SEQ ID NO: 117553 - protein, 98 aa, Glycine max
  Coding DNA Sequence Number=SeqID_775
MVWCLLSLPFSIPLPFIFQEAKESIDEEDPMPTSSNGMDCEVKKRLSHEVLKVTVELSSSIGLSEHPSLSVTSACLARQKNLAKHQYQGCALSARSVR

SEQ ID NO: 117554 - protein, 158 aa, Glycine max
  Coding DNA Sequence Number=SeqID_776
  Gene Ontology: Mol. function=sequence-specific DNA binding; Cellular component=nucleus; Biological process=regulation of transcription, DNA-dependent
  Homolog annotation: Hit_ID=Q1S0M9; Match level="QueryCoverage=81%, HitCoverage=83%, E-value=5e-17, Identity=37%"; Hit description=ELK; Homeodomain-related
  Pfam annotation: Domain name=ELK; Domain location=34-55; Score=34.3; E_value=4.4e-07; Accession=PF03789.4; Description=ELK domain
MDETAGTSEDELSWEKVEAVEGHQSFGPRPGDQELKEMLLHKYGDYLSSLRKEFLKKRKKGKLPKDARMILMDWWNTHYRCLYPTQKASIHMNVIMEGKLASELEIAVRRPSKNSDQGMSEFVNELSEILCVWTIKACYILHANELARRLKLVIDSYN

SEQ ID NO: 117555 - protein, 246 aa, Glycine max
  Coding DNA Sequence Number=SeqID_777
MAPKKLSTKRSRRDATGEGSSAALEFASHRFRSAEHQQRCEAIRGWSFHKERRVQLREDEYTDFQEEIAHALSQFLGDPLILENGQQCEFSQRRSQADGFDEEAIAQLLCIPGQDFARTAAGRRVWIMRTSMTTLTQIWMTLLLSNVLPSDHNSNLPLPKCQLVYVILTRMSVHVAQVIVDAIYLFAGMEPTRHPLDPEKSYKALGFPALITGLCQSYEVPVTPSKVIQPSITRAFIEKYCTPRQA

SEQ ID NO: 117556 - protein, 122 aa, Glycine max
  Coding DNA Sequence Number=SeqID_778
MEEKGHTQKLKKKGQHTGGERRSSGTWGAEVCNPSLHLQKTLKPYSIKTLQPYSSWSEGVSPMGEARPSSRGVSRQWQQRHPLHVSCLAIGDGGTAISPLLPTAPLQKQTPFANSLKMDHVW

SEQ ID NO: 117557 - protein, 121 aa, Glycine max
  Coding DNA Sequence Number=SeqID_779
MRGKFLVDKLLFDPEITKTERKNRKEKKQVTTKPQSESSIDSPSPKKPLQQGKSRVQASNEKAFLGRRKKQQAPLELVGLGSSSSMDSFASWKMNGSGMEKEEREEMPLQGEDESRRSSTP

SEQ ID NO: 117558 - protein, 161 aa, Glycine max
  Coding DNA Sequence Number=SeqID_780
  Pfam annotation: Domain name=zf-CCHC; Domain location=26-43; Score =17.2; E_value=0.0014; Accession=PF00098.13; Description=Zinc knuckle
MKKKGRDKRNFQKKSTKKIDSTPTTHRCFEYGKLGHIKEDCPTYLKKQQRGDKKQKKPFKQRRRCIACDDNDASSLSDSSEEEEEANLCLIADIDEDETKSNVSVSSSKSNTNYDNLLDALEELHEEAQRLTFVNKTVKGQLRWHIEKFVGIIGNLKGRVE

SEQ ID NO: 117559 - protein, 80 aa, Glycine max
  Coding DNA Sequence Number=SeqID_781
MENDKLSLSFMAAEVDLHFVVILDVDVKVDHVQLVRRLLKLRQVHELLSNGGFHGLFNEYSQRSTWSFSSCLWSVTLHFS

SEQ ID NO: 117560 - protein, 767 aa, Glycine max
  Coding DNA Sequence Number=SeqID_782
  Gene Ontology: Mol. function=protein binding; Cellular component =intracellular; Biological process=defense response
  Homolog annotation: Hit_ID=Q1S351; Match level="QueryCoverage=87%, HitCoverage=87%, E-value=0.0, Identity=68%"; Hit description=Disease resistance protein; AAA ATPase
  Pfam annotation: Domain name=LRR_1; Domain location=525-547; Score =6.9; E_value=15; Accession=PF00560.23; Description=Leucine Rich Repeat
  Pfam annotation: Domain name=LRR_1; Domain location=549-571; Score =14.1; E_value=0.52; Accession=PF00560.23; Description=Leucine Rich Repeat
  Pfam annotation: Domain name=LRR_1; Domain location=573-595; Score =13.5; E_value=0.78; Accession=PF00560.23; Description=Leucine Rich Repeat
  Pfam annotation: Domain name=LRR_1; Domain location=597-619; Score =16.1; E_value=0.13; Accession=PF00560.23; Description=Leucine Rich Repeat
  Pfam annotation: Domain name=LRR_1; Domain location=621-642; Score =6.5; E_value=17; Accession=PF00560.23; Description=Leucine Rich Repeat
  Pfam annotation: Domain name=NB-ARC; Domain location=3-300; Score =74.9; E_value=2.5e-19; Accession=PF00931.13; Description=NB-ARC domain
  Pfam module annotation: Pfam domain module=LRR_1::LRR_1::LRR_1::LRR _1::LRR_1::NB-ARC; Domain location=525-547::549-571::573-595::597 -619::621-642::3-300
MEDTAQQIKRPFGVPEGPEFTVGLDVPLSELKVELLKEGVSIIMLTGLGGSGKTTLATKLCWDEQVIGKFKENILFVTFSKKPKLKIIVERLFEHCGYQVPEFQSDEDAVNQLGLLLRKIDASPMLLVLDDVWPGSEALVEKFKVQISDYKILVTSRIAFHRFGTPFILKPLVHNDAITLFRHHALLEKNSSNIPDEDLVQKVVRHCKGLPLAIKVIGRSLSNRSYEMWQKMVEEFSHGHTILDSNIELITSLQKILDVLEDNHIIKECFMDLALFPEGQRIPVAALVDMWVELYGLDNDGIATAIVKKLASMNLANVLVTRKNTSDTDSYYYNNHFIILHDILRDFAIYQSNQEQVEQRKRLMIDITENKPKWWPREKQQGLMIRVLSNIFGWRVEQKPQQIPARALSISTDETCTSYWSHLQPVQAEVLILNFQTNQYTFPKFLKEMSKLKVLTVIHHGFHPSKMNNFELLGSLSNLKRIRLERILVPPFVTLKNLKKLSLFLCNTRQAFENGNMLISDAFPNLEDLNIDYCKDLIELPKGVCDITSLKMLSITNCHKLSALPQQFGNLENLKLLRLSSCTDLQEIPNSIGRLSNLRHMDISNCINLPNLPEDFGNLCNLRNLYMTSCPRCELPPLIINLENLKEVVCDEETAASWEAFKPMLPNLKIDVPQLDWLSGLISNLRFPQEKAIIFCDNLSAICLAKDQVHHERTKHIDIRYHFIHFEKRVKVQKVDTRENPTDMFTKPVLRNKFMHYLDLLTVDCWK

SEQ ID NO: 117561 - protein, 117 aa, Glycine max
  Coding DNA Sequence Number=SeqID_783
MKWIFARLKSKRFPSIKYPLPSKGTTLSEAEQEQSKHALTVVIASAAVAEAAVTAAHRLTGQRKKNSKEYQHVKTRNDAPQSTYQCQREIKESTAAIQDEQFSALSLETMKGISPYN

SEQ ID NO: 117562 - protein, 103 aa, Glycine max
  Coding DNA Sequence Number=SeqID_784
MGSATNVSHVVYSSTTSKRTTCLQGEIAETLHFMVSPVGRRVCTFDDLLPCIEKITLLSDEEDRILEAHEDARPSQPQFEHQQFNILQRSAETRGLAVTSENC

SEQ ID NO: 117563 - protein, 67 aa, Glycine max
  Coding DNA Sequence Number=SeqID_785
MAHVHHYAHKMMKVWRRKNEERMRNMVEGVSLEGGEWGYKERKIDPLGRILKIDVLNDVRAKNIVES

SEQ ID NO: 117564 - protein, 808 aa, Glycine max
  Coding DNA Sequence Number=SeqID_786
  Gene Ontology: Mol. function=protein binding; Cellular component =intracellular; Biological process=defense response
  Homolog annotation: Hit_ID=Q1S334; Match level="QueryCoverage=99%, HitCoverage=99%, E-value=0.0, Identity=59%"; Hit description=Disease resistance protein; AAA ATPase
  Pfam annotation: Domain name=LRR_1; Domain location=646-668; Score =2.6; E_value=93; Accession=PF00560.23; Description=Leucine Rich Repeat
  Pfam annotation: Domain name=LRR_1; Domain location=670-692; Score =12.9; E_value=1.1; Accession=PF00560.23; Description=Leucine Rich Repeat
  Pfam annotation: Domain name=LRR_1; Domain location=694-716; Score =12.8; E_value=1.2; Accession=PF00560.23; Description=Leucine Rich Repeat
  Pfam annotation: Domain name=LRR_1; Domain location=718-740; Score =16.1; E_value=0.12; Accession=PF00560.23; Description=Leucine Rich Repeat
  Pfam annotation: Domain name=LRR_1; Domain location=742-763; Score =5.8; E_value=23; Accession=PF00560.23; Description=Leucine Rich Repeat
  Pfam annotation: Domain name=NACHT; Domain location=176-323; Score= -27.4; E_value=0.0079; Accession=PF05729.3; Description=NACHT domain
  Pfam annotation: Domain name=NB-ARC; Domain location=139-433; Score =67.0; E_value=6e-17; Accession=PF00931.13; Description=NB-ARC domain
  Pfam module annotation: Pfam domain module=LRR_1::LRR_1::LRR_1::LRR _1::LRR_1::NACHT::NB-ARC; Domain location=646-668::670-692::694 -716::718-740::742-763::176-323::139-433
MEETTERVALQERLRMMSSEIVEKGQSSESNKQILRSTLKDNAPVVLEIKQYNEHLNPPREEINTLIGEKDAKEKFVCKCFSKCLSLFLCRFGQKRGHSFAGGEKQALVAKDIEENLYKMREILELLSKGSFEKNLGGVGGPMKCPFGVPQKPEFTVGLDEPLSKLKVEVLRDGVSVVLLTGLGGTGKTTLATKLCWDEQVKGKFSENIIFVTFSKTPQLKIIVERLFEHCGCQVPDFQSDEDAVNQLGLLLRQIGRSSVLLVLDDVWPGSEALVEKFKVQIPEYKILVTSRVAFSSFGTQCILKPLVHEDAVTLFRHYALLEEHGSSIPDEELVQKVVRICKGLPLAVKVIGRSLSHQPSELWLKMVEELSQHSILDSNTELLTCLQKILNVLEDDPVIKECFMDLGLFPEDQRIPVTSLIDMWAESHSLDDDGPEAMAIINKLDFMNLANVLVARKNASDTDNYYYNNHFIVLHDLLRELAIYQSTQEPTEEGKRLIIEINQNKPRWWLGEKSTLLKHQQATAQTLSILTDENCTSDWPQMQLAEVEVLIFNIRTKQYFFPDFIEEMNKLKVLIVTNYSFYPSVMNNFELIGSLSNNLKRIRLERISVPSFVAMKNLKKLSLYLCNMKRAFENNDMLISYAFPSLEELNIDYSKDMVGLPKELCDIISLKKLSITNCHKLSALPQEIGKLENLELLRLSSCTDLEGLPDSIGRLSKLRLLDISNCISLPNLPEDFGNLSNLQNLYMTSCARCEVPPSIANLENLKEVVCDEETAASWEDFKPLLPNLKIDVPQVDVNLNWLHTISS

SEQ ID NO: 117565 - protein, 161 aa, Glycine max
  Coding DNA Sequence Number=SeqID_787
MAPRTCSASGKYTGSHKTLESDQFPLLNDPNKACIYVIKLSIPGSLLNNKEKNKMKDCKNTSGEDVSFTSRILQSLRNSSQALKLAPASSSGGLVHAHALSARMDRLAHISDFWLSVPFSRMLAKPADWLSEKASSQRAWAKDLSLALSKQLAWASGSLQE

SEQ ID NO: 117566 - protein, 140 aa, Glycine max
  Coding DNA Sequence Number=SeqID_788
MTNVAARKEEERTEIETHQESICQVTSIHHQLTNEEETPEVSSTPEYPYMATASYVGGKDKGRLELSIDDQNISFDLFEAMKHPDMGDACFEEEEVEQEITLSAATMILQSPLEKEPGYGRDCLACDEELDDSKDSCVDQ

SEQ ID NO: 117567 - protein, 184 aa, Glycine max
  Coding DNA Sequence Number=SeqID_789
  Homolog annotation: Hit_ID=Q1S8T0; Match level="QueryCoverage=42%, HitCoverage=12%, E-value=4e-13, Identity=47%"; Hit description =Protein kinase
MTTLLSPPQIQTIVATSFINLNPHKDLVATMIPNPLPRPCHPYQSKPMTIVVRDLSCGQRNSLDLRWLEANSSKCKAKGKKCKWKNNKGSILLGFVVIAIFKIIYHFRQKEEDQARVKKFLEEYRAEKPARFTNADVKRITGGFKEKLGEGAHGVVLRGKFSIEILVAVKILNNTEGRRERVHQ

SEQ ID NO: 117568 - protein, 103 aa, Glycine max
  Coding DNA Sequence Number=SeqID_790
MDFSFKNIISKYNEDLDVDTKSIVVVVADLAMSAPVASQMWRGFQVVVRLEGLVALLLVVVLIIATTLNGRPSRLYQSHEVNTAVVTHEEGMLVIEKLRILCE

SEQ ID NO: 117569 - protein, 203 aa, Glycine max
  Coding DNA Sequence Number=SeqID_791
  Subcellular localization annotation: CTP_CleavageSite=38; ConfidenceScore=5.25e-01
MVLILIWPIRNIQAHLVSRHGLTTASLQLVSSTLSRLCLMARPKRRATKFIPNRTTLHHPPVVAPISVVDHCLPYKKHNLYDVTFNNTVLRDHHHCVFTLFWAMVVMRKWFNMGSYESDFRADRSPRVLLRDYLYGRTRTKNQTKKKKLPFCAYAHTSSIAKAGTEEAIRKSKISESQFEKGLTYMIFDIIKGASYVMGIWVQ

SEQ ID NO: 117570 - protein, 226 aa, Glycine max
  Coding DNA Sequence Number=SeqID_792
  Gene Ontology: Mol. function=nucleic acid binding; Biological process= DNA integration
MHAALIDIIDKLAIEAPDLNDSEVTNTYQKYMEQTLSAKCIILASSYLELQRQHEDMDPHEIINHLKKMYGGQSRTARYQLSKALFKCTMPANAQVRPHVLKMIDLIEQLEKSKCKIGKELSQDLILQFPLDTFSQFTVNFNMNKMDCNLHEMLNLLIDYENQIASQERKRTVMVVGKNSKKKGKGKYAQKRKPFGPKGGVTKPMHNKVKIDQSDAECFFCKEKGD

SEQ ID NO: 117571 - protein, 170 aa, Glycine max
  Coding DNA Sequence Number=SeqID_793
  Gene Ontology: Mol. function=DNA binding; Cellular component =mitochondrion; Biological process=DNA integration
MEYYFYHPFDHKLFMVRGIIFLEWEFLVGGSHVTTKFITSSNCGSRAIYSSRLVLDDTSDEVYHDDDDPRSYEEAIRSLDSKKWQEAMESEIKSMKINKVWTLVEASKDIKPIGCKWVYKKKVGANGKVETYKARPVAKGYRQKKGTGYDETFSPMAMLKSIQILLVIAI

SEQ ID NO: 117572 - protein, 61 aa, Glycine max
  Coding DNA Sequence Number=SeqID_794
MKASAKTAPSPLQSTSSLSLKEMLHIKKPWINLSRGLILCLQAIRNNNHYSKQMNKVILKF

SEQ ID NO: 117573 - protein, 86 aa, Glycine max
  Coding DNA Sequence Number=SeqID_795
  Gene Ontology: Mol. function=nucleic acid binding; Biological process= DNA integration
MTGDASKFTHISPKKSGHVTYGDNNKGRIIGVGKIGTNSSTSIENVLLVEGLKHSLLSFSQLCDKGYLIMIHGYGIKELLTLTWNT

SEQ ID NO: 117574 - protein, 113 aa, Glycine max
  Coding DNA Sequence Number=SeqID_796
MEREMITMIVDTLPMFYYEKLVGYMPSSFVDLVFTSERIEVGITRGKFDYVAPASTSNRRSRSTGAKRKEGDAHAMTTTPTWPKPQSTPHNTHQYAEHHSSFSARAGNPPTQH

SEQ ID NO: 117575 - protein, 222 aa, Glycine max
  Coding DNA Sequence Number=SeqID_797
  Homolog annotation: Hit_ID=Q7WJU7; Match level="QueryCoverage=49%, HitCoverage=32%, E-value=4e-22, Identity=54%"; Hit description =Putative AraC-family transcriptional regulator
  Pfam annotation: Domain name=DUF1428; Domain location=158-222; Score =14.7; E_value=7.3e-08; Accession=PF07237.2; Description=Protein of unknown function (DUF1428)
  Subcellular localization annotation: CTP_CleavageSite=75; ConfidenceScore=5.86e-01
MRSRFDSTASDTAPSNGGAMQMSISRASSSTRSACTVMRPSSRLTWRVAASVRTVKRAGRPCAARYSLATRKPCRAVSSEAILAPLGSRNAMFFMPPSIRLRPVAIHPQECRKRLSESAADPDTVTSAGIAADMARADWRVPRRGPQQHQIKEHQMEQYIDGYLLSVPKANLEAYRKMADLAGSIWLENGALEYRECVADDIDGEGFGSFSAAASAREGETV

SEQ ID NO: 117576 - protein, 271 aa, Glycine max
  Coding DNA Sequence Number=SeqID_798
  Gene Ontology: Mol. function=glycerate kinase activity; Biological process=organic acid phosphorylation
  Homolog annotation: Hit_ID=Q8ZME0; Match level="QueryCoverage=100%, HitCoverage=71%, E-value=3e-99, Identity=70%"; Hit description =Putative glycerate kinase 2
  Pfam annotation: Domain name=Gly_kinase; Domain location=1-271; Score= 463.9; E_value=2e-136; Accession=PF02595.6; Description=Glycerate kinase family
MKIVIAPDSYKESLSALEVATAIEAGFREIFPAADYVKIPVADGGEGTVEAMVAATQGNIVRLTVTGPLGEPVDAFYGLSGDARTAFIEMAAASGLELVPAAQRDPLITTSYGTGELIKNALDRGVDHIIIGIGGSATNDGGAGMVQALGARLLDSDGSGIGYGGGALPQLAKIEIADLDPRLLQCRIEVACDVTNPLIGEEGASAIFGPQKGATPQLVQQLDAALGHYAAIIQRDLDIDVLHIAGGGAAGGMGAALHAFCHAELRRGIEI

SEQ ID NO: 117577 - protein, 162 aa, Glycine max
  Coding DNA Sequence Number=SeqID_799
  Gene Ontology: Mol. function=DNA-dependent ATPase activity; Cellular component=nucleus; Biological process=DNA replication initiation
  Homolog annotation: Hit_ID=Q8H0G9; Match level="QueryCoverage=54%, HitCoverage=10%, E-value=2e-30, Identity=70%"; Hit description=MCM protein-like protein
MVSVSIVFFHRLSHCCRLMQLQVKYDYNKCRPILGPFSQNSYLGVKVGYCPACQSKGPFSINIDQTTYRNFHKLTLQEGPRIVPAGRVPRNKEVILVNDRIDYARIGKKLYHGEHKTVYASGKGASVMGPTDAVHKDLVITVDKHQGDLHNTLIQNLKDSGL

SEQ ID NO: 117578 - protein, 728 aa, Glycine max
  Coding DNA Sequence Number=SeqID_800
  Gene Ontology: Mol. function=1-deoxy-D-xylulose-5-phosphate synthase activity; Cellular component=nucleus; Biological process=terpenoid biosynthetic process
  Homolog annotation: Hit_ID=Q5MJZ4; Match level="QueryCoverage=98%, HitCoverage=98%, E-value=0.0, Identity=70%"; Hit description=1-deoxy- D-xylulose-5-phosphate synthase
  Pfam annotation: Domain name=TPP_enzyme_C; Domain location=172-299; Score=-47.1; E_value=0.041; Accession=PF02775.11; Description =Thiamine pyrophosphate enzyme, C-term
  Pfam annotation: Domain name=Transket_pyr; Domain location=402-568; Score=217.9; E_value=2.2e-62; Accession=PF02779.14; Description =Transketolase, pyrimidine binding dom
  Pfam annotation: Domain name=Transketolase_C; Domain location=583 -706; Score=169.2; E_value=1e-47; Accession=PF02780.10; Description =Transketolase, C-terminal domain
  Pfam annotation: Domain name=Transketolase_N; Domain location=98-375; Score=-205.0; E_value=0.022; Accession=PF00456.11; Description =Transketolase, thiamine diphosphate b
  Pfam module annotation: Pfam domain module=TPP_enzyme_C::Transket _pyr::Transketolase_C::Transketolase_N; Domain location=172-299::402 -568::583-706::98-375
  Subcellular localization annotation: CTP_CleavageSite=40; ConfidenceScore=5.17e-01
MASFVLGTTFLPLFYSHDKYSCSPSISNITTNPQRMNQVIAAGGDNFCEEMNSTIMKKSYEPNQQLRRSLNFSGEKPSTPVLDTINYPIHMKNLSIQELEELADELREEIVYTLSKTGGHLSSSLGVAELTVALHHVFNTPQDKIVWDVGHRTYAHKILTGRRSKMHTIRQTGGLAGFPKRDESLHDAFGVGHSSTSISASLGMAVARDLIGKDNHVISVIGDGAMTGGQAYEAMNNAGFLDTNLIIILNDNEQVSLPTATIDGPAPPVGALSRALARLNTSSKFHQLRDLAKGITKQIGSRAYEFTSKLDSYLRGMVGGAGACLFEELGLFYIGPVDGHDIEDLVHILKSVKGMPTLGPVLIHVITEKGKGYHPAEVAPDKMHGVVKFDPKSGKQLKSKASTRSYTQYFAESLTAEAEVDEKIVAIHAAMGGGTGLNLFQKRFPERCFDVGIAEQHAVTFAAGLAAEGLKPFCAIYSSFLQRGYDQVAHDVDLQKLPVRFALDRAGLVGADGPTHCGAFDTTFMACLPNMVVMAPSDETELMHMIATAAAIDDRPSCFRYPRGNGIGTILPPNNKGTPLEVGKGRVLKEGSRVALVGYGTMVQSCMEAAKVLEAHGISTTVVDARFCKPLDGDLMRRLAREHEILITVEEGSIGGFGSHVSHFLGLNGLLDGNLKWRALTLPDRYINHGSQTDQIQMAGLSSNHIAVTALSLTNVHWDSRLLLSLQI

SEQ ID NO: 117579 - protein, 134 aa, Glycine max
  Coding DNA Sequence Number=SeqID_801
MMMILMSTATTMIEILVIVVMDGGGVALVVVVMRMVVAMAMCWCGGGVCRNIDGGYGDDDRDSIVSNDSSNNDTSRGIDGVAMPCGCDTNGGIGDVCGDSGGISQLYDCDNDDNGDGGSNDESDIDVHGDDNQQ

SEQ ID NO: 117580 - protein, 62 aa, Glycine max
  Coding DNA Sequence Number=SeqID_802
MKGTDHLHFFFWNGKRQYLATKVGYSEFLVLLVQTLKSLSILLGQDKNHASKFASNDNKLMV

SEQ ID NO: 117581 - protein, 66 aa, Glycine max
  Coding DNA Sequence Number=SeqID_803
  Gene Ontology: Mol. function=nucleotide binding; Cellular component =intracellular; Biological process=small GTPase mediated signal transduction
  Homolog annotation: Hit_ID=P40940; Match level="QueryCoverage=61%, HitCoverage=22%, E-value=2e-13, Identity=80%"; Hit description=ADP -ribosylation factor 3
  Pfam annotation: Domain name=Arf; Domain location=5-66; Score=-94.8; E_value=0.019; Accession=PF00025.11; Description=ADP-ribosylation factor family
MRKRERERLNRKWDQLQFAIHGPYWRCYFPNTQAIIYVVDSSDVDRLVIAKEEFHAILELQQLLRG

SEQ ID NO: 117582 - protein, 50 aa, Glycine max
  Coding DNA Sequence Number=SeqID_804
MEAAEARALQLAINWLADQDHDSIIIETDCRQIVDSFLQKHFQCIEIITQ

SEQ ID NO: 117583 - protein, 365 aa, Glycine max
  Coding DNA Sequence Number=SeqID_805
  Gene Ontology: Mol. function=DNA binding; Cellular component=nucleus; Biological process=regulation of transcription
  Homolog annotation: Hit_ID=Q0PJD1; Match level="QueryCoverage=56%, HitCoverage=98%, E-value=1e-107, Identity=89%"; Hit description=MYB transcription factor MYB71
  Pfam annotation: Domain name=Myb_DNA-bind_2; Domain location=16-70; Score=-8.4; E_value=0.084; Accession=PF08914.1; Description=Rap1 Myb domain
  Pfam annotation: Domain name=Myb_DNA-binding; Domain location=14-62; Score=45.4; E_value=1.9e-10; Accession=PF00249.21; Description=Myb -like DNA-binding domain
  Pfam annotation: Domain name=Myb_DNA-binding; Domain location=68-113; Score=40.2; E_value=7.3e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=16-70::14-62::68-113
MGRAPCCDKNNVKKGPWSPEEDATLKTYIEKNGTGGNWIALPQKIGLKRCGKSCRLRWLNYLRPNIKHGGFTEEEDNIICSLYISIGSRWSIIAAQLPGRTDNDIKNYWNTRLKKKLLGRRKQSNFSSKDTNNGIEENSYSNALSTSALERLQLHMQLQSLQNPFSFYNNPALWPKLHPIQEKMIHSLQSLNDGSNPVMQNALPNSPHDEQGQKGEFYKPQHDGAKINNPDQVHLLENIPLSNSGVPFVASGSSTNPMHSSLAPRSEAIHVQTNNNVGFQQLGALQNELDEILNNRTMGYVPQEDHDMASGFDCFREMNDSKDSLIWWSNDSDTKSASSNSWESSATPALLTQGMFQDYELGYSL

SEQ ID NO: 117584 - protein, 334 aa, Glycine max
  Coding DNA Sequence Number=SeqID_806
  Gene Ontology: Mol. function=transferase activity, transferring glycosyl groups; Biological process=metabolic process
  Homolog annotation: Hit_ID=Q2PGW4; Match level="QueryCoverage=80%, HitCoverage=64%, E-value=4e-55, Identity=40%"; Hit description=UDP -glucose: flavonol 3-O-glucosyltransferase
  Subcellular localization annotation: CTP_CleavageSite=59; ConfidenceScore=5.34e-01
MVVQYKCIVCNPNPSHHDCLPYRRQACGRVGVSLWHTRNSTPQPRAKSSSRGSPSHILVFSTKKSNASVFAGLNKEQLFNIKPYDVDDGLPDNYVPSGNPKDAVAFFVKAMPANYRTALDEAVAKTGRHITCLVSDAFFLVFVLTWLKKCMQIRENKEVDFLTGFSGVKASDLPEGLVEEPQDPFSIMLEKLGEALPRATAVAINSFATVHLPIAHELESKLHKLLNVGQFILTTPQALSSPDEDGCLPWLNKQEEGSVVYLSFGSSIMPPPHELAAIAEALEEGKYPFIWAFRGNPEKQLPQGFLERTKTQGKVLLRGPHKCKSQNIQRFVCA

SEQ ID NO: 117585 - protein, 1103 aa, Glycine max
  Coding DNA Sequence Number=SeqID_807
  Gene Ontology: Mol. function=protein-tyrosine kinase activity; Biological process=protein amino acid phosphorylation
  Homolog annotation: Hit_ID=Q9FKL3; Match level="QueryCoverage=97%, HitCoverage=100%, E-value=0.0, Identity=51%"; Hit description =Similarity to protein kinase
  Pfam annotation: Domain name=PB1; Domain location=67-154; Score=96.0; E_value=1.1e-25; Accession=PF00564.15; Description=PB1 domain
  Pfam annotation: Domain name=Pkinase; Domain location=830-1093; Score= 199.4; E_value=8.2e-57; Accession=PF00069.15; Description=Protein kinase domain
  Pfam annotation: Domain name=Pkinase_Tyr; Domain location=830-1093; Score=255.4; E_value=1.2e-73; Accession=PF07714.7; Description =Protein tyrosine kinase
  Pfam module annotation: Pfam domain module=PB1::Pkinase::Pkinase_Tyr; Domain location=67-154::830-1093::830-1093
MEGVVVTCSRERFQCLSQCESVIDHRQGFIMDSPIRSPATGSGSGSGEDNRRVKFLCSFLGSIMPRPQDGKLRYVGGETRIVSVPRDISYEELMGRMRELYDGAAVLKYQQPDEDLDALVSVVNDDDVVNMMEEYDKLGSGDGFTRLRIFLFSQSEQDGSSHFIDGDDSERRYVDALNSLNDGSNSDFRRLQQGEFSMMSPVEDIHVAADQFYNPINVESGIHSQRSGDLSMSPYNMHHLTVQHPQALGQRYNEMDAPWNPAYYSPRHHGLHDFPSSPSGTRYRVPFPELPDKCIDRVPEEYARHHVNHHPVYDNQPQYSENVMWMPAHGEKSAFPGNIIHSPHVVDENSICEQCRMGFHRGQPHLEHSNISNGVSQVGNLCAECPPPNRDTFAADAKLHSAIYPNEPSNDHRSVFNDTQNHERGWGLQHPTARVEESRVHVSLGHGSVTDAHNLPSNYVQQQAGPELGTELFPEQTVTPVPPIQFPPLEDCNVRYGNSASPYGVDSNYAVPRGLPPGFWRNTPVPVHIGPSYEAATSPQPVNGLMNAAGLIRGEASPGFFIGPDSQNHWVDSSQKLTGHDGTAIPEYPYAHALNPLPLGQENQHPVIVDFIHPPQDMNAGTCLKPLQLPKSSFNMVPNQQVLRDDTHLTEAKSFESNGLIGEGIVVKIEDNVQNPGTQTISFSVQNKIAENACEAAAASSVESNNLKSKPEADCVHVEKLADKDPSVPEDSKHLVDQFSFLPELIASVKKAALEDAVQLKAAVDEHADSPNHNSDTKDETTNEVEPANAHGDLELDSENDHVDTNKIEPTRAEEEAIAKGLQTIKNDDLEEIRELGSGTYGAVYHGKWKGSDVAIKRIKASCFAGRPSERARLIADFWKEALMLSSLHHPNVVSFYGIVRDGPDGSLATVTEFMINGSLKQFLHKKDRTIDRRKRLIIAMDAAFGMEYLHGKNIVHFDLKCENLLVNMRDPQRPICKIGDLGLSKVKQHTLVSGGVRGTLPWMAPELLSGKSNMVSEKIDVYSFGIVMWELLTGNEPYADMHCASIIGGIVNNTLRPQIPTWCDPEWKSLMESCWASDPVERPSFSEISKKLRSMAASMNLK

SEQ ID NO: 117586 - protein, 523 aa, Glycine max
  Coding DNA Sequence Number=SeqID_808
  Gene Ontology: Mol. function=kinase activity; Cellular component =mitochondrion; Biological process=carbohydrate metabolic process
  Homolog annotation: Hit_ID=Q67Y17; Match level="QueryCoverage=94%, HitCoverage=79%, E-value=0.0, Identity=63%"; Hit description=MRNA, complete cds, clone: RAFL25-18-P16
  Pfam annotation: Domain name=FGGY_N; Domain location=15-275; Score =11.6; E_value=8.8e-11; Accession=PF00370.11; Description=FGGY family of carbohydrate kinases, N-
MAASSSSPDEPSRSVFLGVDVGTGSARAGLFDEEGKLLGSSSSSIQIWKDGACVEQSSTDIWLAVCAAVKAACSKAEVAPTEVKGMGFAATCSLVAVDSDSSPVSVSWSGDSRRNVIVWMDHRAVEQAERINSSKSPVLEYCGGAVSPEMEPPKLLWVKENLQESWSMVFRWMDLSDWLSYRATGDDTRSLCTTVCKWTYLGHAHMQHVNDKESRDMEACGWDDDFWEEIGLGDLIEGHHAKIGIHLINIGLELGLVPGIPVGTSLIDAHAGGVGVIESVPPSEAEEHDMEAICNRMVLVCGTSTCHMAVSRSKLFIPGVWGPFWSAPFMYVFVKISVWLLVISSFLWNIDIGIKPLITASLVSSMLWCIFSLSELSAMVPEYWLTEGGQSATGALLDHIIENHAASARLANQAATQKISLFELLNKMLETMIVELNLSFIAALTEDVHVLPDFHGNRSPIADPKAKGVIYGLTLDTSDKQLALLYLATVQGIAYGTRHIVEHCNAHGHKVRICQKYVAHWLY

SEQ ID NO: 117587 - protein, 323 aa, Glycine max
  Coding DNA Sequence Number=SeqID_809
  Gene Ontology: Mol. function=hydrolase activity, hydrolyzing O -glycosyl compounds; Cellular component=cell wall; Biological process= carbohydrate metabolic process
  Homolog annotation: Hit_ID=Q8S902; Match level="QueryCoverage=82%, HitCoverage=93%, E-value=1e-128, Identity=81%"; Hit description =Syringolide-induced protein 19-1-5
  Pfam annotation: Domain name=Glyco_hydro_16; Domain location=38-219; Score=371.5; E_value=1.3e-108; Accession=PF00722.11; Description =Glycosyl hydrolases family 16
  Pfam annotation: Domain name=XET_C; Domain location=243-297; Score =114.3; E_value=3.4e-31; Accession=PF06955.3; Description=Xyloglucan endo-transglycosylase (XET)
  Pfam module annotation: Pfam domain module=Glyco_hydro_16::XET_C; Domain location=38-219::243-297
MAVECNLLKILAGKVCGLVVTWRCLPKAKVMVAFAGDLNKDFDITWGDGRAKILNNGELLTLSLDKASGSGFQSKNEYLFGKIDMQLKLVPGNSAGTVTAYYLSSKGSTWDEIDYEFLGNLSGDPYILHTNVFSQGKGDREQQFYLWFDPTADFHTYSITWNPQRIIFSVDGTPIREFKNLEPIGVPFPKNQPMRMYSSLWNADDWATRGGLVKTDWTQAPFTASYRNFNAETCIWSSGASSCAKTSSTSTTSSGSWLSQELDSAGHQRLKWVQKNYMIYNYCTDTKRFPQGLPPECNISGEKNKATHSSYIFYDQNVIPILV

SEQ ID NO: 117588 - protein, 608 aa, Glycine max
  Coding DNA Sequence Number=SeqID_810
  Gene Ontology: Mol. function=calmodulin binding
  Homolog annotation: Hit_ID=Q9FKL6; Match level="QueryCoverage=98%, HitCoverage=97%, E-value=0.0, Identity=61%"; Hit description =Calmodulin-binding protein
  Pfam annotation: Domain name=Calmodulin_bind; Domain location=71-374; Score=680.0; E_value=1.8e-201; Accession=PF07887.2; Description =Calmodulin binding protein-like
MKKPTTDAISMGKRSLEGGEDDQPERKRPALASNTDVKQVSEEVERALAKLGPARLSGRSPPKMIEGPDGRSLQLKFRSRLSLPLFTGGKVEGEQGAPIHVVLIDANSGSIVTSGPESCVKLDVVVLEGDFNNEDDEDWTQEDFESHVVKEREGKRPLLTGDLQVTLKEGVGTLGELTFTDNSSWIRSRKFRLGLKVASGFCESIRIREAKTVAFIVKDHRGELYKKHYPPALTDEVWRLEKIGKDGSFHKKLNSAGIVTVEDFLRLVVKDQQRLRNILGSGMSNKMWEALLDHAKTCVLSGKLYVYYPEDARNVGVIFNNIYELRGLISGDQFYSADSLTDSQKVYVDSLVKKAYENWDQVVDYDGKSLVNAKISSENELHVESIDYGSGLDHQLQLPVLPVSVPSEQQINSGIPVGGYNDNNIVTRYPTQSLIPNSSSRNQFDSSLYVSNDQLISNAHQTQSTSNDHGTVGLALGPPQSSTSGFHAGSSSAINPFDDWSHNRDKGADEFFSEEEIRFRSHEMLENEDMQQLLRLFSMGGHGSMSAEDGFSFPSFMPSPSIPNYDEDRSRPGRAVVGWLKIKAAMRWGFFIRKIAAEKRAQIEELDE

SEQ ID NO: 117589 - protein, 294 aa, Glycine max
  Coding DNA Sequence Number=SeqID_811
  Gene Ontology: Mol. function=6-phosphogluconolactonase activity; Cellular component=microtubule; Biological process=carbohydrate metabolic process
  Homolog annotation: Hit_ID=Q84XU3; Match level="QueryCoverage=94%, HitCoverage=89%, E-value=1e-91, Identity=61%"; Hit description =Putative 6-phosphogluconolactonase
  Pfam annotation: Domain name=Glucosamine_iso; Domain location=22-291; Score=-95.9; E_value=0.099; Accession=PF01182.11; Description =Glucosamine-6-phosphate isomerases6-phosphogluconolactonase
MAETNNNVAVEVLEKEDLAVSLAKYVADLSNKFTSERGAFTVCLSGGSLINYLRKLLEPPYVDTLEWSKWHVFWVDERVVPKTHEDSNYKLALDGLLSKYMCEDRNPILELDKKWYMNMFSFKQPAVPNNQSIPNKHKVPIPPGNVYAINDALSAEGAANDYETCLRHLVKNSIIASSPANGFPKFDLMLLGMGPDGHIASLFPGHPLVEEKQRWVTFIKDSPKPPPERITFTLPVINTSAYAALVVTGKGKADAVHSVLGKSQNFAKLPVGLVSPEGELKWFLDKGAASKLAA

SEQ ID NO: 117590 - protein, 394 aa, Glycine max
  Coding DNA Sequence Number=SeqID_812
  Gene Ontology: Mol. function=oxidoreductase activity; Cellular component=chloroplast thylakoid membrane; Biological process =proteolysis
  Homolog annotation: Hit_ID=Q94HY4; Match level="QueryCoverage=89%, HitCoverage=88%, E-value=1e-149, Identity=71%"; Hit description =Putative aldo/keto reductase
  Pfam annotation: Domain name=Aldo_ket_red; Domain location=36-370; Score=164.1; E_value=3.6e-46; Accession=PF00248.11; Description =Aldoketo reductase family
  Subcellular localization annotation: CTP_CleavageSite=33; ConfidenceScore=5.59e-01
MALSVCSMNINPIALAAPSFSFKSLKFPSFWPTQKVKMGPLSVSPMGFGTWAWGNQLLWGYQESMDNELQQIFNLAMDNGINLFDTADSYGTGRLNGQSEKLLGRFIREFQGFITHCFLTFIEFCIYSSVDCSAEQKGSQREIVIATKFAAYPWRLTPGQFVSACRASLDRMQIEQIGIGQLHWSTANYAPLQEFALWDGLVAMYEKDLVKAVGVSNYGPKQLLKIHDYLKDRGVPLCSAQVQFSLLSTGKDQLEIKSICDSLGIRMIAYSPLGLGMLTGKYSSSKLPSGPRALLFKQILPGLDPLLSSLREIANKRRKTMSQVAINWCICKGTVPIPGVKTIKQAEENLGALGWRLSSDELLQLEDAANESPRRMIQNIFQTRQRANNLDQEN

SEQ ID NO: 117591 - protein, 102 aa, Glycine max
  Coding DNA Sequence Number=SeqID_813
  Subcellular localization annotation: CTP_CleavageSite=26; ConfidenceScore=5.66e-01
MLTFTHSNPTNDTHFVAGAARFFSMAAAAVTPAVLFTALAGLAVVALVFCGASRRSHNSQSSSSNSSPSSSSSSSSSSWIHLRSVLFVVTSSSPASCSSSDR

SEQ ID NO: 117592 - protein, 691 aa, Glycine max
  Coding DNA Sequence Number=SeqID_814
  Gene Ontology: Mol. function=nucleotidyltransferase activity; Cellular component=integral to membrane; Biological process=aromatic amino acid family biosynthetic process
  Homolog annotation: Hit_ID=Q2ES30; Match level="QueryCoverage=95%, HitCoverage=99%, E-value=0.0, Identity=74%"; Hit description=YSL transporter 3
  Pfam annotation: Domain name=OPT; Domain location=41-647; Score =513.8; E_value=1.9e-151; Accession=PF03169.6; Description=OPT oligopeptide transporter protein
MGTSTVSDEELKEIENLGREDIEEAPIVPEDVSRIAPWIRQITLRGLVASFLIGIIYSVIVMKLNLTTGLVPNLNVSAALLGFVLIRAWTKVLAKAKIVSTPFTRQENTIIQTCAVACYSIAVGGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVQFPTFGLKAWKNSMTYVGAGMICSHLVNLSLLLGAVISWGIMWPLIRGLKGEWFPASIPESSMKSLNGYKVFISIALILGDGLYNFVKVLYFTATNIHATVKRKNPETYNQKPLPLDDLRRNEVFARESIPIWLACTGYILFSIVSIIVIPLMFPQLKWYYVVFAYLFAPSLGFCNAYGAGLTDMNMAYNYGKVALFVLSALAGKNDGVVAGLVGCGLIKSIVSISSDLMHDFKTGHLTFTSPRSMLLSQAIGTAIGCVVAPLTFFLFYKAFDVGNPDGDYKAPYAIIYRNMAILGVEGFSALPHHCLQLCYGFFTFAIAANLVRDLGPKKIGKWIPLPMAMAVPFLVGGYFAIDMCMGSLVVFLWHTLNRNEAGLMVPAVASGLICGDGLWILPSSILALLKIRPPICMSFLSASAKAPPLRGEDTPNEAEAAGSRWTGCKAI

SEQ ID NO: 117593 - protein, 375 aa, Glycine max
  Coding DNA Sequence Number=SeqID_815
  Gene Ontology: Mol. function=metal ion binding
  Homolog annotation: Hit_ID=Q337A7; Match level="QueryCoverage=93%, HitCoverage=85%, E-value=3e-96, Identity=50%"; Hit description=HIT zinc finger family protein, expressed
MADSIVTSSNSSTSSLNPTRIICHSHSLRCTESFMKENVVQELHQMQPDEQTKNKMLDILKRFHSQEEMDENYSTLSEETMENFLSGQEISFDDLSLEEKKRFHRAIAYGELSKMIKPWDPWWSKPSARNICLSKEGTQLVQPLPDQELLDDDIGSDEFSKVPLGPETPLPPLSRLSSKEPSPLLTVHLVDILYSYCFTLRLYNGDWRSDALGSVMVVLSVSSVLGQGAQPETVLEALSHCLEQVCCPAYRHIGGLQFGLGVIDDVISLLGLGTPALVCALCDMHRWIQEGEKEAKSERPRKSQRGGTRSAIKLAERKIYFIMCWVREQPEEVWSSLAAIARAEKTSAMEFQQSNRSEDLNNKAEAKGKSLIQEI

SEQ ID NO: 117594 - protein, 200 aa, Glycine max
  Coding DNA Sequence Number=SeqID_816
  Gene Ontology: Mol. function=nucleoside-triphosphatase activity; Cellular component=protein complex; Biological process=proteolysis
  Homolog annotation: Hit_ID=Q9FJC9; Match level="QueryCoverage=84%, HitCoverage=38%, E-value=6e-71, Identity=81%"; Hit description=26S proteasome regulatory particle chain RPT6-like protein
  Pfam annotation: Domain name=AAA; Domain location=87-200; Score=-7.4; E_value=0.00077; Accession=PF00004.19; Description=ATPase family associated with various cellular activities (AAA)
MEQYAFEQLSSNVDLKYNFCYCYCLPLFLEDKDVIACDVINPDHINVEFNSIGGLETIKQALFELVILPLKRPDLFSHGKLLGPQKGVLLYGPPGTGKTMLAKAIAKESRAVFINVRISNLMSKWFGDAQKLVDWPVGDRTIKSLVTVAAVFSLAYKLQPAIIFIDEVDSFLGQRRGTDHEAMLNMKTEFMALWDGFTTD

SEQ ID NO: 117595 - protein, 187 aa, Glycine max
  Coding DNA Sequence Number=SeqID_817
  Gene Ontology: Mol. function=transition metal ion binding; Cellular component=endoplasmic reticulum; Biological process=electron transport
  Homolog annotation: Hit_ID=O48618; Match level="QueryCoverage=69%, HitCoverage=97%, E-value=6e-64, Identity=87%"; Hit description =Cytochome b5
  Pfam annotation: Domain name=Cyt-b5; Domain location=7-81; Score =96.9; E_value=6e-26; Accession=PF00173.18; Description=Cytochrome b5- like HemeSteroid binding doma
MASDRKLHTFEEVAKHNQTKDCWLIISGKVYDVTPFMEDHPGGDEVLLSATGKDATNDFEDVGHSDSARDMMEKYYIGEIDASTVPLKRTYIPPQQAQYNPDKTPEFVIKILQFLVPLLILGLAFVVRHYTKKEKGGDGDGRGETLNINQNNECGVASFMEHGPGSEASNVVSEYRWQPSGKTSRCS

SEQ ID NO: 117596 - protein, 533 aa, Glycine max
  Coding DNA Sequence Number=SeqID_818
  Gene Ontology: Mol. function=nucleoside-triphosphatase activity; Cellular component=membrane; Biological process=cell division
  Homolog annotation: Hit_ID=Q1SHI2; Match level="QueryCoverage=52%, HitCoverage=63%, E-value=4e-82, Identity=54%"; Hit description=AAA ATPase
  Pfam annotation: Domain name=AAA; Domain location=58-237; Score=30.1; E_value=1.1e-06; Accession=PF00004.19; Description=ATPase family associated with various cellular activities (AAA)
  Pfam annotation: Domain name=AAA_5; Domain location=58-180; Score= -21.3; E_value=0.075; Accession=PF07728.4; Description=ATPase family associated with various
  Pfam annotation: Domain name=UPF0160; Domain location=357-533; Score=- 112.9; E_value=1.6e-06; Accession=PF03690.4; Description =Uncharacterised protein family (UPF0160)
  Pfam module annotation: Pfam domain module=AAA::AAA_5::UPF0160; Domain location=58-237::58-180::357-533
MYVNSGAGEWGSAPFTHPASFETVAMDAELKNKVKSDLEQFVKSKQYYHRLGRVWKRSYLLYGAPGTGKSSFVAAMAKFLCYDVYDVDVSKFTDGADWKVMLMQTTAKSLIVIEDLDRLLTEKSKSNATSLSSVLNFMDGIVSCCGEERVMVFTMNETKDEVDQAVLRPGRVDVHIHFPLCDFSTFKILASSYLGLKEHKLFPQVEEVFQTGARLSPAEVHSEGQRLSQSGSGRNSDDNEPGAVICRESVHTVREFRKLYGLLRLGSRRKEESYSGPIEKEAPLGDFETAFSSIPFVAPGTDKAEALPKPKMIKLAGPCIVFLDACGHTQTEPSTATRPSPASCFASPNASPALTLSEPGTPTFSNPSTQSSTLEARTTRFDHHQKGFHQVFGHGLHTKLSSACLQRIIANVLKLDEDHPDVHQLYPTIYRNVVEAIDAVDNGVNQYDLDVPPKYEINTILSSRIKRLNLSWMDSDQSSDRENEAFLHAIVLAGAEFLENVNYYAKSWLPARSTVMESLAARGSADSSGEIIL

SEQ ID NO: 117597 - protein, 102 aa, Glycine max
  Coding DNA Sequence Number=SeqID_819
MISRIGSNTDMPNNFNRVKLKTHQDDAVCQVANSHQSLRPRRNNCHWIGFGRVIILSSGEELSTSVLQNARSGCEVFSRLQVATMHLHEQSDCLWLCQEAIL

SEQ ID NO: 117598 - protein, 162 aa, Glycine max
  Coding DNA Sequence Number=SeqID_820
  Gene Ontology: Mol. function=nucleic acid binding; Cellular component= intracellular; Biological process=chromatin modification
  Homolog annotation: Hit_ID=Q39261; Match level="QueryCoverage=74%, HitCoverage=70%, E-value=3e-18, Identity=45%"; Hit description=Zinc finger protein 2
  Pfam annotation: Domain name=zf-C2H2; Domain location=48-70; Score =20.4; E_value=0.0063; Accession=PF00096.16; Description=Zinc finger, C2H2 type
MNFHNPNTSLHLSQHDDENHLNLDLLLEPSSSSSSSPSPICSMEPRIFSCNYCQRKFYSSQALGGHQNAHKLERTLAKKSRELSLNMQSYGAAEQRSNFGASHHLGHRALGVVDNQGQSYVRLGGRKEFSYGSKEGVGVASWSRASEHVQEDMGQLDLSLRL

SEQ ID NO: 117599 - protein, 86 aa, Glycine max
  Coding DNA Sequence Number=SeqID_821
  Gene Ontology: Mol. function=4-coumarate-CoA ligase activity; Cellular component=peroxisome; Biological process=metabolic process
  Homolog annotation: Hit_ID=Q8S564; Match level="QueryCoverage=96%, HitCoverage=15%, E-value=5e-34, Identity=90%"; Hit description=4 -coumarate:coenzyme A ligase
MTNITGVGGFSMKDEAAGEIPVAFVVRSNGSEIAEDEIKKYISQQVVFYKRIGRVFFTDSIPKAPSGKILRKVLTARLNEGLVVAN

SEQ ID NO: 117600 - protein, 243 aa, Glycine max
  Coding DNA Sequence Number=SeqID_822
  Gene Ontology: Mol. function=transcription regulator activity; Cellular component=transcription factor complex; Biological process =regulation of transcription, DNA-dependent
  Homolog annotation: Hit_ID=Q9SS44; Match level="QueryCoverage=94%, HitCoverage=59%, E-value=1e-82, Identity=71%"; Hit description =Transcription initiation factor IIB-2
  Pfam annotation: Domain name=TFIIB; Domain location=1-70; Score=57.4; E_value=4.7e-14; Accession=PF00382.10; Description=Transcription factor TFIIB repeat
MLQVGETSKFIKQDRANEIYKRVEDQKSSRGRNQDALLAACLYIACRQEDKPRTVKEICSVANGATKKEIGRAKEYIVKQLGLEQGQSVEMGTIHAGDFMRRFCSNLGMTNQAVKAAQEAVQKSEEFDIRLALDLMLLLFEYKGVIMDKKSLSFSRCVLHLWGKWRLWEHGACWRSPISIAAAVIYIITQLSDDKKPLKDISVATGVAEGTIRNSYKDLYPHVSKIIPSWYAKEDDLKNLCSP

SEQ ID NO: 117601 - protein, 114 aa, Glycine max
  Coding DNA Sequence Number=SeqID_823
MEHFLEQVAWPEAQLLLVRPNEAAQPKPTPVQVNPEPANPQSPVVNPPSSPELEAVPPSPPLIVISDASSNEAAAPPDSPITETTDPHVSPIGGIVDLSNSSSREVVALTESPV

SEQ ID NO: 117602 - protein, 135 aa, Glycine max
  Coding DNA Sequence Number=SeqID_824
  Gene Ontology: Mol. function=transferase activity; Biological process= metabolic process
  Homolog annotation: Hit_ID=Q2KWU9; Match level="QueryCoverage=52%, HitCoverage=14%, E-value=3e-19, Identity=63%"; Hit description =Putative cardiolipin synthetase
RGVHQHGFVALLRQPRLADAVDPRHEVGRGPEQGREQRQPDPADGRAHVLLGHGGMHRRARARHHADAEHHVRPGDSSAKDSKAGGRGKRMELPWLIRTCQRFYTARKNMLEFGLFAVEHEMLCASSEENRQWWL

SEQ ID NO: 117603 - protein, 189 aa, Glycine max
  Coding DNA Sequence Number=SeqID_825
  Gene Ontology: Mol. function=hydrolase activity; Cellular component =soluble fraction; Biological process=aromatic compound metabolic process
  Homolog annotation: Hit_ID=Q7WP59; Match level="QueryCoverage=99%, HitCoverage=64%, E-value=3e-79, Identity=73%"; Hit description =Putative hydrolase
MQVFDYGAPVGWRLAVAQPSRITAIISQNGNAYEEGLGQGWAPIQRYWNAPSQANRDALREFATPASIAWQYLEGVPDKTLVAPDAIALESQLVSRPGNAEVQLDLLLDYASNVAKYPQFQAYFREHRPPLLAVWGKNDPFFLPAGAQAWKRDIPDAQVRFYDTGHLALETHGVEIGGVIREFLDGNVK

SEQ ID NO: 117604 - protein, 54 aa, Glycine max
  Coding DNA Sequence Number=SeqID_826
  Subcellular localization annotation: CTP_CleavageSite=27; ConfidenceScore=5.04e-01
MGSRNPVMGWHCKVPSQSNHDFHPSFRKASKGRLKRRKKGGIMVSDTIFGVIAM

SEQ ID NO: 117605 - protein, 503 aa, Glycine max
  Coding DNA Sequence Number=SeqID_827
  Gene Ontology: Mol. function=4-coumarate-CoA ligase activity; Cellular component=peroxisome; Biological process=metabolic process
  Homolog annotation: Hit_ID=Q9LL50; Match level="QueryCoverage=99%, HitCoverage=92%, E-value=0.0, Identity=79%"; Hit description=4 -coumarate:coA ligase 2
  Pfam annotation: Domain name=AMP-binding; Domain location=54-467; Score=433.9; E_value=2.1e-127; Accession=PF00501.18; Description=AMP- binding enzyme
MEEQQAHHDFIFHSKLPDIYIPSHLPLHTYIFQNLSQFKHRPCLINGTTGETFSYHAIQLTARRVASGLNKLGIQKGDVILLLLQNCPQFVLAFLGASYRGATVTTANPFYTPAEVAKQATASNSKLIITQASYVDKVKDFARENDVKVICVDSAPEGYLPFSELTEADEGDIPAVKISQDDVVALPYSSGTTGLPKGVMLTHKGLVTSVAQQVDGENPNLYFRSSDVVLCLLPLFHIYALNSVLLCSLRVGASVLIVPKFEIITLLELIQKHKVSIAPFVPPIVLTVAKSPDLERYDLSSIRMIMSGAAPMGKELEDSLRAKLPNAILGQGYGMTEAGPVLSMCLAFAKEPMQVKSGACGTVVRNAEMKIVDPRTGASLHRNQAGEICIRGNQIMKGYLNDQEATQRTIDKEGWLHTGDIGYIDDDDELFVVDRLKDLIKYKGFQVAPAELEAILIAHPSISDAAVVSMKDEVAGEVPIAFLVRSNGSKVTEDEIMRYISKQ

SEQ ID NO: 117606 - protein, 43 aa, Glycine max
  Coding DNA Sequence Number=SeqID_828
MRLSPTVALSAHKALSEQPNAGAKGCAKPGYAPSAPRSSLQQL

SEQ ID NO: 117607 - protein, 252 aa, Glycine max
  Coding DNA Sequence Number=SeqID_829
  Gene Ontology: Mol. function=carbonate dehydratase activity; Cellular component=extracellular region; Biological process=one-carbon compound metabolic process
  Homolog annotation: Hit_ID=UPI0000162AE2; Match level="QueryCoverage =91%, HitCoverage=86%, E-value=4e-77, Identity=54%"; Hit description =carbonate dehydratase/ zinc ion binding
  Pfam annotation: Domain name=Carb_anhydrase; Domain location=20-244; Score=52.8; E_value=1.1e-14; Accession=PF00194.11; Description =Eukaryotic-type carbonic anhydrase
MEKTSKENALQDEEYTYAIGSSTGPENWWRINQKWKTCGDGKLQSPIDLLDQRVQELPQLGKLKKAYKSAPAVLKNRGHDIVLEWKGDAGQLNINETYYNLIQCHWHTPSEHTLNGTKFDLELHAVHTTSKGEFAVIGILYKIGSPDPFFSKLLNDIKSSVDKDIDVGLINSREIKFKSRPYYRYVGSLTTPACTEGVVWTIVKKVRTVSSEQLSALKGAVHHGYEENARPTQELGGRQVWLYGPMENEKPT

SEQ ID NO: 117608 - protein, 278 aa, Glycine max
  Coding DNA Sequence Number=SeqID_830
  Gene Ontology: Mol. function=protein binding; Cellular component =membrane; Biological process=defense response
  Homolog annotation: Hit_ID=Q1T0I4; Match level="QueryCoverage=99%, HitCoverage=24%, E-value=7e-49, Identity=41%"; Hit description =Disease resistance protein
  Pfam annotation: Domain name=NACHT; Domain location=79-239; Score= -22.5; E_value=0.0032; Accession=PF05729.3; Description=NACHT domain
  Pfam annotation: Domain name=NB-ARC; Domain location=36-278; Score =83.0; E_value=9e-22; Accession=PF00931.13; Description=NB-ARC domain
  Pfam module annotation: Pfam domain module=NACHT::NB-ARC; Domain location=79-239::36-278
MAQKIKDVSKRLDKVAADRHKFGLRTIDVDTRVVHRRDTSRMTHSRVSDSDVIGREHDKEKIIELLMQQNPNDDDKSLSVIPIVGIGGLGKTTLAKFVFNDKRIDGCFPLKMWVCVSDDFDINQLIIKIINSANVADAPLRQQNLDMVDLEQLQNQLRSRLAGQKFLLVLDDVWNDDRVRWVELRNLIKVGVAAGSKILVTTRIDSIASMMGTVASYKLQSLSPKNSLSLFVKWAFKNEGEEEKHPHLVNIGKEIVNKCKGVPLAVRTLGSLLFSKFE

SEQ ID NO: 117609 - protein, 152 aa, Glycine max
  Coding DNA Sequence Number=SeqID_831
MQVGLRDDRGRTSAVNVLSVCQRRQCAQERFLLHLWQISQRGVVLQTYSQIRAISKVFFRGCCFCMSPAWDAPVLLATSCMADTCQGGKEASLLLAISAHVKWETPIGATMEAPVLLAIQPRVGNFSTAARAALQQVCAVPLQMVALLLLVI

SEQ ID NO: 117610 - protein, 517 aa, Glycine max
  Coding DNA Sequence Number=SeqID_832
  Gene Ontology: Mol. function=4-coumarate-CoA ligase activity; Cellular component=peroxisome; Biological process=metabolic process
  Homolog annotation: Hit_ID=Q9LL50; Match level="QueryCoverage=97%, HitCoverage=98%, E-value=0.0, Identity=78%"; Hit description=4 -coumarate:coA ligase 2
  Pfam annotation: Domain name=AMP-binding; Domain location=59-442; Score=428.0; E_value=1.3e-125; Accession=PF00501.18; Description=AMP- binding enzyme
MEKQQPTQPQPHHDFIFRSKLPDIYIPTHLPLHTYLFQNLSQFKDLPCLINAATGETFTYAAVELTARKVASGFNKLGIQKGDVILLLLQNCPQFVFAFLGASYRGATVTAANPFYTPAEVAKQATASNSKLIITQASYVDKADEGDIPAVKISQDDVVALPYSSGTTGLPKGVMLTHKGLVTSVAQQVDGENPNLYFRSDDVVVCVLPLFHIYSLNSVLLCSLRVGAAVLIVPKFEIVALLELVQKHNVSVAPFVPPIVLAIAKSPDVERYDVSSIRMIMSGAAPMGKELEDSVRAKLPNATLGQGYGMTEAGPVLSMCLAFAKEPMQVKSGACGTVVRNAEMKIIDPDTGASLHRNQAGEICIRGNQIMKGYLNDQEATERTIDKGGWLHTGDIGYIDDNDELFIVDRLKELIKYKGFQVAPAELEAMLVAHPNISDAAVVSMKDEVAGEVPVAFVVRSNGSMISEDEIKQYISKQVVFYKRISRVFFVGSIPKAPSGKIFRKDLRAWLATDLAI

SEQ ID NO: 117611 - protein, 70 aa, Glycine max
  Coding DNA Sequence Number=SeqID_833
MAISFLAQVIPKIFRNFFRKLSRKNLLPEEQIVFYWKNLFSEEQIVVLVVLPESFQKKFLPVDNLFFRKK

SEQ ID NO: 117612 - protein, 141 aa, Glycine max
  Coding DNA Sequence Number=SeqID_834
  Homolog annotation: Hit_ID=Q9FKM0; Match level="QueryCoverage=67%, HitCoverage=72%, E-value=1e-07, Identity=43%"; Hit description =Arabidopsis thaliana genomic DNA, chromosome 5, P1 clone:MUA2
  Subcellular localization annotation: CTP_CleavageSite=57; ConfidenceScore=5.07e-01
MQKKSFLLSRLRVAVKKMKLLLSATVLSHAWHAATILRGVSMSKRQISFNDRPGLMMCTASSDETDSEGLVSPAHHSLQRTISCPSDDDIDKRAEMFIRKDLHFAVCDDRQENVDKICEKDFGLILKAKRLEGPGSICCFC

SEQ ID NO: 117613 - protein, 93 aa, Glycine max
  Coding DNA Sequence Number=SeqID_835
  Homolog annotation: Hit_ID=Q9CA77; Match level="QueryCoverage=59%, HitCoverage=7%, E-value=5e-13, Identity=54%"; Hit description =Putative receptor protein kinase; 10992-14231
MEHGISNKDGKAKVTDFGLARVVAIVDSHATTKGDVYSFGVLVMELATTIRAVDGGEECLVECKICCYGLWTTSWVGPFCVAFANGFWACWSG

SEQ ID NO: 117614 - protein, 76 aa, Glycine max
  Coding DNA Sequence Number=SeqID_836
  Pfam annotation: Domain name=zf-CCHC; Domain location=54-71; Score =29.0; E_value=1.6e-05; Accession=PF00098.13; Description=Zinc knuckle
MVSFAIGLCELFCTCLVSENAHLSSTSQNKKRKKTKGVAKGSSHKKKPKKDEEFTCYFCKKSGHMKKECPKYAHGV

SEQ ID NO: 117615 - protein, 69 aa, Glycine max
  Coding DNA Sequence Number=SeqID_837
  Homolog annotation: Hit_ID=Q945P0; Match level="QueryCoverage=91%, HitCoverage=29%, E-value=7e-15, Identity=65%"; Hit description =Transcriptional activator FHA1
MCKVVEDAGVVVGDVHAAAEAEEVDVNVDGGLLRVMTEDDGVGLHVVLEVLAQELFEHNFHVAARCHHG

SEQ ID NO: 117616 - protein, 299 aa, Glycine max
  Coding DNA Sequence Number=SeqID_838
  Gene Ontology: Mol. function=calcium ion binding; Cellular component =extracellular region; Biological process=pathogenesis
  Homolog annotation: Hit_ID=Q8XQP2; Match level="QueryCoverage=97%, HitCoverage=86%, E-value=1e-57, Identity=42%"; Hit description =Probable hemagglutinin/hemolysin-related protein
TLVAIAANGATNDTTPQLSGSATAGSIITVYDGDSTTPIGSVTVGADGSWQFVTGTLDEGDHSLTVTVTDAAGNVSDPSAPISFTVDTTAPDAVVDLLLVNNNVDPATPITSGSNTNDSTPLLSGTAEPNSTIIVYDGQTPIGTATAGNDGAWTFSPELTDGSHSLSVTVTDVAGNVSAPSASVAITVDTVAPSAVTQLSVASDNGNGDPVTIPNGGLTSDNTPVLSGSGDPGSLIVITSQDGPVGSVTVGSSGSWSFTPASALSDGSYTLTVVARDAAGNVSAPVTAQLVITPPLRIR

SEQ ID NO: 117617 - protein, 154 aa, Glycine max
  Coding DNA Sequence Number=SeqID_839
MSISPCRRIAPTRHLVDLKESDRALGFPALVTGLCHSYRVLVPPARSCHRDIGKGRTHKTPSGPGEVQQDPRVSSSGYEPLLVLQSAYPPARSCHRDIGVAPTRHLVDLEKSNRALGFPTLVTGLCQSYKVSVPPSKGSRPQDTQWTRRSPTGS

SEQ ID NO: 117618 - protein, 246 aa, Glycine max
  Coding DNA Sequence Number=SeqID_840
  Gene Ontology: Mol. function=nucleoside-triphosphatase activity; Cellular component=membrane; Biological process=response to abscisic acid stimulus
  Homolog annotation: Hit_ID=Q9FKM3; Match level="QueryCoverage=99%, HitCoverage=47%, E-value=1e-125, Identity=85%"; Hit description =Similarity to AAA-type ATPase
MREYWTSLASVLGVFAFCQTILQAVFPPELRFASVKLFHRVFHCFSTYCYFDITEIDGVNTNELYNAVQLYLSSSVSITGNRLSLTRAVNSSGFTFGLANNDSIVDTFNGVNVLWEHVVTQRQAQTFSWRPLPDEKRGFTLRIKKKDKSFILNSYLDYIMEKASDIRRKNQDRLLYTNSRGGSLDSRGHPWESVPFKHPSTFDTLAMDPHKKKQIMEDLQDFANGQSFYHKTGRAWKRGYLLYGPP

SEQ ID NO: 117619 - protein, 58 aa, Glycine max
  Coding DNA Sequence Number=SeqID_841
MMTPNLNLELEDDFKVLSQVDPDPGPVSLDLSLNFNTSDEELKVTSDTNCEVGHETHA

SEQ ID NO: 117620 - protein, 117 aa, Glycine max
  Coding DNA Sequence Number=SeqID_842
  Gene Ontology: Mol. function=voltage-gated ion-selective channel activity; Cellular component=mitochondrial outer membrane; Biological process=anion transport
  Homolog annotation: Hit_ID=Q10S27; Match level="QueryCoverage=89%, HitCoverage=38%, E-value=7e-33, Identity=63%"; Hit description =Eukaryotic porin family protein, expressed
MANGPAPFSEIGKRAKDLLYKDYNFDHKFSLSIPNSTGLGLIATGLKKDKLFVGDISTLYKSGNTTVDVKVDTYSNIYTKVTVNDILHGTKAALSFNIPDHKSGKVGKSSFPSVRQC

SEQ ID NO: 117621 - protein, 325 aa, Glycine max
  Coding DNA Sequence Number=SeqID_843
  Gene Ontology: Mol. function=protein binding; Cellular component =integral to membrane
  Homolog annotation: Hit_ID=O64614; Match level="QueryCoverage=72%, HitCoverage=64%, E-value=2e-72, Identity=65%"; Hit description =Expressed protein
  Pfam annotation: Domain name=Yip1; Domain location=106-306; Score =113.1; E_value=8.1e-31; Accession=PF04893.7; Description=Yip1 domain
MSHSDTIPLHPSSQSDIDEIENLINASVHQSVPSARPPSPPRASIPVSVSAAPSPFISSNLPPPPPLPKSSVSAVPPPPPPPRADISSSGFGSAPNTLTEPVWDTVKRDLSRIVSNLKLVVFPNPFREDPGKALRDWDLWGPFFFIVFLGLTLSWSASVKKGYEFRHLFSDPLTASAAMSGTEGVELQCDSEVFAVAFALLAAGAVILTLNGGVPNHSQQYTLMNEGKYLTVFISSKFQGGHIIFFQSLSLLGYCLFPLDVGALICMLKDNVIVKVVVVCVTLAWSSWAAYPFMSSAVNPRRKALALYPVFLMYVSVGFLIIAID

SEQ ID NO: 117622 - protein, 56 aa, Glycine max
  Coding DNA Sequence Number=SeqID_844
MAVTGHKQRSQGLTGEREKRKVVLAIVDNANGLKVKVDDAAITNYWLLQFHFMRTP

SEQ ID NO: 117623 - protein, 324 aa, Glycine max
  Coding DNA Sequence Number=SeqID_845
  Gene Ontology: Mol. function=nucleoside-triphosphatase activity; Cellular component=membrane; Biological process=response to abscisic acid stimulus
  Homolog annotation: Hit_ID=Q9FKM3; Match level="QueryCoverage=73%, HitCoverage=47%, E-value=6e-74, Identity=62%"; Hit description =Similarity to AAA-type ATPase
  Pfam annotation: Domain name=AAA; Domain location=1-201; Score=-11.4; E_value=0.0015; Accession=PF00004.19; Description=ATPase family associated with various cellular activities (AAA)
MIAAMANFLGYDIYDLELTEVHNNSELRKLLMKTSSKSIIVIEDIDCSINLTNRKNNNSSSSVSASTGYYDSEIRGGGGGCAEEGGNNITLSGLLNFTDGLWSCCGSERIFVFTTNHIEKLDPALLRSGRMDMHIFMSYCSFPALKILLKNYLGCEECELEEPILKRLEEVVDVARMTPADISEVLIKNRRKREKAVEELLETLKLRAEMNEKNGVLRVTNGVEEEEEQEKRALDSESPKQESEIEDNCKEEEEEEEKIKALHPDMLGEPAEMLVNTWVHMAWERLSGCQAKSSAVYFKKKGMYQKQKAIEKGLAQGKVVSADK

SEQ ID NO: 117624 - protein, 198 aa, Glycine max
  Coding DNA Sequence Number=SeqID_846
  Gene Ontology: Mol. function=transcription cofactor activity; Cellular component=nucleus; Biological process=regulation of transcription, DNA-dependent
  Homolog annotation: Hit_ID=Q1RZZ2; Match level="QueryCoverage=88%, HitCoverage=88%, E-value=3e-27, Identity=35%"; Hit description =Ribonuclease H
MERLLSVIIVKRNQQVHNDSFIRPVRPWQFIYHQWQLFKEPETSFWKGTAVPKIQIVVTWLPPSQGWTKLNTDGSVQGPQNVTLVGIIRDEKGCWISGFSKKVGIAFSFAVDLWGVYEGLCLARKIGLVVVEVNIDCQAVVDSLCGSKTGCAVGCRLINSIRSMINTSWLVVFKHSYQETNKCVDALARNALVVFKHS

SEQ ID NO: 117625 - protein, 467 aa, Glycine max
  Coding DNA Sequence Number=SeqID_847
  Gene Ontology: Mol. function=RNA-directed DNA polymerase activity; Cellular component=chromatin; Biological process=chromatin assembly or disassembly
  Pfam annotation: Domain name=zf-H2C2; Domain location=247-288; Score =16.7; E_value=0.0022; Accession=PF09337.1; Description=His(2)-Cys(2) zinc finger
LSKCFFAQSQVEYLGNLVSHKGVEPVASKVHQKLCDNCNPFSPGDHSGPLPMDGSSSNSLRSSKGSFINNFGHPIAFFSKPFSPKLLSASTYVCELCAVTSVVKKWCQYLLGHHFTIITDHHSLKELLSQTIQTLKQHMYLVRLMGYNYNIKYRSSVHNQAVDALSRLPKQNSSMTMILSVPCLTFLEELRHQLDNHSGYIHQCRAILESLATHPEFSISLNLVLHKGRIWLPRELPMISTLLTEYHTTPTGGHTGVAKTITRLSENFYWLGLREDVTQFVANWVECQLTKYETKKLAGLLCHLPVPYCLWENLSLDFIVGLPSYHGNSSGNVTPAHSALMVASLFMNIVVKIHGLPQSLVSDRDPLSSKIDVVEEMLCNMEETFQTIHKKLVKAQETMKNYADFERIEVVYQPGDWVLLKLWPHRQTTTKGPQASSGKLAKWFYGPFQDLECIGKVAYHLQLPEEA

SEQ ID NO: 117626 - protein, 66 aa, Glycine max
  Coding DNA Sequence Number=SeqID_848
MSYNGLSRKKGLAEASSSFKQLLFICPAEELKDPWFLLQAKVKPQHSEKSNNKSHMNLIPSWIQFL

SEQ ID NO: 117627 - protein, 378 aa, Glycine max
  Coding DNA Sequence Number=SeqID_849
  Gene Ontology: Mol. function=RNA-directed DNA polymerase activity; Cellular component=extracellular region; Biological process=RNA -dependent DNA replication
  Pfam annotation: Domain name=Chromo; Domain location=15-68; Score =27.2; E_value=5.8e-05; Accession=PF00385.14; Description='chromo' (CHRromatin Organisation MOdifier
MAPLPQQFINYQPLVSPLAILNYRRVPGTPNAPWEVLVQWQGLSPDETSWEDWSQLCQNYHLEDKGTLVGRTHSYRDSLNQARAVRRPTSPVRSQWFLEGDRNTRYYHDKTVNRRRRNKISILRDSEGHWVDEEDFIEELVNIAYQNLFAEDMPQGSWRDTPYSFHFIKPENFTMLAAPLQHKEIKMALFNMKPWKGPGPDGFPAGFLQNAWSIVGGDLCNLIQEWWDRPEEIMEANAKNIFLIPKVEQPEFQTGFIPSRSIHDNIVVAQEMMHSMRRMQGKVGYFIIKVDLPKAYDRMCLSFVAKILKEDKRDLRQGDPLSPYLFFLCMDKLSHIISKAVDDGHWKPMKMGRQGPQISHLMFADDLLLCAHANLVQM

SEQ ID NO: 117628 - protein, 554 aa, Glycine max
  Coding DNA Sequence Number=SeqID_850
  Gene Ontology: Mol. function=electron carrier activity; Cellular component=endoplasmic reticulum; Biological process=electron transport
  Homolog annotation: Hit_ID=Q1STX7; Match level="QueryCoverage=91%, HitCoverage=74%, E-value=0.0, Identity=68%"; Hit description =Flavoprotein pyridine nucleotide cytochrome reductase; Flavodoxin/nitric oxide synthase
  Pfam annotation: Domain name=FAD_binding_1; Domain location=177-394; Score=302.4; E_value=8.3e-88; Accession=PF00667.10; Description=FAD binding domain
  Pfam annotation: Domain name=NAD_binding_1; Domain location=386-498; Score=126.1; E_value=1e-34; Accession=PF00175.11; Description =Oxidoreductase NAD-binding domain
  Pfam module annotation: Pfam domain module=FAD_binding_1::NAD_binding_ 1; Domain location=177-394::386-498
YGDGEPTDNAARFYKWFTEGGEKGEGWLQNLHYGVFGLGNRQYEHFNKVAKVVDDMLVEQGILFLPLSLSVNITSIIWIWISHEDPTDGLFLRESDGKGGKRLVPVGLGDDDQCIEDDFTAWKEELWPALDELLRDEDDATVSTPYTAAVLEYRVVIHDPLEASVDEKKWHNVNGHAIVDAQHPVRANVAVRKELHTPASDRSCTHLEFDISGTGVTYETGDHVGVYCENLSETVEEAIRLIGLSPDTYFSIHTDDEDGKPRSGSSLPPTFPPCTLRTALTRYADVLSSPKKSALLALAAHASDPSEADRLRHLASPAGKDEYSEWVIASQRSLLEVMAEFPSAKPPIGVFFAAVAPRLQPRFYSISSSPRTSNFRLPSDNKVPIIMIGPGTGLAPFRGFLQERLALKEGGAELGPSVLFFGCRNRQMDYIYEDELSHFVNTGALDELILAFSREGPTKEYVQHKMMEKASEIWSMISQGAYIYVCGDAKGMARDVHRALHTILQEQVVSSVRAQGFWSSVIFFTMSFPFPQDLLLAYLVNFLKNESVANQVPL

SEQ ID NO: 117629 - protein, 151 aa, Glycine max
  Coding DNA Sequence Number=SeqID_851
  Homolog annotation: Hit_ID=Q1STY0; Match level="QueryCoverage=49%, HitCoverage=85%, E-value=5e-37, Identity=97%"; Hit description=Like -Sm ribonucleoprotein-related, core
  Pfam annotation: Domain name=LSM; Domain location=73-138; Score=95.7; E_value=1.4e-25; Accession=PF01423.12; Description=LSM domain
MKSMRTLKNKTVGKGNFRKEKLKRGAEVKCPVGFSKNPNHIPNPGLGVQNPNNYRFEISQRPKFQTIPVNPKPFLNNLTGKPVIVKLKWGMEYKGYLVSVDSYMNLQLANTEEYIEGQFTGNLGEILIRCNNVLYLRGVPEDEEIEDAAED

SEQ ID NO: 117630 - protein, 297 aa, Glycine max
  Coding DNA Sequence Number=SeqID_852
MEEEQAHIMKESDDVESQEEEEEREEALSLCDLPLNRNSRTPSLDDTSFKKILRPSSLPDHACEIFNGFSSSSSSDMCPADDIIFCGKLVPFKAEEPLKNFIVEEEKSPSRRRRSESLSSVTRSNSVSTCTGSRQLMMRNSKSLDHSRLRESSAPEELRAGGGSGEEGDEAALVLSDVRDDEDSAGDGAQRHEEPAGSPESIRNDVCRDGIRREGCRQSQPREGVVENTEGTELQGSQQRRRNDVVFVAASIVGLKSREVDVTRGFYCYVDAIALWFGRKSWIWKGGGRIVKDHGSS

SEQ ID NO: 117631 - protein, 134 aa, Glycine max
  Coding DNA Sequence Number=SeqID_853
MTFEVIPTSTDYRHMFYEVLSTSRSCRKKASKNCWNLDDPTVTFRGPRKARGAQPSPSGGGGASTAQEPEPEEPAVAEGEDELTPPEPFYFDAGVHMAQEEETSTDQIPEPSPVPIPDDAIPFAPSSELEQPIP

SEQ ID NO: 117632 - protein, 132 aa, Glycine max
  Coding DNA Sequence Number=SeqID_854
  Subcellular localization annotation: CTP_CleavageSite=23; ConfidenceScore=5.06e-01
MTSQPDWWHPMSNLSSVAQGRLKAQAAQARSNAGENSERVEKRHRFGNKGGVVDVFEADLAVVLIAEGGVHPGAGELDSTAMRGEVVVREVSMMDCTLDCTRRRLEVEGEERVSENAKNTSSRERMRARVPV

SEQ ID NO: 117633 - protein, 159 aa, Glycine max
  Coding DNA Sequence Number=SeqID_855
  Subcellular localization annotation: CTP_CleavageSite=65; ConfidenceScore=5.02e-01
MASSTCFQQISSQITIMKQKPSKTAHHISQNPIPTKIKDALHNSENAFLSRFGAEMMTKGWSFVGASMEDERGEESYLCHMSPFEWSKKGPLFPLDVTHTQSQKGKNLTFATLKKKSYIGLHAVSLVPVPRVPLRPSGPVFESRQYIYQNAQNETPSVV

SEQ ID NO: 117634 - protein, 57 aa, Glycine max
  Coding DNA Sequence Number=SeqID_856
  Gene Ontology: Mol. function=nucleic acid binding
  Homolog annotation: Hit_ID=Q1STX0; Match level="QueryCoverage=87%, HitCoverage=18%, E-value=1e-14, Identity=72%"; Hit description =Nucleic acid-binding, OB-fold, subgroup
  Subcellular localization annotation: CTP_CleavageSite=29; ConfidenceScore=5.19e-01
MYSSPSQFDGNAAFSGGGFMPSQTTQGPDSSLVPSKNRDAQSLLPLTVKQIYDAVKR

SEQ ID NO: 117635 - protein, 128 aa, Glycine max
  Coding DNA Sequence Number=SeqID_857
  Gene Ontology: Mol. function=nucleic acid binding
  Homolog annotation: Hit_ID=Q1STX0; Match level="QueryCoverage=65%, HitCoverage=31%, E-value=2e-20, Identity=61%"; Hit description =Nucleic acid-binding, OB-fold, subgroup
MSDDFLFTCRLHEAVDTNEAEAILPVTDFNEIASHFSDCIYVHLYNSRLRSSVPNQQHSSPIPPTIVYQAQAVPPTNQFSDQHINGQKGVTVEAMVLDFLHHPTNRLTSSVRTNGKDHVAYILVIREP

SEQ ID NO: 117636 - protein, 185 aa, Glycine max
  Coding DNA Sequence Number=SeqID_858
MMDFEYQKMSSTSKILSRRSSMECSSRISYYRSSEGVPFKWEMQPGIAKGQQPREVLPPLSPPPALLSLGLPKPCIPDPKPSTRSRLRFWKKRVKRGKSKKSPSSSHDCFHEDDVIGLDILDCSSDSESNSMASPRGSSFSSWSSMSSFMKSPTNTIREVCGRPSTLGCFPMHVSRVFVSIARRD

SEQ ID NO: 117637 - protein, 111 aa, Glycine max
  Coding DNA Sequence Number=SeqID_859
MTGLPMILPSESDRTYQCVYVNDVKMCETCQVDGYEELHASMRSFNGDFPPWRCSGRQRRRGERRRHPLGNKPWKKELHHLECALDKKLREDASMEEKKERRGEHEIEGIK

SEQ ID NO: 117638 - protein, 459 aa, Glycine max
  Coding DNA Sequence Number=SeqID_860
  Gene Ontology: Mol. function=phosphoglycerate mutase activity; Cellular component=cytoplasm; Biological process=glucose catabolic process
  Homolog annotation: Hit_ID=Q11NP9; Match level="QueryCoverage=99%, HitCoverage=88%, E-value=1e-172, Identity=65%"; Hit description =Phosphoglycerate mutase
  Pfam annotation: Domain name=Metalloenzyme; Domain location=318-437; Score=125.5; E_value=1.5e-34; Accession=PF01676.8; Description =Metalloenzyme superfamily
  Pfam annotation: Domain name=iPGM_N; Domain location=1-307; Score =462.2; E_value=6.5e-136; Accession=PF06415.4; Description=BPG -independent PGAM N-terminus (iPGM
  Pfam module annotation: Pfam domain module=Metalloenzyme::iPGM_N; Domain location=318-437::1-307
MGNSEVGHMNLGAGRVVYQNLVKLNMAVENGTLGEEKVIQEAFEYAKRENKKVHFIGLVSNGGVHSHINHLKGLLTAAKNFGLNENVFVHAFTDGRDCDPHSGLGFIKELDEHMLATTGKLATIVGRYYAMDRDKRWERVKLAYDALTEGVGLQTTDALAAIQQSYDNNVTDEFLKPIILMNTTETGNVVPVAKIVDNDVVICFNFRTDRGREITEVLSQKDFPEFFMRKLNLYYVTLTNYDKTFNNVKVVFDEEVLQETMGEIIEKNGKTQIRIAETEKYPHVTFFFSGGREKEFVGEKRLLCPSPKDVPTYDLKPEMSAYDITNAIVPELENETADFVCLNFANTDMVGHTGVFEAAVKAAETVDKCIEKVATTAYEHGYAVFILADHGNSDVMINPDGTPNTQHSTNLVPLIIMDKDRTWNLKPGKSGKLGDVAPTILKIMGIDIPESMTGDVLVN

SEQ ID NO: 117639 - protein, 104 aa, Glycine max
  Coding DNA Sequence Number=SeqID_861
MVFVLDGAHVHTSYVVYVHGGCIDLVECPWWGKIEWLKSLNISEGMFRIFNSSMFLVRRTTCTRGGVTRFGNSLVAQADHHGGGGGYGARQGGLDTYYIVSLSE

SEQ ID NO: 117640 - protein, 136 aa, Glycine max
  Coding DNA Sequence Number=SeqID_862
  Gene Ontology: Mol. function=nucleic acid binding; Biological process= DNA integration
  Homolog annotation: Hit_ID=Q1S1X7; Match level="QueryCoverage=89%, HitCoverage=26%, E-value=8e-10, Identity=42%"; Hit description =Integrase, catalytic region; Zinc finger, CCHC-type; Peptidase aspartic, catalytic
MSNSYRLKAIARKKEMKLKQLDEKTTFLHGKLEEEIIMKQPKGFEVQGKEDSAYRLKRYLKGTTDIGLIYQGDILCALAGYLDSSYAADLDVGRSVTSYAFTMSNSIGNESIWLKGLINNLGFPEDKTIILCDSLS

SEQ ID NO: 117641 - protein, 67 aa, Glycine max
  Coding DNA Sequence Number=SeqID_863
MAVCERAWNIGNGFGRKKGEEMAFFRSYLNYKAQNAQVTKALGNRNVAHTRDIFSKIPTVRSWKSVL

SEQ ID NO: 117642 - protein, 80 aa, Glycine max
  Coding DNA Sequence Number=SeqID_864
MGADDEEWWRPIRLRAWMNEMVESGTLELLTTIVEVEVDLLVEARSRMLWQATVMERGMESEEKCVREGMKLKRLESQME

SEQ ID NO: 117643 - protein, 88 aa, Glycine max
  Coding DNA Sequence Number=SeqID_865
  Gene Ontology: Mol. function=metal ion binding; Biological process =metal ion transport
  Homolog annotation: Hit_ID=Q1S7A8; Match level="QueryCoverage=86%, HitCoverage=70%, E-value=9e-36, Identity=85%"; Hit description=Heavy metal transport/detoxification protein
MDQQKVTVTGYVEKGKVLRIVRRTGRKAEYWPFPYDSEYYPYASEYLDESTFASSYNYYRHGYNESVYGYFPDQAYSKENKRGVDMVP

SEQ ID NO: 117644 - protein, 46 aa, Glycine max
  Coding DNA Sequence Number=SeqID_866
MTPMSVNLYQEEDYFGVKEAVEGGPQRRQWRGVGGCSHDDVTFSEW

SEQ ID NO: 117645 - protein, 132 aa, Glycine max
  Coding DNA Sequence Number=SeqID_867
IAARGNLVPLNLEIKAACRRNKAARRRREQQEVQINQGETESSFELFYPSFVTRPHPFSEEHIMAEDRPQRMTLEEYSSFATPQYFTNIARPDVQATNISYPHSLIQLIQGNLFHNLSSEDLYVHLATYIKI

SEQ ID NO: 117646 - protein, 99 aa, Glycine max
  Coding DNA Sequence Number=SeqID_868
MAKIHHQAWQPKTYHPMKHTPPHTYSQNNSKAPKFLKGRVKSWLIWLEAYKNKMPKSSPNMHVKQEVSTRVKPRLLCKQSMGQNTPNKINDDGSNSHQG

SEQ ID NO: 117647 - protein, 270 aa, Glycine max
  Coding DNA Sequence Number=SeqID_869
  Gene Ontology: Mol. function=RNA-directed DNA polymerase activity; Biological process=RNA-dependent DNA replication
MEDMMSMTKIMEVNTIAVATTSIVAEVDPTPTSGLNQINHQTSDMNKHAFLPYGLPPNYTPPNVAHAPDENVDNSAPIPVESQQPQADHVHVSQPIGETHEVPHHNLADFEPCLGYATKGQAVGGVSLPNTLGGPQYHPQPQPLHFTMGRLPPAMVDREKLDHIEERLRAIEGGGDYAFADMEELCLVPDVVVPPKFKVSDFDKYKGTTCPKNHLKMYSKKMGTYSKNEKLLMHFFQESLIGTAVTWYTNLEPSRVHSWKDLMVAFIRQY

SEQ ID NO: 117648 - protein, 572 aa, Glycine max
  Coding DNA Sequence Number=SeqID_870
  Gene Ontology: Mol. function=transcription factor activity; Cellular component=nucleus; Biological process=regulation of transcription, DNA-dependent
  Homolog annotation: Hit_ID=Q1STW9; Match level="QueryCoverage=92%, HitCoverage=89%, E-value=1e-163, Identity=61%"; Hit description =Pathogenesis-related transcriptional factor and ERF
  Pfam annotation: Domain name=AP2; Domain location=149-264; Score =78.0; E_value=3e-20; Accession=PF00847.10; Description=AP2 domain
  Pfam annotation: Domain name=AP2; Domain location=293-358; Score =124.7; E_value=2.7e-34; Accession=PF00847.10; Description=AP2 domain
  Pfam module annotation: Pfam domain module=AP2::AP2; Domain location =149-264::293-358
  Subcellular localization annotation: CTP_CleavageSite=59; ConfidenceScore=5.87e-01
MDSSSSSPPNSTNNNSLAFSLSNHFPNPSSSPLSLFHSFTYPSLSLTGSNTVDAPPEPTAGAGPTNLSIFTGGPKFEDFLGGSAATATTVACAPPQLPQFSTDNNNHLYDSELKSTIAACFPRALAAEQSTEPQKPSPKKTVDTFGQRTSIYRGVTRHRWTGRYEAHLWDNSCRREGQSRKGRQVNGCWVVLLKILTVLCFVSLRGFCTWGIIADSWGSFAHYAVSVYLGGYDKEDKAARAYDLAALKYWGPTTTTNFPISNYEKELEEMKNMTRQEFVASLRRKSSGFSRGASIYRGVTRHHQHGRWQARIGRVAGNKDLYLGTFSTQEEAAEAYDIAAIKFRGLNAVTNFDMSRYDVKSIANSTLPIGGLSGKNKNSTDSASESKSHEPSQSDGDPSSASSVTFASQQQPSSSNLSFAIPIKQDPSDYWSILGYHNTPLDNSGIRNTTSTVTTTTFPSSNNGTASSLTPFNMEFSSAPSSTGSDNNAAFFSGGGIFVQQQTSHGHGNASSGSSSSSLSCSIPFATPIFSLNSNTSYESSAGYGNWIGPTLHTFQSHAKPSLFQTPIFGME

SEQ ID NO: 117649 - protein, 346 aa, Glycine max
  Coding DNA Sequence Number=SeqID_871
  Gene Ontology: Mol. function=nucleoside-triphosphatase activity; Cellular component=myosin complex; Biological process=regulation of transcription
  Homolog annotation: Hit_ID=Q0WPU1; Match level="QueryCoverage=99%, HitCoverage=20%, E-value=1e-133, Identity=71%"; Hit description =Myosin-like protein
  Pfam annotation: Domain name=Myosin_N; Domain location=6-47; Score =39.9; E_value=8.9e-09; Accession=PF02736.9; Description=Myosin N -terminal SH3-like domain
  Pfam annotation: Domain name=Myosin_head; Domain location=61-345; Score=-186.3; E_value=1.1e-08; Accession=PF00063.11; Description =Myosin head (motor domain)
  Pfam module annotation: Pfam domain module=Myosin_N::Myosin_head; Domain location=6-47::61-345
MSLRHGTKVWVHDRDSAWIPAEVLESSGKKVTVATASGKKVVFLPENVFPRDADEEEHGGVEDMTRLAYLNEPGVLYNLQRRYALNDIYNSRWTISVSSCYHSLFVDDEMDTYTGSILIAVNPFTKLPHLYDIHMMEQYKGALFGELSPHVFAVADASYRAMMNGGQSQSILVSGESGAGKTETTKLIMQYLTYVGGRAAGDDRTVEQQVLESNPLLEAFGNARTVRNDNSSRFGKFVEIQFDSNGRISGAAIRTYLLERSRVVQITDPERNYHCFYQLCASERHKAMFCTVHVQDVEKYKLGKPSHFHYLNQSKVYELDGVSSAEEYMKTRRAMDIVGISLGDQV

SEQ ID NO: 117650 - protein, 106 aa, Glycine max
  Coding DNA Sequence Number=SeqID_872
MTGVPENKTVGPTVELTVGTMEEEDPEGFVEATSQQETETEDSHKRNLQISQPEETPALKRDNEDSRVHLGPDRVIVGGGGLTADGGTSDNQAERNETNLNVTRDD

SEQ ID NO: 117651 - protein, 174 aa, Glycine max
  Coding DNA Sequence Number=SeqID_873
  Gene Ontology: Mol. function=motor activity; Cellular component =myosin complex; Biological process=regulation of cell growth
  Homolog annotation: Hit_ID=Q1SMP7; Match level="QueryCoverage=79%, HitCoverage=14%, E-value=9e-66, Identity=74%"; Hit description=IQ calmodulin-binding region; Myosin head, motor region; AAA ATPase
MRWMVGYLFVFLNMCDLNLLLATLCTRSIQTREGNIIKALDCNAAVAGRDALAKTVYARLFDWLVDKINSSVGQDISSQKQIGVLDIYGFECFKDNSFEQFCINFANEKLQQHFNQHVFKMEQEEYSKEEINWSYIEFIDNQDVLDLIEKLSQRIRSIDSTKAVSLTNLLVTTD

SEQ ID NO: 117652 - protein, 53 aa, Glycine max
  Coding DNA Sequence Number=SeqID_874
MESLLAHLLHVPNPRKNENSLELTESSAMVSNRGRGGRGNRGRGGHGGGRNGT

SEQ ID NO: 117653 - protein, 513 aa, Glycine max
  Coding DNA Sequence Number=SeqID_875
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=87%, HitCoverage=45%, E-value=0.0, Identity=72%"; Hit description=ERECTA
  Pfam annotation: Domain name=Pkinase; Domain location=138-407; Score =104.2; E_value=3.8e-28; Accession=PF00069.15; Description=Protein kinase domain
  Pfam annotation: Domain name=Pkinase_Tyr; Domain location=138-404; Score=90.8; E_value=4e-24; Accession=PF07714.7; Description=Protein tyrosine kinase
  Pfam module annotation: Pfam domain module=Pkinase::Pkinase_Tyr; Domain location=138-407::138-404
  Subcellular localization annotation: CTP_CleavageSite=57; ConfidenceScore=5.05e-01
MSLVPNKLIMDCKFCSNVSYNNLVGVIPSSKNFSRFSPDSFIGNPGLCVDWLDSSCLGSHSTERVTLSKAAILGIAIGALAILFMILLAACRPHNPASFSDDGSFDKPVNYSPPKLVILHMNMALHVYDDIMRMTENLSEKYIIGYGASSTVYKCVLKNCKPVAIKKLYSHYPQYLKEFETELETVGSIKHRNLVSLQGYSLSPYGNLLFYDYMENGSIWDLLHGPTKKKKLDWDLRLKIALGSAQGLSYLHHDCSPRIIHRDVKSSNILLDKDFEPHLTDFGIAKSLCPSKTHTSTYIMGTIGYIDPEYARTSRLTEKSDVYSYGIVLLELLTGRKAVDNESNLHHLILSKTANDGVMETVDPDITATCKDMGAVKKVFQLALLCTKKQPVDRPTMHEVTRVLASLVPSITPPKQTDQTQVVLSDSQPSAKMQCYKDEYANLTTPHLVNCPSMSTSDAQLFLKFGEMQQYLRNFGIGLCRRETEVISLKLEQVVSMVSRALKMQKLLHFKKA

SEQ ID NO: 117654 - protein, 677 aa, Glycine max
  Coding DNA Sequence Number=SeqID_876
  Gene Ontology: Mol. function=motor activity; Cellular component =myosin complex; Biological process=regulation of transcription
  Homolog annotation: Hit_ID=Q1SMP7; Match level="QueryCoverage=99%, HitCoverage=63%, E-value=0.0, Identity=66%"; Hit description=IQ calmodulin-binding region; Myosin head, motor region; AAA ATPase
  Pfam annotation: Domain name=IQ; Domain location=181-201; Score=19.0; E_value=0.018; Accession=PF00612.17; Description=IQ calmodulin -binding motif
  Pfam annotation: Domain name=IQ; Domain location=204-224; Score=19.8; E_value=0.0097; Accession=PF00612.17; Description=IQ calmodulin -binding motif
  Pfam annotation: Domain name=IQ; Domain location=229-249; Score=20.4; E_value=0.0067; Accession=PF00612.17; Description=IQ calmodulin -binding motif
  Pfam annotation: Domain name=IQ; Domain location=252-272; Score=18.0; E_value=0.034; Accession=PF00612.17; Description=IQ calmodulin -binding motif
  Pfam annotation: Domain name=IQ; Domain location=277-297; Score=26.7; E_value=8e-05; Accession=PF00612.17; Description=IQ calmodulin -binding motif
  Pfam annotation: Domain name=IQ; Domain location=300-320; Score=21.8; E_value=0.0024; Accession=PF00612.17; Description=IQ calmodulin -binding motif
  Pfam module annotation: Pfam domain module=IQ::IQ::IQ::IQ::IQ::IQ; Domain location=181-201::204-224::229-249::252-272::277-297::300-320
KPIGIIALLDEACMFPKSTHETFSTKLFKHFLSHPRLEKEKFSETDFTLSHYAGKQQLQSLMETLNTTEPHYIRCVKPNSLNRPQKFENTSVIHQLRCGGVLEAVRISLAGYPTRRIYSEFVDRFGLIAPEFMDGSYDDKDVTLKILQKLKLENFQLGRTKVFLRAGQICILDSRRAEVLDNAAKCIQRRLRTFIARRDFISIQAAALSLQACCRGFIGRKLYASKRETSAAISIQKYIRMCWMRHAYVKLYYSAIIVQSNVRGFTTRQRFLHRKEHKAATSIQAYWRMCKVRSAFLKHQNSIVVIQCLWRCKQAKRELRKLKHEANEAGALRLAKNKLEKQLEELTWRLHLEKKIRVSNEEAKHVEISKLQKMVDALNLELDAAKLATINECDKNAVLQNQLQLLVKEKSALERELVAMDEVRKENALLKGSLDAFEKKSTALELELVNARKDHDKTIQKMREFEDKCSELGQNVKSLEEKLSILEDENHVLRQKALSVSPKSNHRGLTKSLSEKYSSAIAPCTEQKPTFESPAPTKLISHITHGGLSDSRRSKLTAEKHQDNYELLSRCIKEDLGFKNGKPLAASIIYKCLHHWHAFESERTAIFDYIVDGINDVLKVRDNDIVLPYWLSNTSALLCLLQRNLHPNGFLTTTAQRYARSSGLTSRIGNVSFQVEY

SEQ ID NO: 117655 - protein, 170 aa, Glycine max
  Coding DNA Sequence Number=SeqID_877
  Homolog annotation: Hit_ID=Q1SQM7; Match level="QueryCoverage=70%, HitCoverage=69%, E-value=2e-27, Identity=51%"; Hit description=MTD1
METLPLFEPQDDNEQCSSSATSSIGNDSDLSETVRGVMDVRGISKFYDGKSKSFTSLVDAGSTPYIKDIAKSENAYTSRGRNLMAFNHTWEKSQSYLLRSNSGGISKKTTISSSRSTVALAFAINYESSSCCASEDSSLSSNPRSPPPLPPLHPPSTAPSSPMQHNFSSR

SEQ ID NO: 117656 - protein, 82 aa, Glycine max
  Coding DNA Sequence Number=SeqID_878
  Homolog annotation: Hit_ID=Q1SMP6; Match level="QueryCoverage=87%, HitCoverage=21%, E-value=2e-19, Identity=64%"; Hit description=Dilute
MLVPFMPDISKNTKVVSEMREIVSKDNQCLSSNSFLLDDDMSIPFSAEDIDKAIPAINTVDIDLPAFLCEYPCAQFLILHEK

SEQ ID NO: 117657 - protein, 198 aa, Glycine max
  Coding DNA Sequence Number=SeqID_879
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q1SQM5; Match level="QueryCoverage=52%, HitCoverage=21%, E-value=8e-28, Identity=63%"; Hit description =Glycoside transferase, six-hairpin, subgroup
MEDRKSLLKKQRQGSFTCNHRLYSRYLYLVYCFQIEKFLPLITSNICSLTTSNLQWKYCITIITSPNHDYIFLEAQRSGKLPSNNRVPWRGDSALDDGKLVNVDLVGGILRCRGQCEIWSPNGFHRYYASMGGAIFYKSEFKAANELDNIHDAIGWGIDYFLKASSRHKRLYVETIEGCMSIHGGISQLYGSITLLNF

SEQ ID NO: 117658 - protein, 62 aa, Glycine max
  Coding DNA Sequence Number=SeqID_880
MAKPHHQIQRVKLRIIKMPMSGKENCNFRNGAESMNHQANYLMLLNADSLRTKHESLAVEVP

SEQ ID NO: 117659 - protein, 390 aa, Glycine max
  Coding DNA Sequence Number=SeqID_881
  Gene Ontology: Mol. function=signal transducer activity; Cellular component=heterotrimeric G-protein complex; Biological process=G -protein coupled receptor protein signaling pathway
  Homolog annotation: Hit_ID=P49084; Match level="QueryCoverage=99%, HitCoverage=100%, E-value=1e-170, Identity=78%"; Hit description =Guanine nucleotide-binding protein alpha-1 subunit
  Pfam annotation: Domain name=G-alpha; Domain location=12-389; Score =401.2; E_value=1.5e-117; Accession=PF00503.10; Description=G-protein alpha subunit
MGLVCSRSRRFREADAEENAQDAEIERRIELETKAEKHIQKLLLLGVFYLVLESLGSLQYLSRQEIASSQLLIKLLFQTGFDEAELKSYIPVVHANVYQTIKVLHDGSKELAQNDFDSSKYVISNENQDIGEKLSEIGGRLDYPRLTKELAQEIETLWEDAAIQETYARGNELQVPDCAHYFMENLERLSDANYVPTKEDVLYARVRTTGVVEIQFSPVGENKRSGEVYRLFDVGGQRNERRKWIHLFEGVTAVIFCAAISEYGLPYGNKCCVRYDQTLYEDENKNRMMETKELFEWVLRQPCFEVPLNVCEWFKDYQPVSTGKQEIEHAYEFVKKKFEELYFQSTAPDCVDRVFKIYQATALDQKLVKKTFKLVDETLRRRNLFEAGLL

SEQ ID NO: 117660 - protein, 922 aa, Glycine max
  Coding DNA Sequence Number=SeqID_882
  Gene Ontology: Cellular component=nucleus
  Homolog annotation: Hit_ID=Q1RSV5; Match level="QueryCoverage=78%, HitCoverage=96%, E-value=0.0, Identity=61%"; Hit description =Quinonprotein alcohol dehydrogenase-like
  Pfam annotation: Domain name=WD40; Domain location=145-186; Score =38.1; E_value=3e-08; Accession=PF00400.22; Description=WD domain, G -beta repeat
  Pfam annotation: Domain name=WD40; Domain location=303-341; Score =20.4; E_value=0.0064; Accession=PF00400.22; Description=WD domain, G- beta repeat
  Pfam annotation: Domain name=WD40; Domain location=532-571; Score =8.4; E_value=3.8; Accession=PF00400.22; Description=WD domain, G -beta repeat
  Pfam annotation: Domain name=WD40; Domain location=588-625; Score =13.5; E_value=0.76; Accession=PF00400.22; Description=WD domain, G -beta repeat
  Pfam module annotation: Pfam domain module=WD40::WD40::WD40::WD40; Domain location=145-186::303-341::532-571::588-625
MSINSESTPPPVIGKIGPYTVFMTPPSTPKPADDNPVTTTKIAPPPPQIPKAVPSPKPKPLSDSDDSVFGFFRNAVAKVQTAHSSLDDHLARWFGLNQSKYQWALDDYYESKGVYEKEKEEEKVFVVTWTPSPRSTVSIFSTGTGSLVSSLEGHTASVTAVVVVPSSTGLSYCWTASVDGTIRHWDFSVPECVNIIDLCLPIFSMVVPSILSPREENGKTPPNVIAYVSVQGIKAPPDNPTKPLYGQIRKCNLTHFRSVSNLIMKETERPESLTISPSGNFLGIKDKRKLHIWAVPKKDSDSAVSKKIILHHTKTLTVLAFHPTERTVAAGDVTGRILIWHEFGAQKFLSSSGLINGRSTDQENKDGVRQNDDAESSVTRHWHSSGVSCLSFSSDGAFLYSDNQMLILKKPSKPMEIISCISGIKPPLSSQDICEGLSSRVAFDCTSGLLAVQTENYAIQFYSLFANREVYEVQVCERNHQPVDEVTVVVSLVELSVDGSMMGTVDVKLPEDGIGGFICLKFWDLDDNKRFSLSTLIYEPHRDAHISAVAFHPTRPMAVSTSYGGDFKIWVCKEEIQQNGQMVRNSGWKCHAVGSYKNKAMRAAAFSADGSVLAVAADTVITLWDPNNNVLIAVIGETPMPITRLVFAGKSDYLLSVCHGSKPQLSVWSMSKLAASWSYRLQIEAVSSAIDLSYFAVLALLPKSNECTFKGDGIILLFKVTDPVPVASWSVTKAKGGRLAFIQGDPFERAVIDGKPTQTLLAYINGDHEYVIFHPSGRKACELSMTKQDDLAFEETGQFGYASIYGELPKFDLKRKMDSSISSAASASKRPWETIFSGLSQSLPPLTKLCSEFLESLLEKRTATRSRGLWTGLEVKIFECSLQEWCKHYLLPAAGKDGTTKISALNGWLDVLGWGENFDSNE

SEQ ID NO: 117661 - protein, 73 aa, Glycine max
  Coding DNA Sequence Number=SeqID_883
  Gene Ontology: Mol. function=hydrolase activity; Biological process =aromatic compound metabolic process
  Homolog annotation: Hit_ID=Q1SQL8; Match level="QueryCoverage=83%, HitCoverage=23%, E-value=6e-11, Identity=52%"; Hit description =Alpha/beta hydrolase fold
MLDREKTMNILGPEKQSLPEALPGSDPRVWARGHVAVVPQVKFLAPHFNLVFFGGSHTKERNVSGNVGGQALR

SEQ ID NO: 117662 - protein, 665 aa, Glycine max
  Coding DNA Sequence Number=SeqID_884
  Gene Ontology: Mol. function=scavenger receptor activity; Cellular component=membrane; Biological process=regulation of transcription, DNA-dependent
  Homolog annotation: Hit_ID=Q2PQA6; Match level="QueryCoverage=97%, HitCoverage=99%, E-value=0.0, Identity=64%"; Hit description=ZTL
  Pfam annotation: Domain name=F-box; Domain location=251-299; Score =32.0; E_value=2e-06; Accession=PF00646.23; Description=F-box domain
  Pfam annotation: Domain name=Kelch_1; Domain location=348-398; Score =21.9; E_value=0.0024; Accession=PF01344.15; Description=Kelch motif
  Pfam annotation: Domain name=Kelch_1; Domain location=401-448; Score =16.1; E_value=0.059; Accession=PF01344.15; Description=Kelch motif
  Pfam annotation: Domain name=Kelch_1; Domain location=453-501; Score =5.0; E_value=1; Accession=PF01344.15; Description=Kelch motif
  Pfam annotation: Domain name=Kelch_1; Domain location=506-557; Score =3.6; E_value=1.5; Accession=PF01344.15; Description=Kelch motif
  Pfam annotation: Domain name=Kelch_1; Domain location=572-620; Score =10.6; E_value=0.24; Accession=PF01344.15; Description=Kelch motif
  Pfam annotation: Domain name=Kelch_2; Domain location=348-396; Score =11.2; E_value=1.3; Accession=PF07646.5; Description=Kelch motif
  Pfam annotation: Domain name=Kelch_2; Domain location=401-448; Score =23.8; E_value=0.0006; Accession=PF07646.5; Description=Kelch motif
  Pfam annotation: Domain name=Kelch_2; Domain location=452-498; Score =12.4; E_value=0.88; Accession=PF07646.5; Description=Kelch motif
  Pfam annotation: Domain name=Kelch_2; Domain location=506-557; Score =38.6; E_value=2.1e-08; Accession=PF07646.5; Description=Kelch motif
  Pfam annotation: Domain name=Kelch_2; Domain location=572-620; Score =33.1; E_value=9.6e-07; Accession=PF07646.5; Description=Kelch motif
  Pfam module annotation: Pfam domain module=F-box::Kelch_1::Kelch _1::Kelch_1::Kelch_1::Kelch_1::Kelch_2::Kelch_2::Kelch_2::Kelch _2::Kelch_2; Domain location=251-299::348-398::401-448::453-501::506 -557::572-620::348-396::...
  Pfam module annotation: Domain location=401-448::452-498::506 -557::572-620
MEWDSNSDLSGDEEEEGFVFNDADDAGPLPFPFPVVENLLQTAPCGFVVTDALDPDHPIIYVNTVFEIVTGYCAEDVLGRNCFVHTCNFCPGLRSESIGKVCGVFLWVLQQSVRSIFPFKTSSWTNGNSNRFLQCRGPFAKRRHPLVDSTVVSEIRRCLEEGIEFQGELLNFRKDGSPLMNRLRLTPIYGDDETITHVIGIQFFTEANIDLGPVPGSTIKESAKSSDRFRSVLSSLQTLPVGDRNVSRGVCGIFQLSDEVLSLKILARLTPRDIASVSSVCRRLYELTKNEDLWRMVCQNAWGSETTRVLETVPGARGLGWGRLARELTTLEAAAWRKLTVGGAVEPSRCNFSACAVGNRVVLFGGEGVNMQPMNDTFVLDLNSSNPEWQHVHVSSPPPGRWGHTLSCVNGSHLVVFGGCGRQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGPLRFRSSDVFTMDLSEEEPCWRCVTGSGMLGAGNPGGTAPPPRLDHVAVSLPGGRILIFGGSVAGLHSASQLYILDPTDEKPTWRILNVPGCPPRFAWGHSTCVVGGTRAIVLGGQTGEEWMLSELHELSLASSAI

SEQ ID NO: 117663 - protein, 58 aa, Glycine max
  Coding DNA Sequence Number=SeqID_885
MDEANGVVAITARPEKRVAQLRFGSLAKVEKRRCYFLPHTSNTVRARREVVRILTSPS

SEQ ID NO: 117664 - protein, 47 aa, Glycine max
  Coding DNA Sequence Number=SeqID_886
MVGKRGRWLPPSSLRRAGMLPPEGTTFCWNILEGPSGLDCYLHTPVY

SEQ ID NO: 117665 - protein, 69 aa, Glycine max
  Coding DNA Sequence Number=SeqID_887
MSRNLTDCATILSWTSGMLQNFTDCATMLPFDFRHVAELHGLPNDGYQVPRSGQAKVASHQTDGPRTKL

SEQ ID NO: 117666 - protein, 85 aa, Glycine max
  Coding DNA Sequence Number=SeqID_888
  Subcellular localization annotation: CTP_CleavageSite=55; ConfidenceScore=5.20e-01
MGPSRGFWAFPCLRWKQPSSLGRAELAWATWAATTSPVFVKKLSIGASRTPVMISAFSKQVCFWRKPPCSSGQAGRQPPPPFSYK

SEQ ID NO: 117667 - protein, 312 aa, Glycine max
  Coding DNA Sequence Number=SeqID_889
  Gene Ontology: Mol. function=transporter activity; Biological process= transport
  Homolog annotation: Hit_ID=Q40YE5; Match level="QueryCoverage=94%, HitCoverage=54%, E-value=2e-16, Identity=24%"; Hit description =Extracellular solute-binding protein, family 5 precursor
DVPVARREEHFAEGGGVDRGDADVDAEVLPRGLGELCGCVAGVAELGGVDHPQRERLSVLRPDPVGAGGPPRLVERGGGRVRVVLRKVPRDGVGAARVGRDGDEAGRDRGLAAADHLTHLLQVERLHQRFADSLVGGGATVGLVEGERAAGGLEVGVEQPGVLHARGIRADHQRRVDLAGEQQVGGGGLVGDDAEDDRVGQSLLVRVPVAGAPREVVASGQRVLAVRHDLGHGEHAGRPFALGQRVRIVDHRAADDRDAADVLQQERVGTATGDRDRARLVVPHGRRSRLHLQPDQGRPVRGIADVGDVRGD

SEQ ID NO: 117668 - protein, 50 aa, Glycine max
  Coding DNA Sequence Number=SeqID_890
MWDRHRLKGTLKSGVFTPKAYTSKNPLGPLPPDSDIAHELYNTYNFTLVF

SEQ ID NO: 117669 - protein, 96 aa, Glycine max
  Coding DNA Sequence Number=SeqID_891
MFKEECKEVSVSSKSLAKKKRHFEIKKNTKKVSPLRQPPHFLLCKKTLVSIATPLGLEFIPQVKELLNEDLVPKSLNPYAFFNTNLGMLDKWPQIS

SEQ ID NO: 117670 - protein, 362 aa, Glycine max
  Coding DNA Sequence Number=SeqID_892
  Gene Ontology: Biological process=regulation of GTPase activity
  Homolog annotation: Hit_ID=Q84T71; Match level="QueryCoverage=93%, HitCoverage=84%, E-value=2e-98, Identity=58%"; Hit description =Putative zinc finger protein
  Pfam annotation: Domain name=ArfGap; Domain location=7-87; Score= -16.0; E_value=0.0006; Accession=PF01412.9; Description=Putative GTPase activating protein for Arf
MSGKPLAGESRKLLNRKKTKKIDRSTNLDSWSPEQLKTMSFGGNNRAHGFFKQHGWTDGGKIEAKYTSRAADLYRQILSKEVAKSMAEDGGLPSSPVASQSAQGVNGLPEVKTNEVPKENTLEKPEKPESTSSPRASHSVISGTVKKPIGAKKAVKSGGLGARKLTKKPSESLYEQKPEEPPAPVPSSTNSMPAGPSPTSRFEYVENVQSSDLNTGGSHVLSHVSPPKSSSFFADFGMDGGFPKKSGPSSSKVQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 117671 - protein, 70 aa, Glycine max
  Coding DNA Sequence Number=SeqID_893
  Gene Ontology: Mol. function=GTPase activator activity; Cellular component=cytosol; Biological process=regulation of GTPase activity
  Homolog annotation: Hit_ID=Q45NI2; Match level="QueryCoverage=95%, HitCoverage=46%, E-value=5e-29, Identity=88%"; Hit description=Zinc finger Glo3-like protein
  Pfam annotation: Domain name=ArfGap; Domain location=10-69; Score =29.9; E_value=7e-08; Accession=PF01412.9; Description=Putative GTPase activating protein for Arf
MASDGFTDKNTVFRKLKAKSENKMCFDCNAKNPTWASVTYGIFLCIDCSAVHRSLGVHISFVRQVFADFV

SEQ ID NO: 117672 - protein, 128 aa, Glycine max
  Coding DNA Sequence Number=SeqID_894
QFSLKIVSALLGTLNESLFFSLTKLPSQGVPFEGTIVDDWKFDYSSHDAHRMWIRKQDLPPLILDERTPSPPPQRVDSSSLLTEVLTELRGLRAFVGERFDVMDTRLDAMDAHFDGMDTRGSLVSKMI

SEQ ID NO: 117673 - protein, 383 aa, Glycine max
  Coding DNA Sequence Number=SeqID_895
  Gene Ontology: Mol. function=prenyltransferase activity; Cellular component=integral to membrane
  Homolog annotation: Hit_ID=Q58FG4; Match level="QueryCoverage=79%, HitCoverage=80%, E-value=1e-154, Identity=85%"; Hit description =Homogentisate phytylprenyltransferase
  Pfam annotation: Domain name=UbiA; Domain location=108-359; Score= -13.3; E_value=0.0012; Accession=PF01040.9; Description=UbiA prenyltransferase family
MVIDTNIQHFGALGSYVPNASWHNRKIQKEYNFLRFRWPSLNHHYKGIEGACTCKKCNIKFVVKATSEKSLESEPQAFDPKSILDSVKNSLDAFYRFSRPHTVIGTALSIISVSLLAVEKISDISPLFFTGVLEAVVAALFMNIYIVGLNQLSDVEIDKINKPYLPLASGEYSFETGVTIVASFSILVPLLRWKRFAVLAAMCILAVRAVIVQLAFFLHMQTHVYKRPPVFSRPLIFATAFMSFFSVVIALFKDIPDIEGDKVFGIQSFSVRLGQKPVFWTCVTLLEIAYGVALLVGAASPCLWSKIFTLANISIWQTCLPSCAVIFYCMSDNIKRESLNTTVQILKLASPLAGKGEATFIYPPPEPTRVLCHLAIVFFTVVF

SEQ ID NO: 117674 - protein, 142 aa, Glycine max
  Coding DNA Sequence Number=SeqID_896
  Gene Ontology: Mol. function=identical protein binding; Biological process=negative regulation of enzyme activity
  Homolog annotation: Hit_ID=Q2HV71; Match level="QueryCoverage=75%, HitCoverage=17%, E-value=1e-27, Identity=64%"; Hit description =Protease-associated PA; Proteinase inhibitor I9, subtilisin propeptide
MNNQLRIQLEVGVSYIPRYIDGNNNKDDSGNGSIKEVNIILRGGIVYQTKINYTIRFNVTTSHSKRASILKCVSIIPDWIWSLEYGQRDFCCNQCRCYSSYTPIRSLDKKTFVSILAEGLFGTKVATTLETGAITSAFKILG

SEQ ID NO: 117675 - protein, 93 aa, Glycine max
  Coding DNA Sequence Number=SeqID_897
MRKNFLSINLESSKTFVMWHSRIQRCRYHHLLKSLEEYLVKLLVVFLIVEFGQENHHYHYLTRDTDHPPTVQPSCPVLQPSSCPVSWVLSELV

SEQ ID NO: 117676 - protein, 49 aa, Glycine max
  Coding DNA Sequence Number=SeqID_898
MYICGSCCMWHFYSEKTESDPVLAAIQTVWSISLLSNLECFNWYAMEPG

SEQ ID NO: 117677 - protein, 67 aa, Glycine max
  Coding DNA Sequence Number=SeqID_899
MGALLIVPPIEIPLPLVLANASAPRYMYVSPSYLSSSLDHILPDVNVPIGDFLELSWSRGSGDLAFA

SEQ ID NO: 117678 - protein, 120 aa, Glycine max
  Coding DNA Sequence Number=SeqID_900
  Gene Ontology: Mol. function=dihydrodipicolinate reductase activity; Cellular component=cytoplasm; Biological process=lysine biosynthetic process via diaminopimelate
  Homolog annotation: Hit_ID=Q1S0J3; Match level="QueryCoverage=77%, HitCoverage=30%, E-value=1e-35, Identity=81%"; Hit description =Dihydrodipicolinate reductase
  Pfam annotation: Domain name=DapB_C; Domain location=2-103; Score= -6.1; E_value=5.3e-06; Accession=PF05173.4; Description =Dihydrodipicolinate reductase, C-terminus
MDLPSADANQIANNLSNLGQIYNGEDPSTDGLKERGQVLGDGIRVHSMVLPELPSSTTIHFYSPGEVYSIKHDIIDVKCLMPGLLLAIRKVVHLKFVGKHYVEGLKRSNKRKTHRPQTAF

SEQ ID NO: 117679 - protein, 54 aa, Glycine max
  Coding DNA Sequence Number=SeqID_901
  Subcellular localization annotation: CTP_CleavageSite=35; ConfidenceScore=5.11e-01
MASTKSMFMSFAILLLLALFSATVSAQGSPTPAPDAGAAGSVSSSASVIGHRGK

SEQ ID NO: 117680 - protein, 179 aa, Glycine max
  Coding DNA Sequence Number=SeqID_902
  Pfam annotation: Domain name=DUF1723; Domain location=45-98; Score =43.2; E_value=9.2e-10; Accession=PF08330.1; Description=Protein of unknown function (DUF1723)
MSREYGDGSNDELSSLSFGSSNNQQYQEQPLAPGGFINPLKARHTKDTFTFVPALMIFLSFWSIATNTFVFPFRFMTITLQDIATILGLPIIGDEIPSLFDQPVEDLGLDHHVLSNVAKQPKSTKELDCHANDPTLRKSLQIKSTTLVMTHFFIEVIFDILDNVGALWNPPIVDHVVLD

SEQ ID NO: 117681 - protein, 60 aa, Glycine max
  Coding DNA Sequence Number=SeqID_903
MTKAHQKGYGKPKNEEERMKNDEERLKIFAKSPTETSRKRYGSASGWIFFTEIIFLTNFK

SEQ ID NO: 117682 - protein, 144 aa, Glycine max
  Coding DNA Sequence Number=SeqID_904
  Subcellular localization annotation: CTP_CleavageSite=55; ConfidenceScore=5.16e-01
LDPEASAAGSGVTGSSSVGIDYNGVPSTAGVASLSSCSKGWLDINVDPNTPSSTVASVDSRLAWIQHYYLYARGTAGARAGFVTQQLSFTSSTASNSMIAGWNPIAGMSTTPYQFFFVGAGANFSDLEAKAKAENAYHIIILVQ

SEQ ID NO: 117683 - protein, 82 aa, Glycine max
  Coding DNA Sequence Number=SeqID_905
AANEYARQGEVAVATKDDVELFAEVGDAIHSKHELHCSRGAAFVSSANVDAANEYARQGEVVVATEDGVELVAEVGDAIVRP

SEQ ID NO: 117684 - protein, 176 aa, Glycine max
  Coding DNA Sequence Number=SeqID_906
  Gene Ontology: Mol. function=oxidoreductase activity
  Homolog annotation: Hit_ID=Q1XLB4; Match level="QueryCoverage=99%, HitCoverage=51%, E-value=1e-64, Identity=68%"; Hit description=Zinc -containing alcohol dehydrogenase superfamily
  Pfam annotation: Domain name=ADH_zinc_N; Domain location=2-141; Score= 92.6; E_value=1.2e-24; Accession=PF00107.16; Description=Zinc-binding dehydrogenase
MADEYVVVIGVGGLGHVALQILREISGAEIIACDVTEDKLAFARELGASYTINSKDADAAEQIKKITGIKKAKVVLDFVGATSTIELGTKVVSLDGDLTIVGLGGGHYQYNMSGLPFGVSMTNPYWGSRVELMEVVGLARQKKIHIEIEKYKLDQANEVYDRLREGKIKGRAVLIP

SEQ ID NO: 117685 - protein, 249 aa, Glycine max
  Coding DNA Sequence Number=SeqID_907
  Gene Ontology: Mol. function=chitin binding; Cellular component =extracellular region; Biological process=chitin metabolic process
  Homolog annotation: Hit_ID=UPI000044A8F0; Match level="QueryCoverage =55%, HitCoverage=99%, E-value=3e-22, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHILTFRGPRTLTFRGLHVLAFRGLHVLAFRGLHVLAFRGLHVVAFRGLHVLAFRGPHALAFRGLHILTFRGLHVLAFRGLHVLAFRGLHVLAFRGLHTLTFRGLHVLTFRGLHALAIRGLHVLAFRGLCIPGHPVDPEEPNRALGFPALVMGLCQSYRVPVPPSKGSRPQDTQWARRSPTGSWGARRDTTTAWGWSAVSNKRTSATSKAPKLIYKNWSVAYDPWSTSRRPSPKPK

SEQ ID NO: 117686 - protein, 35 aa, Glycine max
  Coding DNA Sequence Number=SeqID_908
MASKRSPTKARRSRSSVGTSVRREVESALYGGGNG

SEQ ID NO: 117687 - protein, 123 aa, Glycine max
  Coding DNA Sequence Number=SeqID_909
MGEVEEVKEHIKANMEAIKEQMATMMEAMMSMKKIIEVNAAAVTATSAIAEVDSIPPSGLNQINPPTSDMVGQGGKELGTGRVPPAMAEKGKLDQIEERLRAIEGSEDYGFVDCRSKLHDESS

SEQ ID NO: 117688 - protein, 141 aa, Glycine max
  Coding DNA Sequence Number=SeqID_910
  Gene Ontology: Mol. function=RNA-directed DNA polymerase activity; Cellular component=chromatin; Biological process=RNA-dependent DNA replication
MAPEDMEKTTFVTLLGTFFYKVMSSGLKNAGATYQRAMVALFYNMMHKEIEVYMDDMIAKSKTEEEHLVNLHKLFQRLCKYRLRLNPTKCNFEVMLGKLFGFIVSQKRIEMDLDKVKAILEMSEPRTEKQVRAFLGHLPIP

SEQ ID NO: 117689 - protein, 319 aa, Glycine max
  Coding DNA Sequence Number=SeqID_911
MGCPLKILRKNLTTLAQTWSVLSFSNLAPTSHTSDITLDRARLIYGIIQKMDMNLGYIISSQISMIAQHDSSRLDFPTLITALCKARGVTSDSLSFESLNPAINLAYVKKNCWNLDDPSVTFRGPCKAMGNRSETLLSSKIPPLAAPSTIVPASFAPSASAPLPAPIITPPTGPSSFTSETLYAMLQSLHKGQVIIMKHLQSSGLQPMMSVKEFLSQVAWPGVQPSPSGGDKASAAQEPVLEDDEPVPPEPFVYETDPTSAQEEVASPEPVPHPSPAPVLDDSQPFAPAPVPDQPLAQDPPAAPVLDLNEHAEDHLQND

SEQ ID NO: 117690 - protein, 126 aa, Glycine max
  Coding DNA Sequence Number=SeqID_912
MNDLTIESDHSSVYDFLEPQSIHNAKDKHHECQDYITRLLKQSQREIYLGAYLNNTLKEFHGKSLKSKFDVDWIELKILDVVLGGLLSSDYGRGDYYGHGQSTTTTIKSRVLNLHKFVLFSTLSLN

SEQ ID NO: 117691 - protein, 192 aa, Glycine max
  Coding DNA Sequence Number=SeqID_913
  Gene Ontology: Mol. function=sequence-specific DNA binding; Cellular component=nucleus; Biological process=regulation of transcription, DNA-dependent
  Homolog annotation: Hit_ID=Q9VJ37; Match level="QueryCoverage=58%, HitCoverage=24%, E-value=2e-58, Identity=96%"; Hit description =CG10619-PA, isoform A
  Pfam annotation: Domain name=Arc_trans_TRASH; Domain location=88-127; Score=1.6; E_value=0.059; Accession=PF08394.1; Description=Archaeal TRASH domain
  Pfam annotation: Domain name=LIM; Domain location=88-148; Score=64.9; E_value=2.6e-16; Accession=PF00412.12; Description=LIM domain
  Pfam module annotation: Pfam domain module=Arc_trans_TRASH::LIM; Domain location=88-127::88-148
  Subcellular localization annotation: CTP_CleavageSite=61; ConfidenceScore=5.56e-01
MQLQLQMKTRNIESRRQMTNSSAVGKKQSSFRLLWTKTTSIPLRWLWRSNTRSVYLTRCTRSGMACGVPEVPGVPAISGRKLLFGTKCDKCGNSFSKNDFVMRAKTKIFHIECFRCSSCARQLLPGDEFALRDGGALYCKEDHDMLEKSSQSSLTSSSVESNNNISSSNNNNTNLSNNNHSSELGSMSGENT

SEQ ID NO: 117692 - protein, 209 aa, Glycine max
  Coding DNA Sequence Number=SeqID_914
  Homolog annotation: Hit_ID=Q5CDC4; Match level="QueryCoverage=20%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSISDTLMTKRMKRVDGTLSGLCRPWRSLFILLVIRVSDKGGPLRKPCIIVTMAIDVHQAYRYRRPRGGARYQLLFPLVRVNFELGVIMVIAVSCVKLLSAHNSTQHTSRKHKV

SEQ ID NO: 117693 - protein, 169 aa, Glycine max
  Coding DNA Sequence Number=SeqID_915
  Homolog annotation: Hit_ID=Q9M508; Match level="QueryCoverage=30%, HitCoverage=11%, E-value=4e-07, Identity=63%"; Hit description=Beta -ketoacyl-ACP synthetase I
MDNHNTGLTHTLAQRASSHPYHEEGLNNEGANCVLYVIALQGRVYLLSPGLTSHLSSSSRVIKIISLSKITNYKIPSILSLPRLLSSSSPTPKPPREPPVQAATPSRLQRTTWPSAIITLRGSPLNPLQAPTMPPPSDAPPLRSACSSCPLRWRRRCPPRSGRRTQRST

SEQ ID NO: 117694 - protein, 92 aa, Glycine max
  Coding DNA Sequence Number=SeqID_916
  Gene Ontology: Mol. function=oxidoreductase activity; Biological process=lignin catabolic process
  Homolog annotation: Hit_ID=Q9ZPY2; Match level="QueryCoverage=61%, HitCoverage=10%, E-value=1e-22, Identity=75%"; Hit description =Putative laccase
  Pfam annotation: Domain name=Cu-oxidase_3; Domain location=19-92; Score=40.9; E_value=2.4e-09; Accession=PF07732.5; Description =Multicopper oxidase
MGFKRGGCVFFPTTKRGSAIGPVVYQYDTFQCYYDRIIVKVTNMTPFNVTIHWHGVRQRLSCWYDGPSLITECPIQAGQSFTYNFTVVQQKC

SEQ ID NO: 117695 - protein, 142 aa, Glycine max
  Coding DNA Sequence Number=SeqID_917
  Homolog annotation: Hit_ID=Q1SP03; Match level="QueryCoverage=75%, HitCoverage=19%, E-value=2e-09, Identity=33%"; Hit description=IMP dehydrogenase/GMP reductase
MQAFRKIYGMILKLSIAEISIEVIASLTQYYDQPLRCFTFGDFQLVPTIEEFEEILGCPLRGRKPYLSSGCLPSLSRIATVVKDSARGLDHIKQTRNGIAGLPRRYLEDKARGMANQGDWVPFMDVWFGGPSSNRRFPCIPP

SEQ ID NO: 117696 - protein, 129 aa, Glycine max
  Coding DNA Sequence Number=SeqID_918
  Subcellular localization annotation: CTP_CleavageSite=34; ConfidenceScore=5.16e-01
MFNILRWSSTTIVEKGKNTKRAYPRTSLKRRVVRAGEGESTVRTKRLKLPNTKTDGVIISSGLQRSMHIERIIKMHRFWDATVGVARMPMVYQVKTHWSTINYLTKWGTTELDIKHNQLLEVKTNLDDY

SEQ ID NO: 117697 - protein, 610 aa, Glycine max
  Coding DNA Sequence Number=SeqID_919
  Gene Ontology: Mol. function=RNA-directed DNA polymerase activity; Cellular component=chromatin; Biological process=chromatin assembly or disassembly
  Pfam annotation: Domain name=zf-H2C2; Domain location=321-358; Score =17.5; E_value=0.0017; Accession=PF09337.1; Description=His(2)-Cys(2) zinc finger
  Pfam module annotation: Pfam domain module=RVT_1::zf-H2C2; Domain location=6-171::321-358
MMLSITTSLCFRIMIPPPGTSSRHLHPADQLQSMLDYTGTLITRSRKSNLRALNALTMRDRFQIPTIDELLNKLRAFRTHHGHYEFKVMPFGLCNAPSSFQATMNMIFRPYLHRFIIIFFDYMLIYSVSIDEHLKHLELTFQPLASKVATIQQWPVPRTTKAVRSLLGLAGFYRRFIQKYVTIAAPLVKAMTKEPLQWTSETQEAFDTLKHALSIAPVLALLDFDLPFTRQVTSIINVCARAARDYDDHQKMASILTWLMGYDYQIHYRFGAHNQVADALSRLSEQEPSISMILSVPCQIWLPWDLPMITTLLREYHATPTRRHAKIAKTIARISENFYWPSLRSDVTQFIATCLDCQCTKYETKKLVGLLCPLPGVHLGMLPIAHTAYIVASLFLELVVKIHGVQASMKDQVDTRRRDVNYHPGEWVLLKLRPHRQSTAKGSQAFSGKLAKRFYGPFQIIERIGKVDYRLQLLAEARIHSVFHCSMLKPFRRDPKDTTATLLGPIIDHQPVIALMAILDYRRTTPPPNAAWEDNVFFQGPQSDKEEELAGIETWVAKHAEIIVAEDHPRWSELDGDIKFLSENNDSVAAPALKQSTIVGPYTSVSPSPN

SEQ ID NO: 117698 - protein, 117 aa, Glycine max
  Coding DNA Sequence Number=SeqID_920
MGQMKHWVVVQCDVSGGGGPAVAGGEGDGGVSEKKKIRGKGHNPVHEIQSIKQTKIKSKRRLEIFCLLRKIDTNHPALVVMEILIIKITAYDIHGHMQLAPKLLQDHPRWSELDWRH

SEQ ID NO: 117699 - protein, 61 aa, Glycine max
  Coding DNA Sequence Number=SeqID_921
MYAGKLNSFRLNVTSYDTKNKVAFSKSGTERKKKEEILKQAQSNRGAKRASGAKRATNCRR

SEQ ID NO: 117700 - protein, 186 aa, Glycine max
  Coding DNA Sequence Number=SeqID_922
MKADMEALKDQMTSMMEAMLSMKQMMESNADAIAATSATIEADPTHPSAINQANQPIPDIVAQGGEGQQPQPIGGTHEEPQDHAQVDFEPYPAFATERPTCSVEGREKLDLIKEKLRVVERFGDYPFADMAELCLVPDIVVPLKFKRREALDAFLSRKLGRSGGHLVYKSRSFLNSLMEGLDTYLH

SEQ ID NO: 117701 - protein, 183 aa, Glycine max
  Coding DNA Sequence Number=SeqID_923
MRGGGCTAACPGELLASSRSNLACPGELLNSACENPNVGKRSSPDEIRNLIRSVGVQNAMDFAKVSKSRAITHTVAFAKVVKSNHQPSFMVGSALSKLLHTRLDGYELFERCKGLQLEKIDLIGKVEGIAVERDELAKVVAELEAHEVSSRKVHYFSTSAEWEKDALSRNPLMSAKRFRIALS

SEQ ID NO: 117702 - protein, 161 aa, Glycine max
  Coding DNA Sequence Number=SeqID_924
  Homolog annotation: Hit_ID=UPI0000661253; Match level="QueryCoverage =58%, HitCoverage=92%, E-value=6e-07, Identity=32%"; Hit description =Homolog of Homo sapiens "Dentin sialophosphoprotein precursor
RHDKNAVFDGVGSKTLLKWRQDFGNVGGKAMTKDLFALGFDKPVELHQGLPRIDLGFCEPVRLIKSPCRTLAYMSLRGVVCTRDMVSCLCINVIRGVVYTRDVMRFSCIRVTYGVGCIRDMVACSYIHVTCGMTCTGDMVTGGVGRIGHRWRALAYVSLVK

SEQ ID NO: 117703 - protein, 125 aa, Glycine max
  Coding DNA Sequence Number=SeqID_925
  Gene Ontology: Mol. function=RNA-directed DNA polymerase activity; Biological process=RNA-dependent DNA replication
CVCVFVSLCVMRVCLCACVFMCDEGGVCVCVRGRQLLHGVLVANEVVEEECVCVCVWGCLTSASISILVNGSPTSEFNPQRGLRQRDPLAPLLFDLVAEGLSGMMKEATIQDCFQSFFLGKNKDP

SEQ ID NO: 117704 - protein, 217 aa, Glycine max
  Coding DNA Sequence Number=SeqID_926
  Gene Ontology: Mol. function=phospholipase C activity; Cellular component=membrane; Biological process=intracellular signaling cascade
  Homolog annotation: Hit_ID=Q10JM3; Match level="QueryCoverage=97%, HitCoverage=56%, E-value=1e-86, Identity=71%"; Hit description=MAP3K- like protein kinase, putative, expressed
MEPALDTLKEIEAFLSANPTEIVTLILEDYVDAPNGLTKVFTDAGLMKYWFPLPSMPRNGQDWPLVSDMVAKNQRLLVFTSIASKEQSEGIAYQWNFMVENQYGDGGRKAGSCPNRAESSPLNDKSKSLVLVNYFRSTPIKPITCEDNSGELINMLQTCFGAAGNRWANFVAVDYYKRSEGGGSFQAVDTLNGKLLCGCDDVHTCVPGSTSEACSQS

SEQ ID NO: 117705 - protein, 140 aa, Glycine max
  Coding DNA Sequence Number=SeqID_927
MLNRDLHSRLRTSSFLLTVPGPPPDIGGGPSVRAQPEREAITQLLCIPRQDFTRAAAKRRGSHPQRHPVDLKKSNRALGFPALVTGLCQPYRAPVPPSKFMSSWHRECLSPLARSSGPPTNRAFIKKYCAPRQAQGETPQ

SEQ ID NO: 117706 - protein, 72 aa, Glycine max
  Coding DNA Sequence Number=SeqID_928
MARKGVEVTQESDVGGSTGGGEGCWKGGKGKEDSGVGRERGKGKCGEGEGSHWKRRGVKKWKRQHGKGKVIE

SEQ ID NO: 117707 - protein, 331 aa, Glycine max
  Coding DNA Sequence Number=SeqID_929
  Gene Ontology: Mol. function=phospholipase C activity; Cellular component=membrane; Biological process=intracellular signaling cascade
  Homolog annotation: Hit_ID=Q10JM3; Match level="QueryCoverage=98%, HitCoverage=94%, E-value=1e-121, Identity=61%"; Hit description =MAP3K-like protein kinase, putative, expressed
MSSLPGLLVVILPLFYNVAAACSDGTCKLLDECSSDGDCGTGLYCFSCPFGFLGSRCVRSTVTNQFKLINNSLPFNKYAFLTTHNAYAIDGEPSHTGVPRVTFTNQEDSVTQQLNEPALDTLKEIEAFLSANPTEIVTLILEDYVHAPNGLTKVFTDAGLMKYWFPLTSMPRNGQDWPLVSDMVAKNQRLLVFTSIASKEQSEGIAYQWNFMVENQYGDGGRKAGSCPNRAESSPLNDKSKSLVLVNYFRSTPIKPITCEDNSGELINMLQTCFGAAGNRWANFVAVDYYKRSEGGGSFQAVDTLNGKLLCGCDDVHTCVPGSTSEACSQS

SEQ ID NO: 117708 - protein, 793 aa, Glycine max
  Coding DNA Sequence Number=SeqID_930
  Gene Ontology: Mol. function=nucleotide binding; Cellular component =membrane; Biological process=defense response
  Homolog annotation: Hit_ID=Q8W3K3; Match level="QueryCoverage=99%, HitCoverage=99%, E-value=2e-97, Identity=29%"; Hit description =Putative disease resistance protein At1g58400
  Pfam annotation: Domain name=LRR_1; Domain location=489-513; Score =0.6; E_value=2.2e+02; Accession=PF00560.23; Description=Leucine Rich Repeat
  Pfam annotation: Domain name=LRR_1; Domain location=515-536; Score =4.1; E_value=48; Accession=PF00560.23; Description=Leucine Rich Repeat
  Pfam annotation: Domain name=LRR_1; Domain location=660-685; Score =5.0; E_value=33; Accession=PF00560.23; Description=Leucine Rich Repeat
  Pfam annotation: Domain name=LRR_1; Domain location=732-754; Score =11.4; E_value=2.1; Accession=PF00560.23; Description=Leucine Rich Repeat
  Pfam annotation: Domain name=NB-ARC; Domain location=139-413; Score =140.9; E_value=3.5e-39; Accession=PF00931.13; Description=NB-ARC domain
  Pfam module annotation: Pfam domain module=LRR_1::LRR_1::LRR_1::LRR _1::NB-ARC; Domain location=489-513::515-536::660-685::732-754::139 -413
MVEAVVSFAVERLHDLLTEEARLLIGVSDKVKRMQNELKRMQCFLRDAERKQDKNDTIKNYISEVRKLAYDAEDVTEIYAIKVALGISIGTKNPLTKTKHLHKVGTELTSINSRIDDLTRSLQNYGFIATEDNEEVSEVQRQLRWSYSHIVEEFIVGLDKDIDKVVEWLLNENHHCQFVYICGMGGLGKTTLAKSIYHYNAIRRNFDGFAWAYISQKCKKRDVWEGILLKLISPTKEERDEIKNMTDDELARKLFKVQQDKKCLIILDDIWSNEAWDIGKAAYNIPPPYLRIAKSLWAMGYEVFLRASPGAAVKLCLGDLLVMGSNPETASLHMQGEMVAKCAGLPLTIIVLGGLLATKERVSDWATIGGEDLPCQLKPCFLYLSQFPEDSEIPRTKLIQLWVAEGVVSSQYETERDETMEDVAERYLDARRIDEVRRLAVFLDQRVDQLIPQDKQVNEHLRSLVFFHDKKCRMENWDLVKGVFVEFKLLRVLDLEGIKGLKGQSLPKEVGNLLWLKFLSLKRTRIQILPSSLGNLENLQFLNLQTVNKVSWDSTVEIPNVICKLKRLRHLYLPNWCGNVTNNLQLENLTNLQTLVNFPASKCDVKDLLKLKKLRKTDMLSFPENVVDVEKLVLGCPFLRKLQVEGRMERLPAASLFPPQLSKLTLWGCRLVEDPMVTLEKLPNLKFLNGWDMFVGKKMACSPNGFPQLKVLVLRGLPNLHQWTIEDQAMPNLYRLSISDCNNLKTVPDGLKFITTLRELEIRWMPKSFKTRLGTAGEDYHKVQHVPSIVFLN

SEQ ID NO: 117709 - protein, 337 aa, Glycine max
  Coding DNA Sequence Number=SeqID_931
  Gene Ontology: Mol. function=protein serine/threonine kinase activity; Cellular component=membrane; Biological process=protein amino acid phosphorylation
  Homolog annotation: Hit_ID=Q10LW0; Match level="QueryCoverage=88%, HitCoverage=32%, E-value=4e-57, Identity=41%"; Hit description =Protein kinase family protein, putative, expressed
  Pfam annotation: Domain name=Pkinase; Domain location=48-325; Score =19.7; E_value=9.8e-10; Accession=PF00069.15; Description=Protein kinase domain
  Pfam annotation: Domain name=Pkinase_Tyr; Domain location=48-325; Score=36.5; E_value=1e-14; Accession=PF07714.7; Description=Protein tyrosine kinase
  Pfam module annotation: Pfam domain module=Pkinase::Pkinase_Tyr; Domain location=48-325::48-325
MGLFPLLSCFSINDPGENRLLGTTTFNILEELCTHFSLAEIKSAVRNIKKPSVIGEDSFGVVYKGYLKKGATTVAIKWFRKGSLSGLSESQLKNEVLFLCQLHHPNIMPLIGFCIERDHPHLILVHEYMLNGALSDHLHPKSNHKVDPLPWKRRLQICIGVARGLHYLHTGGKCSVIHNFFKTCYILLDQIWEPKISGLLLSKRGSIDVANSSLVARNHDTFAYCDPEYLATGILTVKSNVFSFGVVLLEVVSAKQGKDLFLERNRLMNDEPKYSLELQTEKIVDPFIKSRIAPDCWKAFVDITERCLHKQGMERPNMGEVEMQLELALQLQEEAET

SEQ ID NO: 117710 - protein, 123 aa, Glycine max
  Coding DNA Sequence Number=SeqID_932
  Gene Ontology: Mol. function=catalytic activity; Biological process =alkaloid metabolic process
  Homolog annotation: Hit_ID=Q9C979; Match level="QueryCoverage=66%, HitCoverage=19%, E-value=6e-24, Identity=63%"; Hit description =Putative alpha/beta hydrolase; 66690-68793
MEGRVKEVSKKIGILFILSCYLCQLCGENGVNVDDLETNHIVLVHGGGFGAWCWYKSIALLEESGYKVAAIDLTGSGVSSFDTNIITSLSQYVKPLTDFLEKLPEGKKVNFQGEKLRNGYSHG

SEQ ID NO: 117711 - protein, 135 aa, Glycine max
  Coding DNA Sequence Number=SeqID_933
  Gene Ontology: Mol. function=hydrolase activity, hydrolyzing O -glycosyl compounds; Cellular component=membrane; Biological process =carbohydrate metabolic process
  Homolog annotation: Hit_ID=Q8RZK0; Match level="QueryCoverage=44%, HitCoverage=21%, E-value=2e-21, Identity=73%"; Hit description=Beta 1,3-glucanase-like
MEKLASGNSVCEKSWFQSHSRYGMWLHAHYHFRLLYKLVQVGVLQVQLLRRLLYKLHWTMLVALVVLIAQQFNLVEAVTTQIPSGTMLLMPLISIIKIIISTVVIISTNPKVTDGSEDNDDGDNSGGVGEMVVVE

SEQ ID NO: 117712 - protein, 353 aa, Glycine max
  Coding DNA Sequence Number=SeqID_934
  Gene Ontology: Mol. function=rRNA methyltransferase activity; Cellular component=nucleus; Biological process=regulation of transcription, DNA-dependent
  Homolog annotation: Hit_ID=P36929; Match level="QueryCoverage=99%, HitCoverage=82%, E-value=1e-139, Identity=70%"; Hit description =Ribosomal RNA small subunit methyltransferase B (EC 2.1.1.-) (rRNA (cytosine-C(5)-)-methyltransferase)
  Pfam annotation: Domain name=MTS; Domain location=161-322; Score= -87.9; E_value=0.034; Accession=PF05175.4; Description=Methyltransfera se small domain
  Pfam annotation: Domain name=Nol1_Nop2_Fmu; Domain location=99-353; Score=356.9; E_value=3.3e-104; Accession=PF01189.8; Description =NOL1NOP2sun family
  Pfam annotation: Domain name=NusB; Domain location=2-64; Score=-18.3; E_value=0.041; Accession=PF01029.9; Description=NusB family
  Pfam module annotation: Pfam domain module=MTS::Nol1_Nop2_Fmu::NusB; Domain location=161-322::99-353::2-64
MARPLTGKQRVLHYLIMVGLYQLLYTRVPPHAALAETVAGAEALKRANLKGLLNGVLRQFQRQQDALLAEVNQGPQRYWHPGWLLKRLQTAWPEQWQQIVEANNQRPPMWLRVNRQHHSRDAWLALLTQQNQNAFSADAPDALRLEAPAPVSQLPGFEQGWVTVQDLSAQRCALLLAPENSETILDLCAAPGGKTTHILEIAPQARVMAVDIDAQRLSRVTENLQRLGMQADVRQGDGRTPAAWCDEQQFDRILLDAPCSATGVIRRHPDIKWLRRDRDIDELAALQREILAAIWPRLKSGGTLLYATCSVLPQENQQQIDAFLATHDDAVPQALPHGQLNGWQVFPAINGGD

SEQ ID NO: 117713 - protein, 234 aa, Glycine max
  Coding DNA Sequence Number=SeqID_935
  Subcellular localization annotation: CTP_CleavageSite=32; ConfidenceScore=5.19e-01
QPLRSLAHILATDVQLSGHCQLSGPCLAKQPMASRKRKSIGTRSTTQYDTRRFSSLDAWTKYTDNVLGRNILPEKKVEIYHSELDEFKAELERRNFHKCLTNLVDGSINLALVKEFYANLYSSEDNPPKQSSVREGHPGKILRKDLTTLAQSNTSRLGFPALITALCRAKGVVSDSLTFECLSPVINLAYIRKNCWNPEDLTISIQGARRARARPAKLSAASTPASTSAAPSVP

SEQ ID NO: 117714 - protein, 64 aa, Glycine max
  Coding DNA Sequence Number=SeqID_936
MKSCVKVALRKSTLHLYFDCKFFFKVDGVKLEVVGERYRKLQLRNKNPLGKRNTSKISSKHITS

SEQ ID NO: 117715 - protein, 76 aa, Glycine max
  Coding DNA Sequence Number=SeqID_937
  Homolog annotation: Hit_ID=Q7XYV8; Match level="QueryCoverage=79%, HitCoverage=59%, E-value=2e-09, Identity=47%"; Hit description=Seed specific protein Bn15D89A
MTKVSKLQKTTMKQGGVGIDVRTEIRRQSTREFEIFQERWNQAISEDKTWVDPFKSDQRRIRKQRDTQRLSKHFIS

SEQ ID NO: 117716 - protein, 333 aa, Glycine max
  Coding DNA Sequence Number=SeqID_938
  Gene Ontology: Mol. function=protein binding; Cellular component =integral to membrane; Biological process=defense response to fungus
  Homolog annotation: Hit_ID=Q1SWI6; Match level="QueryCoverage=69%, HitCoverage=93%, E-value=2e-41, Identity=42%"; Hit description =Leucine-rich repeat, plant specific
  Pfam annotation: Domain name=LRRNT_2; Domain location=27-67; Score =53.2; E_value=8.4e-13; Accession=PF08263.3; Description=Leucine rich repeat N-terminal domain
  Pfam annotation: Domain name=LRR_1; Domain location=115-140; Score =9.5; E_value=4.7; Accession=PF00560.23; Description=Leucine Rich Repeat
  Pfam annotation: Domain name=LRR_1; Domain location=142-164; Score =13.4; E_value=0.83; Accession=PF00560.23; Description=Leucine Rich Repeat
  Pfam annotation: Domain name=LRR_1; Domain location=166-191; Score =8.1; E_value=8.9; Accession=PF00560.23; Description=Leucine Rich Repeat
  Pfam annotation: Domain name=LRR_1; Domain location=193-215; Score =14.4; E_value=0.41; Accession=PF00560.23; Description=Leucine Rich Repeat
  Pfam annotation: Domain name=LRR_1; Domain location=244-265; Score =11.9; E_value=1.7; Accession=PF00560.23; Description=Leucine Rich Repeat
  Pfam annotation: Domain name=LRR_1; Domain location=270-292; Score =7.9; E_value=9.7; Accession=PF00560.23; Description=Leucine Rich Repeat
  Pfam annotation: Domain name=LRR_1; Domain location=294-319; Score =2.0; E_value=1.2e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=27-67::115-140::142 -164::166-191::193-215::244-265::270-292::294-319
MNSSIIYILVFVQLWLLSLPCRESVCIPSERETLLKFKNSLNDPSNRLWSWNHNHTNCCHWYGVLCHNLTSHLLQLHLHSSPSAFDDGYIASDEEAYRRWSFGGEISPCLADLKHLNYLDLSGNYFLEKGMSIPSFLGTMTSLTHLNLSYTGFMGKIPSQIGNLSKLRYLDLSVNYLLGEGMAIPSFLGAMSSLTHLDLSDTGFMGKIPSQIGNLSNLVYLDLGNYFSEPLFAENVEWVSSMWKLEYLDLSYANLSKAFHWLHTLQSLPSLTHLYLSNCTLPHYNEPSLLNFSSLQTLHLSATSYSPAISFVPKWIFKLKKLVSLQLPDNEIQ

SEQ ID NO: 117717 - protein, 266 aa, Glycine max
  Coding DNA Sequence Number=SeqID_939
  Homolog annotation: Hit_ID=Q8H767; Match level="QueryCoverage=81%, HitCoverage=60%, E-value=4e-81, Identity=66%"; Hit description =Lysine ketoglutarate reductase trans-splicing related 1
  Pfam annotation: Domain name=DUF707; Domain location=44-266; Score =179.6; E_value=7.7e-51; Accession=PF05212.3; Description=Protein of unknown function (DUF707)
MSIMHALLNDMYSCAGWSNLFPHAFVYICNYQIDKKSSSWGEPKVYPTTSGNLKGLPQGIVHANSDLELKPSWSTSSSRSKAVFSNRNLLAVPVGIKQKHNVDVMVQKFLQENFTIILFHYDGEVDGWWNLDWSSNVIQIVARNQTKWWFAKRFLHPNIVSIYDFIFLWDEDLGVEHFSPSRYIEIIKQEGLEISQPALDPHSTEIHHRITIRSITKKFHRRVYERRKRRARCSDSSEEPPCTGFVEGMAPVFSRSAWYCTWHLIQ

SEQ ID NO: 117718 - protein, 231 aa, Glycine max
  Coding DNA Sequence Number=SeqID_940
  Gene Ontology: Mol. function=hydrolase activity, acting on ester bonds
  Homolog annotation: Hit_ID=Q00XC3; Match level="QueryCoverage=91%, HitCoverage=89%, E-value=3e-11, Identity=26%"; Hit description=[E] KOG2551 Phospholipase/carboxyhydrolase
  Pfam annotation: Domain name=FSH1; Domain location=6-228; Score= -13.7; E_value=1.7e-06; Accession=PF03959.4; Description=Serine hydrolase (FSH1)
MEDHESQRKLRILCLHGFRTSSEILKQLVLRWPEPVLQKLNFVFLDGQFLAQGRSDVEGIFDPPYYEWFQANEDFTEYTNFEECLVYIEDYMLKNGPFDGLLGFSQEYCLQGAVLAAALLGLQAQGVALGKVNKIKFLIVISGAKFGGRKYGMPKLAANPYSKQMDCPSLHFIGEKDFAKPDSIALLEAFKDPMVIHHPKGHTVPRLDDKGLQTMLGFINTIQTRKTCSRL

SEQ ID NO: 117719 - protein, 124 aa, Glycine max
  Coding DNA Sequence Number=SeqID_941
  Subcellular localization annotation: CTP_CleavageSite=11; ConfidenceScore=5.13e-01
MGMKLKTVKPRIAMAGSRLAAAPTPSAKRVTGRRLQDRRLRIWSVNPHCAHCGVLTVYPNGFELDHRVPLHCGGSDTDDNCQVLCVEVDAQARVARGPPARRGSSRGARVPRSAIAQQRACGGP

SEQ ID NO: 117720 - protein, 81 aa, Glycine max
  Coding DNA Sequence Number=SeqID_942
MSVIELYIENDVTSGSLDEDDIVDDISDTDDEVTHMIESLTIVQPREGVEGIHNPFWNDVLHYNNINWGHPDEENICVKMR

SEQ ID NO: 117721 - protein, 55 aa, Glycine max
  Coding DNA Sequence Number=SeqID_943
MDAEFIERCVPRGLLEWGFNINQGSKFKVVKWILVKYFTYQRPLESERIKAICIQ

SEQ ID NO: 117722 - protein, 96 aa, Glycine max
  Coding DNA Sequence Number=SeqID_944
MDLNGKVLTNDDNKEIPDAVNILIFTIAQHFIDDLSLWKDREDSQQPSWKEKFLVGLPRSLGDKKVALKIYQDDKIQRQLAKEKAQTKRDLGSFCE

SEQ ID NO: 117723 - protein, 81 aa, Glycine max
  Coding DNA Sequence Number=SeqID_945
MEEGGPQRPKQMKDVVTSRWFILRALHEAGMISFDGHKGDSCLIHPGAMHDMETCPTVEELFQGMIDKGMFEVYGARKGEQ

SEQ ID NO: 117724 - protein, 217 aa, Glycine max
  Coding DNA Sequence Number=SeqID_946
MLLVFALPIGKGCLARFSTPVMHDGHDYLWLSSESVLVGDGNIGDALLYGSRCFVGWLSFENAAVGWHGCLNVAVLIGSFARATTQGWIFTNACCRCPPHKWVAVQIRPAQVGGGANNAVLLHCFWLDNDAPSRALRTAGRVSGAWCARACRIPARAATATCARLFNRRFKCALIGVGFLVRRGMDHEASVVFHIPDVTVPGLLAHGGTLDLSDAEN

SEQ ID NO: 117725 - protein, 745 aa, Glycine max
  Coding DNA Sequence Number=SeqID_947
  Gene Ontology: Mol. function=protein binding; Cellular component =integral to membrane; Biological process=defense response to fungus
  Homolog annotation: Hit_ID=Q1SWI7; Match level="QueryCoverage=87%, HitCoverage=97%, E-value=1e-172, Identity=39%"; Hit description =Leucine-rich repeat
  Pfam annotation: Domain name=LRR_1; Domain location=103-125; Score =8.9; E_value=6.1; Accession=PF00560.23; Description=Leucine Rich Repeat
  Pfam annotation: Domain name=LRR_1; Domain location=127-150; Score =10.7; E_value=2.9; Accession=PF00560.23; Description=Leucine Rich Repeat
  Pfam annotation: Domain name=LRR_1; Domain location=152-175; Score =8.1; E_value=8.6; Accession=PF00560.23; Description=Leucine Rich Repeat
  Pfam annotation: Domain name=LRR_1; Domain location=2-24; Score=8.8; E_value=6.4; Accession=PF00560.23; Description=Leucine Rich Repeat
  Pfam annotation: Domain name=LRR_1; Domain location=200-222; Score =2.8; E_value=86; Accession=PF00560.23; Description=Leucine Rich Repeat
  Pfam annotation: Domain name=LRR_1; Domain location=225-247; Score =7.6; E_value=11; Accession=PF00560.23; Description=Leucine Rich Repeat
  Pfam annotation: Domain name=LRR_1; Domain location=249-270; Score =5.1; E_value=32; Accession=PF00560.23; Description=Leucine Rich Repeat
  Pfam annotation: Domain name=LRR_1; Domain location=26-48; Score=9.0; E_value=5.9; Accession=PF00560.23; Description=Leucine Rich Repeat
  Pfam annotation: Domain name=LRR_1; Domain location=298-317; Score =11.6; E_value=1.9; Accession=PF00560.23; Description=Leucine Rich Repeat
  Pfam annotation: Domain name=LRR_1; Domain location=322-344; Score =8.8; E_value=6.3; Accession=PF00560.23; Description=Leucine Rich Repeat
  Pfam annotation: Domain name=LRR_1; Domain location=346-368; Score =9.6; E_value=4.7; Accession=PF00560.23; Description=Leucine Rich Repeat
  Pfam annotation: Domain name=LRR_1; Domain location=370-393; Score =11.5; E_value=2; Accession=PF00560.23; Description=Leucine Rich Repeat
  Pfam annotation: Domain name=LRR_1; Domain location=395-417; Score =11.2; E_value=2.2; Accession=PF00560.23; Description=Leucine Rich Repeat
  Pfam annotation: Domain name=LRR_1; Domain location=419-441; Score =12.2; E_value=1.5; Accession=PF00560.23; Description=Leucine Rich Repeat
  Pfam annotation: Domain name=LRR_1; Domain location=491-513; Score =7.6; E_value=11; Accession=PF00560.23; Description=Leucine Rich Repeat
  Pfam annotation: Domain name=LRR_1; Domain location=50-72; Score =19.7; E_value=0.011; Accession=PF00560.23; Description=Leucine Rich Repeat
  Pfam annotation: Domain name=LRR_1; Domain location=515-537; Score =15.1; E_value=0.25; Accession=PF00560.23; Description=Leucine Rich Repeat
  Pfam annotation: Domain name=LRR_1; Domain location=539-561; Score =17.0; E_value=0.068; Accession=PF00560.23; Description=Leucine Rich Repeat
  Pfam annotation: Domain name=LRR_1; Domain location=563-584; Score =6.8; E_value=15; Accession=PF00560.23; Description=Leucine Rich Repeat
  Pfam annotation: Domain name=LRR_1; Domain location=74-96; Score =13.6; E_value=0.73; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =103-125::127-150::...
  Pfam module annotation: Domain location=152-175::2-24::200-222::225 -247::249-270::26-48::298-317::322-344::346-368::370-393::395 -417::419-441::491-513::50-72::515-537::539-561::563-584::74-96
MILQNLDLSGNSFSSSIPDCLYGLHRLKSLEIHSSNLHGTISDALGNLTSLVELHLSNNQLEGTIPTSLGNLTSLFALYLSYNQLEGTIPTFLGNLRNSREIDLTILNLSINKFSGNPFESLGSLSKLSSLWIDGNNFQGVVKEDDLANLTSLTVFDASGNNFTLKVGPNWIPNFQLTFLDVTSWQIGPNFPSWIQSQNKLLYVGLSNTGILDSIPTWFWEAHSQLLYLNLSHNHIHGELVTTIKNPISIQTVDLSTNHLCGKLPYLSNDVYDLDLSTNSFSESMQDFLCNNQDKPMQLEFLNLASNNLSGEIPDCWINWPFLVKVNLQSNHFVGNIPPSMGSLADLQSLQIRNNTLSGIFPTSLKKTGQLISLDLGENNLSGCIPTWVGEKLSNMKILRLRSNSFSGHIPNEICQMSLLQVLDLAKNNFSGNIPSCFRNLSAMTLVNRSTHPGIYSQAPNDTQFSSVSGIVSVLLWLKGRGDEYGNILGLVTSIDLSSNKLLGKIPREITDLNGLNFLNLSHNQLIGPIPEGIGNMGSLQTIDFSRNQISGEIPPTISNLSFLSMLDVSYNHLKGKIPTGTQLQTFDASSFIGNNLCGPPLPINCSSNGKTHSYEGSHGHGVNWFFVSATIGFILGFWIVIAPLLICRSWRGRVAERKEGKDRRCGEMKLRITNTNTKMLYLLVAVVCFFPNCANARRQMGEIKSSGMVAPGPVHSLQFTSISPQPFDAMELSDEPAVSPFPQY

SEQ ID NO: 117726 - protein, 186 aa, Glycine max
  Coding DNA Sequence Number=SeqID_948
  Homolog annotation: Hit_ID=Q9SWB3; Match level="QueryCoverage=81%, HitCoverage=34%, E-value=6e-65, Identity=81%"; Hit description=Seed maturation protein PM39
MSRVKKKRKVSGKDTLESSGSQSWKSKVSGTQTSSVGVEQDKGVSVKDYLVDKLRPGDEDRALSEVISETLHKKELPPVEVTEEGVRKVVSDAVHKRDDDPERRMEHQRILGKVTESEEVKRRLGGESVVTEKKYQEMYVNSPGKGVVDKFKGMVGTWFTNPAENQSSQVDCKGSNLETASLHMQG

SEQ ID NO: 117727 - protein, 302 aa, Glycine max
  Coding DNA Sequence Number=SeqID_949
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-35, Identity=29%"; Hit description= UPI00006A17C9 related cluster
HTFRGLHVLAFNGPHAFTFVGLHALTIGGLHIVAFIGLHALVFRGLHILPFRGLSVLTFRGLQVLGFRGLHVLTFKGHHVLDFRGQHVLTFRRLHILALRGPHALAFVGLRVLSFRGLHVLDFRGLHILTFRGLHVLTFRGLHTLAFKRLHALAFRGLHDLAFRRLDILAFRVLDVLALTTTNPHLQRATLPRLGGLRALAFRGLRALAFRGLRALAFNGQQVLTFRGLHIPPFRGLHALTFGGLHVLAFKGLHALAFRGLHVLAFRVLQALAFIGLHVLAFVGLHALAFRGSHVDAILPPK

SEQ ID NO: 117728 - protein, 131 aa, Glycine max
  Coding DNA Sequence Number=SeqID_950
MATIATTTMIINHCPHQHDYCTNSGGDDHLGDEDGDHDNNHGGDEDSGVGGGCSDNLDLLVVVSFPSRAPCGRLGYCIERVFCRFFLITVVRLLETSSMGWIPCSGYSGTKNKVEKMEAQDSLVGQIKATP

SEQ ID NO: 117729 - protein, 94 aa, Glycine max
  Coding DNA Sequence Number=SeqID_951
MFSGLDLNQEGEALTNSSKSRLGGRQDTILDEDMFKSKGKDPLEGLGGPMTRARARKAKEALQQVLSILFEYKPKFQGEKSKVVSCIMAQMEED

SEQ ID NO: 117730 - protein, 107 aa, Glycine max
  Coding DNA Sequence Number=SeqID_952
  Subcellular localization annotation: CTP_CleavageSite=91; ConfidenceScore=5.59e-01
MKKIQGLQAPHGATSLVRPPDIVPTSCPPPTEARPCSSHVNARRPSPVPTSTPSSSSIDACGPSSIPTSTPSPSPAIANMPIDEDATNLVVEAPLNGRPMVTLINEA

SEQ ID NO: 117731 - protein, 71 aa, Glycine max
  Coding DNA Sequence Number=SeqID_953
  Gene Ontology: Mol. function=protein serine/threonine kinase activity; Cellular component=membrane; Biological process=protein amino acid phosphorylation
  Homolog annotation: Hit_ID=Q1SQP1; Match level="QueryCoverage=54%, HitCoverage=8%, E-value=2e-10, Identity=71%"; Hit description =Protein kinase
MYDLIICYFQLRHSHSVTWQLQLEIFELNVFWEREALVEYMPLGCLEDHLHDIPPGKKQLDWNTQMKIAAG

SEQ ID NO: 117732 - protein, 107 aa, Glycine max
  Coding DNA Sequence Number=SeqID_954
MMHEELTNNDYSGRYKVIARGLIWEVVMQGHKVEVRKSEILKSIYWALKWAQINNNKETLLQLLSSFPVTQTSKNPFTTREARFYIGYLGHTTLVYDRRHREHRKKG

SEQ ID NO: 117733 - protein, 53 aa, Glycine max
  Coding DNA Sequence Number=SeqID_955
MEMKGFLRGTPGCIQFIGVRNPDDVKSREVEPQRQKDEEMKKREERSLECEIR

SEQ ID NO: 117734 - protein, 137 aa, Glycine max
  Coding DNA Sequence Number=SeqID_956
MQKGSQTELIDVEMEDQLEDMIHDLGEESFKQEHSSMYDTLESDSKKPLYLGCKKSLRLLSAVLSLVNVKVKYGWSDESFTSSFSDGRNYDGMLRHPTESSKWKKINRLNPNFGKEERNLRLGPVIDGMNPYGSLST

SEQ ID NO: 117735 - protein, 323 aa, Glycine max
  Coding DNA Sequence Number=SeqID_957
  Gene Ontology: Mol. function=nucleic acid binding; Biological process= DNA integration
  Homolog annotation: Hit_ID=Q1SRN1; Match level="QueryCoverage=77%, HitCoverage=13%, E-value=5e-10, Identity=28%"; Hit description =Integrase, catalytic region
MDPISIKLGDDNYSTWKAEALGKIEERNLEKFFTETDFGGMPPMFSEEYSSWEEQDQVLYRWLLDSLSTKLLHQLERCKHALELWMEIEVYFLDKQIEELHKKYESLKEERFMLQLICMNLSLECPETSNEDKTIEEELIKEHGPESLADILSVKPGTSGSEMDPISIKLNDDNFSTWKAEALGKIKERNLEKFITMTDLGGRPPMFSEEYKSWKEQDQGLCRWLLSSLSTKLLHRLERCEYALELWMEIKVYFLDLEIEELTKQHNSNLEENAMLELMRSKTHANAEECPETSNENEAIEEERETESAADILTMKRGTSGSA

SEQ ID NO: 117736 - protein, 67 aa, Glycine max
  Coding DNA Sequence Number=SeqID_958
PKIYPKTHENLRTFSCISGPIFLESSIECSWGICVALGQCAADYMEWFYMISHDVNLLEKLLGRLDL

SEQ ID NO: 117737 - protein, 105 aa, Glycine max
  Coding DNA Sequence Number=SeqID_959
MWRRPTASAPKQRQQERVVKDPPTAAEELHEERQEAPIEDPPTDVEGFLGRPRDTSILRDYEIHIALRIWNRELSFHGRNMAKFRRPAPKIEGFVAASGLSPLIA

SEQ ID NO: 117738 - protein, 119 aa, Glycine max
  Coding DNA Sequence Number=SeqID_960
  Subcellular localization annotation: CTP_CleavageSite=37; ConfidenceScore=5.28e-01
MTSKLQMLITFATVVRLRPTIYQNAQNSKENPDKGIRLSSFSTQGLCPSPLGPSSFSTWTFSLYLASFRILITITLDDMASLLHFPIIGAFHSFEQLHVNDAIKILVELLEVSFVDARA

SEQ ID NO: 117739 - protein, 97 aa, Glycine max
  Coding DNA Sequence Number=SeqID_961
MSEISRKITPCNPHTPAQALDKAHPQLLKGPNPPMLSVRQPAHICDGQSITTCPVRCSCDSLHMRLRRQPPGSTWGRLLRGNSPSITTTLTQVAKSV

SEQ ID NO: 117740 - protein, 58 aa, Glycine max
  Coding DNA Sequence Number=SeqID_962
MKDCKNTSDLHTAKSLKTLKTLITMRCLHMSSDLSSPDDEGADNHEVSPRAIGLAVSV

SEQ ID NO: 117741 - protein, 128 aa, Glycine max
  Coding DNA Sequence Number=SeqID_963
  Subcellular localization annotation: CTP_CleavageSite=36; ConfidenceScore=5.14e-01
MAFPYPLPLPMCLHRKWLPRSSPRRDVDRHRISALSAALSSACLSARLALSSNPLTRAKSEGDTKHNIAYSEPVLCKIRVGKRFAQNSRAHHSAYFGKRALEETRGATFAEIPRFFCNGGLNTLVGDF

SEQ ID NO: 117742 - protein, 125 aa, Glycine max
  Coding DNA Sequence Number=SeqID_964
  Homolog annotation: Hit_ID=Q1S0F5; Match level="QueryCoverage=63%, HitCoverage=16%, E-value=1e-09, Identity=42%"; Hit description=IMP dehydrogenase/GMP reductase
MGSSQMPSLKKRFYQVKVKSIGITSLKELGQLMGQLQRQAFRKAYEKGRANWDQLLASKEGAYVNWFPRWKEGRTGFLISCGGFPNVPLMGTRGCISYNPVLAIRQLGYPMRGAPLGDELAPVIS

SEQ ID NO: 117743 - protein, 211 aa, Glycine max
  Coding DNA Sequence Number=SeqID_965
  Gene Ontology: Mol. function=oxidoreductase activity; Cellular component=membrane; Biological process=metabolic process
  Homolog annotation: Hit_ID=Q9FDK2; Match level="QueryCoverage=88%, HitCoverage=74%, E-value=8e-70, Identity=65%"; Hit description=3 -oxoacyl-(Acylcarrier protein) reductase
  Pfam annotation: Domain name=KR; Domain location=28-192; Score=-69.8; E_value=0.0026; Accession=PF08659.1; Description=KR domain
  Pfam annotation: Domain name=adh_short; Domain location=27-191; Score= 82.1; E_value=1.7e-21; Accession=PF00106.15; Description=short chain dehydrogenase
  Pfam module annotation: Pfam domain module=KR::adh_short; Domain location=28-192::27-191
PTGLFGASGDQRAERRSAGGLMRFDNKVVVITGAGNGMGEAAARRFSAEGAIVVLADWAKEAVDKVAASLPKGRAMAVHIDVSDHVAVEKMMNEVAEKLGRIDVLLNNAGVHVAGSVLETSVDDWRRIAGVDIDGVVFCSKFALPHLLKTKGCIVNTASVSGLGGDWGAAYYCAAKGAVVNLTRAMALDHGGDGVRINSVCPSLVKTNMTN

SEQ ID NO: 117744 - protein, 314 aa, Glycine max
  Coding DNA Sequence Number=SeqID_966
  Homolog annotation: Hit_ID=Q1SR88; Match level="QueryCoverage=41%, HitCoverage=31%, E-value=4e-12, Identity=32%"; Hit description=IMP dehydrogenase/GMP reductase
  Pfam annotation: Domain name=DUF674; Domain location=1-266; Score= -254.0; E_value=5.3e-06; Accession=PF05056.3; Description=Protein of unknown function (DUF674)
MIILWQKVQIHWIQNIFVTCTYDMYIFSILKHALTSKSPLSDVFIPNRKKIEPSYSFSPDTGPSHWKGSVEIKLMVSKSKNKVLFAEADGDFVDFLVSFLTTPLGSILNLMNGKSSLGSIDNLYASVKKLNASWFIGSSNKSLLNPRVAPQFGCGSNPLNASQEYTPTYWYGTVVVKDNNEGRTMISKKKEMLQYPAKLKLFEPRCYDGAREAAVGFMKRPCLFVVSDDLKVRQLTTTSSIQYMQELGNVKFDDLKEHMVEIRKSHEALNLLRTSLTSKEVGLTRSLLKKWKCQRCIPFWDSILGCVGMEENET

SEQ ID NO: 117745 - protein, 276 aa, Glycine max
  Coding DNA Sequence Number=SeqID_967
  Homolog annotation: Hit_ID=Q1SR88; Match level="QueryCoverage=32%, HitCoverage=20%, E-value=2e-07, Identity=35%"; Hit description=IMP dehydrogenase/GMP reductase
  Pfam annotation: Domain name=DUF674; Domain location=1-267; Score= -110.9; E_value=6.4e-14; Accession=PF05056.3; Description=Protein of unknown function (DUF674)
MASNQEATIPLRYWVDNEQKRVVMAEASGDFVDVLFSFLTLPLGTIIRLGNQFQQPVQIGCINNLYESVQNLRPDVFWNNICQKMLLAPRNPLEASYQRLKVKVDGTEPTKKLMRKKMELLEESKDEASGVDGVFVKGDAMFLIFDDLTVLRSSPSDSLQTPLLFGHTDFSNMQEMSQDVGPREKVQIHWIQNIFVTCTYDLCMYIFSILKHALTSKSPLSDVFIPNRKKIEPSYSFSPDTGPSHWKGSVEIKLMVSKSKNKVLFAEADGDFVDFL

SEQ ID NO: 117746 - protein, 119 aa, Glycine max
  Coding DNA Sequence Number=SeqID_968
MKIKKRTKERKEGFPIKDRKEVKRGKEATLDQRKEENRKSPKPDCHSESFLTGNIPPHMNKEEKTETPSFLSKNADLEKILLISPMFPLRVCPPPQKLTSYPSFSVTRKITLGASILFL

SEQ ID NO: 117747 - protein, 44 aa, Glycine max
  Coding DNA Sequence Number=SeqID_969
MDSGRFHEIGMLGDGCPSDLGASSPLVLIEIWHLELRRDNDIRH

SEQ ID NO: 117748 - protein, 203 aa, Glycine max
  Coding DNA Sequence Number=SeqID_970
MGEEKEMLDPNVVGRSVPQCCRCNELEERCKKAEVRCEELGFELQKKKEHCEELGAKVMALEGEKFEFEDKVKVLSKGLERLKEVSGGEIKPIVDLAEDNDKVLQCEKIRAESEVEVWKDKYKKLESWALQFGMGRDGDEENGKEQESKPISNEGNLHLDTSFGFWQNLEKVAALGNKKIGDIQSVEVLNDFNQLFYRTAILS

SEQ ID NO: 117749 - protein, 34 aa, Glycine max
  Coding DNA Sequence Number=SeqID_971
MGEMLATQLAQASKVASFRSNRLLEDLLEGPSGP

SEQ ID NO: 117750 - protein, 125 aa, Glycine max
  Coding DNA Sequence Number=SeqID_972
MGSLDGHSLTGEGGEYLEGAKAIVSLSRDRALSEYHPLSEAAARLASKRNLEGNLSCQHALNVSLARLARSLSLLALSTPSSLSQNPLTRAKRENGAKRTFELKGDILPWKAKPPSLGNPAWNLM

SEQ ID NO: 117751 - protein, 125 aa, Glycine max
  Coding DNA Sequence Number=SeqID_973
MKNVEERLKIFAKIPTETLRKPYGSASAWIFWRNLLEESSGGTLGEQGGFLQKQPPSRGIFWRAQNLTIGATMLPFEFRHVTELHELPNDGCQIPQNGQMKVACHQAKVSLHMMSHMLEMERLSL

SEQ ID NO: 117752 - protein, 38 aa, Glycine max
  Coding DNA Sequence Number=SeqID_974
MVTSNSLNERWAPYGIKHTTLGSDISYKLPCRAFRCLI

SEQ ID NO: 117753 - protein, 80 aa, Glycine max
  Coding DNA Sequence Number=SeqID_975
MSGVRVLEIGEKGETCEGISEEGSKREACPYKEKLLHLIDGRVVVEDMDTKSQELDMMEKLSLESVNDTKGEEDRITTRK

SEQ ID NO: 117754 - protein, 59 aa, Glycine max
  Coding DNA Sequence Number=SeqID_976
MDEEHWMYDSIMSEEVDMKVENEEDVGMKVEYVDCSNPFNTFQFYIGLDWWLMTLDLLP

SEQ ID NO: 117755 - protein, 261 aa, Glycine max
  Coding DNA Sequence Number=SeqID_977
  Gene Ontology: Mol. function=protein binding; Cellular component =nucleus; Biological process=ethylene mediated signaling pathway
  Homolog annotation: Hit_ID=Q2PQJ1; Match level="QueryCoverage=52%, HitCoverage=25%, E-value=1e-35, Identity=52%"; Hit description=EIN3 -binding F-box protein 1
HGRAHKEDRHAYATQHSHAQEHDHAHMVKKQLIFTKYGHATHQGMLLDEHDDEHECIRQGFLTVVVSNVVECRFIYDDGSKTVLVCDTLKDDCEFETVFECDTFKDDYNVGTVLECDTFKDVTNEVYIDKSSLTIMQKGEKTNIIYGIEFSQIKMLKSKRLARRKHRHFHIDIFDSHALHKGKRELYFDVCEGNNNPGLSEPVVFLQHQALKRYYNFGKCNQSIVRNKATPAKAQLLQVDATLTNDLYACINYSPTGSNSK

SEQ ID NO: 117756 - protein, 201 aa, Glycine max
  Coding DNA Sequence Number=SeqID_978
MATLLGRVPHGREREFWDLGEKRLTNKRKQLGKIGIPTIIVQKPGLIGTLWYNWASLVIGPAMHLAWYDLARPDRFCANSMTRPIFKSRIGFLREKKEVEKKALTRSPSNIVFSFPSRALCGRLGYCIERVFCRFFLITVVRLLETSSMGWIPCSGYSGTKNKVEKMEAQDSLVGQIKATPDIRPGKKQLDWNTQMKIVAG

SEQ ID NO: 117757 - protein, 92 aa, Glycine max
  Coding DNA Sequence Number=SeqID_979
MSVPAIPIPILMATVDVDAIVSSGVPEGLPHEVLAAVFGTDTTVVRGGKGKAAAGGLRWEREEQGRPLCGERHDKLLHREGKSLRKYMSFFL

SEQ ID NO: 117758 - protein, 82 aa, Glycine max
  Coding DNA Sequence Number=SeqID_980
MEKTKPVGILESRHDKRVRGKGSRGLHVIAPSLEELQQTYLYILNNNNEVLLYIVRLEALVKENLKKLAYQNEPFIMTEQAK

SEQ ID NO: 117759 - protein, 80 aa, Glycine max
  Coding DNA Sequence Number=SeqID_981
MVETNQINTKRGVKDKAPNTLPMKGLFVTKLESNEVLLSPIALKVVGPLLLDSNSSRDGTNPPSNSLYGNPQTRKQRDKQ

SEQ ID NO: 117760 - protein, 51 aa, Glycine max
  Coding DNA Sequence Number=SeqID_982
MARPHNSLGDGRQQATDAPSPPPEPLSSSTKAGALPMTHGRPAGDQVQSQR

SEQ ID NO: 117761 - protein, 37 aa, Glycine max
  Coding DNA Sequence Number=SeqID_983
MSSSVPFVVQGQLVKWQVFTLVVWRHSSPTTHEILLC

SEQ ID NO: 117762 - protein, 474 aa, Glycine max
  Coding DNA Sequence Number=SeqID_984
  Gene Ontology: Mol. function=transcription factor activity; Biological process=regulation of transcription, DNA-dependent
  Homolog annotation: Hit_ID=Q8ZPB0; Match level="QueryCoverage=48%, HitCoverage=75%, E-value=3e-88, Identity=69%"; Hit description =Putative LysR family transcriptional regulators
  Pfam annotation: Domain name=HTH_1; Domain location=143-194; Score =50.4; E_value=5.9e-12; Accession=PF00126.17; Description=Bacterial regulatory helix-turn-helix protein, lysR family
  Pfam annotation: Domain name=LysR_substrate; Domain location=215-415; Score=78.0; E_value=3e-20; Accession=PF03466.10; Description=LysR substrate binding domain
  Pfam module annotation: Pfam domain module=HTH_1::LysR_substrate; Domain location=143-194::215-415
MPVIARQQPRGGKTAGGRAKGEAAEHHGDNKRATPLGRVFSHQRADVGHRRSQSQTGKEAEQHHLFDVLRHGGRQRPEAKKQHAEQNHHAAAVAIGQRVGAIKPISAISMPSSATTTKHSAIKRFCQLLNALWLMSWRTSMASALVTGTLGRAAETLNLSQPALSKTLNELEELAGARLFERGRLGAQLTTLGEQFLTHAVKVLDALNHAGQSFNSPVSGRPIVIRLGALTTAAMGMLPQILDRFHEQQPNTTVQVATLHNNVLLAGLRAGEFDIGIGRMADSEMMTGLTYELLFLESLKLVVRPEHPLLSDNVTLSRAMQWPVVISPEGTAPRRIAQHMLDEQGCSLPGNCVETSSTSLARQLALRYDYVWFVPSGARPLSLVKRGSADGHHPQISQLTAAFGVAFAIVEARAIGFAQPDINCAAAAVLRLRAAEGLNVVKLTQPACHVAADNIGVCFIIPPFAMNNQQIAQG

SEQ ID NO: 117763 - protein, 79 aa, Glycine max
  Coding DNA Sequence Number=SeqID_985
MEREEKRFVYRIRCSSDENYDPEGMEEGIEGRVVLDYTNMVIDYQRATLQEITACNRLHYYGNRLPVVILARKQKQKAF

SEQ ID NO: 117764 - protein, 788 aa, Glycine max
  Coding DNA Sequence Number=SeqID_986
  Gene Ontology: Mol. function=serine esterase activity; Cellular component=membrane; Biological process=metabolic process
  Homolog annotation: Hit_ID=Q6A3R0; Match level="QueryCoverage=43%, HitCoverage=85%, E-value=1e-108, Identity=57%"; Hit description=Elip protein
  Pfam annotation: Domain name=Abhydrolase_3; Domain location=446-651; Score=-64.6; E_value=0.0017; Accession=PF07859.3; Description =alphabeta hydrolase fold
  Pfam annotation: Domain name=COesterase; Domain location=328-788; Score=274.7; E_value=1.8e-79; Accession=PF00135.18; Description =Carboxylesterase
  Pfam annotation: Domain name=DUF1338; Domain location=97-206; Score =206.1; E_value=8.1e-59; Accession=PF07063.3; Description=Protein of unknown function (DUF1338)
  Pfam annotation: Domain name=Peptidase_S15; Domain location=426-650; Score=-104.6; E_value=0.018; Accession=PF02129.9; Description=X-Pro dipeptidyl-peptidase (S15 family)
  Pfam module annotation: Pfam domain module=Abhydrolase_3::COesterase:: DUF1338::Peptidase_S15; Domain location=446-651::328-788::97-206::426- 650
ALMPSRGIEPKILIEGPPPRAVPILLRQTSFKALEEAVHFNDGTPGAHTARFGEIEQRGAALTPKGRALYDRLLAQAGTGSDNQQHQQHLSAVFRDFPDDEQTLREQELAWFRYRLTPQGEHQPPRAGETVAQLLAAGRLQAEPIVYEDFLPVSAAGIFQSNLGNQTQARSAGNASRADFEAALGAAVQDEMVLYQQTQQRSLARCGACVAHQRIFSGTQEQDGQRAQQVKRFRFQRPGADIGAMPECAHFHQQRCDYHVNGNDKGRRARQQANDDHDGCHNFPDVSTVSDETWHAFDAEQMGDPADAMNRLKLAMKQQQPAEDIPLRPANNGIRLYQEPAMKNERRLRIMTAEGELRGLMDDELFTFKGIPYAAPPVGALRWRPPQPVVPWQTLRDATAWGDASWQNRDYCVAAGGGDPGRFSEDCLYLNVWTPDVEPATPLPVMVWLHGGGFSIGAGSLDPYRGKALAAQGVVVVTLNYRLGHFGFFAHPALDAQYPPGKVVNNFALLDQIAALQWIQRNIPAFGGDRHNVTLFGESSGARSVLSLCCSPLAEGLFHKGIVQSAYSLPDVPHKQAQQTGLQVAAHFNLAADASAEQLRALPADSFWPLERPLALGPVAISGDAVLPRPMLDTFMAGKQHRVPLMIGSNSDEASVLDYFGVDARSVLQQLRSKSRLSYRLLKWLYDIHDDSLLGRAVARDMAFTVMPLLVAQSQHSIGMPAWRYWFDYVSENARHLYPHGTWHGNEIPYVFNTLATLPPPGDWHYSASDIAFAGRVSAWWVTFARDA

SEQ ID NO: 117765 - protein, 66 aa, Glycine max
  Coding DNA Sequence Number=SeqID_987
  Gene Ontology: Mol. function=transcription factor activity; Biological process=regulation of transcription, DNA-dependent
  Homolog annotation: Hit_ID=Q2XCI1; Match level="QueryCoverage=80%, HitCoverage=18%, E-value=3e-13, Identity=70%"; Hit description =Transcriptional regulator, putative
MQTARVAFKQGKPQPALQRRNFAAHRALSDAQFAGGARQVEMTGGDQKGMNGVEWQSRAGHNGLEL

SEQ ID NO: 117766 - protein, 389 aa, Glycine max
  Coding DNA Sequence Number=SeqID_988
  Gene Ontology: Mol. function=transferase activity, transferring nitrogenous groups; Cellular component=mitochondrion; Biological process=biosynthetic process
  Homolog annotation: Hit_ID=Q147C3; Match level="QueryCoverage=98%, HitCoverage=100%, E-value=1e-138, Identity=65%"; Hit description =Putative aminotransferase
  Pfam annotation: Domain name=Aminotran_1_2; Domain location=32-384; Score=200.0; E_value=5.8e-57; Accession=PF00155.11; Description =Aminotransferase class I and II
  Pfam annotation: Domain name=Aminotran_5; Domain location=49-384; Score=-185.2; E_value=0.0064; Accession=PF00266.9; Description =Aminotransferase class-V
  Pfam annotation: Domain name=Beta_elim_lyase; Domain location=49-273; Score=-88.4; E_value=8.9e-05; Accession=PF01212.11; Description=Beta -eliminating lyase
  Pfam annotation: Domain name=Cys_Met_Meta_PP; Domain location=47-307; Score=-280.2; E_value=0.0078; Accession=PF01053.10; Description =CysMet metabolism PLP-dependent enzyme
  Pfam annotation: Domain name=DegT_DnrJ_EryC1; Domain location=48-343; Score=-185.1; E_value=0.004; Accession=PF01041.8; Description =DegTDnrJEryC1StrS aminotransferase family
  Pfam module annotation: Pfam domain module=Aminotran_1_2::Aminotran _5::Beta_elim_lyase::Cys_Met_Meta_PP::DegT_DnrJ_EryC1; Domain location=32-384::49-384::49-273::47-307::48-343
  Subcellular localization annotation: CTP_CleavageSite=55; ConfidenceScore=5.08e-01
MMTLNSSVKLSSKQPDVGTTIFSVIGQLSAQHQAVNLSQGAPNFPCDPQLVELVSQAMRDGHNQYAAMTGLPALREALAEKVHRLYGQPYDAASEVLITGSASQGIYMAISALVHPGDEVIFFEPAFDSYAPVVRLQGATPIGLKLQVPDFAIDWDELRAAITPRTRMIIINTPHNPSGQVLNAADLDQLAALTRNTDIVVLSDEVYEHIVFDGQTHCGMATHAELAQRSVVVSSFGKTFHVTGWRVGYALAPAALMAEIVKVHQFMMYAADTPMQVGFAQYLQNPQNYLQLSSFYQAKRDRLQTLLQDSPFRLLPSAGSFFMLASYGHFSDESDSEMVKRLIVDHGVATIPLSAFYMDGTDNKLIRLSFAKDDATLEAGAQALCRVKG

SEQ ID NO: 117767 - protein, 170 aa, Glycine max
  Coding DNA Sequence Number=SeqID_989
  Gene Ontology: Mol. function=transporter activity; Cellular component= outer membrane-bounded periplasmic space; Biological process=transport
  Homolog annotation: Hit_ID=Q147C2; Match level="QueryCoverage=97%, HitCoverage=63%, E-value=4e-58, Identity=65%"; Hit description=ABC amino acid transporter, periplasmic ligand binding protein
  Pfam annotation: Domain name=SBP_bac_3; Domain location=1-163; Score =52.5; E_value=1.4e-12; Accession=PF00497.10; Description=Bacterial extracellular solute-binding proteins, family 3
MNITEARAKSIDFTNPIYRIPTMLIVKQGEKLEPTAASLKGKNIGVLQGSIQETYAKKHWESQGVTVTSYQDQNQVYNDMVAGRLDGTLVMSAAGQSGFLDKPQGKGFAFAGKPVEDDTILGSGIGFGLRKGDSKLKGELDAAIAKVQADGTVTKLAAKFFPGIDVSVSK

SEQ ID NO: 117768 - protein, 306 aa, Glycine max
  Coding DNA Sequence Number=SeqID_990
  Gene Ontology: Mol. function=cytosol alanyl aminopeptidase activity; Cellular component=cytoplasm; Biological process=peptide metabolic process
  Homolog annotation: Hit_ID=Q6D3E2; Match level="QueryCoverage=99%, HitCoverage=75%, E-value=1e-139, Identity=79%"; Hit description =Peptidase
  Pfam annotation: Domain name=M20_dimer; Domain location=106-210; Score=69.4; E_value=1.2e-17; Accession=PF07687.4; Description =Peptidase dimerisation domain
  Pfam annotation: Domain name=Peptidase_M20; Domain location=30-303; Score=7.9; E_value=0.00051; Accession=PF01546.18; Description =Peptidase family M20M25M40
  Pfam module annotation: Pfam domain module=M20_dimer::Peptidase_M20; Domain location=106-210::30-303
GADLCLNAQQDIWLRVAEHPEILPYVGQEIVFSDGTSVLGADNKAAVSVVMTLVENLRGEHGDVVVAFVPDEEIGLRGAKALDLETRFNVDFAWTIDCCELGEVVYECFNGASAEITFTGVPAHPMSGKGVLVNPLLMAHDFIARFDRLATPEHTAGREGYIWFNDMQANASQAVLKASIRDFDLKGFDAKKQQLVEVADQIAAHYPTGHVALKINDIYSNISNAIGEDRRAIDLIFAALQQVGVEPKVIPMRGGTDGSALSAKGLLTPNFFTGAHNFHSRFEFLPIPSFVKSYQVAEALCYLAAR

SEQ ID NO: 117769 - protein, 218 aa, Glycine max
  Coding DNA Sequence Number=SeqID_991
  Gene Ontology: Mol. function=hydrolase activity; Cellular component =cytoplasm; Biological process=signal transduction
  Homolog annotation: Hit_ID=Q2NSX9; Match level="QueryCoverage=96%, HitCoverage=47%, E-value=2e-74, Identity=64%"; Hit description =Putative guanine deaminase
MSDSVVTRLRASFFDFPALADQPDGLADQARYLEDGMLTLRDGKVVSLERWQPAHQHLESTQVIDLRGKLILPGFVDTHIHYPQTEMIGAFGEQLLEWLNQYTFPVESQYHCAAHAARMSAFFLQQLLANGTTTALVFGTVHPQSVDALFSAAEQLEMRLIAGKVMMDRHAPPELTETPAQSYQQTRELIQRWHQRGRLGYALTPRFAPTSSPQLLEK

SEQ ID NO: 117770 - protein, 113 aa, Glycine max
  Coding DNA Sequence Number=SeqID_992
  Gene Ontology: Mol. function=protein binding
  Homolog annotation: Hit_ID=Q5PHH7; Match level="QueryCoverage=77%, HitCoverage=77%, E-value=2e-30, Identity=68%"; Hit description =Putative secreted protein
  Pfam annotation: Domain name=DUF1283; Domain location=11-113; Score =178.2; E_value=2.1e-50; Accession=PF06932.2; Description=Protein of unknown function (DUF1283)
MTMKKLFSALLATTLTASVMLTAPLAVAKTDRLIIEDGNNAASNEAARQSKEQWNDTRNLRNKVNTRVEKEFDKADRAFDTRDACEKSYNVNAYWEPNTLRCLDRRTGRPLAP

SEQ ID NO: 117771 - protein, 139 aa, Glycine max
  Coding DNA Sequence Number=SeqID_993
  Pfam annotation: Domain name=Transposase_23; Domain location=46-116; Score=19.9; E_value=7.5e-06; Accession=PF03017.5; Description =TNP1ENSPM transposase
  Subcellular localization annotation: CTP_CleavageSite=29; ConfidenceScore=5.08e-01
MASFNQLQSQMQSQGSLEPLVGPGPSGPRVSTKGSCVDPSGNDPETGDSDRCGLYIEADPARLVAVGRVYEGSTLVHNTPLFPGQVKVSVDEVKDADASVPVPTDEVSLVGQALHTFLAWLTHLVKSLSHQLCLHQNHL

SEQ ID NO: 117772 - protein, 178 aa, Glycine max
  Coding DNA Sequence Number=SeqID_994
MTGFLRFFRRFPQINVGGDSAHFPPLEDAPVSLASLTRKKVGCDTRFLPFYTTCAIRCTCRKPNKFLSLLPGNFFLVGKNRSCMITMRKKEPLILKGTQFERNRSSAGYQWESYRQSDYHNKVEGVLNMDDLLMQFKDTIESIQQAFRRTKTQLSKLVDDMTNDVATKEEEHAEIEIH

SEQ ID NO: 117773 - protein, 82 aa, Glycine max
  Coding DNA Sequence Number=SeqID_995
MAVVEGDGLDDEGMSSVLALFLDAISSLSHKDFNRRMSIRPHKMNSLSVAWLSTRITPLSERSMRLADKDMRRAHIAAMNLA

SEQ ID NO: 117774 - protein, 155 aa, Glycine max
  Coding DNA Sequence Number=SeqID_996
RQLDWAHLVRYRMHKALRLNAPLPYPQLVTLFFHHFQIPLDSEPYVPIKRSFLIGAAVIASFGYRKELDGSWVKKGAPPADDESNQPVEDNSSLLRKLLEKFDGLQTFVGDKFDNMELQVDMRFDAMESRITKVEEDVSFIRTCFDPPPPLPSSS

SEQ ID NO: 117775 - protein, 183 aa, Glycine max
  Coding DNA Sequence Number=SeqID_997
  Gene Ontology: Mol. function=cysteine-type peptidase activity; Cellular component=cytoplasm; Biological process=proteolysis
  Pfam annotation: Domain name=Transposase_21; Domain location=79-180; Score=16.7; E_value=5e-16; Accession=PF02992.5; Description =Transposase family tnp2
MGIEYHKIHACPNDFILYIHEFEEMHKFPRCGVSWYKVKDDDECSSDDNLKKGPPAKVVWYLLIIPWFKHLFSNGDDAKDLTWHAKGRNWDGMLHHPADSSQWKKIDRLYPKFNKEARNLRLGLSIDGMNPYGSLSTQHSSWLVLLVIYNLSLWLCMKRKYIMLSMMILGPSQGMRLMIISVP

SEQ ID NO: 117776 - protein, 284 aa, Glycine max
  Coding DNA Sequence Number=SeqID_998
  Gene Ontology: Mol. function=inositol or phosphatidylinositol phosphatase activity; Cellular component=Golgi-associated vesicle; Biological process=abscisic acid mediated signaling
  Homolog annotation: Hit_ID=Q1RXP2; Match level="QueryCoverage=99%, HitCoverage=62%, E-value=1e-114, Identity=72%"; Hit description =Inositol polyphosphate related phosphatase
MTGKLAEFMWPALVANKILNKRLGSSNFVADYPSNTEPLLGHDQSSLSSKTILNDHKDTQKYKIFVSTWNVGGIFPDEGLNMEDLLETCNNSCDIYLLGFQEIVPLKASNVLGYENNKISTKWNSIIRKALNKSTHHSFKDQLGDDKREDVKKNICCNNKEGENNNHPGQLCESPQDFECIISKQMVGILISVWAKRDLRPFIQHPSVSCVGCGIMGCLGNKGSVSVRFVLHETSFCFVCAHLASGGRGGDEKLRNSNVAEIFSRTSFPRGPMLDLPRKILDHE

SEQ ID NO: 117777 - protein, 1374 aa, Glycine max
  Coding DNA Sequence Number=SeqID_999
  Gene Ontology: Mol. function=RNA binding; Cellular component =spliceosome; Biological process=mRNA processing
  Homolog annotation: Hit_ID=Q1RXP4; Match level="QueryCoverage=93%, HitCoverage=79%, E-value=0.0, Identity=89%"; Hit description=AAA ATPase
VFPQKQLSGEDNELIDATGLGLLNDACVLYCERFMEFLIDLLSQLPTRRYLRPLVADVAVVAKCHLSALYRHEKGKLFAQLVDLLQFYEGFEINDHTGTQLTDHEVLESHYSRMQSFQLLAFKKMEKLRELALTNIGSIHKRANLTKKLSVLSPEELRNFVCCKLKLVSKEDPWSERVDFLIEVMLSYFEKQQSQKEAINALPLYPNEQIMWDESVVPSINYSGEGCLALPKLNLQFLTLHDYLLRNFNLFRLESTYEIREDIQEAVPHLLAYINNDGGTAFRGWSRMGVPIKEFKITEVKQPNIGEVKPSSVTAEVTYSVSSYRAHIRSEWDALKEHDVLFLLSIRPLFEPLSAEEEDKASVPQKLGLQFVRGCEVIEIRDEEGNLMNDFSGKIKRDEWKPPKGELRTVTVALDTAQYHMDVSNIAEKGAEDVYGTFNVLMRRKPKENNFKAILESIRDLMNEYCIVPKWLENIFLGYGDPSAAQWTNMPDVLETVDFKDTFVDADHLKESFVDYEVSFVNSDGSENLNPRPPFKIKLPRTLKPNNGTLTGHAMSTSGATNDINVVDANYQKEALVIETYTPPDPGPYPQDQPKQNLVRFTPTQQFPLLICKEIGEFILATLAFCLYFLSVGAVVESKEKSTWFTHFKELCGLPVLPFFLAAVQLQVEAIISGIQPGLTMVVGPPGTGKTDTAVQILNVLYHNCPSQRTLIITHSNQALNDLFEKIMQCLLWGMGSSCIAPLCKRASLSTRVSLLPCGLELIGSNLGNNLSACEGKAADKLSRLLLVGARDVPARYLLRLGQGEQELATDLDFSRQGRVNAMLVRRLELLSEVERLARSLQLPEDVGYTCETAGYFWLLHVYSRWEQFLAACAENKEKSTFVRDRFPFKEFFYDTPHPVFTGESFEKDMQAATGCFRHLKNMFQELEECRAFELLKSTADRANYLMTKQAKIVAMTCTHAALKRKDFLQLGFKYDNLLMEESAQILEIETFIPMLLQRQEDGHARLKRCILIGDHHQLPPVVKNMAFQKYSHMDQSLFTRFVRLGIPYIELNAQGRARPSIAKLYNWRYRDLGDLPSVKEEVVFNRANAGFAYDYQLVDVPDYLGKGETTPSPWFYQNEGEAEYVVSVYIYMRLLGYPANKISILTTYNGQKLLIRDVVNRRCVPYDFIGPPSKVTTVDKFQGQQNDFILLSIVRTRFVGHLRDVRRLVVAMSRARLGLYVFCRRSLFEQCYELQPTFQLLLERPDHLALNVNEITSYTERNFEDPGPGHHVHLVSGIEEMGSIIDRLYQEKLRHQFDQNGPYLSHLEPSENTDGMQSGQQTMDTDMPEQTEDDMPHKIKEATTVDNVTGYNNVEDVTMVDNSDGVANGNPSP

SEQ ID NO: 117778 - protein, 179 aa, Glycine max
  Coding DNA Sequence Number=SeqID_1000
  Homolog annotation: Hit_ID=Q1RXR5; Match level="QueryCoverage=49%, HitCoverage=16%, E-value=3e-39, Identity=87%"; Hit description=SAM (And some other nucleotide) binding motif
MFPQENHSNGYQQGPGVGYSHRERVRRGTRRSRASTSSVRVYDQHQPQHRPPCTDFDVAYFHSYAHLGIHQEMIKDRVRTETYRDAIMQHQSSIAGKVVVDVGCGTGILSIFCAQAGAKRVYAIDASDIALQKCCLPSGTFRYVYGITSPVFLFFKSTQLRALISTSNIRRLDRRRVAE

SEQ ID NO: 117779 - protein, 198 aa, Glycine max
  Coding DNA Sequence Number=SeqID_1001
  Homolog annotation: Hit_ID=Q1RXP4; Match level="QueryCoverage=85%, HitCoverage=11%, E-value=3e-67, Identity=75%"; Hit description=AAA ATPase
MTKVYGTGLYDFRRHRVAEYPVAAPPSESKAEVPKAGGGGGFPSSITLSEIQRDRLTKIAEANWLKSGDAARPKKDFDPELVRKIYETELLVKEGSKPVPLQRVMILEVSQYLENYLWPHFDPLAATFEHVMSIIIMVNEKFRENVAAWTCFHERKDAFKVFLERVLRLKETISAAIVVADSSKNLNVTAEIAVVDVF

SEQ ID NO: 117780 - protein, 51 aa, Glycine max
  Coding DNA Sequence Number=SeqID_1002
ISMTQEEKVTYNSGKFESAKNSPSKDYSLPPNSGQTPIYLPPVTKIVITAL

SEQ ID NO: 117781 - protein, 442 aa, Glycine max
  Coding DNA Sequence Number=SeqID_1003
  Gene Ontology: Mol. function=RNA-directed DNA polymerase activity; Cellular component=intracellular; Biological process=RNA-dependent DNA replication
MPYASLKAVPYKYSATMLEGGQEVPLPSLTPAISVDNIASDSKVLRNGRVIPTLLAKKVNDPAVKQATVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDTGSSLNVMAKSTLDQLSYRGPPMRRSGVVVKAFDGSRKSVIGEVDLPITIGPFVFQITFQVMDIQAAYSCLLGRPWIHEAGAVTSTLHQKLKFVRNGSLITVSGEEALLVSHLSAFSFIGADETKGTSFQGLTVEGKKPEKNEVSFATWKSAQKVVQEGTGVGWGKVVQLLESKNREGLGFASSAGSATNSVGSSSITSTFCSAGFINNSPEANAVLEDVPEEIVLAFVTPGKIVRNWDAVDIPS

SEQ ID NO: 117782 - protein, 232 aa, Glycine max
  Coding DNA Sequence Number=SeqID_1004
  Gene Ontology: Mol. function=pepsin A activity; Cellular component =anchored to membrane; Biological process=proteolysis
  Homolog annotation: Hit_ID=Q9LHE3; Match level="QueryCoverage=75%, HitCoverage=38%, E-value=9e-57, Identity=57%"; Hit description =Nucleoid chloroplast DNA-binding protein-like
MSMGKLLLLIIVFLTSKSAAGSWPSHFQELKVEEAIAGTKVQAEELEEKEEAKWKVEIVHRDKLIINTDHRSRFNARIKRDVKRVASLLLLRRHAYTVEEASFGSDVVSGTAEGSGEYFVRIGIGSPATYQYMVIDSGSDVVWVQCQPCDQCYNQSDPIFNPALSASFAAVPCSSAVCDQLDDSGCHQGRCRYQVSYGDGSYTRGTLALETITLGKTVIRNTAIGCGNLNQG

SEQ ID NO: 117783 - protein, 57 aa, Glycine max
  Coding DNA Sequence Number=SeqID_1005
MWREKYSSHTDSEMKASTCSPSLECLETLAEQPEENLEKSQETARDTAITVKIHMDP

SEQ ID NO: 117784 - protein, 85 aa, Glycine max
  Coding DNA Sequence Number=SeqID_1006
MEKVKQQMAEDTIMETGNTNSMVQLQASVEEKLSSSGSKREEYTTNDKCKTTTSGLVVNHLDIGAKEMSTKWEMQEKQGPRRKSH

SEQ ID NO: 117785 - protein, 48 aa, Glycine max
  Coding DNA Sequence Number=SeqID_1007
MDLDQWISKVKDGQHLLEEELQLLCEYIFVLHGTDQRQLNISGYRDPY

SEQ ID NO: 117786 - protein, 329 aa, Glycine max
  Coding DNA Sequence Number=SeqID_1008
  Gene Ontology: Mol. function=peroxidase activity; Cellular component =membrane; Biological process=response to oxidative stress
  Homolog annotation: Hit_ID=Q1RUM5; Match level="QueryCoverage=91%, HitCoverage=90%, E-value=1e-104, Identity=65%"; Hit description=Haem peroxidase, plant/fungal/bacterial
  Pfam annotation: Domain name=peroxidase; Domain location=44-293; Score=448.0; E_value=1.3e-131; Accession=PF00141.13; Description =Peroxidase
  Subcellular localization annotation: CTP_CleavageSite=45; ConfidenceScore=5.23e-01
MDNTPRLLQSVSSLILILSISSLASASLKVGFYSSTCPSAEAIVRSAVEKAISANPGIAAGLIRMHFHDCFVRGCDGSVLLASRPGNPISERDNLVNNPSLRGFEVIEEAKNQIEDACPQTVSCADILAFAARDSVSKVGGINYDVPSGRRDGGVSIGGEVIGNLPGPSFSADELVSSFSRKGLSADEMVTLSGAHSIGVSHCGSFSNRLYSFSDTATQDPSLDSSYAETLKGKCPPPPPTSDPTVSLEPSTPIRLDSKYYEALINHRGLLTSDQTLYTSQSTRAMVESNAYNAASWAEKFALAMVRMGSIEVLTGSDGEIRKQCSFVN

SEQ ID NO: 117787 - protein, 163 aa, Glycine max
  Coding DNA Sequence Number=SeqID_1009
  Gene Ontology: Mol. function=hydrolase activity; Cellular component =cytosol; Biological process=G1/S transition of mitotic cell cycle
  Homolog annotation: Hit_ID=Q0WWV2; Match level="QueryCoverage=98%, HitCoverage=43%, E-value=4e-69, Identity=78%"; Hit description =Phosphoprotein phosphatase
MGIRVIERNCEIPHEGPFCDLMWSDPEDIETWAVSPRGAGWLFGSRVTSEFNNINNLDLVCRAHQLVQEGLKYMFQDKGLVTFNQVRRSIVALVRNGPINRGRGNPQEVVQVVWSAPNYCYRCGNVASILSFNENMEREVKFFTETEENNQMRGPRTGVPYFL

SEQ ID NO: 117788 - protein, 322 aa, Glycine max
  Coding DNA Sequence Number=SeqID_1010
  Homolog annotation: Hit_ID=UPI000038C667; Match level="QueryCoverage =26%, HitCoverage=50%, E-value=1e-07, Identity=44%"; Hit description =COG0477: Permeases of the major facilitator superfamily
MSLFFANKAAFRKKLGNEDCRKRASGVSGWKKRGIRDKLGKVPSPLLIKSFKTFPSFKCCSKSSDEKGSEDVKDTLSGVVDEQVEEFLSRKENKVLLDGLEKASQRVEMAKRELALIRKQEFAVKQLKDYVNQLESKVFEIGECQRDISEAKALVEEAERSLLVNVGGPENGSTSMGMKSEDIDRDEERWESVKAASISALVGTFSGLPICFTQVTNTTQLLLPLAINFICCALFGVTFRYTIRRNLDDVQLKTGVAAAFGVVKGLATLGGGPLPEPNIESFLSHAQEGTIYLSENLLIFVSAAVALDYCLKTRLLSPFPID

SEQ ID NO: 117789 - protein, 386 aa, Glycine max
  Coding DNA Sequence Number=SeqID_1011
  Homolog annotation: Hit_ID=Q9FNN4; Match level="QueryCoverage=43%, HitCoverage=35%, E-value=8e-61, Identity=70%"; Hit description =Arabidopsis thaliana genomic DNA, chromosome 5, P1 clone:MAH20
  Subcellular localization annotation: CTP_CleavageSite=77; ConfidenceScore=5.75e-01
MAFTSSCSLASQFLPPIYHSAIPFHSTNCTNLSFPAVPTPRQQPLLFSSTSTCLAAAAASNSNSTSNSNNNNPASASASSKEKKVEVEVEVEEELPWIQEKALDLVEFTGSVTQAIPGPRVGPTSLPWILAIPLTYAGLTFVIAFVKTVRKFSSPKAKRRRQVSKNATLCKSLDDLFQKGRDEVKLDALKQIENKTGFDLEEILRKYIRYALNEKPFNPDMVADLIQLRKASMLNDSQVAEILNEISRRIVRDKVQDHMKVQPNKRRREVSKYSLRKDIECSSSCNLTGCKPWQEKAVAPSSVVQPLPSLIDNMELQVTPESDLVANNNASGKVQMPTCEDCLKLFSIIHQQFPEFCIEDKVNLLEGSIVMPPINIVYSRSSMGPT

SEQ ID NO: 117790 - protein, 956 aa, Glycine max
  Coding DNA Sequence Number=SeqID_1012
  Gene Ontology: Mol. function=catalytic activity; Cellular component =intracellular; Biological process=metabolic process
  Homolog annotation: Hit_ID=Q5G1T1; Match level="QueryCoverage=81%, HitCoverage=96%, E-value=0.0, Identity=55%"; Hit description=Embryo -defective 2261
  Pfam annotation: Domain name=PPR; Domain location=184-218; Score=6.2; E_value=1.4; Accession=PF01535.11; Description=PPR repeat
  Pfam annotation: Domain name=PPR; Domain location=219-253; Score =16.3; E_value=0.088; Accession=PF01535.11; Description=PPR repeat
  Pfam annotation: Domain name=PPR; Domain location=358-392; Score =33.3; E_value=8.3e-07; Accession=PF01535.11; Description=PPR repeat
  Pfam annotation: Domain name=PPR; Domain location=393-427; Score=2.1; E_value=4.2; Accession=PF01535.11; Description=PPR repeat
  Pfam annotation: Domain name=PPR; Domain location=459-493; Score =32.6; E_value=1.3e-06; Accession=PF01535.11; Description=PPR repeat
  Pfam annotation: Domain name=PPR; Domain location=529-563; Score=1.5; E_value=4.9; Accession=PF01535.11; Description=PPR repeat
  Pfam annotation: Domain name=PPR; Domain location=593-627; Score=4.7; E_value=2.1; Accession=PF01535.11; Description=PPR repeat
  Pfam annotation: Domain name=PPR; Domain location=659-693; Score =52.5; E_value=1.4e-12; Accession=PF01535.11; Description=PPR repeat
  Pfam annotation: Domain name=PPR; Domain location=694-728; Score =15.1; E_value=0.12; Accession=PF01535.11; Description=PPR repeat
  Pfam annotation: Domain name=PPR; Domain location=730-764; Score=3.0; E_value=3.3; Accession=PF01535.11; Description=PPR repeat
  Pfam annotation: Domain name=PPR; Domain location=796-830; Score =10.1; E_value=0.47; Accession=PF01535.11; Description=PPR repeat
  Pfam module annotation: Pfam domain module=PPR::PPR::PPR::PPR::PPR::PP R::PPR::PPR::PPR::PPR::PPR; Domain location=184-218::219-253::358 -392::393-427::459-493::529-563::593-627::659-693::694-728::730 -764::796-830
  Subcellular localization annotation: CTP_CleavageSite=36; ConfidenceScore=5.25e-01
MSVPVSVSVSGSGLLSFPSIQRPHSNPPPKHAVLPSTSREPDTDTKYLCLLSPFQIIASQELPYQTFPFRGLGHRLTGQHRTVVGWIASNQYRYLFEKNIVCKVFDEMPNKDLNPSTWFKGAFVIEKTVMFLLEKLLLGNLTYQGGHTGWIGMLVSMTEAKDLKFESLRKAISRLDLTTTSPLIKSSLLLKACIRSGNLELGKLLHHKLIDSGLPLDSVLLNSLITLYSKCGDWENALSIFRNMGHHKRDLVSWSAIISCFANNSMESRALLTFLHMLQCSRNIIYPNEYCFTALLRSCSNPLFFTTGLAIFAFLLKTGYFDSHVCVGCALIDMFTKGGLDIQSARMVFDKMQHKNLVTWTLMITRYSQLGLLDDAVDLFCRLLVSEYTPDKFTLTSLLSACVELEFFSLGKQLHSWVIRSGLASDVFVGCTLVDMYAKSAAVENSRKIFNTMLHHNVMSWTALISGYVQSRQEQEAIKLFCNMLHGHVTPNCFTFSSVLKACASLPDFGIGKQLHGQTIKLGLSTINCVGNSLINMYARSGTMECARKAFNILFEKNLISYNTAADANAKALDSDESFNHEVEHTGVGASPFTYACLLSGAACIGTIVKGEQIHALIVKSGFGTNLCINNALISMYSKCGNKEAALQVFNDMGYRNVITWTSIISGFAKHGFATKALELFYEMLEIGVKPNEVTYIAVLSACSHVGLIDEAWKHFNSMHYNHSISPRMEHYACMVDLLGRSGLLLEAIEFINSMPFDADALVWRTFLGSCRVHRNTKLGEHAAKKILEREPHDPATYILLSNLYASEGRWDDVAALRKSMKQKKLIKETGYSWIEVDNQVHKFHVGDTSHPQARKIYDELDELALKIKNLGYIPNTDFVLHDVEDEQKEQYLFQHSEKIAVAYALISTPKPKPIRVFKNLRMQTDFIISRMGNALAMIIGYSTYCAKVAMSSLER

SEQ ID NO: 117791 - protein, 549 aa, Glycine max
  Coding DNA Sequence Number=SeqID_1013
  Gene Ontology: Mol. function=binding; Cellular component =intracellular; Biological process=protein kinase C activation
  Homolog annotation: Hit_ID=Q5NAR1; Match level="QueryCoverage=74%, HitCoverage=73%, E-value=1e-100, Identity=40%"; Hit description =Pentatricopeptide (PPR) repeat-containing protein-like
  Pfam annotation: Domain name=PPR; Domain location=194-226; Score=3.7; E_value=2.7; Accession=PF01535.11; Description=PPR repeat
  Pfam annotation: Domain name=PPR; Domain location=227-261; Score =34.9; E_value=2.8e-07; Accession=PF01535.11; Description=PPR repeat
  Pfam annotation: Domain name=PPR; Domain location=330-364; Score =42.7; E_value=1.3e-09; Accession=PF01535.11; Description=PPR repeat
  Pfam annotation: Domain name=PPR; Domain location=365-399; Score=5.0; E_value=1.9; Accession=PF01535.11; Description=PPR repeat
  Pfam annotation: Domain name=PPR; Domain location=401-435; Score =14.5; E_value=0.14; Accession=PF01535.11; Description=PPR repeat
  Pfam annotation: Domain name=PPR; Domain location=94-127; Score=11.2; E_value=0.35; Accession=PF01535.11; Description=PPR repeat
  Pfam module annotation: Pfam domain module=PPR::PPR::PPR::PPR::PPR::PP R; Domain location=194-226::227-261::330-364::365-399::401-435::94-127
MNLALNRKLRDVRQWQRTWNGSCFSTLPRSQHAEQLLCHCTNLSHLQQTQGFMLTRGLDQDDILLARFIYTSASLGLSSYAYSVFISNHRPSIFFYNNVIWALSSSNPTRAISLFNAIRLLGMPPDSYSFPFVLKAVVCLSAVHVGKQIHCQAIVSGLDSHPSVVTSLVQMYSSCAHLSSARKLFDGATFKHAPLWNAMLAGYAKVGNMSNARNLFECMPEKDRDVVSWTTLISGYTQTHSPNEAITLFRIMLLQNVQPDEIAILAVLSACADLGALQLGEWIHNYIEKHNNKLRKTVPLCNSLIDMYAKSGDISKARQLFQNMKHKTIITWTTVISGLALHGFGKEALDVFSCMEKARVKPNEVTLIAVLSACSHVGLVELGRNIFTSMRSKYGIEPKIEHYGCMIDLLGRAGYLQEAMELVRVMPSEANAAVWGSLLSASNRYGDAALAAEALRHLSVLEPHNCGNYSLLSNTYAALGWWKEAAMVRKVMRDTCAEKVPGVSFVELNNRVYEFIAGDKLNICFLDVLQSINGQLIEDALSEKWTNDD

SEQ ID NO: 117792 - protein, 69 aa, Glycine max
  Coding DNA Sequence Number=SeqID_1014
MKERLRDRKMQRVQRPTKHEQRVRNRHMRLHDAKNKGEVVAICCSRGWAMQFPCVYEKSRLEIPMAHNV

SEQ ID NO: 117793 - protein, 120 aa, Glycine max
  Coding DNA Sequence Number=SeqID_1015
MNDKLKAVENHGLKASQKLVESMMSEKAQNKTKRCKIGVFSQNKFDGVETPGTKMHKVDDAVTRNHDQKKCQMCRQALSREVIWQQNWHTGCQKGLLEWWGQWMKGCQSCGGGRKSDDGR

SEQ ID NO: 117794 - protein, 217 aa, Glycine max
  Coding DNA Sequence Number=SeqID_1016
  Subcellular localization annotation: CTP_CleavageSite=53; ConfidenceScore=5.26e-01
MKTEGARIILLTAQHLLTNSVKGNPPRVCARSGAFAGRLVLLLGLPSWVSGLSSSIAWASVNKFKETRKDMRAEDAEGHGAASEEADGERPYEKPMDVEDDSYHGNPQREPRLLRVNLQRQTRWQPRFGFVDSQRAEGEKRMAMLLRTTVGTVKGMTGCCVVTGSEKVGNGDNDFFKTKMENRSDMGSSTPQDPHGSDEVSSNSANETNDECNDASQ

SEQ ID NO: 117795 - protein, 185 aa, Glycine max
  Coding DNA Sequence Number=SeqID_1017
  Gene Ontology: Mol. function=ionotropic glutamate receptor activity; Cellular component=integral to membrane; Biological process=ion transport
  Homolog annotation: Hit_ID=Q93YT1; Match level="QueryCoverage=86%, HitCoverage=29%, E-value=1e-39, Identity=58%"; Hit description =Glutamate receptor 3.2 precursor
MRSKALNLVHVLDSAAAATTTAPALDFGALSVSDGGKQLLDNILCINMSGLTGPIQFGLDRSPLNPSYGILNVIATGYRRIGYWSSYSDLSEIQQKSLMDGFSQITGVQYKFILFGDGHKNPSYCDLVNMITSDVSDIAIVSVRTKIVDFTRPYIESGLVVVAPQWCGFLNIEQMLSFEGHRGNI

SEQ ID NO: 117796 - protein, 106 aa, Glycine max
  Coding DNA Sequence Number=SeqID_1018
  Homolog annotation: Hit_ID=Q1S4N4; Match level="QueryCoverage=65%, HitCoverage=19%, E-value=6e-07, Identity=43%"; Hit description =Ribonuclease H
MDTKRQRDEGPNDIPQSQTVFLEEDGFGGIFWYMIVVSGYLVSGVVVVLPLIFLRSSSFAIQKGLSIAKSKGYLDIICELDSKSAINLVKDGVPESHPYATLVEDI

SEQ ID NO: 117797 - protein, 168 aa, Glycine max
  Coding DNA Sequence Number=SeqID_1019
  Gene Ontology: Mol. function=ribonuclease P activity; Biological process=tRNA 5'-leader removal
  Homolog annotation: Hit_ID=Q2QZQ0; Match level="QueryCoverage=74%, HitCoverage=15%, E-value=3e-08, Identity=32%"; Hit description =Ribonucleases P/MRP protein subunit POP1 containing protein, expressed
  Pfam annotation: Domain name=POP1; Domain location=28-158; Score =28.9; E_value=1.3e-07; Accession=PF06978.2; Description =Ribonucleases PMRP protein subunit PO
MVTDGTKKPQVSVPTRPPPPWKINLQKYAESRALELHSLQSIIENRVNSDYRSQQNKRIWTTVFDNQIARKRCRRKRQKLGIIDKALAKSGLEENHQKKLPRCVHRRYELKKNPENGFCTSGDVTKRLRTHVWHAKWGKGSRALLKKAQTRGVRGQGSGVRGQGLWVR

SEQ ID NO: 117798 - protein, 45 aa, Glycine max
  Coding DNA Sequence Number=SeqID_1020
MEVTKHRANTSLVQGSTNARFTLDGPFPLLSSIFIGTQDGSISKS

SEQ ID NO: 117799 - protein, 207 aa, Glycine max
  Coding DNA Sequence Number=SeqID_1021
  Gene Ontology: Mol. function=nucleic acid binding; Biological process= RNA-dependent DNA replication
MKPPDVQEDHIFLKAFPHSLEGVAKDWLYYLAPRSITSWDDLKRVFLEKFFPASRTTTIRKDISGLSNMERSMIDAASGGALGDMTPAEARNLIEKMASNSQQFSAKNDAIVIRGVHEVATNSVASSETKKLEGKLDALVNLVTQLALNQKSVPVARVCGLCSSADHHTDICPSMQQPGAIEQPEAYAANIYNRPPQPQQQNQPQQN

SEQ ID NO: 117800 - protein, 137 aa, Glycine max
  Coding DNA Sequence Number=SeqID_1022
  Homolog annotation: Hit_ID=Q1S8I9; Match level="QueryCoverage=47%, HitCoverage=13%, E-value=2e-23, Identity=77%"; Hit description =Probable integrase-common tobacco
MLPFALHGYRTLVRTSTGATPYSLVYGMEAVLPFEVEVPSQKILVESGLEESEWAQTRYNQLNLIEVCDNLSPFAQFMGGIIVLGNSQRSRQGQRQKPIKVLRDERKERLGSRPIGHHPLLSLGQTESVAAKQPNIL

SEQ ID NO: 117801 - protein, 109 aa, Glycine max
  Coding DNA Sequence Number=SeqID_1023
  Gene Ontology: Mol. function=nucleic acid binding; Biological process= DNA integration
MDMIKSLSSKPEKFTGENFFCWQQQMKFWLTELDLYSMISKREIKTSTSSTDIVQTDATIKHDVSDKDILCHGRILSALADNIYKIFCHTKTSVELWEALELKYGSAEK

SEQ ID NO: 117802 - protein, 166 aa, Glycine max
  Coding DNA Sequence Number=SeqID_1024
  Gene Ontology: Mol. function=RNA-directed DNA polymerase activity; Biological process=RNA-dependent DNA replication
MRETHEIPHHNLADFKPHLGYATEGQVVGGVPLPNTLEDPQFCPQAQPLPFMVGRVPPAMVERGKFNHIEEWMRDIEGGGDYSFANMEELCLVPDEVIPPKLKESLTGVAVTWYTNLEPFQVHSWKDLMGYFIRQYQYNSDMAPDRMQLQNMCKKEHESFKEYAQR

SEQ ID NO: 117803 - protein, 283 aa, Glycine max
  Coding DNA Sequence Number=SeqID_1025
  Homolog annotation: Hit_ID=Q1T493; Match level="QueryCoverage=76%, HitCoverage=46%, E-value=2e-29, Identity=31%"; Hit description =Nucleic acid-binding, OB-fold, subgroup
MARIADKIKTIDGSKETLKLAVRITELWFVGTPGRSEQAEMIIVDSNGDQIHVVCKQDQLKAWKMDLKEGCTYVMHNFRVTKNDEQYRVCDHPYKLTFIGVMVVRQCDLDGLPLKKYRFIDFSDIIVGQLQFDLLVDIIGVVDEVVFRHISPKIMNWCLALYGPIIVLLTNARIKEGQGSYPCSVSNSLKASKLTINEPLTPIEEFNQKLSELGIEIRSILTRRSQWSSQPSGSAQLSSRETFISKLEAKSISEINNLCEDGDLDLNASQKHLINYWVICSPS

SEQ ID NO: 117804 - protein, 206 aa, Glycine max
  Coding DNA Sequence Number=SeqID_1026
MQNLLQVPFSFHRQWMHRYPKYVLFHYDGNKHFIRVRRHGGKCFFADGLKEFRRAHDLNESVILRCVAFDKNTTFSIHVIGPTQRQLRVKPVISKRRYIFITDVTKDMIQHSLPLVDTSSSSSFKICPCFKEIYYRSTRTGKCTHWDITIHNDVPSVADPWFHLLDEKKLIPEDEAVFYYRFDYHAWELLVRKDIEWDNEEINFDD

SEQ ID NO: 117805 - protein, 184 aa, Glycine max
  Coding DNA Sequence Number=SeqID_1027
  Gene Ontology: Biological process=regulation of progression through cell cycle
  Homolog annotation: Hit_ID=Q9LSG6; Match level="QueryCoverage=99%, HitCoverage=43%, E-value=3e-38, Identity=72%"; Hit description=CDC45 (Cell division cycle 45)-like protein
LRKTLNLPSNARVFVVDSHRPIHLCNLSDQNDVVVVLFTKEDEGQSDLSYDFDLTTLANAATTVNSDFDSESEFESDSNSGSERLSDERYHDGVMELEQHINSSGNLDMVTSVTLKDGTKIRAPNSLRITYENQPRLMLLQEWSLFDSMMCSSYIATKLKMWSENRIKKLKLLFGTMGFALGDC

SEQ ID NO: 117806 - protein, 120 aa, Glycine max
  Coding DNA Sequence Number=SeqID_1028
  Gene Ontology: Mol. function=transferase activity, transferring hexosyl groups; Biological process=carbohydrate metabolic process
  Homolog annotation: Hit_ID=Q010N8; Match level="QueryCoverage=72%, HitCoverage=48%, E-value=3e-11, Identity=47%"; Hit description=[R] KOG3349 Predicted glycosyltransferase
MGNDDMTERVVFVTVGTTCFDALVRAIDSDNVKKALFAKGYTHLLIQMGRGSYLPTKSEGDDCSLAVDYFTFSSSIADHLRSASLVISHAVYAGAGRVNDLVPNRVCILFEHLFSLKQTG

SEQ ID NO: 117807 - protein, 152 aa, Glycine max
  Coding DNA Sequence Number=SeqID_1029
  Gene Ontology: Mol. function=serine carboxypeptidase activity; Biological process=proteolysis
  Homolog annotation: Hit_ID=Q6W6R6; Match level="QueryCoverage=58%, HitCoverage=21%, E-value=5e-11, Identity=58%"; Hit description =Putative serine carboxypeptidase
MYEYAKDGDGDRVGGDEDQVVPHWGRGNLWSWYPSESTLIEHIFITNMLGLKEGQMCSSWNSMLERDKSTAKDAYVFLINWLERFPFRKTPLYIILALLNPGYLLIQSQIRLINHMDGTAEYNIIIRHQDHVTDKPPGTSIDLYNKKQNSMQ

SEQ ID NO: 117808 - protein, 249 aa, Glycine max
  Coding DNA Sequence Number=SeqID_1030
  Gene Ontology: Mol. function=protein serine/threonine kinase activity; Biological process=protein amino acid phosphorylation
  Homolog annotation: Hit_ID=Q1T3X8; Match level="QueryCoverage=42%, HitCoverage=20%, E-value=4e-45, Identity=82%"; Hit description =Leucine-rich repeat, plant specific
  Subcellular localization annotation: CTP_CleavageSite=79; ConfidenceScore=5.19e-01
MAPAPSGGRKCQWEWRFPAPRLPSLALLLLPDWTRPVKAPTGMACCNSRSNRQSGLRFPPALDTCRPCMKSPVLLALPMQATFRYGSLDDGDTYPQFQLYLDATKWATVSIYDASRIYVKEIIFSAPSNSIDVCMCCATTGSSFISTLELRPLNLSVYATDFEGSFFLKVAARINFDAPSEDVVSSNATKATKTVLTSKNALDKNSLANPTKISGYVTVNKIAGRALLYWLTEVALNPLTKPLVIWLNG

SEQ ID NO: 117809 - protein, 79 aa, Glycine max
  Coding DNA Sequence Number=SeqID_1031
MESTYRTWLHATKDASSMWNSDEYMGVATCTQHYCWGTQQTVKWRNCPSAIIFPEEGSSGKVPEIIFPESFRKNLLPEE

SEQ ID NO: 117810 - protein, 156 aa, Glycine max
  Coding DNA Sequence Number=SeqID_1032
MGYARCTQQYCWCTQQFNESLFSSLFPDKLLLRELLRQPLDPFAFEVGGLLLSFGFVMHYIRVDPLGVLPEVPEEPFPESFRKKCSSGSNQTSFERTLLPEDFRKTSSGNFPEEVVHPEEFRKTRTSGRTFKVPEDLSGRTPSSGMFPEEPLLPEV

SEQ ID NO: 117811 - protein, 498 aa, Glycine max
  Coding DNA Sequence Number=SeqID_1033
  Homolog annotation: Hit_ID=Q53KU9; Match level="QueryCoverage=30%, HitCoverage=14%, E-value=6e-19, Identity=39%"; Hit description =Probable protein kinase [imported]-Arabidopsis thaliana
MTTQRERGFDLILILGHDEECKKVWETHVLLLASLDTKPICFASPYHPHIDLEAIKDWLPTHEGKQTLIHKGSIRSDFWKDKSGICRVLPPKDRKIYLTWLKCLEAKKAQHWKNINIYDMIQLSKYEVSTCLRELPYVPVSPTLMDLIAIIGLKPLGKTYSLGLFEDQIERSEVKIDGSAKSYEHKVDFKDNRSVDPEKYTFRLTGRKPISLEEKRKLGEGLGVVDLRLWCPRLGSFGVVVLESLSGLKAVDFRQPEVLLVNKVHQFEGKKRPLEAIADMGLNGEYNLKELMTLVSLGAARTRSDPKLRPTTRHIVSILGAKLWTFIDNAGLFGIEDLDFGSSILTVSILDGNEKLIKGKNMDSREDWRETNTCSLSLVKTTEGLGIQRKVAQTPMKMKLVKLLFQEESRIQAPTKPYKERHKIQTPTKKTNANGTVEEPEKCSKLRTSIGKKSTEVSNSGLPGNLVKEVMKHRDAAQIAAIEAMQEPAATESLLQCL

SEQ ID NO: 117812 - protein, 178 aa, Glycine max
  Coding DNA Sequence Number=SeqID_1034
  Gene Ontology: Mol. function=nucleic acid binding; Biological process= DNA integration
  Homolog annotation: Hit_ID=Q1SB98; Match level="QueryCoverage=54%, HitCoverage=29%, E-value=1e-09, Identity=32%"; Hit description=Zinc finger, CCHC-type; Peptidase aspartic, catalytic
MAALIGLMEIKFSLIGNKGGETLPSHDNGDKDFTCMIAKDGDCYGEGIVGMIVLTMGSVSMMEKSTTNFYNMIVASLGNAIETIESVNDEIIVIHGSGDNGEFICNGFDTLKEFSDKYGPFCMLILSNPIVAILMIRDWAHVGAINKSHQVVAYKESIDLDSPGWVVQPRGLVTKDNY

SEQ ID NO: 117813 - protein, 57 aa, Glycine max
  Coding DNA Sequence Number=SeqID_1035
MEVTSSNNDDRKNVNIKKPTMESEVLSWRKQSVRKSEASSRWDKSEGALRGRKSEGS

SEQ ID NO: 117814 - protein, 197 aa, Glycine max
  Coding DNA Sequence Number=SeqID_1036
  Subcellular localization annotation: CTP_CleavageSite=41; ConfidenceScore=5.53e-01
APPPPPSSNKKVKAQRLFQFQPSMNQLRKTSSEGFTFPLFLATNSTNPTKPHHQVHLNVVHEEEDATPRESLHMFQPPSPPKSRAMDDDAASDASSDLFEIESFSTQTTTLPYPIITPSIARCHESTDHEFFFANDSGSSLWRRRLRDTERDGSLLLMVNPYDMMNDLKHHVRLSMLVLDHKLLYGVWKHDPGVERA

SEQ ID NO: 117815 - protein, 50 aa, Glycine max
  Coding DNA Sequence Number=SeqID_1037
MGIPLLSFLFCKKVGISSSAAAVNKAFYIGRKRTVVEHVTNEVVLTPTTM

SEQ ID NO: 117816 - protein, 45 aa, Glycine max
  Coding DNA Sequence Number=SeqID_1038
MVDDNDETAGVLHDDTAGVLHDDNQLTKTKLKGTKVLRLLMNKRK

SEQ ID NO: 117817 - protein, 156 aa, Glycine max
  Coding DNA Sequence Number=SeqID_1039
MSSVIACLQKATMPLFMLSKTIMSSSQKLLYLLSLCFIGLNLKPPAFLGELGGKLLLHFFYKWTLETEGDAILPRKGPVTITMSKRLQEDWARAAEEGPRVLMNLRTHLLLEVASPLSLFLSPFRCHSSSKKQRNPLMQKILGLEAPMELTSEGKG

SEQ ID NO: 117818 - protein, 262 aa, Glycine max
  Coding DNA Sequence Number=SeqID_1040
  Homolog annotation: Hit_ID=Q2N2B2; Match level="QueryCoverage=41%, HitCoverage=44%, E-value=1e-14, Identity=46%"; Hit description=RPGR ORF15 isoform
MKARTLSPLKVRIFESSEGEDFESSKGRDFESSKGEDLKSSKGEDLESFEGEDFEPSEGKDLEPSKGKDLEPSKGEDLESSKGEDLESSKGEDFESAEGEDFESSKGKDFESYEGEDLESSEGEDFIFESSETSQSMGTSTQRLNLMRKKEIDSLRGILIFGEKSMHLNMIFFVALYATMQCNGNLYNVHDILSYFCDFDLVDFFPFCREHKLTVSFLKDVITHTTSSYLLKISLGTSSECMFYLILSLDNFGVMAVEPFDI

SEQ ID NO: 117819 - protein, 74 aa, Glycine max
  Coding DNA Sequence Number=SeqID_1041
MDSIWLRGICSKRESFGWISSAVAFCSTFSSFRYIQGKSDLLESAPYRQPRLLNLDPSSDQIKPSFVLRYLLLD

SEQ ID NO: 117820 - protein, 210 aa, Glycine max
  Coding DNA Sequence Number=SeqID_1042
VPGDMSRGSGDLGDVRRAPGSQQIKRTKTTKQGGLCGGWPAVNLVLKKGTGRLWRPLVIDYQSVYSITQRNGSLVIEYQIVMAAQLIHDRVEMECLEGAWETLEGNTRCRFRGTIRFTATSLVHTDEPARTLQRTVEWILPTPTPYRLVEPVQVIEVTSSEEDPEEDLEELPPEPIVDALDFLEGDEDPLPEVDSPKDVMSASEAYSTED

SEQ ID NO: 117821 - protein, 206 aa, Glycine max
  Coding DNA Sequence Number=SeqID_1043
MHETSGFSSPGDNIEHRNVVRVLRKKRESAAFYRQGQAVIDSLWLSGHRLQSCVIDYSLLLYGNRLQGVRLDSQILQKKGIIISEFQLWFRPLIQDQIQDSPLSVLRCHKASVEARLQEDVLMMLKEHTSQVLFNPRNPRYMIKQTSRIFQVETSKVGSGSYWKLKVENGSWKWKLLEVEVGSESYWKLKVENGSWKWKLLEVEVV

SEQ ID NO: 117822 - protein, 94 aa, Glycine max
  Coding DNA Sequence Number=SeqID_1044
  Gene Ontology: Cellular component=mitochondrion
  Homolog annotation: Hit_ID=Q9MD97; Match level="QueryCoverage=33%, HitCoverage=59%, E-value=2e-10, Identity=84%"; Hit description =Hypothetical protein rps12
MDVDKILPSSSTLGWHSLKVKGEVQTKKGLWWIPRHPETRKGVVSDEMLRGVENKRRSGDSRYRGKESKSDSRSSGERNGSSINRENGVVGELY

SEQ ID NO: 117823 - protein, 375 aa, Glycine max
  Coding DNA Sequence Number=SeqID_1045
  Gene Ontology: Mol. function=DNA binding; Biological process=DNA recombination
  Homolog annotation: Hit_ID=Q82RY5; Match level="QueryCoverage=83%, HitCoverage=46%, E-value=6e-19, Identity=29%"; Hit description =Putative transposase
  Pfam annotation: Domain name=Phage_integrase; Domain location=6-203; Score=-23.0; E_value=0.049; Accession=PF00589.13; Description=Phage integrase family
MDHLHLLQRHSALVTAEAKVMIYLQERCGRRTSETVRLKEECISYDSAGQAYLEWDRVKPPFGRGTRLPIHKDVHDAIRQWQEIKIEHGIESQWLFPTDRGRKDAPRSAAFLNARIDELVAVVLDEAPFMEEVEGADGNYIRFDLTTIDAYAFRHAFAQRHADATDREGRPTCTPEELQEWMGHKSFKTTMNYFLITSRRKRHAMSSLPSRRLNWSGEAVTVDRERDGFTKLAVSLGSCTEPANVAAGGAACAMDHVCESCPFFLVDPFERDGLLAKRLYLQAQIERVRIIAPDSHMISHYERRTRDCDRILAGIDSYIDNLPEMERSSIHLALEKMEDIRRRAGAPRRIDLRAIHGEFSHLSDIERAGATKGIE

SEQ ID NO: 117824 - protein, 137 aa, Glycine max
  Coding DNA Sequence Number=SeqID_1046
METCLAVGELLQQIIDQGQLEVGDEGREEQHICMQSVDEKIFGRPKPLVIYFTKGAASQKPQHPSVAKPVPFPYQNSHAVPWRYTPPKTKEEEATDISLLSTKVTNITGLSGVTCSGRVFAPPDLPIQPMNVKGKAK

SEQ ID NO: 117825 - protein, 38 aa, Glycine max
  Coding DNA Sequence Number=SeqID_1047
MEEDVREVLGVAPKYCLIVTPAPVACTLPGCPSCLMVA

SEQ ID NO: 117826 - protein, 153 aa, Glycine max
  Coding DNA Sequence Number=SeqID_1048
MASVIASGKVEVAKQMNPRNEDSTSSNSDSGLDRILEQSTSKPKKKPKDLDGEDLSFDFEERPNALKVIPFFTTRTTLKEKSTQSQSESSLEKVKEIIDFFEEDMRLPGEKVYNKDQVVNQPTAPIEKTIVGQLEAMQVDPSPPKVNALEIEQ

SEQ ID NO: 117827 - protein, 164 aa, Glycine max
  Coding DNA Sequence Number=SeqID_1049
MPYFGVIEEIWVLNYDKFTIFVFKYLCDERWSVVLHGKTIGVNVEDDDSIIDTCLNLFSTQMLPNVNEEEEIDDVHPNSTWLHHPAPLLLFLSQHHLFRLRRRRQEKAVGAKRPMVHVDPTPGNVDGPHRKKLRTYLGIVACDKVDNWKQIPASQKDLIWEDIH

SEQ ID NO: 117828 - protein, 93 aa, Glycine max
  Coding DNA Sequence Number=SeqID_1050
MDKVDIFVPHPLTNACLLIQLSSECGCKPLVCLLKRPALLSVDFQDCSIRDYSSCTLVGGQPFPCVQESPTTRDPRSLNPFFRNKKKRRRGLS

SEQ ID NO: 117829 - protein, 177 aa, Glycine max
  Coding DNA Sequence Number=SeqID_1051
MSPQGQLKGLLEWLENRIMEITPSLKDIELKDELGVKLLLFARIMTQVGVDMNAFCLARRSQIVANGGPFPLSLKTLRGSISTIKGVTAITKVARGSFRYKDGSSQEKRLKQYVMYSIERVLGSKMIKVNRMRADTREGIVNKLLSLTLAEEGTREGTIDKSLKFNLSWEGYSRGNY

SEQ ID NO: 117830 - protein, 180 aa, Glycine max
  Coding DNA Sequence Number=SeqID_1052
  Pfam annotation: Domain name=DUF506; Domain location=20-153; Score= -70.5; E_value=0.00055; Accession=PF04720.3; Description=Protein of unknown function (DUF506)
MDKEFSTIPVAGRSSDDVSFADTVFGFWDSSNSSNDRDDDDDDDDDDETICTAENGKAFWEEQYQLLKAILCRTSSYETKVRQATKGVLRELNISEMLCICRRAEVAKSCRNCLLREIYTLRFKKLDIKINPIGNGNNKFTIRILVLVGSAKKEANSWATDASANIATSLEVEYVMVEQQ

SEQ ID NO: 117831 - protein, 117 aa, Glycine max
  Coding DNA Sequence Number=SeqID_1053
  Subcellular localization annotation: CTP_CleavageSite=79; ConfidenceScore=5.81e-01
MPPLPNLWLLFHAGLSSSLCLSVLSSSPFSLFLASLLSLAPLSLPFFSFIFVLSLPPMPLVRSQLHYSVSLSLRLPDVVASRASSPFAPPQVHLAIHTLWFEGMKKLDMKIFWRTHC

SEQ ID NO: 117832 - protein, 476 aa, Glycine max
  Coding DNA Sequence Number=SeqID_1054
  Gene Ontology: Mol. function=RNA-directed DNA polymerase activity; Biological process=RNA-dependent DNA replication
MVSWQKAPNMLPITFTSDDFKEIDPVQNNSMVISVELANCIIMKTLVDQESLTGILFWNTFKQMDIPKSEILLHDDPFFNFAGERGKMEVEEVEELDLDLGIDDDNCVRMIEETSTFQLSPKEGQVSSSTVGDCQLMVAQFIREIDYSTWLSNLVMAKKLNGKWRMCTDNLSAFNGQGVQGSAWMKPGSLCGWHGGGKFLGFMLTHRGIHVNLDKCQAIVEIRSPQNVIEAKRLASMKAFLSRFLPRIAERVRPIMNLLKKTNNFVWDDECKESFRHLKETLATPLILSKPNINKKLIVYLLVSGLRNEVLTDFINELHPLQSHFEQEKWMVHVDGSSNRHGSGAWLILEEPNGIAQIQSLHFDFKATCNQAEYEALLAGLTLAKEVGAQRHETFPTNKGKAKKTLRAQATRHLRHAFRGKNNGLKSVERQIILANFKDKLFEIHEKMPPMPKAWEFDTLVVPRTTSYGFPLVVPV

SEQ ID NO: 117833 - protein, 188 aa, Glycine max
  Coding DNA Sequence Number=SeqID_1055
MRRLQARVSKMQRHHVEELISFHRENAHLWECHRSWKPEANPSKGGEVESTTINLPRATNFSIHSNTNPPSLNTLGKQFLQFKNLFVPSIMEATLPSNRKNLTIEKYDGTIDPNEHLNVYIIQVGIYTTDNAILCQVWADAISAKKDMISPTPTKLATTRRGIDHPENRVMLATLPLQPIDLISWMRP

SEQ ID NO: 117834 - protein, 199 aa, Glycine max
  Coding DNA Sequence Number=SeqID_1056
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=39%, E-value=2e-35, Identity=49%"; Hit description =Integrase, catalytic region
  Pfam annotation: Domain name=Chromo; Domain location=103-151; Score =14.0; E_value=0.022; Accession=PF00385.14; Description='chromo' (CHRromatin Organisation MOdifier
MKRYADAKRDDVSFSVGQWVYVRLRPGRQTSVTGPHHPKLSKRFFGPFMFEDRIGFVAYRLRLPPDSQVHPVFHSSLLRAHHGPPPLSTDTWPLGTLTQQPIRRPLCFLDSKMDDSTDPPTQMVLTQWVGEPPEDTTWEPWPSLCKSYHLKDKVDFGGGGIVSNSAASNPAQARPRSVRVKSAPIHLKDYYVDHMHGSS

SEQ ID NO: 117835 - protein, 69 aa, Glycine max
  Coding DNA Sequence Number=SeqID_1057
  Gene Ontology: Mol. function=nucleic acid binding; Biological process= DNA integration
MNEATYNNAESYLYLHPSENPATALVSPVLESTNYHSWSRSMITALSAKNKLEFVDGSAPEPLKTDRMY

SEQ ID NO: 117836 - protein, 672 aa, Glycine max
  Coding DNA Sequence Number=SeqID_1058
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=94%, HitCoverage=93%, E-value=0.0, Identity=52%"; Hit description =Receptor protein kinase like protein
  Pfam annotation: Domain name=Lectin_legB; Domain location=25-263; Score=326.4; E_value=5e-95; Accession=PF00139.10; Description=Legume lectin domain
  Pfam annotation: Domain name=Pkinase; Domain location=356-622; Score =150.4; E_value=4.9e-42; Accession=PF00069.15; Description=Protein kinase domain
  Pfam annotation: Domain name=Pkinase_Tyr; Domain location=356-622; Score=118.9; E_value=1.4e-32; Accession=PF07714.7; Description =Protein tyrosine kinase
  Pfam module annotation: Pfam domain module=Lectin_legB::Pkinase::Pkina se_Tyr; Domain location=25-263::356-622::356-622
  Subcellular localization annotation: CTP_CleavageSite=65; ConfidenceScore=5.10e-01
MSTLLISLLLFIISNLTLLLLTSVSCTEFIYNTNFNSTNTLLHGNATIESSILTLTNRSTFSVGRAFYPFKILTKPSNSSSTPLPFSTSFIFSITPFKDLLPGHGFVFILTPSAGTTGVNSAQHLGLFNYTNNGDPNNHVFGVEFDVFDNQEFNDINDNHVGVDINSLSSFASHDAGFWGGGDNDEFEDLKLNDGENYQVWIEYLDSRVNVTMAPAGQKRPQRPLISEIVDLSEVLLDEMYVGFCGATGQLVESHKILAWSFSNTNFSIGDALVTTNLPSFVHSKESILRSTGFIVGIIIGVLFVIGGAVVIFVLFLRRKRSKRKDEEQEEIEDWELEYWPHRVSYEDIYAATKGFSDQHVIGFGGNGKVYKGLLQGVQVAVKRIPCDSEHGMREFLSEISSLGRLKHKNVVPLRGWCKKQRSLILIYDYMDNGSLDKRIFDGDENTIFGWEKRIKVLKDVAHGILYLHEGWEVKVLHRDIKSSNVLLDKGMNARLGDFGLARMHHHGQIAHTSQVIGTVGFMAPELIHTGRASTQTDVFSFGVLILEVVCGRRPNEENRPLVTWLWSLKERGEECSALDERLKRRGECSIDEVKRVLHLGLLCTHHDPHVRPSMRQVVKVLEGESLDMSLLDKINSAAGYVGSFVNRFHPTIEDIYSSNCSFTTLTMRADE

SEQ ID NO: 117837 - protein, 670 aa, Glycine max
  Coding DNA Sequence Number=SeqID_1059
  Gene Ontology: Mol. function=RNA-directed DNA polymerase activity; Cellular component=chromatin; Biological process=chromatin assembly or disassembly
  Pfam annotation: Domain name=RVP_2; Domain location=333-450; Score= -31.0; E_value=0.00026; Accession=PF08284.2; Description=Retroviral aspartyl protease
  Pfam module annotation: Pfam domain module=RVP_2::Retrotrans_gag; Domain location=333-450::104-194
MADHGTRKTTTDCLEEAITLLTNSQASLSDRYMDLSGKVNSILDHLRLHDSGRNAANSANHHKPQRNSVKLDIPRFDGHDPLGWIFKITQLFQYQDTPEEERITVASLYLDGAALSWYQWMFSNGFITSWEGFLQALESRFAPTFYDDPKGALFKLTQKGSVNEYLTEFERLANRVVGLPPPFLLSCFISGLNADVRREVMTLQPISLLQATALAKLQEEKLRDRVVSNTRNLYQPKPLQPLTPNPTTKAKPPFVQRSPAEIAFRREKGLCYNCDEKWNTNHRCKGRVMLLIADDQQLDPDVSVSELEEALPTSIDTNNEPSADSNCSHISLHALSGSPSTDTFRIFGSVKNAQLTILVDSGSTHNFLQPRIAQFLKLPIQSTQPLQVLVGNGSTLDCNQVCPKTLVTIQGHPFSVSFHLLQISGADAVLGVDWLKNFLSAQCLTRNHTRNCPGPTSLPFHSASSSPIQPSVPDSLTTTTTSSSGSPRYTTTRHSPHQRQAVQFQSIFFTGSPGKEERRSSLSSHLQHLEAIFEALQNAEFYLKQSKCLSAQQTIEYLGHMVSGNGVTPEPSKIQAMVQWPTPTSVRELRAFLGLTGFYRKFIRGYAAIAAPLTSLLCKDAFTWTTESQEAFIQLKYAMTNALVLALPNFVEPFVIETDASAMAIGAVLT

SEQ ID NO: 117838 - protein, 1122 aa, Glycine max
  Coding DNA Sequence Number=SeqID_1060
  Gene Ontology: Mol. function=DNA binding; Cellular component=oxygen evolving complex; Biological process=DNA integration
  Homolog annotation: Hit_ID=Q1SS72; Match level="QueryCoverage=96%, HitCoverage=75%, E-value=0.0, Identity=50%"; Hit description =Integrase, catalytic region
  Pfam annotation: Domain name=rve; Domain location=257-417; Score =156.6; E_value=6.6e-44; Accession=PF00665.16; Description=Integrase core domain
  Pfam module annotation: Pfam domain module=RVT_2::rve; Domain location=615-870::257-417
MNDKSMDDQTQHHEAQDSVRFSPEQHKALLALIQRPLTGSTASEQTKQVASILSCTTDRLPNPGMSSSIVSSWILDSGATDHVTCSLNNLHSYEPINPVTVKLPNGHHVQATHSGIVYLSKTITLFNVLYIPTFTFNLISISKLVSSTDCALIFSSTSCMLQDTNTRMRIGIVKERHGLYHLIPDQNDKVVYSAIVHPKCNIIPVDLWHFRMGHLSTERLQCMKPYYPILKHDRNFVCNTCHYAKHKKLPFSSSISHALHNFDLLHMDIWGPCSKISMHGHKYFLTIIDDHSRFTWVHLMHSKAETRDIIINFITSIETQYNQKVKIIRSDNGSEFIMTNFYASKGIVHQTSCIETPEQNGIVERKHQHLINVTRALLFQANMPSSFWNYALLHAAYLINCIPTPFLHNISPYETLHGHIPNISHLRIFGCLCYAGTIKANRKKLEPRAHPCIFIGFKPNTKGYMLYDLHSHSIITSRNVVFYENHFPQIINTQPSCMEPSTILPEPFSNNPCEPTAETTQHPVQEPIDQTLKATSPQPRRSTRTKQTPTYLRDYHRDLSSHDTNASTKVRYPLSSVLSYSRLSPTHKHFVMSITSTVEPSSYAEASQHDCWIKAMQAELDALQSNETWRLTPLPPHKTAIGCRWIYKIKHRADGSIERYKARLVAKGYTQMEGLDYLDTFSPVAKLTTVRFLLAIAAMNNWHLRQLDVNNAFLHGELDEEVYMQVPPGLTIQNPNLVCRLQRSLYGLKQASRQWFLKLSSLLTTHGFQKSQLDHSLFLRFTGSITTILLVYVDDIILTGNSSSEIQEIITILDQTFKIKDLGNLKYFLGLEVARSSNGIHLSQRKYTLDILSDSGMLGCRPNTTPMDYSTKLHTTAGTPLSDAESSSYRRLVGRLIYLTNTRPNIMYAVQQLSQYMSSPTNMHLQAAYRVLRYLKSTPGSGVFFSATSIPQLRAFSDSDWAGCQDSRRSITGFVVYFGSSLVSWQSKKQNTVSRSSSEAEYRALASTTCELQWLTYLLQDFRIQFIEPATIYCDNRSAIQIATNPVFHERTKHIEIDCHIVRQRVTSGHLKLLPVTSSLQLADIFTKALPPATFQTLCTKLGMLNIHSQLEGGILADASKN

SEQ ID NO: 117839 - protein, 33 aa, Glycine max
  Coding DNA Sequence Number=SeqID_1061
MARPARDLNALSARCGAERDYEGPCKPSMAMSG

SEQ ID NO: 117840 - protein, 695 aa, Glycine max
  Coding DNA Sequence Number=SeqID_1062
  Gene Ontology: Mol. function=protein serine/threonine kinase activity; Cellular component=nucleus; Biological process=protein amino acid phosphorylation
  Homolog annotation: Hit_ID=Q9FKV9; Match level="QueryCoverage=97%, HitCoverage=98%, E-value=1e-162, Identity=48%"; Hit description =Cyclin-dependent protein kinase-like protein
  Pfam annotation: Domain name=Pkinase; Domain location=135-419; Score =322.8; E_value=6e-94; Accession=PF00069.15; Description=Protein kinase domain
  Pfam annotation: Domain name=Pkinase_Tyr; Domain location=135-418; Score=34.9; E_value=1.3e-14; Accession=PF07714.7; Description =Protein tyrosine kinase
  Pfam module annotation: Pfam domain module=Pkinase::Pkinase_Tyr; Domain location=135-419::135-418
MGCICSKASAVEDSKEAVTEKFQSYSTRPSELNVLRLNSTRRVDEGGVKDVLIVGGHVKGSLIDKKANGSGQLYGDHDAKKKLEKLELTVVDHIGPGRVPKAIEGEQVAAGWPAWLSSVAGEAIKGWIPRSANTFERLHKIGQGTYSTVYKARDVINQKFVALKKVRFDNLDPESVKFMTREIHVLRRLDHPNIIKLEGLITSQMSRSLYLVFEYMEHDLTGLASNPDIKFSEPQLKCYMRQLLSGLDHCHSHGVLHRDIKGSNLLIDNNGVLKIADFGLASFYDPQHNVPLTSRVVTLWYRPPELLLGANHYGVAVDLWSTGCILGELYTGRPILPGKTEVEQLHRIFKLCGSPSDDYWLKSRLSHSTVFRPPHHYRRCVADTFKDYPSTAVKLIETLLSVEPAHRGTAAAALESEFFMSEPLPCDPSSLPKYVPSKEIDAKLRDEAVRQGVVGGREQKVASGVRQEKGHRANVTAKDNADPGLAVQQGHCSSSRNQSELSNPHRGSVSGILVFPHKQSEKEMNDNFSGHLYKRPSHSGPLVPGSVWAKGRKEVDDVPPVSNRVNLSKLSGLVASRTFSEDQEVKPVHSNHRKPIEVRKSVESTNGSESRRRHDQKQIVDLNQIESRRVPAEKSTPGGRESMGNKIYLSGPLMVSSSNMDQMLKEHDRKIQEFSRRARIDKSRARGEKVFAQRK

SEQ ID NO: 117841 - protein, 211 aa, Glycine max
  Coding DNA Sequence Number=SeqID_1063
  Gene Ontology: Mol. function=serine-type endopeptidase activity; Cellular component=extracellular region; Biological process =proteolysis
  Homolog annotation: Hit_ID=Q54484; Match level="QueryCoverage=99%, HitCoverage=20%, E-value=7e-97, Identity=84%"; Hit description=SSP-h2
  Pfam annotation: Domain name=Peptidase_S8; Domain location=1-174; Score=-61.0; E_value=0.0016; Accession=PF00082.12; Description =Subtilase family
TIRSGQTVARQPGRRRLSGRHRRRAQNILVLFAAGNDGNYNQPDVISGLAYFVPDIAPNWLSVASVAQDAASTNSVPYTISSFSSRCGYTASFCVSSPGTRVYSSVIEGTSVENLTTGYAKYSGTSMAAPHVAGSVAVLMERFPYLNGAQVAEVLKTTATDMGAPGIDALYGWGMINLGKAINGPGMLATVEDIPEEFRIPDPTGVAYGPT

SEQ ID NO: 117842 - protein, 75 aa, Glycine max
  Coding DNA Sequence Number=SeqID_1064
MDKCRLKLQTKFREDPTVNEGWAAFLPRQLHGVTLVEFSLTRGICEQCLIRIWLNYHKESGFSISGDTIRTHEHC

SEQ ID NO: 117843 - protein, 109 aa, Glycine max
  Coding DNA Sequence Number=SeqID_1065
  Gene Ontology: Mol. function=structural constituent of ribosome; Cellular component=ribonucleoprotein complex; Biological process =translation
  Homolog annotation: Hit_ID=P56804; Match level="QueryCoverage=78%, HitCoverage=86%, E-value=3e-38, Identity=88%"; Hit description =Chloroplast 30S ribosomal protein S14
  Pfam annotation: Domain name=Ribosomal_S14; Domain location=45-95; Score=59.1; E_value=1.4e-14; Accession=PF00253.11; Description =Ribosomal protein S14pS29e
MARKSVIQREKKIQKLEQKYHLIRRSSKKEISKVPSLSDKWKIHGKLESLPRNSAPIRLHRRCFSTGRPRANYRDFGLSGHILREMSNLVARKAHNLEVTGSNPVSATF

SEQ ID NO: 117844 - protein, 82 aa, Glycine max
  Coding DNA Sequence Number=SeqID_1066
ELVPEEDELIPPEPFVYETDPASAQEEVASPELIPQSSPTPVLDDPQPYALASVPDQPIVQDPPVALVLDLNEHAQDHSQDF

SEQ ID NO: 117845 - protein, 416 aa, Glycine max
  Coding DNA Sequence Number=SeqID_1067
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=96%, HitCoverage=17%, E-value=0.0, Identity=79%"; Hit description=RNase H, putative
SATNSVGSSSITSTFCSAGFINNSPEANAVLEDVPEERVLAFVTPGKLVRNWDAVDIPSVVHASKLGIYEPVEHNNPALSPNFESPVYEAEEEEDDEIPKELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMAVEDREKTSFITPWGTFCYRVMPFGLINAGATYQRGMTTLFHDMMHKEIEVYVDDMIVKSGTEEEHVEYLLKMFQRLRKYQLRLNPNKCTFGVRSGKLLGFIVSQKATEVDPDKVKAIREMPVPQTEKQ

SEQ ID NO: 117846 - protein, 215 aa, Glycine max
  Coding DNA Sequence Number=SeqID_1068
  Homolog annotation: Hit_ID=Q47522; Match level="QueryCoverage=24%, HitCoverage=70%, E-value=3e-14, Identity=70%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGIRFTHTLLTPFMQKTHAKIVLQIQFTAVDGFVDNGMATGFDSDRAGGWARFGLLLDSRISSLSIPSTSRGGPVPAFVPFSEVGKPVVPAALMNRPTRGERRFAYWALAECILAYYVGTDEGVSEVLHVAEKKGCT

SEQ ID NO: 117847 - protein, 177 aa, Glycine max
  Coding DNA Sequence Number=SeqID_1069
  Homolog annotation: Hit_ID=Q6CYK8; Match level="QueryCoverage=37%, HitCoverage=12%, E-value=7e-14, Identity=53%"; Hit description =Putative glycosyl transferase
METRAATLAGAGRHAALLAGGDDDSDAQQQDDTLTLRLLAAADLLWFRGHFPTLPILPGVAQLDWVLHYGLTRLAPAAGAAGCAAGAAVAVAAGKVAAKLRSPAAGRFACAECLFCALRADSLLQPRCHAGVGAGAAGPVQPAGDRGRRRQRCPDPTAYRCAGCAAAPGADAAAQPR

SEQ ID NO: 117848 - protein, 106 aa, Glycine max
  Coding DNA Sequence Number=SeqID_1070
  Gene Ontology: Mol. function=catalytic activity; Biological process =metabolic process
  Homolog annotation: Hit_ID=Q6CYK6; Match level="QueryCoverage=98%, HitCoverage=23%, E-value=2e-23, Identity=54%"; Hit description =Putative AMP-binding enzyme
MAAVTLNRQRGGIFHTRQRQQATLYFAQRHALVFNFHHPILAPCQLKLARRLLHDTIVQRTARAALQQIGEDLPALRRDLAQRNVGETLPQRSVIAGPAPRDHPGF

SEQ ID NO: 117849 - protein, 96 aa, Glycine max
  Coding DNA Sequence Number=SeqID_1071
MCEKRHRSSRSKTLPPTCCLVKDSLEEQASQGSFVAYGHQDVLTAAIGLPECPGCVRAAGVGVTIKQYFGPTPRTSYTSSTMAPEDLEQLTQQIRD

SEQ ID NO: 117850 - protein, 87 aa, Glycine max
  Coding DNA Sequence Number=SeqID_1072
ARISREWGQCGMRHHFRIHPRPRPSLTTPQSNPNKQQSEDKSLTRIIEQNGIKNAKNGDLRAAKSVSPVARPGEPSSPRRAQLAQAS

SEQ ID NO: 117851 - protein, 69 aa, Glycine max
  Coding DNA Sequence Number=SeqID_1073
MDPLSEMHPLSKASSSLSGWETLEEDKTKICSPSAQPARPTRTLSLLTLSAPTLAKRKFTNLRLARYAR

SEQ ID NO: 117852 - protein, 251 aa, Glycine max
  Coding DNA Sequence Number=SeqID_1074
  Homolog annotation: Hit_ID=Q47522; Match level="QueryCoverage=14%, HitCoverage=44%, E-value=8e-14, Identity=100%"; Hit description=LacZ protein
VLQWLLFLSAVPPVQLLTGWCVTAKAPPDISAGKCSGRVPFAIQAAQLLGRAIGAGLFAITPAGERGMCCKAIKLGIRSAVSAASPRRSAPARRPPRAPRPVAAVPCARARRPPMPAGRPHSCPPGRDARPAPTGVPAVCWTAPGSGSRHPDCGAHGRAHDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 117853 - protein, 187 aa, Glycine max
  Coding DNA Sequence Number=SeqID_1075
MVIRTPFTIQRRSNLMARRDKLWSFCTFLSSIGGEPDDMRRQIMVIRTPFAIQRRSSPMACREKLWSFSTFLSSRGGEPDDMQRQIMFIHTPFAIQRRSSLMARRDKLWSFYTFLSSRGGEPDDMQRQIMVIRIPFAIQRRSSFFTLVVRKHSRPATRRILLCWAKTIGCNGKGKCHGCPTLSFSKH

SEQ ID NO: 117854 - protein, 132 aa, Glycine max
  Coding DNA Sequence Number=SeqID_1076
FPSLITGLCQSFGVPVTLSKVIRPPITRAFIEKYCTPRQVQGDAHQAADAPPPPRQADPAGSLGIERYLQHLVRQQATNHRGQFGAKVAWLEDWPEAQVGEEPVGSVGEAEEARMDEDMTDLHSFLGGSGAT

SEQ ID NO: 117855 - protein, 143 aa, Glycine max
  Coding DNA Sequence Number=SeqID_1077
MAPSLEMCTEAGDHRTPCASRKQEGDAIDLECRGVGGAAVARAAASRRTPSSRFLDPMWRSSHLLCKEMGRALHCKATQPPLARLAVAIGTAAVGRPCSCAQAHQGGGWPSNPLFVHAALAHQAKKRTLKGVPLIWIPSVPPT

SEQ ID NO: 117856 - protein, 361 aa, Glycine max
  Coding DNA Sequence Number=SeqID_1078
  Homolog annotation: Hit_ID=Q9AVH2; Match level="QueryCoverage=40%, HitCoverage=63%, E-value=6e-50, Identity=60%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRKANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTD

SEQ ID NO: 117857 - protein, 71 aa, Glycine max
  Coding DNA Sequence Number=SeqID_1079
MKMKASKTRNDLKVSDSNSYRLKNEKRTKKSEEWRKIFTDLLTETSRKRYGSTSTRFSSRKCGFTQNSRNA

SEQ ID NO: 117858 - protein, 309 aa, Glycine max
  Coding DNA Sequence Number=SeqID_1080
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-30, Identity=28%"; Hit description= UPI00006A17C9 related cluster
DYTSSPLEDCTPLASKGFTPSPLEDYTSSPSEGYMSSPSEDYMSSPLEDYTAARLRLQGLCVLTFIGLHTLTFIGLHVIGFRGLHALAFRGQGLHVLAYRGLHVLPFRGLHVLAFRAQHVLAFRGLHVLAFKGLHVLTFRGLQVLAFRGLHILTFRGLHALTFRALHILAFKWLHALSFRGLHRTTRPRLQRATRPHLQGTTRPRLQRTTRLHILTFKGVNALAFLGLHTLSIRGIHVLASRGLQALAFKGLHTLAFRLLLVLTFRGLHVLAFRGLHVLPFRRLHALAFTWLHALTFRGLHVLAFRGLH

SEQ ID NO: 117859 - protein, 71 aa, Glycine max
  Coding DNA Sequence Number=SeqID_1081
MENVEIVSFRLMTHACNNYVWKDLILPYQASQSLVLSDVRYDTGTDACVRVEFDMFDKCSPDTDTDGLCPD

SEQ ID NO: 117860 - protein, 319 aa, Glycine max
  Coding DNA Sequence Number=SeqID_1082
  Gene Ontology: Mol. function=hydrolase activity; Cellular component =nucleus; Biological process=metabolic process
  Homolog annotation: Hit_ID=Q0ZPV7; Match level="QueryCoverage=98%, HitCoverage=94%, E-value=1e-63, Identity=40%"; Hit description=CXE carboxylesterase
  Pfam annotation: Domain name=Abhydrolase_3; Domain location=77-300; Score=174.2; E_value=3.3e-49; Accession=PF07859.3; Description =alphabeta hydrolase fold
MSKFDPYTHLGITLNPDGTVTRAFKAPTVDANPEPSPGTTTVSKDITLDTQKETWVRIFRPTRLPSDHNTVARLPIVIYFHNGGFLFHSPANLSCHKKCTQIASDVPSVVVSASYRLAPENRLPAMYHDARDAVLWVKKQMNDPNGEQWLKDYGDASRVYIYGCDSGANIAFNVSMQVADLDLEPLRIRGLVMNQPMFGGEKRTGSELRYATDETLPLPVLDLMWYLTLPKETDRDHRYCNPMVKGPHLDNVKKLRKCLVIGFHGDIMVDRQQEFVTMLAKWGAQVEARFDQVGFHNIDMVDAARASAIINIAKDFILG

SEQ ID NO: 117861 - protein, 301 aa, Glycine max
  Coding DNA Sequence Number=SeqID_1083
  Gene Ontology: Mol. function=RNA-directed DNA polymerase activity; Cellular component=nucleus; Biological process=RNA-dependent DNA replication
MVETLIVSIPKIDTPTYFGDFRPISLCKSDNALIAQEIIHHMHKKKEKKAFIMFKIFFKKAYERVDWDFLHLTLKDFGFPPPTIKLIMKCTMSTTLSLKWNGKKLDNFAPSRGLRQGDPMSPYLFVLCMEKLSLLIQQKVQDSSTWVPVKIAQNAPSISHLFFVGDCLLFTEAKSSQIRLVMEVLEAFCGASGLKVNVHKTHIMTSKHVSTIKVNRFAAISQFQHTRQIGKYMGFPMLTGRVRNSDFNYILEKINSRLAGWKMKLLNRAGSLRGPWKRKEGAVVVVVVERKLKWKEELKVK

SEQ ID NO: 117862 - protein, 73 aa, Glycine max
  Coding DNA Sequence Number=SeqID_1084
MPFAPAFELEQPIPQDSPAAQVLDLNEHAQEQSQDSLNFSTLSWLLVQKACLNSELVEFDMQWIVLYEMSVCK

SEQ ID NO: 117863 - protein, 368 aa, Glycine max
  Coding DNA Sequence Number=SeqID_1085
  Gene Ontology: Mol. function=protein serine/threonine kinase activity; Cellular component=integral to membrane; Biological process=protein amino acid phosphorylation
  Homolog annotation: Hit_ID=Q9STJ8; Match level="QueryCoverage=91%, HitCoverage=52%, E-value=8e-66, Identity=45%"; Hit description =Receptor kinase-like protein
  Pfam annotation: Domain name=Pkinase; Domain location=76-341; Score =8.7; E_value=4.4e-09; Accession=PF00069.15; Description=Protein kinase domain
  Pfam annotation: Domain name=Pkinase_Tyr; Domain location=76-272; Score=-17.2; E_value=2.1e-11; Accession=PF07714.7; Description =Protein tyrosine kinase
  Pfam module annotation: Pfam domain module=Pkinase::Pkinase_Tyr; Domain location=76-341::76-272
MPSRPPPLSPPATAAASHRREIILCGAIGGALFLTALIISVMIFIYRKLSYSRTAPFEHNQRRFSYTVLRRATNSFSPSTKLGHGGFGSVHKATLPSGQTVALKVMDSPGSLQGEREFHNELTLCSNLKSPFVISLLGFSSDRRGKKLVLVYELMPNRSLQDALLDRRCPELMSWGKRFDVAVSVARGLEYLHHVCDPPVIHGDIKPSNVLLDRDFRAKIGDFGLARVKNVEDLGMVDENEKKKDEEFSVLEGESVVDVDRSPESCPVRAAEYSDASPVGGDKLSVVSDGGGCFESVDSGSVSVNPKKCGVGGGGGGSGRDWWWRLESGGGGESGRVKDYVMEWIGSEIKKERPKSEWDDSCSSSSPK

SEQ ID NO: 117864 - protein, 251 aa, Glycine max
  Coding DNA Sequence Number=SeqID_1086
  Gene Ontology: Mol. function=protein serine/threonine kinase activity; Biological process=protein amino acid phosphorylation
  Homolog annotation: Hit_ID=Q10P10; Match level="QueryCoverage=80%, HitCoverage=31%, E-value=1e-48, Identity=47%"; Hit description =Protein kinase domain containing protein, expressed
  Pfam annotation: Domain name=Pkinase; Domain location=3-221; Score= -110.7; E_value=0.058; Accession=PF00069.15; Description=Protein kinase domain
  Pfam annotation: Domain name=Pkinase_Tyr; Domain location=5-221; Score=-169.5; E_value=0.045; Accession=PF07714.7; Description =Protein tyrosine kinase
  Pfam module annotation: Pfam domain module=Pkinase::Pkinase_Tyr; Domain location=3-221::5-221
WWASLDEERVKGKAKKKNRKPREWWKEEFCEELSKKSRKKKRGMEWWQREEEGVEQKRKRKSKGSRGSIDWWLDGLSGEMRNNGRRNSQDWGVSGDVPKSGGISSTPSMRGTVCYIAPEYGGGGQLSEKCDVYSFGVLLLVLVAGRRPLQVTASPISEFERANLISWARQLAHNGRLLDLVDTSIHSLDKEQALLCITIALLCLQRSPGKRPSIKEVVGMLSGEAEPPHLPFEFSPSPPSNFPFKTRKKAR

SEQ ID NO: 117865 - protein, 55 aa, Glycine max
  Coding DNA Sequence Number=SeqID_1087
  Gene Ontology: Mol. function=helicase activity
  Homolog annotation: Hit_ID=Q1SZZ8; Match level="QueryCoverage=94%, HitCoverage=24%, E-value=5e-15, Identity=69%"; Hit description =Unnamed protein product; contains similarity to helicase gene _id:T13C12.11-related
MVPNGLENLECAVRPPGKSNEAIPLEAIVQTIPPLERIPDDKVVQTNVLPVPPYP

SEQ ID NO: 117866 - protein, 271 aa, Glycine max
  Coding DNA Sequence Number=SeqID_1088
  Gene Ontology: Mol. function=pepsin A activity; Cellular component =endoplasmic reticulum; Biological process=proteolysis
  Homolog annotation: Hit_ID=Q9SJJ2; Match level="QueryCoverage=95%, HitCoverage=75%, E-value=1e-22, Identity=26%"; Hit description =Putative chloroplast nucleoid DNA binding protein
MDTSSDILWIMCNHVGLLFDPSKSSTFSPLCKTPCGFKGCKCDPIPFNISYVDKSSTSGTFGSDTVVFETTDEGHSQIFDVLVRCGHNIGFNTDPGYNGIRGLNNGPNSLATKIGQKFSYCVGNLADPYYNYNQLILCEGADLEGYSTPFEVHHGFYYVTLKGIIVGEKRLDIAPITFEIKGNNTGGVIRDSGTTITYLVDMVTFHFADGADLALDTGSFFNQLNSILCMTVSPASILNTTISPSVIELLAQQSYNVGYDLVNQFCLLPKN

SEQ ID NO: 117867 - protein, 330 aa, Glycine max
  Coding DNA Sequence Number=SeqID_1089
  Gene Ontology: Mol. function=pepsin A activity; Cellular component =cellulose and pectin-containing cell wall; Biological process =proteolysis
  Homolog annotation: Hit_ID=Q2HUN0; Match level="QueryCoverage=56%, HitCoverage=93%, E-value=5e-42, Identity=50%"; Hit description =Peptidase aspartic, catalytic
  Pfam annotation: Domain name=Asp; Domain location=2-323; Score= -130.2; E_value=6.4e-06; Accession=PF00026.14; Description=Eukaryotic aspartyl protease
MDTGSDILWVMCTPCTNCDNDLGLLFDPSKSSTFSPLCKTPCDFEGCRCDPIPFTVTYADNSTASGTFGRDTVVFETTDEGTSRISDVLFGCGHNIGHDTDPGHNGILGLNNGPDSLVTKLGQKFSYCIGNLADPYYNYHQLILGEGADLEGYSTPFEVYNGFYYVTMEGISVGEKRLDIAPETFEMKENRAGGVIIDTGSTITFLVDSVHKLLSKEVRNLLGWSFRQATIEKSPWMQCFYGSISRDLVGFPVVTFHFSDGADLALDSGSFFNQLNDNVFCMTVGPVSSLNIKSKPSLIGLLAQQSYNVGYDLVNQFVYFQRIDCELLTG

SEQ ID NO: 117868 - protein, 343 aa, Glycine max
  Coding DNA Sequence Number=SeqID_1090
  Gene Ontology: Mol. function=oxysterol binding; Cellular component =integral to membrane; Biological process=steroid metabolic process
  Homolog annotation: Hit_ID=Q2HUM5; Match level="QueryCoverage=99%, HitCoverage=86%, E-value=1e-143, Identity=74%"; Hit description =Oxysterol-binding protein
  Pfam annotation: Domain name=Oxysterol_BP; Domain location=1-342; Score=-37.5; E_value=3.3e-07; Accession=PF01237.9; Description =Oxysterol-binding protein
MQLPPQFNFPKSQLQCYGESIYSKTSDLLSRCNTGQNPLERLIFVVAWSISTTRPAIFGVAPYNPTLGETHHVSKGNLNVLLEQAHAFTFCYMLNVVSHHPPVSALHATDEKENIEIIWCQYPVPKFNGTSVEAQVHGKRQLKLINHGETYEMNSPHLLIKILPVPGIDWVGNVNIKCIETGLVAELCYIGQSFFGFGGSRRLIKGKIIDSSSLKILHEVNGHWDSTVTLKETNSGEVRAIYDAKEVIYGLQAPTVKDAESVWPTESALIWSELSQAILSKNWEKAREAKKAVEERQRELLRERESKGETWVPKHFILSQSKEGVWDCSPIQKWVPASPIVTL

SEQ ID NO: 117869 - protein, 112 aa, Glycine max
  Coding DNA Sequence Number=SeqID_1091
  Homolog annotation: Hit_ID=Q2HUM7; Match level="QueryCoverage=98%, HitCoverage=14%, E-value=1e-20, Identity=42%"; Hit description =Tetratricopeptide-like helical
MEEAGSLLREMLQYKNAAELINIINNEVDTESISDFLATLCEQGRVQEAVSVLFGIACFGSRSRRVPHSSCKSGLKFGPCDDKDLQGFDFYCSRIAALCVKGELEKANQSAT

SEQ ID NO: 117870 - protein, 72 aa, Glycine max
  Coding DNA Sequence Number=SeqID_1092
  Gene Ontology: Mol. function=pepsin A activity; Biological process =proteolysis
  Homolog annotation: Hit_ID=Q2HUN7; Match level="QueryCoverage=69%, HitCoverage=23%, E-value=1e-08, Identity=54%"; Hit description =Peptidase M, neutral zinc metallopeptidases, zinc-binding site; Peptidase aspartic, catalytic
MKPNFSQITTWKDMEDERNTLFHLLNLGDWSPNSFTLAQFAISTTSQMKQPKTEWNSISNTRLHISPTNQHG

SEQ ID NO: 117871 - protein, 1016 aa, Glycine max
  Coding DNA Sequence Number=SeqID_1093
  Gene Ontology: Mol. function=binding; Cellular component =intracellular; Biological process=translation
  Homolog annotation: Hit_ID=Q2HUM7; Match level="QueryCoverage=99%, HitCoverage=99%, E-value=0.0, Identity=63%"; Hit description =Tetratricopeptide-like helical
  Pfam annotation: Domain name=PPR; Domain location=123-157; Score =13.8; E_value=0.17; Accession=PF01535.11; Description=PPR repeat
  Pfam annotation: Domain name=PPR; Domain location=160-194; Score =18.3; E_value=0.029; Accession=PF01535.11; Description=PPR repeat
  Pfam annotation: Domain name=PPR; Domain location=196-230; Score =25.8; E_value=0.00015; Accession=PF01535.11; Description=PPR repeat
  Pfam annotation: Domain name=PPR; Domain location=231-265; Score =10.4; E_value=0.44; Accession=PF01535.11; Description=PPR repeat
  Pfam annotation: Domain name=PPR; Domain location=266-300; Score =39.6; E_value=1e-08; Accession=PF01535.11; Description=PPR repeat
  Pfam annotation: Domain name=PPR; Domain location=301-335; Score =51.2; E_value=3.6e-12; Accession=PF01535.11; Description=PPR repeat
  Pfam annotation: Domain name=PPR; Domain location=336-370; Score =41.6; E_value=2.7e-09; Accession=PF01535.11; Description=PPR repeat
  Pfam annotation: Domain name=PPR; Domain location=371-405; Score =21.5; E_value=0.003; Accession=PF01535.11; Description=PPR repeat
  Pfam annotation: Domain name=PPR; Domain location=436-470; Score =27.5; E_value=4.7e-05; Accession=PF01535.11; Description=PPR repeat
  Pfam annotation: Domain name=PPR; Domain location=471-504; Score =28.3; E_value=2.7e-05; Accession=PF01535.11; Description=PPR repeat
  Pfam annotation: Domain name=PPR; Domain location=505-539; Score =35.9; E_value=1.4e-07; Accession=PF01535.11; Description=PPR repeat
  Pfam annotation: Domain name=PPR; Domain location=663-697; Score =17.1; E_value=0.066; Accession=PF01535.11; Description=PPR repeat
  Pfam annotation: Domain name=PPR; Domain location=698-732; Score =40.2; E_value=7.3e-09; Accession=PF01535.11; Description=PPR repeat
  Pfam annotation: Domain name=PPR; Domain location=733-767; Score =33.5; E_value=7.3e-07; Accession=PF01535.11; Description=PPR repeat
  Pfam annotation: Domain name=PPR; Domain location=768-802; Score =37.4; E_value=5e-08; Accession=PF01535.11; Description=PPR repeat
  Pfam annotation: Domain name=PPR; Domain location=803-837; Score =29.4; E_value=1.3e-05; Accession=PF01535.11; Description=PPR repeat
  Pfam annotation: Domain name=PPR; Domain location=838-872; Score =23.2; E_value=0.0009; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=123-157::160-194::196-230::231-265::266-300::301-335::336 -370::371-405::...
  Pfam module annotation: Domain location=436-470::471-504::505 -539::663-697::698-732::733-767::768-802::803-837::838-872
  Subcellular localization annotation: CTP_CleavageSite=49; ConfidenceScore=5.64e-01
MLFYPRTLSLQTSLKRGFTPTPKPINCFLLFLFRHRKFNLITHFFSQLKSNNAPTNRRTLSLLTWSLLKSHKFEEAEQFMHSHTHITHSSMWDSLIQGLHDPEKALSVLQRCVRDRGVLPSSSTFCLVVHKLSSKGLMGRAIEVLELMAGDGVRYPFDDFVCSSVISGFCRIGKPELALGFFKNVTDCGGLRPNVVTCTALVGALCKMGRVGEVCGLVQWMEREGLGLDVVLYSAWACGYVEERVLGEVFGRMREMVEKGIGHDFVSYTVLVDGFSKLGDVEKSFTFLAKMIKEGHRPNKVTYSAIMSAYCKKGKVEEAFGVFESMKDLGIDLDEYVFVILIDGFGRIGDFDKVFCLFDEMERSGISPSVVAYNAVMNGLSKHGRTSEADELLKNVAADVITYSTLLHGYMEEENIPGILQTKRRLEESGISMDVVMCNVLIRALFMMGAFEDVYALYKGMPEMDLIPNSVTYCTMIDGYCKVGRIEEALEVFDEFRKTLISSLACYNSIINGLCKNGMTEMAIEALLELNHEGLELDIGLLDDANHMWMMMKKKGLSVTCNSYYSILRGHLNNGNREQIYPLLNSFLKDYGLVEPMVQKILACYLCLKDVNGAIRFLGKTMDNSSTVTFLTSILKILIKEGRALDAYRLVTETQDNLPVMYADYAIVIDGLCKGGYLNKALDLCAFVEKKGMNLNIVIYNSIINGLCHEGRLIEAFRLLDSIEKLNLVPSEITYATVIYALCREGFLLDAEHVFSKMVLKGFQPKVQVYNSLLDGISKFGQLEKAFELLNDMETKYIEPDSLTISAVINCYCQKGDMHGALEFYYKFKRKDMSPDFFGFLYLIRGLCTKGRMEEARSVLREMLQSKNVVELINIVNKEVDTESISDFLGTLCEQGRVQEAVTVLNEIVCILFPVQRLSTYNQGSLKQQKIYEWKDEPKSSSIVPSSCKSGLNLGSCDDKDVRNLSTDNGGYMTRSQLHGFDFYYSRIAALCAKGELQKANQSVKEFLSDLTESMN

SEQ ID NO: 117872 - protein, 95 aa, Glycine max
  Coding DNA Sequence Number=SeqID_1094
MMDIAMTMVVHNNDDMTNDNDYDNSVIIMVVGMKITVVMVVVAIDNDDHDPEDRSEDGDLEQHARHTHPYPHRVVMSIPNSLYPTATTYTSFSVK

SEQ ID NO: 117873 - protein, 830 aa, Glycine max
  Coding DNA Sequence Number=SeqID_1095
  Gene Ontology: Mol. function=identical protein binding; Cellular component=cell wall; Biological process=negative regulation of enzyme activity
  Homolog annotation: Hit_ID=O64481; Match level="QueryCoverage=98%, HitCoverage=99%, E-value=0.0, Identity=73%"; Hit description =Subtilisin-like serine protease
  Pfam annotation: Domain name=DUF1034; Domain location=712-830; Score =120.9; E_value=3.5e-33; Accession=PF06280.2; Description=Domain of Unknown Function (DUF1034)
  Pfam annotation: Domain name=PA; Domain location=404-517; Score=62.6; E_value=1.3e-15; Accession=PF02225.12; Description=PA domain
  Pfam annotation: Domain name=Peptidase_S8; Domain location=148-678; Score=101.7; E_value=2.1e-27; Accession=PF00082.12; Description =Subtilase family
  Pfam annotation: Domain name=Subtilisin_N; Domain location=28-138; Score=52.7; E_value=1.2e-12; Accession=PF05922.7; Description =Subtilisin N-terminal Region
  Pfam module annotation: Pfam domain module=DUF1034::PA::Peptidase _S8::Subtilisin_N; Domain location=712-830::404-517::148-678::28-138
MRLWWFLEFGCVFIVVLLFGLVKFGKAEVYIVTVEGEPIISYKGGIDGFEATAVESDDDDDEKLDSTSEVVVSYARHLEKRHDMLLGMLFERGTYNKLYSYRHLINGFAVHLSPEQAETLRHAPGVKSVERDWKVKRLTTHTPQFLGLPTGVWPTGGGYERAGEDIVIGFVDSGIYPHHPSFTTHNTEPYGPVSRYRGKCEVDPDTKRSFCNGKIIGAQHFAQAAIAAGAFNPSIDFDSPLDGDGHGSHTASIAAGRNGIPVRMHGHEFGKASGMAPRARIAVYKALYRLFGGFIADVVAAIDQAVHDGVDILSLSVGPNSPPSNTKTTFLNPFDATLLGAVKAGVFVAQAAGNGGPFPKSLVSYSPWIATVAAAIDDRRYKNHLILGNGKILAGLGLSPGEASTRLNQTYTLVAATDVLLDSSVTKYSPTDCQRPELLNKNLIKGNILLCGYSYNFVIGSASIKQVSETAKALGAVGFVLCVENVSPGTKFDPVPVGIPGILITDASKSKELIDYYNISTPRDWTGRVKTFEGTGKIEDGLMPILHKSAPQVAMFSARGPNIKDFSFQEADLLKPDILAPGSLIWAAWSLNGTDEPNYVGEGFAMISGTSMAAPHIAGIAALIKQKHPHWSPAAIKSALMTTSTTLDRAGNPILAQLYSETEAMKLVKATPFDYGSGHVNPRAALDPGLIFDAGYEDYLGFLCTTPGIDVHEIKNYTNSPCNNTMGHPSNLNTPSITISHLVRSQIVTRTVTNVADEEETYVITARMQPAVAIDVNPPAMTIKASASRRFTVTLTVRSVTGTYSFGEVLMKGSRGHKVRIPVLANGYSR

SEQ ID NO: 117874 - protein, 72 aa, Glycine max
  Coding DNA Sequence Number=SeqID_1096
MTTPCISFKKAMGQIRISHPVGRKPERGAKAKVRVTIVVAYPSMGGRAKIQRSFFQKGKHGVDLAPKYPQVQ

SEQ ID NO: 117875 - protein, 88 aa, Glycine max
  Coding DNA Sequence Number=SeqID_1097
METMTSTNDVMEHTTIVTHEFGCQGRGVNCCKRNLYSSKIERWCSTSNERLMSIVELLLENEVVLVWFLSLEVWSKMGGFEFCGIAGG

SEQ ID NO: 117876 - protein, 231 aa, Glycine max
  Coding DNA Sequence Number=SeqID_1098
MVEVHGRVALSGGYSFPDHAGTTYVVPISLEAKNERYKVYGGRSKHLQEELGITMHIVPLSLGHGDEGYWVYGGRSKYLQEELGRTMHTIPLSLGARNEGYQVYGGKSNCFQEELDITRAHRSSYPFTLRDTLLKSSTSTNVGYPRKDHVRSMDIVHSSLGARNEGYFSNVYGGSSNNWQEELDRTTAQRASYSFDGVRSDFERYTTKVLGRFVQSRMNILMKERRVFVES

SEQ ID NO: 117877 - protein, 129 aa, Glycine max
  Coding DNA Sequence Number=SeqID_1099
MAERLYQKRNTPRYTASKVPNKLTTLRALKNLESMSLEELVGTLKVHEQELQQNEGPKREKSLALNSQKNKKVLSSKEHISRNSFKALKFDNSSNEESEENSDKDELPFISWKIRKMWKNKGGSKWKNS

SEQ ID NO: 117878 - protein, 283 aa, Glycine max
  Coding DNA Sequence Number=SeqID_1100
MATSNSFGVEIIQIIVITIIHTDNEPSIYIEHFFDIQKLERIGLKINETLLFCGARHFFNEPQTIYPKLIKTYWRNVEFSNRKEGPIKKDRRKTITHVARALYKENIDKANMLNKSVLHKTRSKTSLSDLHKFVLFHLMENIPFHMLNTIYINIMRNLKGLGSRDNICYAALINKMLWDQGNLKQAPQVDLDAINKRKQKRLVKAITNEDKDLSETDEEDEGFVQIALQKQKIATQVVPTQKEQKIVQPTPEEWTISFTGNKENPTSSSSDNESTDETLVSPL

SEQ ID NO: 117879 - protein, 275 aa, Glycine max
  Coding DNA Sequence Number=SeqID_1101
MYMRDQATAYPPGLHISKATNIKIIIDKVEVVNYPRNWSSLFSGKKFICAPNEYDVRTFWNQIMWADTLKVSTSSYDGSDKVVHHDIIQVLHSVRKYHFDDACVCFTKDANIETSTKVVDDTIVCGIITDLTNTGIMDETPKAYNAAIADKVVHQDKEPTSKQSTTLNEATSREKGELDIVIIYFTTSGLAPFNYAHHIIVTRDQVQDMISQAMESFAERQRQENKVVVALAPMPIPISPTLKPTPPSIEPIPLSIEPTPSPPPSLPPPPPLVQD

SEQ ID NO: 117880 - protein, 307 aa, Glycine max
  Coding DNA Sequence Number=SeqID_1102
  Homolog annotation: Hit_ID=Q1T242; Match level="QueryCoverage=35%, HitCoverage=26%, E-value=2e-14, Identity=36%"; Hit description =Homeodomain-like
  Pfam annotation: Domain name=Myb_DNA-binding; Domain location=225 -272; Score=17.2; E_value=0.059; Accession=PF00249.21; Description =Myb-like DNA-binding domain
MSEETHQENKNAIEFLDEYTFYYDEEHEKCIPCYKEDSTKVVLNSVDFDFNNHNKDLDKFLKNLATRDSSPQLEVLALAPSTYEVPVILAPTTSPIVDAPTKVLALAIDEVVAPTLGSYPSKGLHPVPTPQRRVLGHTALAPQRVYTFLDLVPVLSAHTTHVCAPQRVFASQVPAKSLEQTLNSIAFEQVHVPISYQHHLLSHNTKSNSIKLFGDSSRSVHCNKYTHWIKEGHRSFVLGLEKYEHGGWKNISKKFVPTKTPTQVASHAQKYFERKKAPKKEKKRRSIHDTTLEDIDMIVTPHIDQHN

SEQ ID NO: 117881 - protein, 117 aa, Glycine max
  Coding DNA Sequence Number=SeqID_1103
  Gene Ontology: Cellular component=protein complex
  Homolog annotation: Hit_ID=Q9M330; Match level="QueryCoverage=88%, HitCoverage=33%, E-value=1e-20, Identity=51%"; Hit description =Probable proteasome inhibitor
  Pfam annotation: Domain name=PI31_Prot_Reg; Domain location=8-79; Score=17.1; E_value=0.0016; Accession=PF08577.1; Description=PI31 proteasome regulator
MEPSVAFPIGSGSDLVPGPAAGVFPSRGGHGIGGSMLVVQHLEAGPNDPRWFGGIGGDPAFPGGLPGVPPGARFDPYGPPGVPGFEPNKFARNPRRPGYDAHPDLQHFRRDADSDYI

SEQ ID NO: 117882 - protein, 444 aa, Glycine max
  Coding DNA Sequence Number=SeqID_1104
  Gene Ontology: Mol. function=DNA-directed RNA polymerase activity; Cellular component=nucleus; Biological process=transcription
  Homolog annotation: Hit_ID=Q9LVK6; Match level="QueryCoverage=89%, HitCoverage=87%, E-value=2e-84, Identity=44%"; Hit description =Arabidopsis thaliana genomic DNA, chromosome 3, P1 clone: MDC16
  Pfam annotation: Domain name=RNA_pol_I_A49; Domain location=69-444; Score=208.1; E_value=2e-59; Accession=PF06870.3; Description=A49 -like RNA polymerase I associated fa
MDSDTEETKPKHPKKEKKKKNKKKEVEVVQPQSEQIEVEVEVVREHPNKTPPVVGYFPSGFDPVKNHGGGPSNFQVYRHRSMPKRLELVVRPPRSSVEFVGTSYAGEAAARHRAKYALGVLDKEAGTLKVVPIAGNKIFRLEPKVKGVGAFENEPANSTLEEMTQQQKFAETTSIWGTKKDIEKLFVEHAVCCLSWHMFVLFLQAKKKLALRQDEDPDSQRNLDVKMKSVTVNKKALESTESHVSRNIPPYDASATTPQEAYILDKIILKGEWDYLEDIYNNLQRGEEADFSAYPTFVRNRIERLRKIKDESEKKQLSCIFSYINHLIKFKDQHSFDVLSAKGHKIPNILRHKFSNMFAVSESKRLPPEKISLLICYVLVLTLFSDEFRTDYTDIAKDLSMNILPVRQLYEHLGCKISRQKNIFYATLPVPLKFPELRQRKRKR

SEQ ID NO: 117883 - protein, 104 aa, Glycine max
  Coding DNA Sequence Number=SeqID_1105
  Gene Ontology: Mol. function=transition metal ion binding
MQRGSQSKPFDVKMGDRSKDMIRDLGQESFQQAHAPMYDTLQIDSKKPLYPGCKNSLTLFSTVLSLVNVKAKYGWSNKSFSSLLQVVHDMLPKQNTLPKSYYQA

SEQ ID NO: 117884 - protein, 870 aa, Glycine max
  Coding DNA Sequence Number=SeqID_1106
  Gene Ontology: Mol. function=Rab GTPase activator activity; Cellular component=intracellular; Biological process=regulation of Rab GTPase activity
  Homolog annotation: Hit_ID=Q1T440; Match level="QueryCoverage=62%, HitCoverage=97%, E-value=0.0, Identity=61%"; Hit description =RabGAP/TBC
  Pfam annotation: Domain name=TBC; Domain location=81-299; Score= -75.3; E_value=0.033; Accession=PF00566.9; Description=TBC domain
  Subcellular localization annotation: CTP_CleavageSite=60; ConfidenceScore=5.25e-01
MPPALSDPLSVTPASSDAVLQRSAPENRRFGDLRGLQWRINLGVLPSSSSTSIDDLRRVTANCRRRYASLRRRLLVEPHVPKDGTNSPNLVIDNPLSQNPDSTWGRFFRNAELERMVDQDLSRLYPEHGSYFQTPGCQSMLRRILLLWCLRHPECGYRQGMHELLAPLLYVLQVDLEHLLEVRKLYEDHFTDRFDGLLCQENDLSYSFDFKKSPELMEDEFGSHGNSVKGNSLEELDPEIQTIVLLSDAYGAEGELGIVLSEKFVEHDAYCMFDALMSGAHGSVAMADFFSSSPVSGSHSGLPPVIEASTALYYLLSLVDSSLHTHLFELGVEPQYFSLRWLRVLFGREFSLANLLIIWDEIFASENSSMGKGADDCEFRILNSPRGAFISAMAVAMLLHLRSSLLATENPTRCLQRLLNFPEDINIEKLLEKAKSLQAFALSVDISSSSLLFLGSHYQSKSMYTTSVTLPSESVSPKTPLNLLPDSYWEEKWRVAHKAEELRQDSLEKQVPTRKKGWTEKVKFSLRRAKSDPPLSRIQSGRNFRRSLLEDLRKALGSEEDAEKMQPDETLRQHDNPSEAVEVKEDNGCSGDNNYLSDDRSPSGNSGSEEDLSIYSEPTSPPNEANDHEITSVKSSVASNSPLDECNETSGTSSSFPISNLPENISQTSQCNTENSECNETLHTSPNDPPLPISDPPENISQTSRCNTENSECNETSDTRPSDLPLPISDPPKNIPPTSGSKNDEAGNTATLPKDKKQNKLQWFWPFGRNNAEAISEKAGGAAEAANRDSTQNNTPQPASSVANEPCSSVSCSGESVDKNVMGTLKNIGQSMLDHIQVIESVFQQDRKGQVTAMTALKELRKISNILSEM

SEQ ID NO: 117885 - protein, 144 aa, Glycine max
  Coding DNA Sequence Number=SeqID_1107
  Gene Ontology: Mol. function=hydrolase activity, acting on acid anhydrides, catalyzing transmembrane movement of substances; Cellular component=membrane; Biological process=transport
  Homolog annotation: Hit_ID=Q9LT02; Match level="QueryCoverage=53%, HitCoverage=6%, E-value=3e-30, Identity=82%"; Hit description =Putative cation-transporting ATPase
VKNIDQVDSCKITSVKFSCAKEVVSLHSRKSMEIVVIRDFDRENYVEFMYGKTRLVLGKMGLEDPIRSKYKLMLSCSLIITFVIPPELPMELSIVVNTSLTALARHDIFCTEPFRIPFVRKVDICCFDKTWTLTSNDMVCPYES

SEQ ID NO: 117886 - protein, 76 aa, Glycine max
  Coding DNA Sequence Number=SeqID_1108
MDMTIKDNVVGEKFKRFNKAEKAHYLSLVGKTTNDGVGGVHEHTMKMVNWYNKWKSMNVELGEDFLICQVFESLPS

SEQ ID NO: 117887 - protein, 244 aa, Glycine max
  Coding DNA Sequence Number=SeqID_1109
  Gene Ontology: Mol. function=oxidoreductase activity; Cellular component=membrane fraction; Biological process=electron transport
  Homolog annotation: Hit_ID=Q1H097; Match level="QueryCoverage=75%, HitCoverage=92%, E-value=5e-66, Identity=65%"; Hit description =Flavodoxin/nitric oxide synthase
PQDKETTKTPGNKLRQDTKLVNLVRTAIDTASNEDGWAHLGPVGSNIVKNAPEFDPRNYGGAVKEMAQLIARGVESIAGVKARVRTVPKVSANCEATEADIPSSGAPYASLQDLEECAGLALGSPTRFGNMAAPMKYFLDGTAGLWLKGSLIGKPAAVFTSSGSLHGGNEMTLMTMMVPLMHHGMLMLGLPYSEPQLGTTKTGGTPYGASHIGGTMDDQPISEDEKKLCIALGKRLAETALKLQ

SEQ ID NO: 117888 - protein, 142 aa, Glycine max
  Coding DNA Sequence Number=SeqID_1110
MYNYHEKGRAADLESVLADFMTYQARSKDHQWESEWQPYYHNEAEGLSNLDDLLMQFKDTVDSMQKAFKRAKTQIGKLVDNMTKVVVRREEKYAEIETHQESILQVNTIHHQLIAKEEKDEVSIIPEYPCMATIGYVVGKDK

SEQ ID NO: 117889 - protein, 167 aa, Glycine max
  Coding DNA Sequence Number=SeqID_1111
MVTGRGLGRGDRDDSDDSDDALQRRRPTASARRQRVAVTADHVDEPIIPTPDVQDDPMEAPAAVEDIPADIPANTGAEVAEDEHQGFPGGPSDPSVLTLYADHIACSVWTGEERPELKLSSHGRKVHSLGRHVPAIEGLIAGTGLSPLIACSVDTGDRGLLSAFVKR

SEQ ID NO: 117890 - protein, 115 aa, Glycine max
  Coding DNA Sequence Number=SeqID_1112
  Subcellular localization annotation: CTP_CleavageSite=56; ConfidenceScore=5.64e-01
MAENPSETVLSSSQPPPPPPSSSSSSSQKSPQDSPQVPALSNFMPFPSGYYYQMIPGMYPALVPGLTLPQHEEHGNRGAGIYAVPVNPYDRQVTGLPYNTLIPLTYRTPTVIVSV

SEQ ID NO: 117891 - protein, 262 aa, Glycine max
  Coding DNA Sequence Number=SeqID_1113
  Gene Ontology: Mol. function=nucleic acid binding; Cellular component= nuclear pore; Biological process=DNA integration
MVSEQQILVENPISLLHKTKMAEAQHISSPMTSTCKLSKRCNDLFQDPTLYRSVVGALQYATLTRPKISFAVNKVCQFMAKPLDSHWVVKRILRYLKGTLFHGLHMRPAAAGKSLTLTAMCDDDWASDIDGRRVQIRLCHLFRAKSDLLVVKETARSSTEAEYRSLAQTSAELTWVQALLQELQVSFSTLALLCDNQSAEAIAHNPVFHSHTKHMEIELLIYHIPALDQWADVLTKPLSPARLEFLRGKLNVKGFSSEKPSP

SEQ ID NO: 117892 - protein, 54 aa, Glycine max
  Coding DNA Sequence Number=SeqID_1114
MEEDKRVNLTTFEKNKRNQVNQKEIFLLIKTGCPKFKNWLEKKGYGKPKEANEK

SEQ ID NO: 117893 - protein, 91 aa, Glycine max
  Coding DNA Sequence Number=SeqID_1115
MAKPSSPANLASAIICFFASKKFPHRLKASPGRISSKAYKLYLELHYKGDSYAQVIMCVRRINLIDRHDNEVGTNIVSPIPDPDSPTCLHT

SEQ ID NO: 117894 - protein, 375 aa, Glycine max
  Coding DNA Sequence Number=SeqID_1116
  Homolog annotation: Hit_ID=Q2HRL0; Match level="QueryCoverage=26%, HitCoverage=20%, E-value=2e-07, Identity=33%"; Hit description=RNA -processing protein, HAT helix
  Pfam annotation: Domain name=zf-CCHC; Domain location=206-223; Score =6.5; E_value=0.084; Accession=PF00098.13; Description=Zinc knuckle
MIPLQMRNPLHPSSDSELVPPTANTEATKPWVNLFKDNRKPSKGFGLQFSPPSAEEVLLDDSDLQPLEEAWGYSLIGYVAGRFPRKKALMECCQKWGVNFSYSTHESGWLVFRFQNEEDMNQVISAGPYFIFQRPLLLKVMPPFFDFGNEELNKIPVWLTASKGSISFARALVEVDASMDLIEEVRFRLPNGKVFTQKVEFENRPTFCKHCKMIGHRLANCKAVPGAKDDPALVSTPVVQSQVVGPADLDVTKILNSSGTQKVQPNQSAASIHISSGTQKDDHPNQLAAPHVQQSQGAIFVPVHKHSSVLKGAGGARYEPDEEGFIQVKTKTQKKIKKVPSQKPARVDEMQLDAKTGRPQKSGSRTGEASSRPQL

SEQ ID NO: 117895 - protein, 339 aa, Glycine max
  Coding DNA Sequence Number=SeqID_1117
  Homolog annotation: Hit_ID=Q1SKJ3; Match level="QueryCoverage=35%, HitCoverage=14%, E-value=5e-11, Identity=30%"; Hit description=Zinc finger, CCHC-type; Endonuclease/exonuclease/phosphatase
MIPLQMRNPLHPSSDSELVPPTANTEATKPWVNLFKDNRKPSKGFGLQFSPPSAEEVMLDDSDLQPLEEAWGHSLIGYVAGRFPGKKALMECCQKWGVNFSYSTHESGWLVFRFQNEEDMNQVISAGPYFIFQRPLLLKVMPPFFDFGNEELSKIPVWVKLRNLSLELWNPQALGKILSKVGLPIRTDQLTASKGSISFARALVEVDASMDLIEEVRFRLPNANCKAVPGAKIDPAVVSTPVVQSQVVGPADLDVTRILNSPGSQKVVQPNHNWLQRARSSLLQTLSLVQEVGSAPLNLSDGERIVLKSLVRSQGQSMVALILFRLTHKDLLATTECSP

SEQ ID NO: 117896 - protein, 229 aa, Glycine max
  Coding DNA Sequence Number=SeqID_1118
  Homolog annotation: Hit_ID=O64482; Match level="QueryCoverage=30%, HitCoverage=37%, E-value=1e-08, Identity=45%"; Hit description =Expressed protein
NQFNPISLSNHDDDDDVRCPPLQGRAPPPPPLPLCPPPTAIEQGSGGDGGGGHGGVRRGAEALRRPNSAYTRQEEHTGLAPLRPGVLLLGPTAPLPFQRRRPSPQAHLRGPPPPPPRLLPPPLHPPRLALRKIEGKGTWVSATSNTALAAFVSNFFIDGKIEGKGTWVSATSNTALAAFVSNFFIDENESTDGEDTDIEINGLDGTNGTVKVKVLTFSENVAHSEDEEG

SEQ ID NO: 117897 - protein, 38 aa, Glycine max
  Coding DNA Sequence Number=SeqID_1119
MKILLGGRRRVGVDVEYGDTPVMEDGQKLESQKSDLGK

SEQ ID NO: 117898 - protein, 146 aa, Glycine max
  Coding DNA Sequence Number=SeqID_1120
MHFTVQDNEGQTETYLEEWEISYRATNRKMSDTRQIKRASAQKMYIIERKNHRDSLIGIPSIILPPKRKNEKKVKVLYVNQSGKYPTTLPKGHTLSYPPTSHNCCKDMHIRLSNRRHKHRRNFQAKEASSPQQLAWLNYGSSFLIF

SEQ ID NO: 117899 - protein, 113 aa, Glycine max
  Coding DNA Sequence Number=SeqID_1121
  Gene Ontology: Mol. function=phospholipid binding
  Homolog annotation: Hit_ID=Q1T445; Match level="QueryCoverage=93%, HitCoverage=17%, E-value=1e-14, Identity=42%"; Hit description =Carbamoyl-phosphate synthase L chain, ATP-binding; ANTH
  Subcellular localization annotation: CTP_CleavageSite=30; ConfidenceScore=5.10e-01
MDIQNNNPFDHYNQQDPFAMSNNIAPPPSVQMALMSQQQQQQQMMFQQQQMMYQQAQQQHNNMMMVPYHQQQPYNQYPQQMYNSSSHNPFGDPLPVPNYNHSSMPQQGNYNLM

SEQ ID NO: 117900 - protein, 72 aa, Glycine max
  Coding DNA Sequence Number=SeqID_1122
  Gene Ontology: Mol. function=phospholipid binding; Cellular component= coated pit; Biological process=endocytosis
  Homolog annotation: Hit_ID=Q8VYT2; Match level="QueryCoverage=100%, HitCoverage=11%, E-value=1e-31, Identity=88%"; Hit description =Putative clathrin assembly protein At4g25940
MTRHDAVKALNIYKRAGQQAENLADFYEYCKGLDLTRNFQFPTLRQPPPSFLATMEEYIKEAPQTGYVNKKV

SEQ ID NO: 117901 - protein, 87 aa, Glycine max
  Coding DNA Sequence Number=SeqID_1123
  Gene Ontology: Mol. function=phospholipid binding; Cellular component= coated pit; Biological process=endocytosis
  Homolog annotation: Hit_ID=Q1T445; Match level="QueryCoverage=98%, HitCoverage=14%, E-value=9e-41, Identity=93%"; Hit description =Carbamoyl-phosphate synthase L chain, ATP-binding; ANTH
MGTFQSFRKAYGALKDSTKVGLAKVNSEYKELDIAIVKATNHVEYPPKERHVRKIFCATLAHQPRADVAYCIHKLAKRLSKTRSWIV

SEQ ID NO: 117902 - protein, 91 aa, Glycine max
  Coding DNA Sequence Number=SeqID_1124
YILCGTSRGYIYLDLTENKRGYISCGSVLVEGTSTRFKENKGGMSLVCLYVQHLHIQCIMSAPSSSTAVVDGTEHVHDAQVYRSHNMSKDH

SEQ ID NO: 117903 - protein, 59 aa, Glycine max
  Coding DNA Sequence Number=SeqID_1125
MKVFTSSTYKEEPTEDLALHNWEASFTNKEKMEEIQAVRMPPPPLEPHNHSQTPLKLSG

SEQ ID NO: 117904 - protein, 236 aa, Glycine max
  Coding DNA Sequence Number=SeqID_1126
  Homolog annotation: Hit_ID=Q47522; Match level="QueryCoverage=18%, HitCoverage=53%, E-value=6e-19, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPEFDNSAINKDLFSVVEVLSSKSPTSEQDVNNFNIEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 117905 - protein, 937 aa, Glycine max
  Coding DNA Sequence Number=SeqID_1127
  Gene Ontology: Mol. function=motor activity; Cellular component =myosin complex; Biological process=signal transduction
  Homolog annotation: Hit_ID=O24515; Match level="QueryCoverage=99%, HitCoverage=94%, E-value=0.0, Identity=73%"; Hit description =Unconventional myosin
  Pfam annotation: Domain name=IQ; Domain location=615-635; Score=20.5; E_value=0.0061; Accession=PF00612.17; Description=IQ calmodulin -binding motif
  Pfam annotation: Domain name=IQ; Domain location=638-658; Score=13.9; E_value=0.58; Accession=PF00612.17; Description=IQ calmodulin-binding motif
  Pfam annotation: Domain name=IQ; Domain location=664-684; Score=17.9; E_value=0.036; Accession=PF00612.17; Description=IQ calmodulin -binding motif
  Pfam annotation: Domain name=IQ; Domain location=687-707; Score=14.2; E_value=0.48; Accession=PF00612.17; Description=IQ calmodulin-binding motif
  Pfam annotation: Domain name=Myosin_head; Domain location=40-600; Score=575.2; E_value=6.1e-170; Accession=PF00063.11; Description =Myosin head (motor domain)
  Pfam module annotation: Pfam domain module=IQ::IQ::IQ::IQ::Myosin _head; Domain location=615-635::638-658::664-684::687-707::40-600
KLQSWFQLPNGNWELGKIITTSGNESIISLPDRKVLKVKEESLVPANPDILDGTKAGPVLVAINPFKKVPLYGNDYIEAYKRKAIESPHVYAIADTAIREMIRGKTETAKIAMQYLAALGGGSGIEYEILKTNPILEAFGKLNLQNAEDYKYLRQSNCYSISGVNDADEFRTVMEALDVVHIRKEDQENVFAMLAAVLWLGNISFTVIDNENHVQAVEDEGLFHVAKLIGCDIEDLKLILSTRKMKVGNDNIVQKLTLSQAIDARDALAKSIYACLFDWLVEQINKSLAVGKRRTGRSISILDIYGFESFNRNSFEQFCINYANERLQQHFNRHLFKLEQEEYIQDGIDWAKVEFEDNQDCLNLFEKRPLGLLSLLDEESTFPNGTDLTFANKLKQHLNSNSCFKGERDQAFTVHHYAGQVTYDTTGFLEKNRDLLHLDSIQLLSSCTCPLPQIFASHMLTQSDKPAVGPLHKSGGADSQKLSVATKFKGQLFRLMQQLESTTPHFIRCIKPNNLQSPESYEQGLVLQQLRCCGVLEVVRISRSGFPTRMFHQKFARRYGFLLLDHVASQDPLSVSVAILHQFNILPEMYQVGYTKLFFRTGQIGVLEDTRNRTLHGILRVQSCFRGYQARHSLKDLRGGITTLQSFIRGDKTRKAYSALLKRHRAAVIIQKRIKAVFARNRMRTISDAAIVIQAVIHGWLVRRCSGNIGFLKSGDMKMKESDEVLVKSSFLAELQCRVLKAEAALREKEEENDILHQRLQQYESRWSEYELKMKSMEEVWQKQMRSLQSSLSIAKKSLAIDDSERNSDASVNASDERDYSWDVGGNHKRQESNGARSTSAGLSVISRLAEEFEHRSQVFGDDAKFLVEVKSGQVEASLNPDQELRRLKQMFEAWKKDYGARLRETKVIINKLGSEDGALEKMKKKWWGRRNSTRIN

SEQ ID NO: 117906 - protein, 860 aa, Glycine max
  Coding DNA Sequence Number=SeqID_1128
  Gene Ontology: Mol. function=RNA-directed DNA polymerase activity; Cellular component=chromatin; Biological process=chromatin assembly or disassembly
  Pfam annotation: Domain name=Chromo; Domain location=781-835; Score =32.2; E_value=1.9e-06; Accession=PF00385.14; Description='chromo' (CHRromatin Organisation MOdifier
  Pfam annotation: Domain name=RnaseH; Domain location=273-391; Score= -28.1; E_value=0.024; Accession=PF00075.14; Description=RNase H
  Pfam annotation: Domain name=rve; Domain location=526-682; Score =94.3; E_value=3.6e-25; Accession=PF00665.16; Description=Integrase core domain
  Pfam annotation: Domain name=zf-H2C2; Domain location=471-508; Score =29.0; E_value=1.7e-05; Accession=PF09337.1; Description=His(2) -Cys(2) zinc finger
  Pfam module annotation: Pfam domain module=Chromo::RVT_1::RnaseH::rve: :zf-H2C2; Domain location=781-835::12-181::273-391::526-682::471-508
MLQKGIIRPSTSPFSSPVLLVRKHDGTWRFCVDYRALNVLTIKDRFPIPTIDELLDELGGTSWFSKLDLLQGHHQILMNEEDICKTAFRTHHGHFEFRVMPFGLCNAPSSFQATMNSIFRPYLRQFIIVFFDDILIYSTTLEDHVLHLEQAFRILLQEQFVLKLSKCTFAQPQVEYLGHVVSAQGVEPVMAKVQAIQQWLEPNSGRALRSFLGLAGFYRRFICGYATIAAPLTKLVTVEPFQWTEEARAAFNRLKQVLTSTPVLRLPDFSLPFTVETDASGTGMGAVLTQQGHPIAYFSKAFPPKLMGASTYVREFFAITAAVKKWRHYLLGRCFHILTDHRSLKELLTQVIQTPEQQMYLARLMGYDYTIMYRSGSSNKAADALSRLPESSSPTLMLLSVPCFTFLQELRRQLTQNTEFTQLRQSILTDPDAHPEFSVTNDLILHKGRIWLPQAFPFTTTLLSEYHSTPTGDHMGIAKTLARLTKNFYWKGILQDVERFIASCVDCQHTKYETRKPAGLLCPLPIPSKPWEDLSLDFITGLPAFQGHTVILVIVDRFSKGIHLGMLPTRHTAYTVVVLFIDLVGKLHGMLRSLVSDRDPLFLSRFWQELFRLSGTKFRLSSAYHPQSDGQTEVLNRVIEQYLRAFVHKKPSSWGKLLRWVEWSYNTSWNSSSGLSPYEITFGKKPVNFPRYLEGNSPIVAVEDMLSERQAVFEEIKKKLEKAQSRMKHFADARRRDVHFSVRDMVLVKLRPHRQRTVTESDNTQYCSTLLSHYENDQLVVTPLTILDTRHSVESKLEVLVQWQGLSPDDTTWENWDQLREVYHLEDKVLPEGVKDDSKENAESRPKRKQKILAYLRDFV

SEQ ID NO: 117907 - protein, 350 aa, Glycine max
  Coding DNA Sequence Number=SeqID_1129
MDQAGRVPGPIGYSLLRGARLHQPLAGVRRFSGMTERGLVVEPEEAERKTVVHGDGKPFSPQGASPLNLTTDVGIEARNEAAEEEVWRETDNAVREILKFRKGMEETLPGRKLAVTGHPLVPGQSSAVHVKGRDGESVVIRGVVIFKKLSDFEYPTQWVRSIEPGHIELDARGIKFMGHGLQVFTETELIDGELGYDVFQLIRVGLRGHECETRAPNCPNRNEGIFLKWQTRSRHRSLDVQLIKFDYPAQLLCSNEVSEVCWYLLLPFGSAFCCFLAMRRARQFCISQVYVFRRNPDPREVEAMDLLHGLLWAHELGHANIQFEVDYKNVVDGILASPSGITDFHVLLSN

SEQ ID NO: 117908 - protein, 1299 aa, Glycine max
  Coding DNA Sequence Number=SeqID_1130
  Homolog annotation: Hit_ID=Q010R1; Match level="QueryCoverage=39%, HitCoverage=64%, E-value=2e-20, Identity=22%"; Hit description=[S] KOG4524 Uncharacterized conserved protein
MDKLGEEEQLRTSTFQRLKSHTLHLLDLLQNPHIQYQKHCSLTVIPQLLRFLQSSSPSTLQPFFDYTLFPLLLLLDAAIQCRSTQKVDSQENYNMPGVLKTPVNVSDGVAEGVVNCLEELLRKCRLNSVDQALLLSLYSCSDVSCLCEQIPGLPALSDDIYNDELHKTFKYGSESDKCLLAFLQSQFASAAVGHWLSLLLKIADTEAARGQKGSARLRIEAFKTLRVLVAKVGYADALAFFLPGIVSQLAKVLHSAKTMISGAAGNVESIDQAIRGLAEFLMIVLQDDANAPALDIEASSDFYSNECNSTLSLLDELRHLQVKNCVKTKAAEDTDVESEKISCSQTQLQEMGNTDPGRENMSLHVNRTKDWMQKTSAHSSDVFNYSAMCIFYYCNVTFYVISKIIEFQICIHPSQKVRKGLVDAIKGLLSECFYTLGESRLMLLVSSELRPRGGQVDEIGCTKECVVFSCIFPECLCALVVDVSNDVSSTAQDFLECLFSQNLKHVIKHNAAEIFIRNLEKLPRVVLGHEESHAVLHAQQLLTIIFYSGPRLLVDHLQSPVEAARFLDLFAACLSHNTVFSGLLGIITKTDRSSTLGYLPSIAELKSGANFFNYGPLLINSALSEVPKCRLIEEKSIDEPVKTAQNNYELPRMPPWFSYVGSIKLYQPLAGILRFVGLSLVAGLLSHVIDILLGYFRRLVSELRLKEYNKESWQSWYDRNGSGQLLRQASTAACMLNEMIFGLSDQATNDFARIFHRSTLSRGVQVQSYKHDSAFHEFSWKKSKDKGVRSCLVECIGGILHEYLSTEVWNVPIDGRIADLQLNAAVEEDISLYFFQDAAMLRENLSSSNYRVRNAADSVLHILTTTSSYTTVGQLVLENADYVIDSICQQLRHLDLNHHVPNVLASMLSYIGVAHKILPLLEEPMRSVSTELEILGRHQHPDLTVPFLKAVVEIVKASKREACLLPTQAESFARYVRSMVSNSEETTQDLWEDILFKLNDSRRYRRTVGSIAGSCITAAIPLLASFKQEICLAALDIIEGGTLAIAKVEAAYKLEREIKEATEEALQSLSLYQLKDTLEANEEAADENRLLPAMNKIWPFLVTCIQNRNPVAVRRCLNVISIVVPVCGGDFFTRRFHTDGTHIWKLLITSPFHKKSNFKDEKTPLQLPYRSSSVCSEDSFAETSYLKIQIAVLNMIADLCRNKSSSSALELVLKKVSGLVVGIACSSVVGLRDASLNALHGLASIDPDLVWILLADIYYTAKTENFPPPTPDLPEISEILPLPISPKEYLYVQYGGQSY

SEQ ID NO: 117909 - protein, 408 aa, Glycine max
  Coding DNA Sequence Number=SeqID_1131
  Gene Ontology: Mol. function=nucleoside-triphosphatase activity; Cellular component=membrane; Biological process=defense response
  Homolog annotation: Hit_ID=Q1SVC4; Match level="QueryCoverage=60%, HitCoverage=72%, E-value=2e-36, Identity=34%"; Hit description=TIR; Disease resistance protein; AAA ATPase
  Pfam annotation: Domain name=NB-ARC; Domain location=145-363; Score= -73.7; E_value=1.4e-05; Accession=PF00931.13; Description=NB-ARC domain
  Pfam annotation: Domain name=TIR; Domain location=52-177; Score=4.8; E_value=2e-05; Accession=PF01582.10; Description=TIR domain
  Pfam module annotation: Pfam domain module=NB-ARC::TIR; Domain location=145-363::52-177
MACMGSMWSVMRNSSGISMYAYPSLGTGIANLECAVLSSGNNKDVMPLDATVNTIWPCKDTRDNFTGNLSNSVREKGIHTFTDDEELRRGEEITPALLNAIQNSRIILPIIVFSKNYASSTIVWMNLSRSLSLNQYKFICKIVEEVSEKINCIPLHDADNPIGLESAVLEVKYLLEHGSDVKMIGIYGIGGIGTTTLARAVYNLIFSHFEDDVDKLEQLKVLAGNWFGSGSIIIITTRDKHLLATHGVVKLYEVQPLNVEKALELFNWNAFKNSKADPSYVNISNRAVSYAHGIPLALEVIGDGLRVLVDRSLINVYAPGFVRMRDLIQETGREIVRHESILEPGNEGTDKTEFIKLEGYNNIEVQWNGKAFEKMKNLRILIVENTIFSTGPEHLPLPISLRVLDWYA

SEQ ID NO: 117910 - protein, 614 aa, Glycine max
  Coding DNA Sequence Number=SeqID_1132
  Gene Ontology: Mol. function=microtubule binding; Cellular component =cortical microtubule, transverse to long axis; Biological process =positive regulation of microtubule polymerization
  Homolog annotation: Hit_ID=Q10PE0; Match level="QueryCoverage=99%, HitCoverage=98%, E-value=0.0, Identity=55%"; Hit description =Microtubule associated protein family protein, putative, expressed
  Pfam annotation: Domain name=MAP65_ASE1; Domain location=37-613; Score=107.7; E_value=3.3e-29; Accession=PF03999.3; Description =Microtubule associated protein (MAP65ASE1 family)
MLAIGGHGTSIRTSSTCTALLRELEQIWNDIGETEVEKDRMLMELERECLEVYRRKVDEAVNTKARFHQTVAAKEAELATLMAALGEHDIHSPSFDSPLCLHTPAQIKTEKRSVSLKQKLASITPWVEELKKKKDERLKQFEDVKAQIEKISGEIFGFHSVNNALSSTTVEDDQDLSLRRLNEYQTHLRTLQKEKSDRLQKVLQCVNEVHSLCSVLGLDFGQTVGDVHPSLHGTQVEQSTNISNSTLEGLEQAILKLKIERKTRIQKLKDVVAKLFELWNLMDSSKEERNCFMKITSIVGTSESEITERGVLSTEMIEKASAEVDRLAKLKASRMKELVFKKRSELEEICRLTHIEPDTSTAAEKASALIDSGLVDPSELLANIEEQIIKAKGEALSRKEVTDRIDKWFAACEEENWLDKYNQDDNRYSAGRGAHINLKRAEHARITIGKIPAMVDNLINKTLAWEDEKKTHFLYDGVRLVSILDDYKLARQQKEEDKRRHRDLKKMQDLLLNQKEAMYGSKPSPRKNNSFRKTNSYRANGNGSMPPTPRRNSLSGGTTSELLTPRSYSGRQNGYFKEMRRLSTAPLNFVAISKEDTMSYASLCGSEPDSPPQV

SEQ ID NO: 117911 - protein, 236 aa, Glycine max
  Coding DNA Sequence Number=SeqID_1133
NEANGKLKYVDGELDVWDKIETNYLNFFLLTNLVKHCRKYNNVSDIHWVVDKEVDLEEGLRVCETDFDIRDMVITARHDGDEVELYYDHKVDEQPILFEADVPEDGLGNLNPIPEVEEEGDKDDGDGDVGNGDNIASEEHDDIDGDEDVDVEVRVGCEWWTDIPEYNNEVQEDEVEPADTFIYGVLQELDIVRAKVDVIDFNAEQKYLSLAVEFSKLESHVANLEYSIDQRLREIR

SEQ ID NO: 117912 - protein, 203 aa, Glycine max
  Coding DNA Sequence Number=SeqID_1134
  Pfam annotation: Domain name=RRM_1; Domain location=18-88; Score =11.5; E_value=0.012; Accession=PF00076.12; Description=RNA recognition motif. (a.k.a. RRM, R
MGEGKEQKREGCTRHILVLLHTISKRHGEKNLWFEFKKRGNVREVFIARNKNKSGRRYGFVRFKWVNNARKLERQLDNLVLEGLKLHLNLLKHGREWKPTKKVNKEHQHKEEVVTEKLAEREKRQNPQRVTTFRSYAEVVATGSKNMAKRWTLKYVQASNTTSCLSVQLTISMEKKTWLRKTWVGRLRNLTMFDRLEELVGRR

SEQ ID NO: 117913 - protein, 98 aa, Glycine max
  Coding DNA Sequence Number=SeqID_1135
  Gene Ontology: Mol. function=sequence-specific DNA binding; Cellular component=nucleus; Biological process=regulation of transcription, DNA-dependent
  Homolog annotation: Hit_ID=Q1T448; Match level="QueryCoverage=80%, HitCoverage=12%, E-value=2e-11, Identity=46%"; Hit description=Zinc finger, RING-type; Zinc finger, FYVE/PHD-type; Homeodomain- related
MLSSTKLEGGKNSHSSGIEGNDVDGEAKIKKRKRRKKKRQRNNIDVDDASRLRRRTRYLLIKMKLEQNLIDAYSGEGWKGQRKNMFTTSHLGISEIFT

SEQ ID NO: 117914 - protein, 138 aa, Glycine max
  Coding DNA Sequence Number=SeqID_1136
  Gene Ontology: Mol. function=RNA-directed DNA polymerase activity; Cellular component=nucleus; Biological process=RNA-dependent DNA replication
  Homolog annotation: Hit_ID=Q1SQP0; Match level="QueryCoverage=85%, HitCoverage=23%, E-value=5e-33, Identity=56%"; Hit description=RNA -directed DNA polymerase
MEPNIVIVPLVLPSIIDERRTAFMEGRHMLHSVVIANEVVDEAKRCNKSCLVLKVDYEKAYDSMCWDFLLYIMTRMGSCTKWVRSIKGCLKLTSISILVDGSPTNEFIPQRGLRQGDPLVPFLFNIVAEGLTGLMREA

SEQ ID NO: 117915 - protein, 140 aa, Glycine max
  Coding DNA Sequence Number=SeqID_1137
MAVKPLPSPGELWAKVLDSRYGSWKSLDEPRSSRDSIWGQDLSIVCNSFEDRVGLNQQQYIQQIGVASNGGWEFHWRRLFMEGEIEIATKYMEDLESMVVQVQQQDSWSWGADLSESYTVGSTYKLLNRHTTNENNNGVY

SEQ ID NO: 117916 - protein, 573 aa, Glycine max
  Coding DNA Sequence Number=SeqID_1138
  Gene Ontology: Mol. function=sequence-specific DNA binding; Cellular component=nucleus; Biological process=regulation of transcription, DNA-dependent
  Homolog annotation: Hit_ID=Q1T448; Match level="QueryCoverage=79%, HitCoverage=69%, E-value=1e-178, Identity=69%"; Hit description=Zinc finger, RING-type; Zinc finger, FYVE/PHD-type; Homeodomain- related
  Pfam annotation: Domain name=Homeobox; Domain location=430-486; Score= 16.0; E_value=0.00011; Accession=PF00046.19; Description=Homeobox domain
  Pfam annotation: Domain name=PHD; Domain location=174-229; Score =60.7; E_value=4.7e-15; Accession=PF00628.19; Description=PHD-finger
  Pfam module annotation: Pfam domain module=Homeobox::PHD; Domain location=430-486::174-229
MAAPWRYGVEDFRKNATKEWWRCRLRMAAAIAMAVVAELRCWADPTQPYSSFSCKRTTHNSEHEQNSLQHDDDERQRRRRRCTRPAAQRRRTAASHARATHETQRTVPTDGDGSVFRREKIRPEKELLRAKKQILKCKLSIRDAIHQLDSLSSVGSIEDSAIAPDGSVYHENIFCANCKLHEAFPDNDIILCDGTCNRAFHQRCLNPPLDTENIPPGDQGWFCKFCECKIEILEATNAHLGTQFSLDSTWQDVFKEEAAMPDGDIALLNPEEEWPSDDPEDDDYNPERKEDNHNFDTEGADENASNDSTSCSSLLSLNGECPPVDEGICHEYYSVNSCLDSDESGEIACGPRQRKAVDYKKLYDEMYGKDAPPCEQMSEDEDWGPGKRKRREKESDAVNTLMTLHESENKHSDNEKNDRTREGSSGIQIRRSCFRIPLDAVEKLRQVFAENELPPRSVKDSLSKELGLDPEKVSKWFKNARYLALKTRRYQSEGERLQSFTSKITKDSISQNEEKDELLKSKVSKITVIHSKKDGKNITGKEKNKLSNILLKKRQPKISPPLARENGNKVLFY

SEQ ID NO: 117917 - protein, 137 aa, Glycine max
  Coding DNA Sequence Number=SeqID_1139
  Gene Ontology: Mol. function=peptidyl-prolyl cis-trans isomerase activity; Cellular component=nucleus; Biological process=protein folding
  Homolog annotation: Hit_ID=Q94G00; Match level="QueryCoverage=89%, HitCoverage=93%, E-value=2e-49, Identity=78%"; Hit description =Peptidyl-prolyl cis-trans isomerase 1
  Pfam annotation: Domain name=Rotamase; Domain location=18-137; Score =121.3; E_value=2.7e-33; Accession=PF00639.11; Description=PPIC-type PPIASE domain
MSSSSSKTGGGGEVRASHILIKHEGSRRKASWKDPEGRIIKSTTRENAVSQLKALRDDIVSGKATFEDIASRFSDCSSAKRGGDLGSHNCGYVTLEGPFGRGQMQKPFEEATFALKIGEISDIVDTDSGVHIIKRTK

SEQ ID NO: 117918 - protein, 496 aa, Glycine max
  Coding DNA Sequence Number=SeqID_1140
  Gene Ontology: Mol. function=nucleic acid binding
  Homolog annotation: Hit_ID=Q1S0C3; Match level="QueryCoverage=87%, HitCoverage=85%, E-value=1e-114, Identity=51%"; Hit description=Zinc finger C-x8-C-x5-C-x3-H type (And similar), putative
MTEIHVKQRFKGQPCPYFSITGKLLRHTLTLFFNFRPGFLLPDFPSIVGQKSQDHLQAKTSSMLHSSINEPNDLPPGFESSHFLNQPKVEFSNIPQIKWECPPVVVVRSQWRVAAGEESREKENQKLREMRVLEALYPRLSAIPPSPSVSLDVEEEDYDDGRTPLIPIIPIEEEESTDILPELAVALKPSPNVQSQNSQQYISAKTSISSASNAAHAVSLDPCIRPMAGVSSGMEADLAAASSVVATIIRSNEQGTLIDMDLLGKIFTDPKILEQLINEHGTAATTASASSNTVDIPTSGLKPAIPSVLVSTPTPDVTASWTTPTSAVGSLPSGFGLKPSNPSVSLLNPTPILSVPAIPSVSLLSSSHDKPVTASVPLSRPVPGMPVTPSVSMLTHHTPAPDMHRPVSKNFHHVSSGMPPALNNQSQQETAMASGPKRANYYKNLIRQHGADKQDIQDSHIGIRHSNFQDMKPVGEICAVSVKCWPSWADGTQPYK

SEQ ID NO: 117919 - protein, 395 aa, Glycine max
  Coding DNA Sequence Number=SeqID_1141
  Homolog annotation: Hit_ID=Q9LU68; Match level="QueryCoverage=87%, HitCoverage=84%, E-value=9e-26, Identity=29%"; Hit description =Arabidopsis thaliana genomic DNA, chromosome 5, P1 clone:MUL3
  Subcellular localization annotation: CTP_CleavageSite=53; ConfidenceScore=5.94e-01
MSSSCGRTCGFNLDFAKSSSTSTLTSPTSSPSSTTTSETTNSPQSIIFRKKPRTLRKRPNQTFNEAATLLSTAHPNLFSTKNLKNPEKFTKPIITEYNDSSEPLLLFRDYENSDNDNDAFSFLLERKRSFQTEPNKAFFSVRENINKPCELSTKVVNCDKLDLESEEFDCESMLDEEIEEGIDGIMRGRTVQKDDTNCTECHIGLKQRSQSPLYHPSCHCGDGGKFGWVRTLRGVGEDDDTKWWNFCVVDMLQISPRMKHAAAEDLVPATTTTTTKKKAKNKKNKKDLVKELLPEEVAVSQGLLLKLNYDDVRNAWSDRGSPFADGSPGNDVTLSCSSLARDLKSKRKKDRSISSWMEGGVRKKSGLRYKEKKQIRHQFWIVNAHQRPRIKARLS

SEQ ID NO: 117920 - protein, 117 aa, Glycine max
  Coding DNA Sequence Number=SeqID_1142
  Gene Ontology: Mol. function=kinase activity
  Homolog annotation: Hit_ID=Q6UC87; Match level="QueryCoverage=50%, HitCoverage=17%, E-value=7e-20, Identity=84%"; Hit description =Putative calcium-dependent protein kinase CPK1 adapter protein 2
MEWLVGKTTQLEGEKMQKEAEVQKLMEENVRLSALLDKKEAQLLALNEQCKMMALSASNMISDDKSNMASQILLPKRVCNPKDAVVYVLADIFGSVSMKYGRSERNKDELSFNHLES

SEQ ID NO: 117921 - protein, 130 aa, Glycine max
  Coding DNA Sequence Number=SeqID_1143
  Gene Ontology: Mol. function=RNA binding; Biological process =gynoecium development
  Homolog annotation: Hit_ID=Q1T451; Match level="QueryCoverage=81%, HitCoverage=22%, E-value=1e-38, Identity=75%"; Hit description=KH, type 1
  Pfam annotation: Domain name=KH_1; Domain location=70-110; Score =25.2; E_value=0.00024; Accession=PF00013.19; Description=KH domain
MCEETRSRIRVLDAPLGTPDRIVLVSGKEEPEAALSPAMDAVVRIFKRVSGLSETDAENKESAAGLAFCSIRLLVASTQAINLIGKQGSLIKSIQENTSASVRVLSGGMILVMLCNYASMMIPLILSSNY

SEQ ID NO: 117922 - protein, 420 aa, Glycine max
  Coding DNA Sequence Number=SeqID_1144
  Gene Ontology: Mol. function=tRNA methyltransferase activity; Cellular component=nucleolus; Biological process=tRNA methylation
  Homolog annotation: Hit_ID=Q75LH5; Match level="QueryCoverage=66%, HitCoverage=94%, E-value=2e-54, Identity=45%"; Hit description =Expressed protein
  Pfam annotation: Domain name=DUF715; Domain location=147-415; Score =234.5; E_value=2.4e-67; Accession=PF05206.5; Description=Protein of unknown function (DUF715)
METKRCNFWLPNKNRFCANCPLNGSFSVLKQNLKGHVKRCPLLKQVQSLSDQPFYDKGINAGSDGEEETSGVDDSRLPTMTVSSEMKRNTLHEMSVAEFCNLIEKIEFLHESLCKDIEDSVQMPEVCRLWIKRVGDRKLPFQEKHIMQQASIVGNLENFGVLKNSLRRNQSECVEPVEKKEKDVLAVIEFGAGRGYLTQMLADCYGIKKVFLVERKAYKLKVGHKLLGKADRSLRQNESLMLERLRIDIEDLDLNAVESLQGVPYLATGKHLCGAATDLTLRCCFPEYREDSSGQYTANNKRFFLDLGLTKEEFHAITWFTSWAVDANHGSDLPDTTNCISHLQTIKEQGDECANGVEKILSDMQADKRAALGFKCKWIIDMGRLMWLRQHGLDAKLVKFVPPSISPENHLLLARPSNRL

SEQ ID NO: 117923 - protein, 267 aa, Glycine max
  Coding DNA Sequence Number=SeqID_1145
  Gene Ontology: Mol. function=RNA binding; Biological process =gynoecium development
  Homolog annotation: Hit_ID=Q1T451; Match level="QueryCoverage=64%, HitCoverage=47%, E-value=1e-57, Identity=59%"; Hit description=KH, type 1
MARKKMGGVWEWQLEWRRMLMEGEMDLAANLLEDIEGMYTVGSAYRALNQFIIEEDDERAFSILWKLKIPSKVSHFAWRLIRDKLPTRMNLRSQNYNASTSQDRQAETWSDKSLLHTTSRTSIFADIPYSTKRDSVLADRESQLDSFLPSSTMSLYGQDSSLSGVRSSALGRVGAPIVTTESRVPDEIVVEIKGTSSEVQTAQQLIQDVISSHKEPITSSYGRLDAGPRSSYSQLGTTSRLPPSSLSSQPYTGYGASGLGDYSTFRL

SEQ ID NO: 117924 - protein, 107 aa, Glycine max
  Coding DNA Sequence Number=SeqID_1146
  Homolog annotation: Hit_ID=Q1RV13; Match level="QueryCoverage=62%, HitCoverage=16%, E-value=3e-08, Identity=50%"; Hit description=IMP dehydrogenase/GMP reductase
MEGRHMLHSVVIANEIVDEARRYISCTPRIKASDVGLPNSLVPFLFNIVAEGLTGLTREAQKKNLFEGFLVGRNNVDISILQYADDSVFRESNNVKREGHQGYAKEF

SEQ ID NO: 117925 - protein, 55 aa, Glycine max
  Coding DNA Sequence Number=SeqID_1147
  Subcellular localization annotation: CTP_CleavageSite=58; ConfidenceScore=5.42e-01
MALELSTDTTKTITSSDSSSATSKVFFVSCVGPCGLNNLRRIGLECRRSISFRRG

SEQ ID NO: 117926 - protein, 73 aa, Glycine max
  Coding DNA Sequence Number=SeqID_1148
MMENWHLTARISHPKRKMMTTPLFSLSQIAAQCRDGIAPRVAEICVTLAENETSGEGMCKLREQEERLERDGG

SEQ ID NO: 117927 - protein, 348 aa, Glycine max
  Coding DNA Sequence Number=SeqID_1149
  Homolog annotation: Hit_ID=Q9SWB3; Match level="QueryCoverage=51%, HitCoverage=73%, E-value=8e-54, Identity=53%"; Hit description=Seed maturation protein PM39
  Pfam annotation: Domain name=CAP160; Domain location=116-142; Score =30.0; E_value=8.5e-06; Accession=PF07918.2; Description=CAP160 repeat
  Pfam annotation: Domain name=CAP160; Domain location=167-192; Score =28.8; E_value=2e-05; Accession=PF07918.2; Description=CAP160 repeat
  Pfam module annotation: Pfam domain module=CAP160::CAP160; Domain location=116-142::167-192
MELIREDPQTQLEHFVRSLGERKQCMLKSILRDQWTWKKILIPTKYISSIYAPANYQAVDPTAIVMLIFKPRSGSSLSLRIRQTHFLLVFMACVRPLQQSAVGAFVSPPKYGRHVVTPQQLAIADKAVSAKNTVASNLGYGNNAETKTTQTTQTRNQLKNTGNEKPSTISSATSDKAFSAKNTVASKLGFGDTATTTPQEKRTDHAAAPTEYGKSVAQSLTEKLAPVSGKVAGVGSGVKSKVSGTQTSSVGVEQDKGVSVKDYLVDKLRPGDEDRALSEVISETLHKKELPPVEVTEEGVRKQSATLILNLWFAWVEDSSMNYEAGRAEVEQVNQGAAGERRLQESSN

SEQ ID NO: 117928 - protein, 34 aa, Glycine max
  Coding DNA Sequence Number=SeqID_1150
MKLKKSETLIWLDFVECPKVQDEKMEDLHMDFME

SEQ ID NO: 117929 - protein, 354 aa, Glycine max
  Coding DNA Sequence Number=SeqID_1151
  Gene Ontology: Mol. function=sugar porter activity; Cellular component=nucleus
  Homolog annotation: Hit_ID=Q1SNI6; Match level="QueryCoverage=99%, HitCoverage=100%, E-value=1e-82, Identity=53%"; Hit description =Sugar transporter superfamily
  Subcellular localization annotation: CTP_CleavageSite=13; ConfidenceScore=5.22e-01
METPSSTARRITRSQTASNNIPVSRKKNEECSGKKSVSKTRQRSSVQQQQDNRCALVDISNDSPIVGLANGKDMIETPLSSTAKKKTTMTPGSGEALLRGQVKTLLQRVEEEAVISKLSMEIVAPFLKLANSSSVSPMSLLAPTPANTPQVPNLSEVSPPSCVLEEQLLISRAMNEILEGKNNENAECEKSVITRSLLLDFSDKSEVSECSSEVTYQEVTQGSVGSGSSEDDGASIWSIQVNASTHDEDEDDEEMGEEEEDYYEDDGDDEECYVDGVGLSLDELCAGMNNISVNENKNKGCGKHTRFVYDSEDDEIVEKVVECCAESDVMHLKGLPTPKGKHLRFPEEEENSDL

SEQ ID NO: 117930 - protein, 517 aa, Glycine max
  Coding DNA Sequence Number=SeqID_1152
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q1SNJ1; Match level="QueryCoverage=81%, HitCoverage=95%, E-value=0.0, Identity=77%"; Hit description =Glycoside transferase, six-hairpin, subgroup
  Pfam annotation: Domain name=Glyco_hydro_9; Domain location=64-507; Score=612.8; E_value=3e-181; Accession=PF00759.9; Description =Glycosyl hydrolase family 9
MEHKVNDKEPNKKHYVGALCWWLTVSIIAVLVVVAGVLSLITKFKFGHSNSPEFTSHPTNVVQKYASALELALQFFDVQKSGKLENKRVWWRGDSGLRDGSEENLDLSKGMYDAGDHMKFGFPLAFTATVLSWAILEYGGRMDAVKQLHYALDSLKWITDYLVNAHPFPEVLYIQVGDPEVDHNCWERPEDMKEKRPLTQVNSSFPGTEVAAETAAALASASLVFKEIDFAYSRILLRHAQQLFTFADAYRVSYSVSIPQVGKYYNSSGYGDELLWAGQNEKAFGSLGSLSWLSWDDKHAATQVLLSRVNFFGESNIPDAENLDLQMYRETAEILMCKLLPDSPTATANRTESGLIWVVPWNSLQHSVASAFLAVLYSDYMLTSQTEILYCSGKLYKPVDLRKFAISQADYVLGENPMKMSYLVGYGTQYPKYIHHRGSSIPVNATTGCKDGFKWFDSPHPNPNVAFGALVGGPFFDETYNDFRNNSMQAEPTTYSSALFVALLSGLVASSSVAWSF

SEQ ID NO: 117931 - protein, 324 aa, Glycine max
  Coding DNA Sequence Number=SeqID_1153
  Gene Ontology: Mol. function=zinc ion binding; Cellular component =intracellular
  Homolog annotation: Hit_ID=Q1SNI8; Match level="QueryCoverage=93%, HitCoverage=97%, E-value=1e-121, Identity=64%"; Hit description=Zinc finger, RanBP2-type
  Pfam annotation: Domain name=zf-RanBP; Domain location=17-46; Score =36.7; E_value=8.2e-08; Accession=PF00641.9; Description=Zn-finger in Ran binding protein and others
  Pfam annotation: Domain name=zf-RanBP; Domain location=183-211; Score= 17.7; E_value=0.0065; Accession=PF00641.9; Description=Zn-finger in Ran binding protein and others
  Pfam annotation: Domain name=zf-RanBP; Domain location=60-89; Score =33.8; E_value=6.1e-07; Accession=PF00641.9; Description=Zn-finger in Ran binding protein and others
  Pfam module annotation: Pfam domain module=zf-RanBP::zf-RanBP::zf -RanBP; Domain location=17-46::183-211::60-89
MLKGTTKGGEMGGEGGREGDWECSSCNNRNYAFRSFCNRCKQPRLLVDTKTPSDSKWLPRIGDWICTGCTNNNYASREKCKKCGQPKEVAAMPAIAMTGASFPPYSHYFSRAPGGPEQKMNIGLLGNSAPSQSLHFNSNWPVPRADKYGVQPLSIWLPSRNYGSGHPHENSTNHNLSVPKGWRNGDWICNCGFHNYSSRSQCKKCNAFPPAIDVKLHAVSTFWCEALGTKRLASEELVYDWDNKRLNVGTTNDQQQTYTSLDLVVGTGADPKPGVFPSYPSMNSSTAPSLPLATLLPPQVSTPALIGKGCKTQRMAPMQPVNVV

SEQ ID NO: 117932 - protein, 391 aa, Glycine max
  Coding DNA Sequence Number=SeqID_1154
  Gene Ontology: Mol. function=oxidoreductase activity; Cellular component=proton-transporting two-sector ATPase complex; Biological process=flavonoid biosynthetic process
  Homolog annotation: Hit_ID=Q3T7D5; Match level="QueryCoverage=99%, HitCoverage=100%, E-value=0.0, Identity=96%"; Hit description =Flavanone 3-hydroxylase
  Pfam annotation: Domain name=2OG-FeII_Oxy; Domain location=211-312; Score=143.6; E_value=5.4e-40; Accession=PF03171.10; Description=2OG -Fe(II) oxygenase superfamily
MAPAAAKTLTYLAQQKTLESSFVRDEEERPKVAYNEFSDEIPVISLAGIDEVDGRRREICEKIVEACENWGIFQVVDHGVDQQLVAEMTRLAKEFFALPPDEKLRFDMSGAKKGGFIVSSHLQPLHTYLEKDPNPKHEGESVQDWREIVIYFSYPKRERDYSRWPHKPEGWRWATEEYSEKLMGLAGKLMEVLSEAMGLEKEGLSKACVDMDQKVVVNYYPKCPQPDLTLGLKRHTDPGTITLLLQDQVGGLQATRDNGKTWITVQPVEAAFVVNLGDHAHYLTNGRFKNADHQAVVNSNHSRLSIATFQNPAPNATVYPLKIREGEKPVMEEPITFAEMYRRKMSKDLEIARMKKLAKENHLQDLENEKHLQELDQKAKLEAKPLKEILA

SEQ ID NO: 117933 - protein, 251 aa, Glycine max
  Coding DNA Sequence Number=SeqID_1155
  Gene Ontology: Mol. function=nuclease activity; Cellular component =mitochondrial inner membrane; Biological process=DNA repair
  Homolog annotation: Hit_ID=Q69JZ1; Match level="QueryCoverage=56%, HitCoverage=23%, E-value=2e-44, Identity=63%"; Hit description=AP endonuclease 2-like
  Pfam annotation: Domain name=Exo_endo_phos; Domain location=1-239; Score=-7.0; E_value=0.034; Accession=PF03372.13; Description =EndonucleaseExonucleasephosphatase family
MKIVSYNVNGLRQRIAQFGSLRNLLNSFDADIICFQETKLRRQEVTADLVMADGYESFFSCTRTSQKGRTGYSGVITFCRVKSAFSSNEVVLPLAAEEGFTGLLGNSQTSNDKLPFLMEDLEEFSKDELLSLDSEGRCIITDHLTLEGGGGGGAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 117934 - protein, 411 aa, Glycine max
  Coding DNA Sequence Number=SeqID_1156
  Gene Ontology: Mol. function=protein serine/threonine kinase activity; Cellular component=cytoplasm; Biological process=protein amino acid phosphorylation
  Homolog annotation: Hit_ID=Q5D875; Match level="QueryCoverage=84%, HitCoverage=62%, E-value=0.0, Identity=92%"; Hit description=Calcium- dependent protein kinase CDPK1444
  Pfam annotation: Domain name=Pkinase; Domain location=8-210; Score =124.9; E_value=2.2e-34; Accession=PF00069.15; Description=Protein kinase domain
  Pfam annotation: Domain name=Pkinase_Tyr; Domain location=8-208; Score=-168.4; E_value=0.039; Accession=PF07714.7; Description =Protein tyrosine kinase
  Pfam annotation: Domain name=efhand; Domain location=257-285; Score =30.8; E_value=4.8e-06; Accession=PF00036.22; Description=EF hand
  Pfam annotation: Domain name=efhand; Domain location=294-322; Score =18.6; E_value=0.022; Accession=PF00036.22; Description=EF hand
  Pfam annotation: Domain name=efhand; Domain location=335-363; Score =20.2; E_value=0.0072; Accession=PF00036.22; Description=EF hand
  Pfam annotation: Domain name=efhand; Domain location=365-393; Score =24.7; E_value=0.00032; Accession=PF00036.22; Description=EF hand
  Pfam module annotation: Pfam domain module=Pkinase::Pkinase _Tyr::efhand::efhand::efhand::efhand; Domain location=8-210::8 -208::257-285::294-322::335-363::365-393
MVMCQNFYVEIAELGSMIFGTILCLCVWQKAVFVYRTQWRTYMKDGRYTEKDSAVVVRQMLKVAAECHLHGLVHRDMKPENFLFKSIKEDSPLKATDFGLSDFIKPGKKFHDIVGSAYYVAPEVLKRKSGPQSDVWSIGVITYILLCGRRPFWDKTEDGIFKEVLRKKPDFHRKPWPTISNAAKDFLKRLLVKDPRARLTAAQGLSHPWVREGGEALEIPIDISVLSNMRQFVKYSRMKQFALRTLASTLNEEELADIKDQFDAIDVDKNGSISLEEMRQALAKDLPWKLKESRVLEILQAIDSNTDGLVDFREFVAATLHVHQLEEDSDKWQQLSQAAFEKFDIDKDGYITTEELRMHTCLRGSVDPLLEEADIDKDGKISLPEFRRLLRTASMSSKNVSSPSVHRRRRF

SEQ ID NO: 117935 - protein, 70 aa, Glycine max
  Coding DNA Sequence Number=SeqID_1157
MSWLQVKGAFPLSPKQHFLHHLGVQPAGLFEEAIFLLWSWLRGYEKDFTVHFNHWSSNLPQSFMYQQGIA

SEQ ID NO: 117936 - protein, 256 aa, Glycine max
  Coding DNA Sequence Number=SeqID_1158
  Gene Ontology: Mol. function=DNA ligase (ATP) activity; Cellular component=intracellular; Biological process=DNA recombination
  Homolog annotation: Hit_ID=Q1T452; Match level="QueryCoverage=93%, HitCoverage=72%, E-value=1e-108, Identity=82%"; Hit description=ATP -dependent DNA ligase
  Pfam annotation: Domain name=DNA_ligase_A_N; Domain location=5-187; Score=-62.3; E_value=0.027; Accession=PF04675.5; Description=DNA ligase N terminus
  Subcellular localization annotation: CTP_CleavageSite=22; ConfidenceScore=5.13e-01
MTEQTKLSVLCSLFTWTQRSKSAAKKRAKFRKFLDAFCTDHNFFPAVRLLLPNLDRERGSYGLKESVLATSLIDALGISRDSPDALRLLNWRKGGAATGPTAGNFALVASEVLQRRQGTASGGLTIRELNELLDRLASAENRAEKILVLSTLIQKTNAQEMKWIIMIILKDLKLGISEKSIFHEFHPDAEDLFNVTCDLKLVCEKLRDRNQRHKRQDIEVGKAVRPQLAKRVANATEAWKKDLKPLVGPPSPEVAC

SEQ ID NO: 117937 - protein, 477 aa, Glycine max
  Coding DNA Sequence Number=SeqID_1159
  Gene Ontology: Mol. function=nuclease activity; Cellular component =mitochondrial inner membrane; Biological process=DNA repair
  Homolog annotation: Hit_ID=Q69JZ1; Match level="QueryCoverage=95%, HitCoverage=71%, E-value=5e-92, Identity=41%"; Hit description=AP endonuclease 2-like
  Pfam annotation: Domain name=Exo_endo_phos; Domain location=1-185; Score=-12.3; E_value=0.073; Accession=PF03372.13; Description =EndonucleaseExonucleasephosphatase family
  Pfam annotation: Domain name=zf-GRF; Domain location=423-461; Score =27.7; E_value=1.3e-05; Accession=PF06839.3; Description=GRF zinc finger
  Pfam module annotation: Pfam domain module=Exo_endo_phos::zf-GRF; Domain location=1-185::423-461
LFNLYGPRAGGDDTERIQFKQKFYRILQKRWESLLHQGRRIFVVGDLNIAPFAIDRCDAGPDFENNEFRKWFKSMLIENGGRFSDVFRAKHPDRREAYTCWSQNTGAEVFNFGSRIDHILFAGSCLHELDDLQCHSFIRCHVKECDILTQYKRCKPESTLSAHRWKGGHSVKLEGSDHAPVLMSLHEIPDVSLHSTPSLSARYVPMVHGIQQTLVSVLMKRQVSELMKSCEMAQEDIAMDGTCEREEPVNRAGSSTRSPNECHFPPSQDFEVSSILKPNKLSGGSSQESVSKSGSENKKSTTRQCNRSNKKARNGQWSQLSLRSFFQKSTNLDKGSSIKEVVNDSCTDYSNNNQAEPSQPSPRLQEIPTVCAHNGSPKQYELDTDTCDPDLAGPNGSSTKEEKSNVASLEWQRIKQLMQNSIPICKGHKEPCIARVVKKQGPNFGRRFYVCARAEFYEDSSICPSKEFSPSLKLEQC

SEQ ID NO: 117938 - protein, 52 aa, Glycine max
  Coding DNA Sequence Number=SeqID_1160
MAQMKFEEPVEMKMLCSIERLNSDKLQEQEVTEAMICQTQLEKTKTQELKTK

SEQ ID NO: 117939 - protein, 97 aa, Glycine max
  Coding DNA Sequence Number=SeqID_1161
  Homolog annotation: Hit_ID=Q0PCF8; Match level="QueryCoverage=84%, HitCoverage=6%, E-value=4e-23, Identity=67%"; Hit description=DNA ligase IV
MLCISFLPFFRDEGIVLKDHSSKWEPSDRSGKWLKLKPEYIQAGSDLDVLIIGGYYGSGRRGGEVAQFLVGLAERPSPNTHPKQYKRVKNFLSFWFL

SEQ ID NO: 117940 - protein, 64 aa, Glycine max
  Coding DNA Sequence Number=SeqID_1162
MLCGSNKRLPSKSPTAAHLLPRIKVQDHHRHQSHGIKIAKPKHVHMTLSLRKTRQQVSMSPCHA

SEQ ID NO: 117941 - protein, 98 aa, Glycine max
  Coding DNA Sequence Number=SeqID_1163
  Gene Ontology: Mol. function=DNA ligase (ATP) activity; Cellular component=intracellular; Biological process=DNA recombination
  Homolog annotation: Hit_ID=Q1T453; Match level="QueryCoverage=86%, HitCoverage=11%, E-value=2e-36, Identity=86%"; Hit description=ATP -dependent DNA ligase; BRCT
MNLNNSVTHCVAADSKGFKFEAAKRHGDIIHYSWVLDCYDQKKLVCLQPKYFLFLSELTKKKLQEEIDEFSDTYYLDLDLGVIKQLFLTKLFPWEVRI

SEQ ID NO: 117942 - protein, 178 aa, Glycine max
  Coding DNA Sequence Number=SeqID_1164
  Gene Ontology: Mol. function=nucleic acid binding; Biological process= DNA integration
  Homolog annotation: Hit_ID=Q1S7C5; Match level="QueryCoverage=93%, HitCoverage=13%, E-value=9e-32, Identity=37%"; Hit description =Integrase, catalytic region
MASAPLNPVSQSFPNTIAEKFDDSNYFHWQQHVEPVIKAHKLQCFVVNPVIPPHHLTEDDSIADRVNPEYEAWEVQDQTLLVWLQSTFSKSVLSHVLGSNHSYQVWDKIHEYFCLHTKSHARQLRTAMRAVSLEGKSIKEYLQKIKSYVDELAGVGVLVQHEEYVYALLEGILSDYAP

SEQ ID NO: 117943 - protein, 57 aa, Glycine max
  Coding DNA Sequence Number=SeqID_1165
MGFRRVLLKGPCPMKGLVTLWKSIWGLCRVLLRRPYLVKGHVDATEFLDDATSSEGR

SEQ ID NO: 117944 - protein, 142 aa, Glycine max
  Coding DNA Sequence Number=SeqID_1166
MHAAIRNGESSTDGPRGSGLAGTSGDFKPAGLASQTGELVPAHVSPNAVAIKPCTSAAVASGGAQARAKTAKSIGSVYSECVTSFNLNSWFFLLCYKFLSLQAFRVKNSYKEEELRTSKRQHKKEQSFFTNRNQTHTHNIFF

SEQ ID NO: 117945 - protein, 123 aa, Glycine max
  Coding DNA Sequence Number=SeqID_1167
  Gene Ontology: Mol. function=transporter activity; Cellular component= integral to membrane; Biological process=auxin mediated signaling pathway
  Homolog annotation: Hit_ID=Q673E8; Match level="QueryCoverage=99%, HitCoverage=19%, E-value=2e-41, Identity=73%"; Hit description =Putative auxin efflux carrier protein 6
MEMPSLIKASVKIISDAGLGMAMFSLDVFIPTPNQIGEEDKRRTRLFMALQPRIIACGTKRAVMGMVIRFMCGPLVMSASSIVIGLRQDRLHTAIVQAALPQGIVPFIFAREYGLHPDILSTG

SEQ ID NO: 117946 - protein, 102 aa, Glycine max
  Coding DNA Sequence Number=SeqID_1168
  Gene Ontology: Mol. function=heat shock protein binding; Cellular component=integral to membrane; Biological process=protein folding
  Homolog annotation: Hit_ID=P93499; Match level="QueryCoverage=98%, HitCoverage=61%, E-value=4e-32, Identity=68%"; Hit description=DnaJ -like protein
  Pfam annotation: Domain name=DnaJ; Domain location=6-70; Score=94.2; E_value=3.9e-25; Accession=PF00226.21; Description=DnaJ domain
MASSATLYQILGVRAVASGEEIKAAYRRLARVCHPDVVPLERRDSSAAEFMKIHAAYRTLSDPEKRASYDRSLFRRRQRTLTMSPSGYCGYGGRNWETDQCW

SEQ ID NO: 117947 - protein, 67 aa, Glycine max
  Coding DNA Sequence Number=SeqID_1169
MALLPPILYVYMRKKGMKGSIIVGTNTTDADKMSGKSMKFSERKDGGEIKKKGLYIPHAIAELAASN

SEQ ID NO: 117948 - protein, 53 aa, Glycine max
  Coding DNA Sequence Number=SeqID_1170
MLLSWLKFVSNSIVEAGSTVAGQGGVAHAELEFGATKMGNTDSNLRQRWVGWG

SEQ ID NO: 117949 - protein, 136 aa, Glycine max
  Coding DNA Sequence Number=SeqID_1171
  Gene Ontology: Mol. function=structural constituent of ribosome; Cellular component=ribonucleoprotein complex; Biological process =translation
  Homolog annotation: Hit_ID=UPI000068BD78; Match level="QueryCoverage =71%, HitCoverage=90%, E-value=1e-17, Identity=51%"; Hit description =ribosomal protein L24
  Pfam annotation: Domain name=Ribosomal_L5; Domain location=95-136; Score=22.8; E_value=6.7e-05; Accession=PF00281.9; Description =Ribosomal protein L5
MSKLKIKRGDNVIITTGKKDIKGKTGEVIEVIKKEGRDPRVIVAGLNIIKKHVKPSASNPQGGIVEREASIHISNVALVGKDGKAVKVGYKTEGDKKVPKLEKIILSQGLGDATADKKIIDYAVEELTNITGQKAV

SEQ ID NO: 117950 - protein, 77 aa, Glycine max
  Coding DNA Sequence Number=SeqID_1172
MKYNETCRKYIGQNKNFEKSSTASKSPKQASKLVGKNFGDEGQEIVTDTLEEVPPCGGINEHRNRSTPIHPQHHISN

SEQ ID NO: 117951 - protein, 187 aa, Glycine max
  Coding DNA Sequence Number=SeqID_1173
  Gene Ontology: Mol. function=RNA-directed DNA polymerase activity; Cellular component=chromatin; Biological process=chromatin assembly or disassembly
TDWLFANYASIDCSHKEVVFNPSSVASFKLKGAGTIVLPKVISALKAKLKVSLSSEPVVREYPDVFPYELPGLPPLREIDFAMELEPDTGLISRAPYRMAPAELKELKRVTLGSTSVREEEGWIDALCIDYRELNKIDLLSGYPQLRIRVSDIPKTASRSRYGHYEFIVMSFGLTNAPAVFMDLMNR

SEQ ID NO: 117952 - protein, 183 aa, Glycine max
  Coding DNA Sequence Number=SeqID_1174
MSIRSTGLEPKSQLTINLSLKRKQKGENSRSKESAKSKRRKFPIKKKMGESKKRKKIPNQGSEENRRNMLKELSPSKRKKKRNHDLKWSSTFDCQPKSCVSVACSPYTKQKQKRKRPRTLKAKIPTKKQTIPKKKSYSSMITHVIFDLIGNCRNLPFGGRATRDSRDACSTKGMRAESPPTFI

SEQ ID NO: 117953 - protein, 64 aa, Glycine max
  Coding DNA Sequence Number=SeqID_1175
MSIGKLCCVPARDPAKLRAWAWINAKGKGRKFSYYEWEMNPRACLNSQEYWRCTDESSERPAWD

SEQ ID NO: 117954 - protein, 109 aa, Glycine max
  Coding DNA Sequence Number=SeqID_1176
  Homolog annotation: Hit_ID=Q9SD67; Match level="QueryCoverage=37%, HitCoverage=5%, E-value=8e-11, Identity=80%"; Hit description=FtsH metalloprotease-like protein
MSRLLAPKQQCRPSICIGEIDNQVDTAHSHDSHMCRLSMLKHNLTLDETELELHKAKPHGQIREGADEIEEKTAKLKGSEKALVARHEARHAVVGTAVANLLAGQPHVE

SEQ ID NO: 117955 - protein, 36 aa, Glycine max
  Coding DNA Sequence Number=SeqID_1177
MILRQLLEKPKAGFREISRDHHGSFLVGFYGHVGGQ

SEQ ID NO: 117956 - protein, 524 aa, Glycine max
  Coding DNA Sequence Number=SeqID_1178
  Gene Ontology: Mol. function=nucleic acid binding; Cellular component= intracellular; Biological process=chromatin modification
  Homolog annotation: Hit_ID=Q5UDB6; Match level="QueryCoverage=97%, HitCoverage=88%, E-value=9e-91, Identity=42%"; Hit description =INDETERMINATE-related protein 9
  Pfam annotation: Domain name=RS4NT; Domain location=85-122; Score =16.0; E_value=0.025; Accession=PF08071.2; Description=RS4NT (NUC023) domain
  Pfam annotation: Domain name=zf-C2H2; Domain location=100-122; Score =21.1; E_value=0.004; Accession=PF00096.16; Description=Zinc finger, C2H2 type
  Pfam annotation: Domain name=zf-C2H2; Domain location=24-46; Score =26.0; E_value=0.00013; Accession=PF00096.16; Description=Zinc finger, C2H2 type
  Pfam module annotation: Pfam domain module=RS4NT::zf-C2H2::zf-C2H2; Domain location=85-122::100-122::24-46
MGYIDPDAEVIKLSPKTLMATNRFICEVCNKGFQREQNLQLHRRGHNLPWKLKQKSTKEQKRKVYLCPEPTCVHHDPSRALGDLTGIKKHYYRKHGEKKWKCEKCSKKYAVQSDWKAHSKTCGTREYRCDCGTLFSSGGIWQQETARTRDSFITHRAFCDALAQESARFPGGLNPLGTHLFGTNHTTSLSLSQVGNQLSQVQKQNQTATNYNSILRLGNNNVGAAATKFEHLIPPLNHSSFGHSPQSMPSSAFFMNDNTNQALFEEHQSQLQGLMQLQDLQGNTNNSDSSSVGPPNSNLVNLSFFPISSNIGTGTIIPGQFNNISGSNQGTTTTTTTTLYGNSIENESSPHAGSSFSSIFGNSIENASSSHMSATALLQQAAQMGSTTTTTTNNGSSLLGGMCTNNSSKAENDHHHNLQGLMNSIANGNTSLFGSMQGNENNLCGFHNVDESNNNKLPQNLSVNFGGSDKLTLDFLGVGGMMTNMSGGFSQREQQQHVTGTMSSLDHDLKSAQSYRHFGKSTLQ

SEQ ID NO: 117957 - protein, 63 aa, Glycine max
  Coding DNA Sequence Number=SeqID_1179
  Subcellular localization annotation: CTP_CleavageSite=26; ConfidenceScore=5.46e-01
MTTVGSSCSSSPSCEPPRRSSPLSLRAAPKPYKNPSFKTSLSAPLLSTNVVLGEKELDLPMKI

SEQ ID NO: 117958 - protein, 42 aa, Glycine max
  Coding DNA Sequence Number=SeqID_1180
MVWVKNWQDHFDPVICLESSAQLWRSGSSGRLGIDGNINRNH

SEQ ID NO: 117959 - protein, 304 aa, Glycine max
  Coding DNA Sequence Number=SeqID_1181
  Homolog annotation: Hit_ID=Q6YUR8; Match level="QueryCoverage=39%, HitCoverage=56%, E-value=6e-23, Identity=42%"; Hit description =Putative Glycine-rich protein 2
  Subcellular localization annotation: CTP_CleavageSite=74; ConfidenceScore=5.78e-01
MPWLPTIKASAFSTAAAASATTTKSPSFHAAIPSQMTNLPTPKTTSTASSTANVALPGGAIPRHVSKSATPKARSASATTSNAYTAAASAHAISREVAEPPAIETTTAAAASAATRITAPVAIPGEVSKLATLVARGAASAIAPGAETEARAGGAVVVAGGCAGLERGAVDAGDVDGLGLVVVAGGDGELDAVALEEGAVAVGSDGGLVNEEILAAVVGLDEAEALAIVEPLHHARESLFRHRNRFDFLDPTNPRNRASRGGMPTTEHFLWSLYIYVRGELKFQGIYKSNPTLPITVNHFFKGC

SEQ ID NO: 117960 - protein, 454 aa, Glycine max
  Coding DNA Sequence Number=SeqID_1182
  Gene Ontology: Mol. function=binding
  Homolog annotation: Hit_ID=Q1SPQ2; Match level="QueryCoverage=95%, HitCoverage=69%, E-value=1e-165, Identity=67%"; Hit description=IMP dehydrogenase/GMP reductase
  Pfam annotation: Domain name=Arm; Domain location=221-261; Score=2.7; E_value=5.6; Accession=PF00514.13; Description=Armadillobeta-catenin -like repeat
  Pfam annotation: Domain name=Arm; Domain location=277-312; Score=5.9; E_value=2.2; Accession=PF00514.13; Description=Armadillobeta-catenin -like repeat
  Pfam annotation: Domain name=Arm; Domain location=30-70; Score=20.9; E_value=0.0045; Accession=PF00514.13; Description=Armadillobeta -catenin-like repeat
  Pfam annotation: Domain name=Arm; Domain location=355-395; Score =12.7; E_value=0.31; Accession=PF00514.13; Description=Armadillobeta -catenin-like repeat
  Pfam module annotation: Pfam domain module=Arm::Arm::Arm::Arm; Domain location=221-261::277-312::30-70::355-395
GVGPLLKLIKEGKKEGQENAARAIGLLGRDLESVELMIHAGVCSVFAKVLKEGPMKVQAVVAWAVSELAAKYPKCQDLFAQHNIVRLLVSHLAFETVQEHSKYAIVSNKPTSIHAVVMANSNNSNGNGARKESEDEEKQMQSRMQHPLGDRSTNQMHRVVTSTMAMHAANKKQQQVNGGNGKQSYSYSGINMKGREIEDPDNKAYMKAMAARALRQLAKGNAAICRSITESRALLCLAILLEKGTEDVMYNSALAVKEITAVAEKDAELRRSAFKPNSPACKAVVDQVLKIIEKEDRKLLIPCVKAIGNLARTFRATETRIIGPLVRLLDEREAEVSREAAISLTKLACSENYLHLDHSKAIISASGAKHLVQLVYLGEQTVQISALVLLSYIALHVPDSEELARAEVLGVLEWASKQPNLTQDQTLEALLQDSKGRLELYQSRGSRGFQKLHH

SEQ ID NO: 117961 - protein, 64 aa, Glycine max
  Coding DNA Sequence Number=SeqID_1183
  Subcellular localization annotation: CTP_CleavageSite=46; ConfidenceScore=5.21e-01
MAAASSSTPFLGIREESPQITTHHQPSTVSPTTAPQKKRRNQPGTPCKLLSSKFLKSTEMRLLV

SEQ ID NO: 117962 - protein, 41 aa, Glycine max
  Coding DNA Sequence Number=SeqID_1184
MTCLHSDYDTVAMCTFKEGNAMEGMRQLWGGGNIAKRCDNG

SEQ ID NO: 117963 - protein, 97 aa, Glycine max
  Coding DNA Sequence Number=SeqID_1185
  Gene Ontology: Mol. function=DNA binding; Cellular component=nucleus; Biological process=regulation of transcription
  Homolog annotation: Hit_ID=Q2LME9; Match level="QueryCoverage=91%, HitCoverage=31%, E-value=7e-33, Identity=71%"; Hit description=MYB11
  Pfam annotation: Domain name=Myb_DNA-binding; Domain location=15-62; Score=43.2; E_value=9.1e-10; Accession=PF00249.21; Description=Myb -like DNA-binding domain
MGRKANCDNQYAMNRGPWSAEEDKILMNDVQVHGERKWRELSKRAGLKRCGKSCRLRWLNYLKPDIKRGNISSDEEDLIIRLHKLLGNRWYIYLFIL

SEQ ID NO: 117964 - protein, 198 aa, Glycine max
  Coding DNA Sequence Number=SeqID_1186
  Homolog annotation: Hit_ID=Q10P78; Match level="QueryCoverage=87%, HitCoverage=53%, E-value=2e-30, Identity=44%"; Hit description =Expressed protein
MDNRTTNEKASSLRWKILRRALLSRSSPPHPDEQSQMITKSISRRTGHGFNLILSHVIADSSSSTRDARVCYTLPIPGAPQLFLTQRVDNRADLSDFEICNRYNIDNTGLVCKFLLSSSSQLTSTDSKVIGHQKMFLLTIACHMQIYSVIELGSGYGLAGFAIAAATEASEVVISDGNPQVVDLIFAVNMADRMVSEK

SEQ ID NO: 117965 - protein, 121 aa, Glycine max
  Coding DNA Sequence Number=SeqID_1187
  Homolog annotation: Hit_ID=Q10P78; Match level="QueryCoverage=74%, HitCoverage=26%, E-value=2e-24, Identity=56%"; Hit description =Expressed protein
MSFLVNSIFLSLYNLDKDQSQTKGFSISTFFKDFHRDLARIVKHLLSKAGSSEAIFLSPKRGNSLDLFLEVAKENSLHFSVMENYDEEVWKRHKGFLNEDRDSWPSYDKGHSYPLLIRITL

SEQ ID NO: 117966 - protein, 274 aa, Glycine max
  Coding DNA Sequence Number=SeqID_1188
  Gene Ontology: Mol. function=DNA binding; Cellular component=nucleus; Biological process=regulation of transcription, DNA-dependent
  Homolog annotation: Hit_ID=Q9ATD3; Match level="QueryCoverage=71%, HitCoverage=62%, E-value=2e-49, Identity=51%"; Hit description =GHMYB36
  Pfam annotation: Domain name=Myb_DNA-bind_2; Domain location=15-70; Score=-8.4; E_value=0.084; Accession=PF08914.1; Description=Rap1 Myb domain
  Pfam annotation: Domain name=Myb_DNA-binding; Domain location=16-63; Score=52.1; E_value=1.9e-12; Accession=PF00249.21; Description=Myb -like DNA-binding domain
  Pfam annotation: Domain name=Myb_DNA-binding; Domain location=69-114; Score=50.0; E_value=7.8e-12; Accession=PF00249.21; Description=Myb -like DNA-binding domain
  Pfam module annotation: Pfam domain module=Myb_DNA-bind_2::Myb_DNA -binding::Myb_DNA-binding; Domain location=15-70::16-63::69-114
MKRKAMSCDNRDAVNRGAWSAEEDQILINYVQAHGEGNWRELSKRAGLKRRGKSCRLRWLNYLKPDIKRGNISSDEEDLIIRLHSLLGNRWSLIAGRLPGRTDNEIKNYWNTYLRKKVEQNHNYNSNLPGHDNIPIKLRIESPRRSKNSLGIVIDPTKSSHPMTIKSMRCTEVMMPTRSVNDFTTSWDINPSASTPQDGHDHCSEGFLKHFGISDVLMPYEDCRFNGYACVEIPQHFGEEGYKVNDAIGETQYGNWKTEDYFPLDYDVGFYFKS

SEQ ID NO: 117967 - protein, 747 aa, Glycine max
  Coding DNA Sequence Number=SeqID_1189
  Gene Ontology: Mol. function=oligopeptide transporter activity; Cellular component=integral to membrane; Biological process =oligopeptide transport
  Homolog annotation: Hit_ID=Q5VS43; Match level="QueryCoverage=99%, HitCoverage=97%, E-value=0.0, Identity=69%"; Hit description =Putative sexual differentiation process protein isp4
  Pfam annotation: Domain name=OPT; Domain location=52-711; Score =723.6; E_value=1.3e-214; Accession=PF03169.6; Description=OPT oligopeptide transporter protein
MANDPEINSPLIKRHVNNADANTSSSPDGGENSPIEQVALTVPVGDDPSLPSFTFRTWILGTLACALLSFLNQFFGYRREPLSVTAISAQIAVVPAGHLMAAAVTRRVFMRGTKWEFTLNPGKFNVKEHVLITIFASSGAASVYAIHFVSAVKVFYRKELTVLAALLVVITTQVLGFGWAGVFRRYLVEPATMWWPQNLVQVSLFRALHEQEKRPKGGLTRNQFFLIAFLCSFAYYVFPGYLIPMLTSISWICWVFPTSVIAHQLGSGLHGLGLGAIGFDWSSICSYLGSPLASPWFATANVAAGFAIFMYVIMPIAYWTNLYKARSFPIFSDDLFMSNGQKYNISAITDSKFHLDMEAYEREGPLYLSTMFAMSYGIGFACLSATLVHVLLFHGSEIWRLSKSAFQENKIDIHTKIMRKHYKQVPEWWFLCILLFNITATIFICEYFNNQLQLPWWGVVLACIVAISFTLPVGVIRATTNQAPALNIITEYIIGYIYPGYPVAIMLFKVYGNVSMKQAIFFLQDFKLGHYMKIPPREMFFAQVLGTLISAVVHLLTAWWLMNTVPNICERELLPAGSPWTCPGDHVFYDASVVWGLIGPRRIFGDLGHYSAINWFFLAGAIAPFLVWLAHKAFPNKQWIRLITVPVLLGALADMPPATAVNYTSWVLVGFLSGFVVYRYYRDWWSRHNYVLSGALDAGLAFMGVLLYLCLGMKQISLNWWGSDPDGCPLASCPTSPGVESKGCSVY

SEQ ID NO: 117968 - protein, 79 aa, Glycine max
  Coding DNA Sequence Number=SeqID_1190
MEEKSEVYKHYSTDGGDVTGVAGLPLLLKWRLVVARLLLMLACTEEQWLTILHYKHKIRNNYSKPFYVYQLGQSKSLGD

SEQ ID NO: 117969 - protein, 95 aa, Glycine max
  Coding DNA Sequence Number=SeqID_1191
  Homolog annotation: Hit_ID=Q9FKW7; Match level="QueryCoverage=92%, HitCoverage=23%, E-value=3e-16, Identity=72%"; Hit description =Similarity to nucleolar protein
MVNWVESSHQWFPTAKSWRVPRLQHLQSARSLTIAQNEDVVEQFLKENETAELTEIDAASDWPCKGGRIPKTWRFDPLTSQTSGLFVAKFTKVVI

SEQ ID NO: 117970 - protein, 307 aa, Glycine max
  Coding DNA Sequence Number=SeqID_1192
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=1e-35, Identity=32%"; Hit description= UPI00006A17C9 related cluster
  Subcellular localization annotation: CTP_CleavageSite=67; ConfidenceScore=5.48e-01
MSFSKDYTSSPSEGYMPSHLQRTSHPRHKRTTRPDHLRTTCPRHQRTTRRRLQKAAYPRLQRTTCPRLERVARPRLQRTTRPPFQRTTRPLLQRATHPHLQRTTPPHLRRLDALTFRGLNVLTFRGLHVVAFRKPHALAFRGLHVIFFRGLHVLGLRGLHALAFRGLHVLPFRGLHVPSFRGLHVLNFRGLHLLTSEGYMPSQSDDYTSSPSEVYTSSTSEDYTSSPSAVYTSSTSEDYTSSPSEGYMPSPSEGYTPSPSKDYASLPSEDCTPWPSEDYMSSPSKAYTSSPSEDYTSSPSEDYTSSP

SEQ ID NO: 117971 - protein, 76 aa, Glycine max
  Coding DNA Sequence Number=SeqID_1193
MTEGCGEGFCLANLPGDAFSLWGNFFEAKKQMMADAKVGGAGLWPRAKFRIGWPPPPPRDQFCCQDFANFGLRPVG

SEQ ID NO: 117972 - protein, 67 aa, Glycine max
  Coding DNA Sequence Number=SeqID_1194
MDGILISSVVLLADSRFTRPDMGFHPTKLNFVPSDADEAPLDVSICLHAFGIVGCGSFSGVKSCERE

SEQ ID NO: 117973 - protein, 99 aa, Glycine max
  Coding DNA Sequence Number=SeqID_1195
  Homolog annotation: Hit_ID=UPI000044A741; Match level="QueryCoverage =46%, HitCoverage=11%, E-value=3e-09, Identity=69%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRRERFAARDVVRSPLNLII

SEQ ID NO: 117974 - protein, 235 aa, Glycine max
  Coding DNA Sequence Number=SeqID_1196
LGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSRLDGSRDSAIHTKYRISLRSSSMQEPRYPLPRVIDEEAGRTGRRGHPLPPDGR

SEQ ID NO: 117975 - protein, 80 aa, Glycine max
  Coding DNA Sequence Number=SeqID_1197
MDKSSEQAAGTEPQSRRRRSNSAWEEEEEEEEEEEEATSSFVNPNFFGEEEATLHLHAKPISLRQAVFFVAVTELSDLVR

SEQ ID NO: 117976 - protein, 399 aa, Glycine max
  Coding DNA Sequence Number=SeqID_1198
  Gene Ontology: Mol. function=nucleic acid binding
MDYLIPTLREANTVQLPDLPKGVVFDFNHKFLQMLENNPIGGIVHEDHMQHLRKFIKLTNTVRQNCVPTKYFSPMKIDQYIRDIGNFVWREHENLPKAWERLQEMIRSCPHHGITQQRLVLIFYGRVSSHNRTSLDVACRGDMRIMKRGVNQVEKDDSRAELGKQIDKAQVPITTPLFPTYDKCGIVHKPGECTIDDKLATTMDEINFVGGENNSYNQRSSNLSSQPESNPKREDVNAMMNRSKRIQEDSKEKEGSFLKAVDDILIEQDQAPKKVEVSTDGNLMPKKVGGEKKEILTSPQISLPFPHKVLYPRRVIKDVLVKVHKFIFPSDFVIFGMEVDKDVPIILGQPFLSICDLLVDVRLGGLTFRIGVDALMKEVFLSVGMLYPLERVLTNEDLE

SEQ ID NO: 117977 - protein, 296 aa, Glycine max
  Coding DNA Sequence Number=SeqID_1199
  Gene Ontology: Mol. function=protein binding; Cellular component =protein complex; Biological process=chromosome segregation
  Homolog annotation: Hit_ID=Q1S6B8; Match level="QueryCoverage=89%, HitCoverage=65%, E-value=5e-68, Identity=56%"; Hit description=Von Willebrand factor, type A; Ubiquitin interacting motif
  Pfam annotation: Domain name=UIM; Domain location=168-185; Score =19.1; E_value=0.016; Accession=PF02809.10; Description=Ubiquitin interaction motif
  Pfam annotation: Domain name=UIM; Domain location=200-217; Score =18.8; E_value=0.019; Accession=PF02809.10; Description=Ubiquitin interaction motif
  Pfam annotation: Domain name=UIM; Domain location=98-115; Score=14.5; E_value=0.31; Accession=PF02809.10; Description=Ubiquitin interaction motif
  Pfam module annotation: Pfam domain module=UIM::UIM::UIM; Domain location=168-185::200-217::98-115
MLEMIGRKLKKNSVALDIVNFGEEDEGKTEKLEALLSAVNNNDTSHIVHVPSGPNALSDVLISTPIFTGDGEGGSGFAAAAAAAAAGGVSGFEFGVDPNLDPELALALRVSMEEERARQEAAAKKASEDASKQEKDGEQQASPQDTTMTEGASAAASEAETKRTDLTDDENALLQQALAMSMDDPTINHEVRDTDMSEAAAEDPELALALQLSVEDSSKDSASQSDVSKLLADQSFVSSILASLPGVDPNDPSVKDLLASMQNQSEYSFGRHIGSMLESDFTRVVISRVPIVEFPC

SEQ ID NO: 117978 - protein, 475 aa, Glycine max
  Coding DNA Sequence Number=SeqID_1200
  Homolog annotation: Hit_ID=Q1S3T3; Match level="QueryCoverage=97%, HitCoverage=98%, E-value=1e-168, Identity=67%"; Hit description =Senescence-associated
  Pfam annotation: Domain name=Senescence; Domain location=61-445; Score=763.2; E_value=1.6e-226; Accession=PF06911.3; Description =Senescence-associated protein
MASENPNQRNSLYPQVIESEPEACSSNHSSSLYPKIDEVGDLVENLFPDNTSPSAPPVAAEEVLIKVPGAILHLIDKDCSVELACGNLTIICLRQGQSLVAVYARVGDEIQWPLAKDEAAVKVDDSHYFFSLRVPKEESDSSSSDEEGEKAKHQNKKKKKNKKNKDSSASVLSYGLTIASKGQEDLLKELDKVLQECSAFSVQKVSEKAKKEGEALDASLELTISPADLETEEKKEMMEEKCAAYWTTLAPNVEDYSGTAAKLIAAGSGQLVKGILWCGDVTVERLRWGNEVMKRRMAPGSQGEISPETLKRIKRVKKVTKMTESVANGVLTGVVKVSGFFTSSMANSKAGKKIFSLLPGEVVLASLDGFSKVCDAVEVAGKSVMSTSNTVTTELVNHRYGEEAAKATSEGLDAAGHAVGTAWAAFKIRQVLNPKSVIKPTSLAKSAAKAAAAELKNKRSKPGGNIVYIRGGNID

SEQ ID NO: 117979 - protein, 1012 aa, Glycine max
  Coding DNA Sequence Number=SeqID_1201
  Gene Ontology: Mol. function=alpha-mannosidase activity; Cellular component=lysosome; Biological process=carbohydrate metabolic process
  Homolog annotation: Hit_ID=Q1S3T6; Match level="QueryCoverage=97%, HitCoverage=97%, E-value=0.0, Identity=83%"; Hit description =Glycosyl hydrolases family 38 C-terminal domain, putative
  Pfam annotation: Domain name=Alpha-mann_mid; Domain location=361-435; Score=103.3; E_value=7.4e-28; Accession=PF09261.1; Description=Alpha mannosidase, middle domain
  Pfam annotation: Domain name=Glyco_hydro_38; Domain location=42-357; Score=507.0; E_value=2.1e-149; Accession=PF01074.12; Description =Glycosyl hydrolases family 38
  Pfam annotation: Domain name=Glyco_hydro_38C; Domain location=493 -1009; Score=518.3; E_value=8.4e-153; Accession=PF07748.3; Description=Glycosyl hydrolases family 38 C-termi
  Pfam module annotation: Pfam domain module=Alpha-mann_mid::Glyco _hydro_38::Glyco_hydro_38C; Domain location=361-435::42-357::493-1009
MGNLAAESLCALLLLYFYGTLLVSAKYIKYNTGAGVVPGKLNVHLVPHSHDDVGWLKTVDQYYVGSNNSIQGACVENVLDSVVVSLQKDPNRKFVFVEMAFFHRWWVEQSPETQEQVKKLVDEGQLEFINGGWCMHDEAATHYIDMIDQTTLGHRFIKDRFNKTPTVGWQIDPFGHSAVQAYLLGAELGFDSIHFARIDYQDRAKRKADKSLEVVWRGSKTFGSSSQIFANTFPVHYSAPNGFNFEVNNPDVDVVPVQDDPLIFDYNVEQRVQDFIDAATTQANVTRTNHIMWTMGDDFQYQYAESWFKQMDKLIHYVNKDGRVNALYSTPSIYTNAKNAANQTWPLKTDDYFPYADSRNAYWTGYFTSRPALKRYVRMLSGYYLTARQLEFLVGKKSTKYNTYDLGDALGIAQHHDAVSGTAKQHTTNDYAKRLAIGASEAEAVVSSSLACLTRKQSGDKCSAPASAFAQCQLLNISYCPPAEDNIPEAKSLVVVVYNPLGWNRTDIVKIPVNDANLVVKDSSGNNLEVQYVDVDDVTTNLRKFYVKAYLGVSPKQAPKYWLLFQVSVPPLGWSTYFISKATRKGTRRKDLSHPNSQKGDTINVGSGNLKMSFSSTSGQLKRMYDSKTGVDIPIQQSYLWYGSSEGDSDPQASGAYIFRPNGSPPNIVSRSVPTKVIRGPLVDEVHQKFSSWIYQVTRLYKDKDHAEIEFTIGPIPTDDGVGKEVITRMTANMATNKEFYTDSNGRDFLKRVRDHREDWPLQVTQPVAGNYYPINLGIYTKDKKSEFSVLVDRATGGASIKDGEVELMLHRRILHDDSRGVGEPLDEQVCVNNNNTCEGLTVRGNYYISIHKLGAGSRWRRTTGQEIYSPFLVAFTHENSENWKSSHLTKGTIMDPNYSLPPNIALITLEELDGGIVLLRLAHLYEPSEDAEYSTLTKVELKKLFAMKTIKELKEVSLSSNQEKSEMKRMTWKVEGDKGQEPLAIRGGPVSYHNLVVELGPMEIRTFLLKF

SEQ ID NO: 117980 - protein, 201 aa, Glycine max
  Coding DNA Sequence Number=SeqID_1202
  Gene Ontology: Mol. function=nucleic acid binding; Biological process= DNA integration
  Homolog annotation: Hit_ID=Q1SDG1; Match level="QueryCoverage=71%, HitCoverage=12%, E-value=8e-18, Identity=33%"; Hit description =Integrase, catalytic region; Zinc finger, CCHC-type
MMKVGYAVKKPPMFKGVNYDYWKERMIAFFESNHIDISNVVEKGNHNPLNPQRNEIPRDRWTDEHKSRFLLNSQARNALLCALSHEEYSKVHSFRNAKQMRDTLVITYEGFSKRPQVTVLKTIKNLDSVTLEELIGILKVHEQELARDEGTKKGKLLALVAQRQKCSIASKESSSKAFAINDASTEEPNDDESDKEDDEMS

SEQ ID NO: 117981 - protein, 118 aa, Glycine max
  Coding DNA Sequence Number=SeqID_1203
MKNQRRSRTHERRRSSNNGQRRSRNTGRRSTNAKNKKHEGGEEEAGSRRGRRSEKRCNERVTRTDESLFFINKRKLIIFKNQLDILTFLAGLLGVLEKTMVAQSNPLRNWAMSPITTT

SEQ ID NO: 117982 - protein, 77 aa, Glycine max
  Coding DNA Sequence Number=SeqID_1204
  Subcellular localization annotation: CTP_CleavageSite=62; ConfidenceScore=5.22e-01
MPKLMGDKWITTSSMGEVQQSTNNPKKRRKQKWKKNINTTDHSTLTTTSTHNASSSHHGGPRLASQSQHCGAMTSVV

SEQ ID NO: 117983 - protein, 362 aa, Glycine max
  Coding DNA Sequence Number=SeqID_1205
  Gene Ontology: Mol. function=hydrolase activity, acting on ester bonds; Cellular component=nucleus; Biological process=lipid metabolic process
  Homolog annotation: Hit_ID=Q1S3U7; Match level="QueryCoverage=88%, HitCoverage=89%, E-value=7e-93, Identity=50%"; Hit description =Lipolytic enzyme, G-D-S-L
  Pfam annotation: Domain name=Lipase_GDSL; Domain location=41-353; Score=187.3; E_value=3.6e-53; Accession=PF00657.12; Description=GDSL- like LipaseAcylhydrolase
MKLSTFKLLYVCPLLVLFYSNPFVVIAISQTEIVKYSFSAIIAFGDSILDTGNNNYIETFLKANFKPYGKDFIGAKSTGRFCNGKIPSDLFAEKLGVKEALPPYLDSNLKIEDLLTGVSFASAGSGYDPITVKLTRALSVEDQLNMFKEYIGKLKAAVGEEKTTLTLTKSLFLVSMGSNDISVTYFLTSFRKNDYDIQEYTSMLVNMSSKFLQELYQLGARRIGIIGLSPIGCVPMQRTVRGGSERKCVESVNQASVIYNSKFSSSIMDLNTRFPDARLVYLENYSKLSGLIQQYNQSGFEVADDACCGIGNLEFGFICNFLSLKVCNDASKYVFWDGYHPTERTYNILVSEAITKHIDKFV

SEQ ID NO: 117984 - protein, 500 aa, Glycine max
  Coding DNA Sequence Number=SeqID_1206
  Gene Ontology: Mol. function=binding; Cellular component=membrane; Biological process=photosynthesis
  Homolog annotation: Hit_ID=Q1S3U4; Match level="QueryCoverage=99%, HitCoverage=100%, E-value=0.0, Identity=73%"; Hit description =Tetratricopeptide repeat, putative
  Pfam annotation: Domain name=TPR_1; Domain location=177-210; Score =40.0; E_value=8.1e-09; Accession=PF00515.18; Description =Tetratricopeptide repeat
  Pfam annotation: Domain name=TPR_2; Domain location=177-210; Score =38.0; E_value=3.2e-08; Accession=PF07719.7; Description =Tetratricopeptide repeat
  Pfam annotation: Domain name=TPR_2; Domain location=81-114; Score =4.1; E_value=11; Accession=PF07719.7; Description=Tetratricopeptide repeat
  Pfam module annotation: Pfam domain module=TPR_1::TPR_2::TPR_2; Domain location=177-210::177-210::81-114
  Subcellular localization annotation: CTP_CleavageSite=52; ConfidenceScore=5.17e-01
MLQEMWNAPPGLRPSKSAPCSPAKPLGVVPRTRSESFHVAHKVPVGDTPYVRAKNVQLVDKDPERAIPLFWAAINAGDRVDSALKDMAIVMKQQNRAEEAIEAIKSLRSRCSDQAQESLDNILLDLYKRCGRLDDQIGLLKHKLYLIQQGLAFNGKRTKTARSQGKKFQVSVEQEATRLLGNLGWALMQQNNYIEAEDAYRRALSIAPDNNKMCNLGICLMKQGRIGEAKETLYRVKPAVMDGPRGSDSHLKAYERAQQMLKDLESEMMNKGVDRIEQSRLFEAFLGSSSIWQPQPCKDHHHTTTLLATTTINSAKIHDEFADENINSNIMLTNHTALPPSKGSNNNNSNKQVGAILGNSLNVAAPPFYASKSSMLREPIENQLFSETLKRTRSGNAAGSMRVVSDVRDANINNKKLHVELGVPVPQNKSRRLSSEDAAEKNKLTDLLPNDDEFEEAILAAILGAPNESDKAYYDTGSTTSRMLRLKVFQDITLSLSPRA

SEQ ID NO: 117985 - protein, 39 aa, Glycine max
  Coding DNA Sequence Number=SeqID_1207
MGRIMFPITIYAMAHRLDLASCVAQMRNETIVKFVFLSP

SEQ ID NO: 117986 - protein, 111 aa, Glycine max
  Coding DNA Sequence Number=SeqID_1208
MEITSFSGGVSLGNVADHGSKESDPMLGSNNSVCSWHIIQQWAWNGWGGGKIRQRRVGSAIAIAKEDEEEGATEHGEEVAGGDKEDVRDDEVEGVFGEGKTHAIKEICTQK

SEQ ID NO: 117987 - protein, 113 aa, Glycine max
  Coding DNA Sequence Number=SeqID_1209
  Gene Ontology: Mol. function=oxidoreductase activity, acting on the CH-OH group of donors, NAD or NADP as acceptor; Cellular component =chloroplast; Biological process=L-serine biosynthetic process
  Homolog annotation: Hit_ID=Q1SGN7; Match level="QueryCoverage=95%, HitCoverage=17%, E-value=4e-42, Identity=80%"; Hit description=D -isomer specific 2-hydroxyacid dehydrogenase, catalytic region
  Pfam annotation: Domain name=2-Hacid_dh_C; Domain location=1-112; Score=17.4; E_value=1.6e-10; Accession=PF02826.9; Description=D -isomer specific 2-hydroxyacid dehyd
MVGKTLAVMGFGKVRSKVARRAKGLVMHMIAHDLYAPSDSACAFGVDLVSFDQAIATADFISLYMPLTPTTNKIFNENTFAKMNKGVCIINVAREGVIDEDALVRALDSKPLL

SEQ ID NO: 117988 - protein, 43 aa, Glycine max
  Coding DNA Sequence Number=SeqID_1210
MRYANFENKGSGVVYAWGSSPRGASSFTPKQLHSEVESGTTSF

SEQ ID NO: 117989 - protein, 203 aa, Glycine max
  Coding DNA Sequence Number=SeqID_1211
  Gene Ontology: Mol. function=beta-galactosidase activity; Cellular component=beta-galactosidase complex; Biological process =carbohydrate metabolic process
  Homolog annotation: Hit_ID=Q8RWC1; Match level="QueryCoverage=51%, HitCoverage=24%, E-value=3e-13, Identity=67%"; Hit description =Galactosidase, putative
MQCYSFFRGFPVWLKYIPSISFRIDNGPFKFQMEKFTKKIVDMMKAERFTEFGGVVPHTPAEDLAFSIASIMGKQILVELLVVPLLLQAMIMMRLLMNMLRTINSNLEKENTENEEDKKEKSFENTEKVEVVAAIIQNTPEVEVGERTHVESMKDSTFNIENLQYLFNSSIFDTSVKIAYGLGPIHGEPSTFSIPFPRLTHLL

SEQ ID NO: 117990 - protein, 1155 aa, Glycine max
  Coding DNA Sequence Number=SeqID_1212
  Gene Ontology: Mol. function=RNA-directed DNA polymerase activity; Cellular component=chromatin; Biological process=chromatin assembly or disassembly
  Homolog annotation: Hit_ID=Q2LMF3; Match level="QueryCoverage=21%, HitCoverage=64%, E-value=4e-84, Identity=61%"; Hit description=MYB2
  Pfam annotation: Domain name=Chromo; Domain location=825-877; Score =17.5; E_value=0.0085; Accession=PF00385.14; Description='chromo' (CHRromatin Organisation MOdifier
  Pfam annotation: Domain name=Myb_DNA-binding; Domain location=881 -926; Score=47.9; E_value=3.5e-11; Accession=PF00249.21; Description =Myb-like DNA-binding domain
  Pfam annotation: Domain name=RVP_2; Domain location=195-318; Score= -57.3; E_value=0.029; Accession=PF08284.2; Description=Retroviral aspartyl protease
  Pfam module annotation: Pfam domain module=Chromo::Myb_DNA -binding::RVP_2; Domain location=825-877::881-926::195-318
MREYMPRFSPSVKSTPMLTSYEFFAMDDNHLPKCVNLPSFTGEDPVGWLTKAEMYFMDSLKYALLDHYDDHQLGPSSNRRAIHGFYPIGLPEDIRMEVLTFELPPIACPLTMTSGPSSPTQSMDSSNGLVDREPKSVSTHAGPSSSWSGTCNLSYPKLMDNQSDDPTPLSDSVPSSDDTPKIEVQDMACQVLDYHALAPGELAQSKTIRLEGELAAYPILLLIDSGANHNFIVRELVSSLNLEVTMTKELCVGLGNGSRCSSQGVCQTFWVRLGHCIIVINAYVLDLGGVDIVLGVEWLRPPFTRITRPLALCSSRGGHTPSLGLPGLPQQAHDHAIFLLPGSKPASVIVLDKYPIPAIKKLIDELHGHYEGTPIGLAICRTLLKCYITWLSINSWPTEKSGFHLPSIDYLGHIISGQGIGMDPFKVKAVRDWPTPHNAKDARVNAFECLKQCLASFPILALLDFTKDFFIECDASGHRIGVVLMQDYQPIAYFSKALSPCTMSKSIYEKEIMALGLSVQHWQHYLLGGSFKVYIDHRSLRHLLQQRLTTTSQQCWLSKLMAYQFKEVQSDPNLVRLSESLQSNPAVAPHYVLCDGLLFFKGHLVLPKSLALIPTLLAEFHDTVTSGHLGFMKTYKRLLQPIPISEVVWDDISMDFITGLPCSQGYEVILLVLDRLSEYVHFISLKHSYTTKTVAEAFIKDVAKLHNFLKHHFEDEYHLPYQDRWPNRGGQLIFGDIPLLLCLGATNQVAYVAVLGGVLVDSVATVLFDCDEALRQLKFHLNRAQQTKKYADAHCCHVTFVVGDWVGTAVTSLPPGLAIDEPASPSPEAILATCVGKHQGGPVEEWLIPWKSQPVEEALWEDKANFIGGGIDRNSKWDRPFKRYSHEEDRMIVAAHAIHGNKWAAIARLLPGRTDNAIKNHWNSTLRRRGVGHDTIKLESVSFMEDVSLEKAKASSEDTLSCGDVSLKSSEGRDVSSMEIMDDKSDDKAQTEGQIHHEVKDLPTLFRPVARVSAFNVYHSFDGTQPSTSIKRPVPMQGAVLQSSKPDMEFCRMLEGICGDQSVPHQCGHGCCAAPDGRKSESSLLGPEFVEFSEPPSFPNFELAAIATDISNLAWLKSGLESSSAKMMGNTSGRDWIMGMIKAIVMATYFPCKSN

SEQ ID NO: 117991 - protein, 108 aa, Glycine max
  Coding DNA Sequence Number=SeqID_1213
MKPNEKFQFTFMIKEGSAGHLFKFLRKKTSDLIWENLTVAMAQKFPGRRLCSLYERLPTLQKMGLLMKINTRFWNPGDTDKTQWEGCKVWTSSHLSSPISNLWASRQC

SEQ ID NO: 117992 - protein, 70 aa, Glycine max
  Coding DNA Sequence Number=SeqID_1214
MMHQLLQDLSPYPWYTPEQFRATVAWPSDKPIFQEEAGPAYAQGAAQGDGGRTEDDEDMADLVDYFIAGD

SEQ ID NO: 117993 - protein, 61 aa, Glycine max
  Coding DNA Sequence Number=SeqID_1215
MSNEELKLQDPRCRIQCPDILPENTGVAVQCKIKVKCRNFSEEDRSPPASSRCSPETQIAI

SEQ ID NO: 117994 - protein, 378 aa, Glycine max
  Coding DNA Sequence Number=SeqID_1216
  Gene Ontology: Mol. function=hydrolase activity, acting on ester bonds; Cellular component=cellulose and pectin-containing cell wall; Biological process=lipid metabolic process
  Homolog annotation: Hit_ID=Q1S3U7; Match level="QueryCoverage=96%, HitCoverage=98%, E-value=1e-148, Identity=70%"; Hit description =Lipolytic enzyme, G-D-S-L
  Pfam annotation: Domain name=Lipase_GDSL; Domain location=43-369; Score=157.5; E_value=3.4e-44; Accession=PF00657.12; Description=GDSL- like LipaseAcylhydrolase
MDLLCQKLLSQWLLVILWCSIIATIFQHVSVVSLPNNETVPAVIVFGDSIVDTGNNDYITTLVKCNFQPYGRDFGGGNQPTGRFSNGLVPSDIIGRKLHTNLSALKTSAKFGVKKFLPPYLDPNLQLQDLLTGVSFASGGAGFDPLTAELVNVMSLSDQLDMFREYTRKINEAVGRNRTAMIVSKSIYIVCVGSDDIANTYSQLPFRSAEYDIPSYTDLMASEASNFLQKLYGLGARRIGVFGLPVIGCVPSQRTLGGSLNRACLDSSNQAAMLFNSKLSTQMVVLGKKFSDSRLVYLDSYNGLLNMLQNPAKYGFEVTDRGCCGTGNIEVSLLCNRYSIDTCSNSSNYIFWDSYHPTQKAYNVLSSLVLDNKIKDFF

SEQ ID NO: 117995 - protein, 530 aa, Glycine max
  Coding DNA Sequence Number=SeqID_1217
  Gene Ontology: Mol. function=3-methyl-2-oxobutanoate hydroxymethyltran sferase activity; Biological process=pantothenate biosynthetic process
  Homolog annotation: Hit_ID=Q3U2U7; Match level="QueryCoverage=41%, HitCoverage=52%, E-value=3e-15, Identity=29%"; Hit description=NOD -derived CD11c +ve dendritic cells cDNA, RIKEN full-length enriched library, clone:...
  Homolog annotation: Hit description=F630201I04 product:similar to False p73 target protein
  Pfam annotation: Domain name=Methyltransf_12; Domain location=187 -290; Score=8.9; E_value=0.068; Accession=PF08242.2; Description =Methyltransferase domain
  Pfam annotation: Domain name=Rsm22; Domain location=107-529; Score =9.4; E_value=3.5e-13; Accession=PF09243.1; Description=Mitochondrial small ribosomal subunit
  Pfam module annotation: Pfam domain module=Methyltransf_12::Rsm22; Domain location=187-290::107-529
MAAQTIAETAQKILTPETLRYAAKQSARCLVVPVRLRRAIKKYLREQEEPYMKRKVLRLSQTFNQIKDVNLQLASTTAKKIVEDPFEQSKRWKITSSYGDIGLIYRDEETNAYVASRMPAVYSACYRVLKELTQMKGLVIYALCYEIESWSQMRADLHMEARTVAKDFRSKLNQTGRLPGFSPSKVLDFGAGTGSAFWALQEVWPKSLEKVNLIEPSQSMQRAGRSLMQGLKNLPLIHSYDSIQSLSKSITKSEREHDLVIASYVLGEIPSIKDRITIVRQLWDLTRDILKYRKSSRKNNEVCKDLITEKAGAFVVAPCPHDGACPLVKSGKYCHFVQRLERTSSQRAYKMKNFPMLFLDEDQGQGNDPWPLDGMEFETLKEQHAKRNPEDLEIDYEDWLKLQQSDDTPHEVADAETDIADDLETDDAPREVVNAVTYDSDDAVETDGPIDSEEDEEREEERGSADLGGGWGRIVFMPVRRGRQVTMNVCRSTKRDASEGSYDRIVVTRTKNPTLHQQAKRSIWGDLWPC

SEQ ID NO: 117996 - protein, 78 aa, Glycine max
  Coding DNA Sequence Number=SeqID_1218
MEHISVHVTQLISDAIHQFVGIEPLRHPVDTEKSNKALGFPALITGLCQFYGVSVTPTKHIRPLINKSFIEKYYMPRQ

SEQ ID NO: 117997 - protein, 128 aa, Glycine max
  Coding DNA Sequence Number=SeqID_1219
MAPKKLTSKRSRKTTVGERSSTTLPVEFEFDGHHFFCEEHQRRFNVIKDWSFLKEKRLQLAEGEYIEFHIEIARRHWTQLHSPCLNMALKLSWNFMQMLGLLKKVLWISAPKCGANGFLMTQMPSTKF

SEQ ID NO: 117998 - protein, 301 aa, Glycine max
  Coding DNA Sequence Number=SeqID_1220
  Gene Ontology: Mol. function=sulfotransferase activity; Cellular component=integral to membrane; Biological process=thyroid hormone metabolic process
  Homolog annotation: Hit_ID=Q1S1F5; Match level="QueryCoverage=99%, HitCoverage=86%, E-value=1e-99, Identity=59%"; Hit description =Sulfotransferase
  Pfam annotation: Domain name=Sulfotransfer_1; Domain location=62-301; Score=224.6; E_value=2.2e-64; Accession=PF00685.17; Description =Sulfotransferase domain
MDHEQEASEENKLSQDCKELILSLPREKGWITPYLYLFQGFWYSSTEIQAINTFQNQFQAKDNDVVIASVPKSGTTWLKALTFAILHRQYFPSLENHPLLIFNPHELVPPFEFVIYDEINGQTHDLSKMPEPRIFGTHVPFTSLAKSIKETDCKIIYICRNLFDTFVSTWVFVNKIMPKFLPTLPLEEAFERYCEGIIGFGPSWNHILDYWKESIARPKKVLFLKYEDLKENVHFNVKKIAEFLGCPFTKEEENSEVIENIIKLCSFEKMKELKVNKSGTMGKGRIVENKYFFRKAEIGDW

SEQ ID NO: 117999 - protein, 77 aa, Glycine max
  Coding DNA Sequence Number=SeqID_1221
MSHPIRALCPDVLQHKGKNIISPSQSISINTQALCNIYTKTQSYMQCGTMSVKNLVGCLGVHDKTNHTLASQVTLTR

SEQ ID NO: 118000 - protein, 128 aa, Glycine max
  Coding DNA Sequence Number=SeqID_1222
  Subcellular localization annotation: CTP_CleavageSite=25; ConfidenceScore=5.33e-01
MYPLLFSVTTTQVDVPSTCTTKDVPSNVLRQSFQAVSPLKLCQGETKDISGEQRLETRKLRKLLAKEEEEEVQEDVQSDSKVVKEYMKKLLKCKSRSGQNLSLVIDYQNHVIDYTKHFMKRCDSSQLN

SEQ ID NO: 118001 - protein, 49 aa, Glycine max
  Coding DNA Sequence Number=SeqID_1223
MCLSGKESMLITVNEILDVSISFLKDHLEETLGPTKIGENHSKCINLTQ

SEQ ID NO: 118002 - protein, 154 aa, Glycine max
  Coding DNA Sequence Number=SeqID_1224
  Gene Ontology: Mol. function=transposase activity; Cellular component= membrane; Biological process=transposition, DNA-mediated
  Homolog annotation: Hit_ID=Q654Z3; Match level="QueryCoverage=86%, HitCoverage=24%, E-value=6e-32, Identity=50%"; Hit description =Receptor protein kinase-like
MASSSWEYFGEIANVAQLTGIDAVKLIGMIVKAANTARMHKKNCRQFAQHLKLIGNLLDQLKISELKKYPETREPLEQLEDALRRSYILVNSCQDRSYLYLLAMGWNIVYQFRKAQSEIDRYLHLVPLISLVDNNRLRVYAIPSLYLIVLLNTH

SEQ ID NO: 118003 - protein, 138 aa, Glycine max
  Coding DNA Sequence Number=SeqID_1225
  Gene Ontology: Mol. function=transposase activity; Biological process= transposition, DNA-mediated
MERLEVIEKDRCEYTLEDEEQKVQSVILKPEPEKADAVVLKKTLSCSYPNFSFTEALKKENEKLQVELQHSQANMDLHQYEFIQHLLDVTEVAALYDSKKNHKTVEYSDYSYSDANGDKAHSSNEKIHKKNDTHSASG

SEQ ID NO: 118004 - protein, 480 aa, Glycine max
  Coding DNA Sequence Number=SeqID_1226
  Homolog annotation: Hit_ID=Q140S0; Match level="QueryCoverage=31%, HitCoverage=45%, E-value=5e-27, Identity=46%"; Hit description =Putative tight adherence TadC related transmembrane protein
MPADRRSADGRRRRGRARHTMRLAAACVRSAPGRHCGCPAAPVRARPGWARAGTSVWSMHSRWRRQRRPGQQSGRKCAGQASGGPHLGHGSGQRDQRRPGEHQHQRWQQGQHHHHGHLHRELADLFLQRVATLLAQAEAELPQGLLHRTAMGMHLQDQLHQAGQVIVGIDLAQPPQGLRARAAMGIGDIGLLKFAAEYRQCIAKLVAERLQALVHAEAYALQQTQQVDQQRQLGFDCTPAPLHPGRENEFGQQQSSGQGTDDHHDPGQPGDAAECQHQCQHQHGQQQAQAEVDGRTATGVPPGQIQQQPIFIGQQCRFQAAAAEGTAEAFEPAQRIVPCRFGVTGRIARLQGGLQRGRCTLLTMAAYPAADTQQGDAGSQHEQGEGEPGAGAHRSSPAGRGFIAIWPGDTAGSRRQAPCPVQAAGSCGQADRAAPAGRSPGWRSPSAPRRPVAAGPAPTQTCVSRRSSPKAPAAPVPGRA

SEQ ID NO: 118005 - protein, 203 aa, Glycine max
  Coding DNA Sequence Number=SeqID_1227
  Gene Ontology: Cellular component=membrane; Biological process =protein secretion
  Homolog annotation: Hit_ID=UPI00005587D6; Match level="QueryCoverage =39%, HitCoverage=26%, E-value=8e-15, Identity=50%"; Hit description =COG4965: Flp pilus assembly protein TadB
  Subcellular localization annotation: CTP_CleavageSite=40; ConfidenceScore=5.06e-01
FNAARRAAAFARKRHGRGTRRAVRHRCQRSGAARQHRAPRAAAGWPAAARRAADRLENPHHAAGTGAGTVGGSDGAAGHRVDVSADPAAVPAWLLAVGDAADHEAACATAASAAGLPRQPGAADCTGQQPAGRVPGCVDADQRAVARAVGHHGALCAQRHGVGPCTRAGRATLSHGGAEGVVGGDRCQRAHRRALRPDPAAHG

SEQ ID NO: 118006 - protein, 129 aa, Glycine max
  Coding DNA Sequence Number=SeqID_1228
MATERGKLSFAFALPTCATTNDRGRFMAGATLDAVEKIVEEQDLDVLFSDRSNIMDVAENLSMAKKNEIQHLKHMVQLGEEHNQMLRTRLQLLKEGNQVLSGASQAVEKQFKSMNLNYGANSGDEIHDV

SEQ ID NO: 118007 - protein, 766 aa, Glycine max
  Coding DNA Sequence Number=SeqID_1229
  Gene Ontology: Mol. function=RNA binding; Cellular component=nucleus; Biological process=regulation of transcription, DNA-dependent
  Homolog annotation: Hit_ID=Q6CBN0; Match level="QueryCoverage=70%, HitCoverage=75%, E-value=5e-48, Identity=28%"; Hit description =Similar to tr|Q06344 Saccharomyces cerevisiae YDR365c
  Pfam annotation: Domain name=NUC153; Domain location=627-655; Score =18.8; E_value=0.0028; Accession=PF08159.2; Description=NUC153 domain
MGSKNANGKNHKDKRNKFKDNLSSSYSSPSDAKVILISDPRYSKAHTDPRFREAPKRETKVAVDSRFNRMFTHKSFLPSSAPVDKRGKPKNNPTSQLGSLRHYYKIDEKEVEQSSDEEEENEEELLKANQVKPESDKGTESEETSESESEETSESESDVDTDTETDEGADEEVYEDEASDVKEDIATIDKETHRVAVVNMDWRYVKAVDLYVLLSSFVPPNGLIKSVRVYPSEFGLQRMKEEEVRGPIGLFDDEDSSNDDLDNEKLRAYEKSRMRFPKPMMIAPLPESTFSASGVLDDVGCVSRSEDLRSTYCYSLLYYFAVVECDSSATANYIYKECDGLELKQSSNALDLRFIPDNMEFKHPPRDVATEVPANYECKDFYSRALQHSEVNLTWDDDEPLRAKTLNRKLTDEQLAEFEVKEFLTSDESESDDSKDNNETDDQPDKMAKKRAKYRALLQSGDDSDGGNEHDNAQNMEVTFNTGLEDLSKYIMEKKDKKSETVWDAYLSKKSEKKKAGKNKRKYSSDDDDSDDTDQEATEEADDFFIEEPAAKKRKKPQNKEDEEPRPEEIDGLYKASKEELELLLADDKGTDTGVKGYNLKFKKGPGKKRRENDIDEEKIPSNAYNDPRFSALFSPNYAIDPTDPQFKRSATYARQLAQKQQKDNADPPVEREPTKLKGTQLSSEDSGRMKDEEEGLDALKSKKDKYELSSLVKSIKMKSKQVQLPSDNKTRKDGKSYIKGGELASFMCYRTQQGKKKQSSIIKEV

SEQ ID NO: 118008 - protein, 230 aa, Glycine max
  Coding DNA Sequence Number=SeqID_1230
  Homolog annotation: Hit_ID=Q9FKX3; Match level="QueryCoverage=65%, HitCoverage=75%, E-value=6e-44, Identity=59%"; Hit description =Arabidopsis thaliana genomic DNA, chromosome 5, TAC clone:K2A18
  Pfam annotation: Domain name=Usp; Domain location=109-229; Score =10.9; E_value=0.077; Accession=PF00582.16; Description=Universal stress protein family
MYLTSMLSISSHLITKLQCCCCCCRLLFLDVTPIFTEPHRFHFKAFVHYLLSVPNKPIALVDDFLTLFKPLSHSPPQNSLFSRLRRIAHKAKAKPQELAVTVASDAFTQFKHLLLPITDRNPYLSESTRQAIATTSALAKKYGADITVVVIDEQQKESLPEHETQLPSIRWHLSEERLGDGNKPAAIIGDVADDLNLDLVVISMEAIHTKHIDANLLAEFIPCPVMLLPL

SEQ ID NO: 118009 - protein, 101 aa, Glycine max
  Coding DNA Sequence Number=SeqID_1231
  Gene Ontology: Mol. function=pepsin A activity; Cellular component =anchored to membrane; Biological process=proteolysis
  Homolog annotation: Hit_ID=Q8VYV9; Match level="QueryCoverage=74%, HitCoverage=14%, E-value=5e-15, Identity=51%"; Hit description =Putative chloroplast nucleoid DNA-binding protein
MACNHGHGCVMLVYLVVLSLSASQSCYGLGTFGFDIHHRFSDPVKGMLGIDDVPQKGTPQYYAVMAHRDRIFRGRKLAGADHHAPLTFTAGNVTYRIASSG

SEQ ID NO: 118010 - protein, 117 aa, Glycine max
  Coding DNA Sequence Number=SeqID_1232
  Gene Ontology: Mol. function=pepsin A activity; Cellular component =anchored to membrane; Biological process=proteolysis
  Homolog annotation: Hit_ID=UPI000034F181; Match level="QueryCoverage =79%, HitCoverage=18%, E-value=3e-12, Identity=41%"; Hit description =aspartic-type endopeptidase/ pepsin A
MVRQVIRNRKVQSEGADAEGGVAVGEGEAGVDLGELAAAEEAVAVGELGVVLDGALLRRGGDSGGGGVGPLPDGLGVAVVHRKSVDVAVALTTLPEGEERHNDENGSEHFSWFFRSL

SEQ ID NO: 118011 - protein, 261 aa, Glycine max
  Coding DNA Sequence Number=SeqID_1233
  Gene Ontology: Mol. function=protein kinase activity; Biological process=protein amino acid phosphorylation
  Homolog annotation: Hit_ID=Q1SN45; Match level="QueryCoverage=97%, HitCoverage=16%, E-value=2e-56, Identity=42%"; Hit description=AAA ATPase
MADDITFNHRKQGIHLTEKETIHLCLTEIENMLQANRRSLRDFPSMPYPIGYAPNQHHNKLIHNEMAYDKEMLAAEFNTAYHLLTDEQKTIVDIIMRVVNTQSAAVYFLYGYGGTGKTFVWTTLSSAICSNGGIPGGQITHSKFAIPVPATQNSTCNIHQGSELAELLKVTKLIVWDEAPMCHKFAFKELDKSLKDIMQNNVPFGGKIIVFGGDFRQILPIVPNGNHSDIVHATINASYIWDHCQILKLTKNMRLLSTAPQ

SEQ ID NO: 118012 - protein, 369 aa, Glycine max
  Coding DNA Sequence Number=SeqID_1234
  Gene Ontology: Mol. function=nucleoside-triphosphatase activity; Cellular component=membrane; Biological process=peptide transport
  Homolog annotation: Hit_ID=Q7W2J4; Match level="QueryCoverage=60%, HitCoverage=75%, E-value=8e-98, Identity=72%"; Hit description =Putative transport system ATP-binding protein
RAAPERRGPARRLAGALAAVARPGDRHDLPGPDDDVEPGAARRYADDRGGAGAPQDADDGRHSVAAGTPARLSAPVVRRHAATRGDRDRAAEFAARHHRGRTHHGAGRDHPGADPVRSAEAVPRNRHRPGVDHARPGGGGRPGRSRVGDVRRPRGRDRQHARRHQTSNASVHARPDCVDSHTAIARPAVGADSGHDAVAAQPAAGSGGGAAGAMGALLACRRAGGPMSAADRNAAPILSLRGGARRGRRGPGRAAGRGHRHRRRIRLRKIDAGSHRLGHPAALFRTLYASLNPRMRGAQDRRAEAPGWRTGLIPRARTRPEYVAWALMRQVGLGTPAFRAALIHHQVLGAAQCQAASGIASAAGAENPR

SEQ ID NO: 118013 - protein, 267 aa, Glycine max
  Coding DNA Sequence Number=SeqID_1235
  Gene Ontology: Mol. function=DNA binding
  Homolog annotation: Hit_ID=Q1RUD8; Match level="QueryCoverage=52%, HitCoverage=26%, E-value=3e-16, Identity=38%"; Hit description=IMP dehydrogenase/GMP reductase
MRGAPTEEILSPFLVRDLGAQGLKVIQGIHKAWRSPLKKDKEIRGIRNGVIRGYDGWLRIHTRGLDWLSKLKVIDEENFEAPEEDEEVRALKLELGKARLAKEKFKSAATHIRKQCTELHEENADILALLIFGVVLFPNVDGLVDLAAIDAFLAYHHSKESPVVAILADLFDTFDRRCEKNSARIVCCLPALCVWLISHLFRQDTRHPCPLQSYRSCAEKGRVDWDQHLARIGGSAINWFPRWKEGKEGVLFSCGDYPNVPLIGTRG

SEQ ID NO: 118014 - protein, 151 aa, Glycine max
  Coding DNA Sequence Number=SeqID_1236
  Subcellular localization annotation: CTP_CleavageSite=51; ConfidenceScore=5.06e-01
MEFKYRAAQDRRTSSPLPYPLSTGTYVSDRPLRGGYPGNVPAPRVFRTPVPVNAGEAFRRELEKKQIRREILAREMTRRRELEEEVRREIAIERVLGIPFRERAWVSLNQDQGMNNPVNNNIFGGSQPSLSPQIDISRQQTNKDKVIILFS

SEQ ID NO: 118015 - protein, 108 aa, Glycine max
  Coding DNA Sequence Number=SeqID_1237
MVGYTPSSFADLVFAGEMIEVGLKRGKYDHLALINAKKTGANEEGEDEGEARAVTAIPIQPSFPPTQQCHYSANNKPSPYPPPSYPQRPSLKSTTKPTYRTSNDKHHL

SEQ ID NO: 118016 - protein, 70 aa, Glycine max
  Coding DNA Sequence Number=SeqID_1238
MAPKTWSIPTSAPDHVCKLTIKKENHSSLILIKHRPQIPLVGLNSTRTALRQTYKQQGYHTPIPRDNTIN

SEQ ID NO: 118017 - protein, 395 aa, Glycine max
  Coding DNA Sequence Number=SeqID_1239
  Gene Ontology: Cellular component=membrane
  Homolog annotation: Hit_ID=Q10S28; Match level="QueryCoverage=98%, HitCoverage=48%, E-value=1e-147, Identity=68%"; Hit description =Expressed protein
MELSSPLAVISAVKSAGRIINAEAMDNAQLWLAWVQSSSWLASLIFQFLPNMIIFVSMYIVIPSALSYLSKFERHLTVSGEQRAALMKMVCFFLVNLILLRGLVESSLESMILKMGRCYLDGEDCKRIEQYMSASILSKSCLSSLAFLITSTFLGISYDLLAPIPWIKRNIQKFRKNDMLQLVPEQSEEYPLENQGIDNQNSLQRPLMHDNAYDIANGDNVEGQDLFVYPITGSSPAPKQTFDFAQYYAFNLTIFALTLVYCSFNPLVVPVGAVYFGYRYVVDKYNFLFVYRVRGFPAGNDGRLIDTVICIMRFCVDLFLLAMLLFFSVQGDSTKLQAIFTLGLLVMYKLLPSSNDSFQSTLLEDIQTVDNVVDTRPIDYEVFSQPRFDWDTPQR

SEQ ID NO: 118018 - protein, 217 aa, Glycine max
  Coding DNA Sequence Number=SeqID_1240
  Gene Ontology: Cellular component=membrane
  Homolog annotation: Hit_ID=Q10S28; Match level="QueryCoverage=85%, HitCoverage=23%, E-value=4e-51, Identity=55%"; Hit description =Expressed protein
MQHYPISTYDFGQTLNHNSEYGSGIHGGIAQITVPVSEPRDPKTLFSGGDSEVDENRDEDGEEEMNPEQGGAFGDVSDGGFGEAVSEGGGASGEVEGEEDGEGEGGEGEEEGEAASLDEEELRRVRAAVAGDFAAGGVPDGEELRGEGGGARHAAVVAAQLHEEEDQKAARGADRGDVQQIVDVAIPGAEGVAVVSAGRRRRRREGVDHMKLGFSEV

SEQ ID NO: 118019 - protein, 754 aa, Glycine max
  Coding DNA Sequence Number=SeqID_1241
  Gene Ontology: Mol. function=nucleic acid binding
  Homolog annotation: Hit_ID=Q1S7Q2; Match level="QueryCoverage=89%, HitCoverage=69%, E-value=0.0, Identity=56%"; Hit description =Tropomyosin; Zinc finger, CCCH-type
  Pfam annotation: Domain name=zf-CCCH; Domain location=188-213; Score =26.3; E_value=0.00011; Accession=PF00642.15; Description=Zinc finger C-x8-C-x5-C-x3-H type (and similar)
MEFEGQDKILGPVSSVAENPEVMPPSSMHCLEENDAMLKKSEIPTLEKDELPLKYEFSSHPKSRENLTSVEDYRSQVFDVEVENAGSLLQNETFGGYSEPGCNSKANLCGDNNIDSRARATKSSSDTVQDMVIGPLPRDCLVEDSNGGQNSRIKIMQSEIESRDNVKQMTSRTRSLSPGAEIKDGNKRPRIICDFFAKGWCIRGSSCSFLHIKDTGANIDQEAEADLVTTHQKRQLKVEEGVRENVERSRMNQQEATPSWHPSQEKQKFPLRDNLVPENRFPFSASDNYFSSNLSLTSTRADGMATLRNQHMYKRYTSTLLSHSPNSSLVSQFPASSMPLSQQILAQSGRSLSFSNVDSKKFLNTDKEYLTSKSTFSGSGSGSGREDFSLVNLSRVPSYPAGYKSKICSYDWEPSVPFRPSFFITSMNVSSPGDLYDPLRDSIEIPNIGDGSLKASLLIHGSNIQASSQVRTYGDSAVVGKHMANLNDDKSSVSSHNKFCENEPNKNCLPREKDCLPPETEITSGTYVHYQGKMGMGQHTFEVADNKKKERDLTECDARCHGEGSGRKKKRVDRDKKNHEMDVDFQMDGSMQKESKALKFFRAVLIDHVKELLKPAWHEGRLSKDTHIMIVKKSVDKVVNTLEPHQIPTIDTAKQYVSSSQVKIAKLVNGLIVVGAKRLKSRIVDAPPAAIADVSMSEEEEAMVTELRRVRQRFVKENKEESLDAVVRGTSGHTLLLGRREFSREKQGREMSYT

SEQ ID NO: 118020 - protein, 362 aa, Glycine max
  Coding DNA Sequence Number=SeqID_1242
MSLPDSPVANDDEIDPSLDEEEEEEEEEEEEEEEEEEEEEEIEEEEEEEEEEVEEEVEEEEVEGEEVEEDEVDEEEEEEEEVVEEEVEEEEEEEELEEIEVEEEEEESEQRAEEMEEEEEEEVEVEEEGEEEEVEEEEEGEEEEVEEEEEEEEVEVEEEEEEEEEVEVEEKEEKEDEAQQQQQQETVEEKKEERQQQQEAEEAVKEQQKKQQQEAMEEKEEDKLAVPGSPLDADKDRQESIENMNQLGDSRMRLVEAIVERDMNQKCKIRKKCTAHCPKLQTKQYLNHRFTNKVLAPELQPEIVPDTPEKMLFGACLAQQRSGTWGVHEGLAEQAVAGDGQIGNQQVEQWFCQLERSLELRC

SEQ ID NO: 118021 - protein, 246 aa, Glycine max
  Coding DNA Sequence Number=SeqID_1243
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9SD12; Match level="QueryCoverage=81%, HitCoverage=53%, E-value=5e-98, Identity=83%"; Hit description =Protein phosphatase 2C-like protein
  Pfam annotation: Domain name=PP2C; Domain location=44-238; Score= -66.0; E_value=0.041; Accession=PF00481.12; Description=Protein phosphatase 2C
MDFLTACWRRRGSSSDGKGSEVSGRKEGLLWYKDTGQHLFGEYSMAVVQANNLLEDQSQIESGPLSMLDTGPYGTFVGVYDGHGGPETSRYVCDHLFQHLKRFASEQKSMSMEVIRKAYQATEEGFLSVVTKQWPMNPQIAAVGSCCLVGVICGGILYIANLGDSRAVLGRVVRATGEVLAIQLSSEHNVAIESVRQEMHSLHPDDSKIVVLKHNVWRVKGLIQDRKYCLNIASHIIGKRVFNLWV

SEQ ID NO: 118022 - protein, 402 aa, Glycine max
  Coding DNA Sequence Number=SeqID_1244
  Gene Ontology: Mol. function=protein binding; Cellular component =integral to membrane; Biological process=protein amino acid phosphorylation
  Homolog annotation: Hit_ID=Q0PY41; Match level="QueryCoverage=91%, HitCoverage=64%, E-value=1e-135, Identity=62%"; Hit description =Leucine-rich repeat family protein
MPNIATFRFLLLWMLFLCFACTARAAQRGPFAMRISCGARQNVQTKPTTTLWYKDFGYTGGIPTNAKTSSYIAPPLKTLRYFPLSEGPSNCYNINRVPKGHYSIRIFFGLVAQARATDEPLFDISIQGTQIYSLKSGWTTQDDQAFTEAQVFLMDGSVSICFHGTGHGDPAILSIEILQIDNKAYYFGSQWSQGIILRTVKRLSCGFGQSKYGVDYGADPRGGDRFWQHTETFGEDSDRPRSVETRIKQASHPPNFYPETLYRSALVSTSSQPELTYTLDVDPNKNYSVWLHFAEIDNSVTAEGQRVFDIMINGDVAFKDVDIVKLSGDRYTALVLNTTVVVNGRTLTIALSPKDGSFAIINAIEIMEVIMAESKTLSDEGLGGMVIHAFPNNIHGLEPIAD

SEQ ID NO: 118023 - protein, 179 aa, Glycine max
  Coding DNA Sequence Number=SeqID_1245
  Homolog annotation: Hit_ID=Q1S7C5; Match level="QueryCoverage=43%, HitCoverage=7%, E-value=2e-10, Identity=40%"; Hit description =Integrase, catalytic region
  Pfam annotation: Domain name=zf-CCHC; Domain location=103-120; Score =16.5; E_value=0.0019; Accession=PF00098.13; Description=Zinc knuckle
  Subcellular localization annotation: CTP_CleavageSite=65; ConfidenceScore=5.77e-01
MAESSPPPSTTSSFSAFSHSISKKLTDSNFLQWRQQKKLTSETASLNLTEVPSSKSLQQSSSSAQANVASENANSNYNSNFGFRGSGHGRGGGRGRGGWFANVQCEVCFKYGHLASDCYSHYDQNYQPQIPANFQGFQISLNPWNSFIAAQQNYGAYQPNSFPISSNSWGMMPKQVQFP

SEQ ID NO: 118024 - protein, 182 aa, Glycine max
  Coding DNA Sequence Number=SeqID_1246
  Gene Ontology: Mol. function=S-adenosylmethionine-dependent methyltransferase activity
MKKDIRSCCYNEGSTSTHNKQNNTCKVSSLALQDLMLQFELEAKLSDDFSGIMMNDSNILRSTRKALNQYPRLSLDGGRDAMNRSSFGNIQGRRSVCCDRRLKGGLIEENNDLGSKLRFGEGMSLPHTLAGESVVWCKPGVVARLMGLEAIPLPVSSIRSDNKEKILSVFRMQNPRRRFREA

SEQ ID NO: 118025 - protein, 186 aa, Glycine max
  Coding DNA Sequence Number=SeqID_1247
MDGNKLTSHVADDSISYSLDSLSFSGLVCIQDHQPKLPSPNRAKHYQVSKHDPEFEFTSTKANLNSAVNPIKITPADQLISNGRLQPQALAIQTNQSLLTNLPSSSSSLLATRSSSKMPSGRTDSKMKYHEQLNKASKHTNKKSTVTRTGFGQKMKSFLSPCRECQTIKQGAVKAQTVPGENLKIY

SEQ ID NO: 118026 - protein, 116 aa, Glycine max
  Coding DNA Sequence Number=SeqID_1248
  Gene Ontology: Biological process=auxin mediated signaling pathway
  Homolog annotation: Hit_ID=Q9FNV7; Match level="QueryCoverage=96%, HitCoverage=100%, E-value=2e-24, Identity=60%"; Hit description =Auxin-repressed protein
  Pfam annotation: Domain name=Auxin_repressed; Domain location=7-112; Score=153.7; E_value=4.8e-43; Accession=PF05564.3; Description =Dormancyauxin associated protein
MVLLEKLWDDVVAGPQPERGLGKLRKLTTLKTIDEGDSSKLQKTLSMPSTPTIPMTPTTPTTPGSARKADNVWRSVFHPGSNSATKTIGAQMFDKPLPNTPTAVQWGDQKQAPLKG

SEQ ID NO: 118027 - protein, 417 aa, Glycine max
  Coding DNA Sequence Number=SeqID_1249
  Gene Ontology: Mol. function=protein serine/threonine kinase activity; Cellular component=membrane; Biological process=protein amino acid phosphorylation
  Homolog annotation: Hit_ID=Q9LK35; Match level="QueryCoverage=81%, HitCoverage=38%, E-value=5e-66, Identity=40%"; Hit description =Receptor-protein kinase-like protein
  Pfam annotation: Domain name=APH; Domain location=52-224; Score=-9.4; E_value=0.027; Accession=PF01636.13; Description=Phosphotransferase enzyme family
  Pfam annotation: Domain name=Pkinase; Domain location=49-324; Score =108.8; E_value=1.6e-29; Accession=PF00069.15; Description=Protein kinase domain
  Pfam annotation: Domain name=Pkinase_Tyr; Domain location=49-324; Score=92.8; E_value=1e-24; Accession=PF07714.7; Description=Protein tyrosine kinase
  Pfam module annotation: Pfam domain module=APH::Pkinase::Pkinase_Tyr; Domain location=52-224::49-324::49-324
MVGALLYCLFWRKVIPFLKQRKTLKGKEHDKISLRYFDFKELERATKNFSQDCLLGSGAFGNVYKGTFDLEGTLAIKRAHSESFSSVEEFRNEVRLLSAVRHRNLIGLIGYCEEPERHGAKILVYEYVPNGSLLEYIMGNETSLTWKQRLNIAIGAARGIAYLHEGVKPSIIHRDIKPSNILLAEGFEAKVSDFGLVRSGPTGDQSHVSSQIKGTPGYLDPAYCLSFHLTKFSDVYSFGIILLQLVSARPVVDSTVNQSNQHIIDWARPSLEKCSVEEIIDANLLCQSEPCNMEVMLKMGQLGLRCVVEEPKHRPTMSQVCQELEQALYSANDSFNNKKSSKGFLTPIGSSQQSTKSETRRSVESYDCSQSFVSIDSVGLQKFHVDMDSFSFKSTDLRRFLPTLVNIGRGTGKERII

SEQ ID NO: 118028 - protein, 147 aa, Glycine max
  Coding DNA Sequence Number=SeqID_1250
  Gene Ontology: Mol. function=serine-type endopeptidase activity
  Homolog annotation: Hit_ID=Q0PY37; Match level="QueryCoverage=87%, HitCoverage=13%, E-value=6e-16, Identity=38%"; Hit description =Putative protease/hydrolase
MVLSDAVNFARNFAVMVRVRGPDPKGLKMRNHAFHQYRFLTPPLILFCFSFLKVWFFYALMAVGFGFLLLSMCSSGETTLSASGVLVPDTLCDSQVATRLNGDNCEDRVLVVTVASVVEPFLSPQQRDNIPQVGAARFRTCLDKLLY

SEQ ID NO: 118029 - protein, 117 aa, Glycine max
  Coding DNA Sequence Number=SeqID_1251
VDITYENWKEIPTSQKDLIWEDIQAEFDIPEASNNRTKRKLLQTMGERWRQFKSDLTRKWALAANQDNVEDTVYDKYGISKEKWAQFCQTRRDPSWEVFFNHSNHMGNDVDFILIIM

SEQ ID NO: 118030 - protein, 80 aa, Glycine max
  Coding DNA Sequence Number=SeqID_1252
MAGVAVKYQLTSEDLRFRHIETHKSQHYSRIQCQITSLYILDKSTIHLRRHIIHMIISISYRSTLLYWDGEAILQAYLLY

SEQ ID NO: 118031 - protein, 72 aa, Glycine max
  Coding DNA Sequence Number=SeqID_1253
MVQLHVKMRLPRVETLLVEIQNLSLFVVNSSVLPSRDSILDITTVVQYKSGPIFPNATVVHKCNCFNSCWVR

SEQ ID NO: 118032 - protein, 171 aa, Glycine max
  Coding DNA Sequence Number=SeqID_1254
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q1XG55; Match level="QueryCoverage=58%, HitCoverage=22%, E-value=2e-09, Identity=36%"; Hit description =Putative prolyl 4-hydroxylase, alpha subunit
MVKARQCSRLWPRKSWWRVSSPATLTLLLLTCSFLTLILLALHILSTPHANANSSVSRNTHIEAEEDDQVALRMEVISWQPRAFLYHNFLGCGSSLFESLENCEVGTVKGSKNGVTWLMERKTKEECEYLINIATPHMQKSTVADNQSGQSVVHELDSLLYTFLSFEFIHY

SEQ ID NO: 118033 - protein, 239 aa, Glycine max
  Coding DNA Sequence Number=SeqID_1255
  Gene Ontology: Mol. function=metal ion binding; Cellular component =integral to membrane; Biological process=ubiquitin cycle
  Homolog annotation: Hit_ID=Q8GT74; Match level="QueryCoverage=94%, HitCoverage=90%, E-value=2e-80, Identity=67%"; Hit description=RING -H2 finger protein ATL2B
  Pfam annotation: Domain name=Rick_17kDa_Anti; Domain location=54-93; Score=6.4; E_value=0.039; Accession=PF05433.5; Description =Rickettsia 17 kDa surface antigen
  Pfam annotation: Domain name=zf-C3HC4; Domain location=194-235; Score= 19.6; E_value=0.0015; Accession=PF00097.15; Description=Zinc finger, C3HC4 type (RING finger)
  Pfam module annotation: Pfam domain module=Rick_17kDa_Anti::zf-C3HC4; Domain location=54-93::194-235
MEFVPNQCPWMGSFGNFVERVKRVGALFVSAIIGNIFSAILTFCFALEKCENLDVVGTLLGAMTGALIGQETESGFIRGAAIGAISGAVFSIEVFESSLVLWKSDESGIGCVLYLIDVISSLLNGRLVRERIGPAMLSAVQSQMGAVEISFDEVQNLFDIGGAKGLSRDSVEKIPKITITSDNNVHASGEKDSCSVCLQDFQLGETGRSLPHCHHIFHLPCIDKWLIKHGSCPLCRRDL

SEQ ID NO: 118034 - protein, 273 aa, Glycine max
  Coding DNA Sequence Number=SeqID_1256
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q9FKX6; Match level="QueryCoverage=79%, HitCoverage=80%, E-value=3e-86, Identity=70%"; Hit description =Prolyl 4-hydroxylase, alpha subunit-like protein
  Pfam annotation: Domain name=2OG-FeII_Oxy; Domain location=168-261; Score=25.6; E_value=0.00018; Accession=PF03171.10; Description=2OG -Fe(II) oxygenase superfamily
MVKGRQSRLGHRKPSRGSSWPVMLTLLATCSFLILILLALPILSNSNANSSGRLIIKPNDLNSIALNTTTHISEAEYDQLGERWVEIISWEPRIFLYHNFLTKEECEHLINIAKPNMRKSTVIESETGMSIESRVRTSSGTFLARGRDKIVRNIENRIADFTFIPVDNGEELQVLHYQVGEKYVPHHDYFMDDINTANGGDRIATMLMYLSDVEEGGETVFPDAKGNFSSMPGWNELSVCGKKGLSIKPKMRNALLFWSIKPDATYDPLSLHG

SEQ ID NO: 118035 - protein, 159 aa, Glycine max
  Coding DNA Sequence Number=SeqID_1257
  Homolog annotation: Hit_ID=Q8S901; Match level="QueryCoverage=90%, HitCoverage=69%, E-value=4e-08, Identity=29%"; Hit description =Syringolide-induced protein 14-1-1
  Subcellular localization annotation: CTP_CleavageSite=73; ConfidenceScore=5.71e-01
MDKLSQMKNNLFKFLPNQPLASFQNPNLSPSGSVTPGAGRTPTHRVSIVPKEARRRHKTESFSGWEPNSPKVSCMGQVKSKKKRKAHEQKKVQTQESENKRFLRWIFMRNGEGTKESGNLEEKASTTEVAPSLGTMKKFASGREGSLRDFDVALMERLI

SEQ ID NO: 118036 - protein, 89 aa, Glycine max
  Coding DNA Sequence Number=SeqID_1258
  Subcellular localization annotation: CTP_CleavageSite=37; ConfidenceScore=5.12e-01
MASSLSQTSTTLFTFVILPSTQSNTFIISLCRLILPSQAILSGRDGISGTQGHLPHGKLSRDRDLGQGRDLGRGLGLDKGQDRVLEVVA

SEQ ID NO: 118037 - protein, 310 aa, Glycine max
  Coding DNA Sequence Number=SeqID_1259
  Gene Ontology: Mol. function=ammonium transporter activity; Cellular component=membrane; Biological process=transport
  Homolog annotation: Hit_ID=Q1SM09; Match level="QueryCoverage=90%, HitCoverage=62%, E-value=2e-85, Identity=53%"; Hit description=Blood group Rhesus C/E and D polypeptide; Rh-like protein/ammonium transporter
  Pfam annotation: Domain name=Ammonium_transp; Domain location=1-271; Score=-94.6; E_value=3e-07; Accession=PF00909.11; Description =Ammonium Transporter Family
MNFYAWMMFVPLWLTLSYTVGAFSIWDDDGFLQGKIIDYAGGICPTPWLEESSSNIDLIWHAGFNGGAPFQVGEIASLAIYNTHLCTATSLLVWLTLDMIVYTKSSVIGAVQGMITGLVCITPGAGLVDPWAAVLMGALSGSIPWYTMMVLHKKSAFFQSVDDTLGVFHTHAVAGLLGGILSGVFAKPDLLRIMYQDTNYCPGLFYTFFKGEVDHGFRQIWYQLLGAGFIIVWNVVITSLICILISRIVDLRMKEEDLEVGDDAAHGEEAYALWGDGERMRIPLRLHIGPTIPSLCRKRFSIPLTRKEGE

SEQ ID NO: 118038 - protein, 503 aa, Glycine max
  Coding DNA Sequence Number=SeqID_1260
  Gene Ontology: Mol. function=binding; Cellular component =intracellular; Biological process=metabolic process
  Homolog annotation: Hit_ID=Q2HU53; Match level="QueryCoverage=94%, HitCoverage=77%, E-value=2e-90, Identity=34%"; Hit description =Tetratricopeptide-like helical
  Pfam annotation: Domain name=PPR; Domain location=185-219; Score =32.0; E_value=2e-06; Accession=PF01535.11; Description=PPR repeat
  Pfam annotation: Domain name=PPR; Domain location=288-322; Score =33.4; E_value=7.7e-07; Accession=PF01535.11; Description=PPR repeat
  Pfam annotation: Domain name=PPR; Domain location=323-357; Score =18.9; E_value=0.018; Accession=PF01535.11; Description=PPR repeat
  Pfam annotation: Domain name=PPR; Domain location=358-391; Score=4.4; E_value=2.2; Accession=PF01535.11; Description=PPR repeat
  Pfam annotation: Domain name=PPR; Domain location=84-118; Score=25.1; E_value=0.00024; Accession=PF01535.11; Description=PPR repeat
  Pfam module annotation: Pfam domain module=PPR::PPR::PPR::PPR::PPR; Domain location=185-219::288-322::323-357::358-391::84-118
MRGVSRRVQQLLRPKLHKDSFYYTELLNLCKTTDNVKKAHAQVVVRGHEQDPFIAARLIDKYSHFSNLDHARKVFDNLSEPDVFCCNVVIKVYANADPFGEALKVYDAMRWRGITPNYYTYPFVLKACGAEGASKKGRVIHGHAVKCGMDLDLFVGNALVAFYAKCQDVEVSRKVFDEIPHRDIVSWNSMISGYTVNGYVDDAILLFYDMLRDESVGGPDHATFVTVLPAFAQAADIHAGYWIHCYIVKTRMGLDSAVGTGLISLYSNCGYVRMARAIFDRISDRSVIVWSAIIRCYGTHGLAQEALALFRQLVGAGLRPDGVVFLCLLSACSHAGLLEQGWHLFNAMETYGVAKSEAHYACIVDLLGRAGDLEKAVEFIQSMPIQPGKNIYGALLGACRIHKNMELAELAAEKLFVLDPDNAGRYVILAQMYEDAERWQDAARVRKVVKDKEIKKPIGYSSVELESGHQKFGVNDETHVHTTQIFQILHSLDRIMGKETRAM

SEQ ID NO: 118039 - protein, 119 aa, Glycine max
  Coding DNA Sequence Number=SeqID_1261
MTSLMEAMLSMKRMIESNTTTTAATSATAEADLIHSSAINQANQPIQDVLGQGGEVLGSTGGPHVGHNRNAYPYGLPPNYTPPTMHMPNENANHAVPVTLEGQQPQPVGGTREEPWEHA

SEQ ID NO: 118040 - protein, 71 aa, Glycine max
  Coding DNA Sequence Number=SeqID_1262
MPQCESGCCASTCPDHKFHRAREKGVKILMGLSTLEGEIPSFNGGGLFWFLYDNQYRHHHAQPLSCPSAHS

SEQ ID NO: 118041 - protein, 47 aa, Glycine max
  Coding DNA Sequence Number=SeqID_1263
MATEEPIIRDNVSDFSDDEQQHDFDEHGEPSNQRREYHSAKYAKGGS

SEQ ID NO: 118042 - protein, 206 aa, Glycine max
  Coding DNA Sequence Number=SeqID_1264
MPIHIKKVTTKDELKQFIRFNYELYKNNAYSVPDLLEDMLDTFNPEKNAAYDFCEDQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 118043 - protein, 55 aa, Glycine max
  Coding DNA Sequence Number=SeqID_1265
MSQNPTEIATIGVKELNSATKNPNGSKDKDTNFVLGISPSNRPLAEVQAVKPVKA

SEQ ID NO: 118044 - protein, 56 aa, Glycine max
  Coding DNA Sequence Number=SeqID_1266
MAARGGHWWLWVVEEEISLSKLVSLSESPLLALSVTFRTKRNSSWVGISAERDNSP

SEQ ID NO: 118045 - protein, 80 aa, Glycine max
  Coding DNA Sequence Number=SeqID_1267
MDHEFKEKMDKLQGVIDGKRGTGYAEGTQLTSCFCGMHYKVALYALGGNVVKQLKTFVWIPLHEEVQSADTLLSGIQMEY

SEQ ID NO: 118046 - protein, 557 aa, Glycine max
  Coding DNA Sequence Number=SeqID_1268
  Gene Ontology: Mol. function=protein binding; Cellular component =membrane; Biological process=protein transport
  Homolog annotation: Hit_ID=Q2QP91; Match level="QueryCoverage=77%, HitCoverage=68%, E-value=1e-174, Identity=70%"; Hit description=Dor1- like family protein, expressed
  Pfam annotation: Domain name=Dor1; Domain location=1-338; Score =378.5; E_value=1e-110; Accession=PF04124.3; Description=Dor1-like family
MVEALVTGNDLCAFVQSSIETIILCSSQTSLSRTQSHRAFVIEYLSPLSQINEIPKLTSGCTEFIESAERILEKRKMNQTMLTNHSTLLDLLEIPQLMDTCVRNGNYDEALDLEAFVGKLSTMHPKLPVIQALAADVRLTTQSLLSQLLQKLRSNIQLPECLRIIGYLRRIGVFSEYGMRLLLLGTFNFWLPFDSTVVYCQFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSSAVENFQLVLDSHRWVPLPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESKSVAENGESPKMENGETPDAKESEAVNSEEVNEEGTEEGPTLQTDREDTNLEKPLE

SEQ ID NO: 118047 - protein, 512 aa, Glycine max
  Coding DNA Sequence Number=SeqID_1269
  Homolog annotation: Hit_ID=Q10KZ6; Match level="QueryCoverage=92%, HitCoverage=94%, E-value=1e-131, Identity=52%"; Hit description =Proline-rich family protein, putative, expressed
MTRLTRDFGDTMQRDAVPAVSSDVVFASSRFPNYRIGANNQIIETKDDPKVLSMKEVVARETAQLLEQHNRLSVRDLASKFEKGLAAAAKLSEEARLREAASLEKHVLLKKLRDALESLKGRVAGRNKDDVEEAIAIVEALAVQLTQREGELIQEKAEVKKLANFLKQASEDAKKLVDEERAFARAEIEDARAAVQRVEEALQEHERMSQASGKQDLEQLMREVQEARRIKMLHQPSKVMDMEHELRALRSQLAEKTRQYLRLQKELTRTKKGGENVPHLYELEGNETLGSYLQIQPCSDNAPEVSKCSIQWYRVSSDGAKKELISGATKSVYAPEPFDVGRILQVDIISESEHVTLSTAGPIDPAAGLGTYVEALVRKHDTEFNVVVTQMNGSHHPTESIHVLHVGKMRIKLCKGKTTIAKEYYSSSMQLCGVRGGGNAAAQALFWQPKQGHSFVLAFESERERNAAIMLARRFAFDCNTDIQTITENSDCILSMDTGLVDRTICESTLIM

SEQ ID NO: 118048 - protein, 100 aa, Glycine max
  Coding DNA Sequence Number=SeqID_1270
MGLSESLNLHDENSKAAAGVSAAMSLILGGIFVFIVCYYVCIRLRSQTHRDVPAAAAVAAVSDQETVEKCPVFVYSTVKKENVAAEECAVCLGEFEDCDV

SEQ ID NO: 118049 - protein, 97 aa, Glycine max
  Coding DNA Sequence Number=SeqID_1271
MKKFDTLTGGQVLFKVEKDVMNFDLMTLAELNICDDSSIIEEFKVEDNVSTPQKMALLMVSSKILSVKLKACCLDIGSLFVGLHSIHQSADMPTKMQ

SEQ ID NO: 118050 - protein, 146 aa, Glycine max
  Coding DNA Sequence Number=SeqID_1272
  Gene Ontology: Mol. function=RNA-directed DNA polymerase activity; Biological process=RNA-dependent DNA replication
  Homolog annotation: Hit_ID=Q1STT2; Match level="QueryCoverage=91%, HitCoverage=32%, E-value=3e-16, Identity=33%"; Hit description =Lipocalin
MGFRHLHGFNLVMLGRQGWKLTTNQDVMHPCFTGIIKEGIKWRVGNDKSISVWNQPWICSSRISSRPSSIPPNGLEQLKVNTLIRHDFNCWRSEILEQIFNEDVKEIQQMPLVNIVGQDKIIWRLGSNGDYLVRLVPSPYGEYVGQ

SEQ ID NO: 118051 - protein, 297 aa, Glycine max
  Coding DNA Sequence Number=SeqID_1273
  Homolog annotation: Hit_ID=Q1S065; Match level="QueryCoverage=99%, HitCoverage=100%, E-value=2e-22, Identity=30%"; Hit description =Arabidopsis conserved protein
  Pfam annotation: Domain name=DUF241; Domain location=52-294; Score =233.0; E_value=6.3e-67; Accession=PF03087.5; Description=Arabidopsis protein of unknown function
MEAISTMPSTTTHQPVRSISLPTRVHPSSQRVEALLNQIKPHTCLEAETIQSDLVVLAELYNCMEELFNSPQTQQALLHYQNGKLVEEALCGSVTLLDACGTARDLLLALKEHVQTLQSAIRRRRGDSSIENSICEYGGFRKKAKKEIAKQLGAMKRTENKVNTCFLMGQSQDQHLIYLARVLREASTITISIFRSLLLFLSMPGLRTKGTSMISKLKPMRLFSSEKGQKNTNVVDLSAMCSLLGRAKHSDAKVEVQIALRVLETLNVSIDGLDGGLDCIFRRIVQNRVSFLNMLAH

SEQ ID NO: 118052 - protein, 289 aa, Glycine max
  Coding DNA Sequence Number=SeqID_1274
  Homolog annotation: Hit_ID=Q1S062; Match level="QueryCoverage=97%, HitCoverage=95%, E-value=9e-31, Identity=30%"; Hit description =Arabidopsis conserved protein
  Pfam annotation: Domain name=DUF241; Domain location=48-286; Score =211.3; E_value=2.2e-60; Accession=PF03087.5; Description=Arabidopsis protein of unknown function
MANKYHKLRSISLPSRSHPSTVRVEEELRKIKTWEGTSTISTSKSIHTGLSLLEDLYICLDDLLNMASTQKVISHHRGDKCVEEVLDGSVRILDICGITRDTMLQIKENVQALHSSLRRRKGDSCVEASVAEYKLFTKTMKKNAIKLISSLKQMDGKFGVSPLLDLDHHFAAVIRVLREVILINLSVFQFILSFLTVSSSNSKTSKWSLVAKLMHKGAKPCDGTNDEMQCVEAALSSLLNEGTNDDKIHVAHERLEALEDAIESFENGLESLFRHLIKTRASLLNIISQ

SEQ ID NO: 118053 - protein, 75 aa, Glycine max
  Coding DNA Sequence Number=SeqID_1275
MILLLLLISKDDNVGWDKFGVTKHMSTNGNFEALGDSVSGGDNVDKLNCIHVLMVVEVKEEWKEKCVVGNIGSEE

SEQ ID NO: 118054 - protein, 318 aa, Glycine max
  Coding DNA Sequence Number=SeqID_1276
  Gene Ontology: Mol. function=DNA binding; Cellular component =cytoplasmic membrane-bound vesicle; Biological process=regulation of transcription, DNA-dependent
  Homolog annotation: Hit_ID=Q2RAU4; Match level="QueryCoverage=93%, HitCoverage=17%, E-value=7e-73, Identity=47%"; Hit description=HEAT repeat family protein, expressed
  Pfam annotation: Domain name=HEAT; Domain location=36-72; Score=19.7; E_value=0.011; Accession=PF02985.12; Description=HEAT repeat
MAESSSSSLAKSDSEVEEMLDRMLTRLALCDDSKLEPLLSKLLPLCISSLSSQSVAVRNKVLEILSHVNKRVKLQPQIGLPLSDLWKLYSESAAVPIIRNFCIVYIEMAFQRVNAKEKEDLAPDLLVNISKLPLQHQEIILRIIVKQRSPSVINLQDMTTYGFLLPSSGGFPPGLSVAQVNRVTGKQQLQSNEILLRKLGILNVIQAMELAPELVYPLYIAASVDCEEPVIKRGEELLKKKANGANLDDLNLINRLFLLFNGTVGVEHVDSESRVSPGSPALKAKLMSIFCRSIAAANNFPSTLQCIFGCIYVLFEVV

SEQ ID NO: 118055 - protein, 383 aa, Glycine max
  Coding DNA Sequence Number=SeqID_1277
  Gene Ontology: Mol. function=hydrolase activity, acting on glycosyl bonds; Cellular component=vacuole; Biological process=cell wall catabolic process
  Homolog annotation: Hit_ID=Q9SDY6; Match level="QueryCoverage=70%, HitCoverage=84%, E-value=1e-144, Identity=90%"; Hit description =Chitinase class I
  Pfam annotation: Domain name=Glyco_hydro_19; Domain location=147-376; Score=508.9; E_value=5.7e-150; Accession=PF00182.9; Description =Chitinase class I
NDDNDNGNDSNDNSNGECNDDGCNNNGDNNDDSDHDADNDIDNNNDDVITTKVMEEIMVLAIIINGGIDDTNDDNNNSDNDIKMTMPTDNTDDDDNNDDNNTHNKDDNNDDKGDSYCGEGCQSQCKSATPSTPTPTTPSSGGDISRLISSSLFDQMLKYRNDGRCSGHGFYRYDAFIAAAGSFNGFGTTGDDNTRKKEIAAFLAQTSHETTGGWASAPDGPYAWGYCFINEQNQATYCDGGNWPCAAEWSNYGWILTLCNSNYNYGQAGKALGLDLINNPDLVATDATVSFKTALWFWMTAQGNKPSSHDVITGRWTPSSADSSAGRAPGYGVITNIINGGLECGHGQDNRVQDRIGFYRRYCQMMGISPGDNLDCNNQRPFA

SEQ ID NO: 118056 - protein, 92 aa, Glycine max
  Coding DNA Sequence Number=SeqID_1278
MSSDSNMVDPACPIPNLPNQSATTIDDKNQKVGKFEGYIVQRLADGSPISRVTRFGDASAKEFSSAYEEAHFIFLLLEVLLEKFMETCPLRS

SEQ ID NO: 118057 - protein, 445 aa, Glycine max
  Coding DNA Sequence Number=SeqID_1279
  Homolog annotation: Hit_ID=Q2RAU4; Match level="QueryCoverage=95%, HitCoverage=23%, E-value=7e-99, Identity=47%"; Hit description=HEAT repeat family protein, expressed
  Pfam annotation: Domain name=HEAT; Domain location=131-161; Score =3.7; E_value=15; Accession=PF02985.12; Description=HEAT repeat
  Pfam annotation: Domain name=HEAT; Domain location=207-243; Score =9.8; E_value=2.7; Accession=PF02985.12; Description=HEAT repeat
  Pfam annotation: Domain name=HEAT; Domain location=293-329; Score =3.6; E_value=16; Accession=PF02985.12; Description=HEAT repeat
  Pfam module annotation: Pfam domain module=HEAT::HEAT::HEAT; Domain location=131-161::207-243::293-329
MALEGLCLLKSGSEIVGLKYPKLGMMLDYILRQQPKLLESSETREQNLLFPSNTYVAMIKFLLKCFESELEQNKSLEGSSEFISSVKTFCLVLEHSMSFEGSVELHANASKALLIIGSHMPEVVASHFALKVSWLKQLLSHVDWDTRESIARILGIVSSALPIPDVMSELTSLFSQSHKSRFETQHGALCAIGYVTANYLSTTPMPEIFLQDTLRCLVDVVNSETSALAAAAMQALGHIGLRISLPPLDDSNSDGILIMLSDKLSKLLSGDDIKAIQKIVISIGHICVKETSSTELDMALNLIFSLCRSKVEDILFAAGEALSFLWGGVPFNADIILKTNYTSLSMASNFLMGDLTSSVSKQSTNEQSEYSGDYHAAVRDAITKKLFDVLLYSSRKEERCAGTVWLVSLIKYCGNHPTIQQMLPEIQFITFGAQAGVLGQGCLLG

SEQ ID NO: 118058 - protein, 77 aa, Glycine max
  Coding DNA Sequence Number=SeqID_1280
MSLPSAVHVFSIIKCEASGDWEARYSVVFQIGSFAKYMYMCIYKKKKEVEMRVVITERAGRTKSVSYLCFPLISDER

SEQ ID NO: 118059 - protein, 453 aa, Glycine max
  Coding DNA Sequence Number=SeqID_1281
  Gene Ontology: Mol. function=molecular_function; Cellular component =cytoplasmic membrane-bound vesicle; Biological process=ER-associated protein catabolic process
  Homolog annotation: Hit_ID=Q2RAU4; Match level="QueryCoverage=99%, HitCoverage=24%, E-value=1e-166, Identity=64%"; Hit description=HEAT repeat family protein, expressed
  Pfam annotation: Domain name=HEAT; Domain location=117-153; Score =10.0; E_value=2.6; Accession=PF02985.12; Description=HEAT repeat
  Pfam annotation: Domain name=HEAT; Domain location=210-247; Score =13.6; E_value=0.7; Accession=PF02985.12; Description=HEAT repeat
  Pfam annotation: Domain name=HEAT; Domain location=76-112; Score =11.7; E_value=1.6; Accession=PF02985.12; Description=HEAT repeat
  Pfam module annotation: Pfam domain module=HEAT::HEAT::HEAT; Domain location=117-153::210-247::76-112
LVEDTEVFTDGALGESASGGKLNTYKELCNLANEMGQPDLIYKFMDLANYQASLNSKRGAAFGFSKIAKQAGVVLKPYLRSLIPRLVRYQYDPDKNVQDAMIHIWKSLVDDSKKTIDENLDLIIDDLLVQCGSRLWRSREASCLALTDIIQGRKFHEVGKHLKRLWSGTFRVMDDIKETVRISGEKLCRAVTSLTTRLCDVSLTDMSDAHKAMDIVLPFLLAEGILSKVDSVRKASIAVVMKLTKHAGTAIRPHMSDLVCCMLESLSSLEDQSLNYVELHAANVGIQSEKLESLRISIAKGSPMWETLDSCIKVVDAESLNTLIPRLAHLVRSGVGLNTRVGVANFITLLLESVGVDIKPYANMLVRLLFPVVKEERSTAAKRAFASACAKVLKHIPASQAQKLIEDTTALHAGDKNSQIACAFLLKSYSSMAADVVGGYHAVIIPVVFLSRS

SEQ ID NO: 118060 - protein, 347 aa, Glycine max
  Coding DNA Sequence Number=SeqID_1282
  Homolog annotation: Hit_ID=Q2RAU4; Match level="QueryCoverage=99%, HitCoverage=19%, E-value=3e-77, Identity=45%"; Hit description=HEAT repeat family protein, expressed
MSPAYLRNYGKNTQVGNESLSTCTWEKLFHLFVRACHHHHGQSAEAICRLSEVLGESLSSHHEVLLQSLMKEIPGRLWEGKEMLLLAVGALCTSCHKAILTQGSSSSIAILNLVSSACTRKGKKYREAALSSLEQVIKALGNPEFFNMVFPLLFDLCNSEPLKSGQAPLASDAAGSELNSVEEISVPHNKIVDCLTSCIHVAHINDILEKQKGLAHMYTAFLLPEHKWTVKTTAFVSIRELCSRLQNVVKDSQGSNELAGATSFVQEIFHSLSPKILHCISTIKIAQVHVSASECLLEVMNLAMDVPSVGTINEGFKDELLHQYEIEKNEGAKSILKKCVNILQDWK

SEQ ID NO: 118061 - protein, 195 aa, Glycine max
  Coding DNA Sequence Number=SeqID_1283
MTQELVARGDTLRLSAPRHSVTPSVIDEQRPMWSSAPFPEMSSFSDGDFSSLTSYPELRRSEFLIGGYVGARASLLSTAPLFVTMIQELVARGDTLRLSAPLCHPEAAGPMIRGDTLRLSAPFCHPEAAGPMTSRDKIWSFCTLVSSRGGGPDDTRRYLTVIRTLLSSRGGGPDDKQRQNLVILHPCVIQRRRAR

SEQ ID NO: 118062 - protein, 424 aa, Glycine max
  Coding DNA Sequence Number=SeqID_1284
  Gene Ontology: Mol. function=transcription factor activity; Cellular component=intracellular; Biological process=regulation of transcription, DNA-dependent
  Homolog annotation: Hit_ID=Q62IH6; Match level="QueryCoverage=54%, HitCoverage=74%, E-value=2e-49, Identity=47%"; Hit description=RNA polymerase sigma-70 factor, ECF family
  Subcellular localization annotation: CTP_CleavageSite=49; ConfidenceScore=5.04e-01
TVASAECQSEQPDQQNPLTSSEWQQSPAPSRFQALITSNAHAQVTDAPLIEMRRQRIERRLRRRTVGQASQRLGPAQRCAFACIEEAAFVPRGQGVQLARLDAALAQRGAVHVHAVAAAVELRHAQEHQFHQGRVDRTVMHRLAGGQQALEGLGGQAGVGDAGRGVVGHFRLHGGHVGRLSLPGRRTAIARDNRRQFFRIQHAVHVGDAAIGHFDGGDRVQPIAMEAQDRRLAVDVAQLRRMHRATTCDGPEQAADALGAQQRAYRCGDHAAAVGDQLRVGVQQGLDCFAVAALRGIHEARQQLPVLAGIGIEAWAPGLQALPGPMHQLPAVGFAVADQVGDFAVVVVERLLQQEGGAFLGAELFEQGQEGDRDIVGQRMQLRRAGRRVGLQGDRQWLGQPGADVVHALALGRAQPVQAKPGGG

SEQ ID NO: 118063 - protein, 290 aa, Glycine max
  Coding DNA Sequence Number=SeqID_1285
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=70%, E-value=1e-134, Identity=73%"; Hit description =Photosystem II P680 chlorophyll A apoprotein
  Pfam annotation: Domain name=PSII; Domain location=1-290; Score =337.6; E_value=2.2e-98; Accession=PF00421.9; Description=Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFMGMELLGPMFLFEGQNLNIVWNK

SEQ ID NO: 118064 - protein, 96 aa, Glycine max
  Coding DNA Sequence Number=SeqID_1286
  Subcellular localization annotation: CTP_CleavageSite=38; ConfidenceScore=5.12e-01
MVQLISDTIYCLQGSRPQDAQWTRRSPTGPWGFQLCLRASVVLQGAHSPRQGIVPARQLVDSKKSNRVLELPSSNYGPRSVLRSVCRPQQGHQPPY

SEQ ID NO: 118065 - protein, 135 aa, Glycine max
  Coding DNA Sequence Number=SeqID_1287
MWRQVKATSQDESIGRRRNINPVHVAFIVDKYLCDNNFSSTRSIFRNEASSLFATSSINQLPKTLEEMLDEYIFLKKQNAILNQERVMVMEEKNRIQILLQGMQNALNTYNAFQRPPSLNVAGMNANFAVVPQPR

SEQ ID NO: 118066 - protein, 265 aa, Glycine max
  Coding DNA Sequence Number=SeqID_1288
  Subcellular localization annotation: CTP_CleavageSite=71; ConfidenceScore=5.42e-01
MISVSDKKRKDTEAVNGPIVAKKPRGRPPGRKNQVQGENTSPQSSNAVNNQVVSWPSSSATQSSSGNCAPSGSLVQGSNAVKGSFNHPPLFVPDNSPIPKTPTTQSSQSDTYVSPTKIYPAASCNGEASPTCCTMNPTNKVMVGPETQMAYKENSHCNSPIEVDTGKSSKKDDVRSKLNFDASNMPESLDKSLSNEVYTSESDKEVDISDIDFSNLMDCCPFLGITSEDFSYHPVPTHSKDNASTSSHEFNANHLTYHQTANNHR

SEQ ID NO: 118067 - protein, 218 aa, Glycine max
  Coding DNA Sequence Number=SeqID_1289
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=98%, HitCoverage=49%, E-value=1e-94, Identity=81%"; Hit description =Putative hydroxymethylglutaryl-CoA lyase
  Pfam annotation: Domain name=HMGL-like; Domain location=2-196; Score =92.3; E_value=1.5e-24; Accession=PF00682.9; Description=HMGL-like
MASGAREVAIFASASESFSKSNINCSIEESLIRFRAVTRAAKQLSIPVRGYVSCVAGCPVEGPIPPSKVAYVAKELYDMGCFEISLGDTIGVGTPGTVVPMLLAVMAVVPIDKIAVHFHDTYGQSLPNILVSLQMGISTVDSSVAGLGGCPYAKGASGNVATEDVVYMLNGLGVKTNVDLGKLMLAGDFISNHLGRPSTSKTAIALNRVTSNASKISY

SEQ ID NO: 118068 - protein, 628 aa, Glycine max
  Coding DNA Sequence Number=SeqID_1290
  Gene Ontology: Mol. function=catalytic activity; Cellular component =nucleus; Biological process=metabolic process
  Homolog annotation: Hit_ID=Q1RVD3; Match level="QueryCoverage=97%, HitCoverage=90%, E-value=0.0, Identity=83%"; Hit description=AMP -binding enzyme, putative
  Pfam annotation: Domain name=AMP-binding; Domain location=119-552; Score=275.1; E_value=1.4e-79; Accession=PF00501.18; Description=AMP -binding enzyme
MRHEKQLQEDHDHDPGSWESMEGLLRCPANFVPLSPISFLERAAKVCRDRTSLVYGSLEYNWGETHQRCLKLASAITHLGISQITTFWMLLDFSSALQCLDVSTKCAALLTILICVDKTFAREQISGSILGLPKVNESLMIFHVVSAQVATLSPNVPAMYELHFAVPMAGAILCTLNSRLDAAIVSVLLEHSQAKVLFVDYQLLEIARGALDLLGKKARELPILVLIADNDCTSHIDITSVSYEYERLLADGHNGFDIVRPHCELDPISINYTSGTTSRPKGVVFSHRGAYLNSLATVLLFRMDLFPVYLWNVPMFHCNGWCLPWGVASQFGTNVCVRKVTPKNIFDNIAQHKVTHMAGAPTVLNMIVNSALTDRKPLNHKVEVMTGGSPPPPQILAKMEEIGFNISHLYGLTETYGPGTFCAWRPEWDLLPHEERSKMKARQGVPHVALEEIDVKDPSTMESVPSDGKTMGEVMFRGNTVMSGYLRDLKATKEAFKDGWFHSGDLAVKHSDGYIEIKDRLKDIVVSGGENISSVEVETVLYSHPAVLEAAVVAKPDDHWGQTPCAFVKLKEGFDLDALEIINFCRDHLPHYMAPKTVIFQDMPKTSTGKIQKFVLREKAKAFRGNQA

SEQ ID NO: 118069 - protein, 136 aa, Glycine max
  Coding DNA Sequence Number=SeqID_1291
  Gene Ontology: Mol. function=oxidoreductase activity, acting on the CH-OH group of donors, NAD or NADP as acceptor; Cellular component =mitochondrion; Biological process=tricarboxylic acid cycle
  Homolog annotation: Hit_ID=Q1RVD4; Match level="QueryCoverage=85%, HitCoverage=31%, E-value=2e-40, Identity=76%"; Hit description =Isocitrate dehydrogenase, NAD-dependent
MRFSISTAETVLVCVEMDKVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 118070 - protein, 367 aa, Glycine max
  Coding DNA Sequence Number=SeqID_1292
  Gene Ontology: Mol. function=strictosidine synthase activity; Cellular component=membrane; Biological process=biosynthetic process
  Homolog annotation: Hit_ID=Q9CAZ7; Match level="QueryCoverage=96%, HitCoverage=95%, E-value=2e-96, Identity=50%"; Hit description =Strictosidine synthase-like protein
  Pfam annotation: Domain name=SGL; Domain location=59-306; Score= -71.3; E_value=7.3e-05; Accession=PF08450.2; Description=SMP -30GluconolaconaseLRE-like region
  Pfam annotation: Domain name=Str_synth; Domain location=157-244; Score=133.3; E_value=6.8e-37; Accession=PF03088.7; Description =Strictosidine synthase
  Pfam module annotation: Pfam domain module=SGL::Str_synth; Domain location=59-306::157-244
  Subcellular localization annotation: CTP_CleavageSite=46; ConfidenceScore=5.01e-01
MSRLWFSTPFFVIILPVAVAALFFRLEPFDPGFLPVQLGRSTVAVPASNGHVRVGSEAMGEGHLEGPEDLAYDAAARVVYTGCEDGWIKRVTVNDSVLDSAVEDWVNTGGRPLGLTLKPNGELIVADAEKGLLRVSSEREIELLVDEYEGLKFKLTDGVDVADDGTIYFTDASHKYPVKDAVLDILEGKPNGRFFSYNPATKKTTLLAKDLYFANGVAVSADQQFVVFCESVLMICEKYYVQGPKKGTIEKFCDLPGMPDNIHYDGQGHYLIAMVTALTPELELAYRYPFIRKTFAIVTKYVGSLPISKNGGVLVVDLEGKPTAHYYDPKLSLTSAIKIGNHIYGGSIFYPFVTRFDIEKYPALPTV

SEQ ID NO: 118071 - protein, 93 aa, Glycine max
  Coding DNA Sequence Number=SeqID_1293
MAEACGNPLNFHNARKIRDIVVLQVETAAIVNKNSLVGDPPTDVVPPLVFKKKNKDKLKRKHHKHQKSFEDSSDHHRSNPMVCAKTYSPKGSE

SEQ ID NO: 118072 - protein, 165 aa, Glycine max
  Coding DNA Sequence Number=SeqID_1294
  Gene Ontology: Mol. function=serine O-acetyltransferase activity; Cellular component=cytoplasm; Biological process=cysteine biosynthetic process from serine
  Homolog annotation: Hit_ID=Q8W2B8; Match level="QueryCoverage=76%, HitCoverage=36%, E-value=5e-45, Identity=70%"; Hit description =Serine acetyltransferase 4
  Pfam annotation: Domain name=SATase_N; Domain location=68-165; Score =161.7; E_value=1.8e-45; Accession=PF06426.4; Description=Serine acetyltransferase, N-terminal
MSHLSHKTLVYLPEMRPEHEAEEGQANSLSSISSWPHRLENVFPVYAMGTSNPVLNSSLHISDCLDPIWDVVREEAKLEAEKEPILSSFFHATILSHDCLEEALAFALANRLQKPTLLATQLMDIFSNVMKHDKGIQQSIRLDIQAFKDRNPACLLYCSALLFMK

SEQ ID NO: 118073 - protein, 171 aa, Glycine max
  Coding DNA Sequence Number=SeqID_1295
  Gene Ontology: Mol. function=serine O-acetyltransferase activity; Cellular component=cytoplasm; Biological process=cysteine biosynthetic process from serine
  Homolog annotation: Hit_ID=Q8W2B8; Match level="QueryCoverage=77%, HitCoverage=37%, E-value=1e-35, Identity=55%"; Hit description =Serine acetyltransferase 4
  Pfam annotation: Domain name=Hexapep; Domain location=36-53; Score =14.2; E_value=0.46; Accession=PF00132.14; Description=Bacterial transferase hexapeptide (three rep
  Pfam annotation: Domain name=Hexapep; Domain location=68-85; Score =17.2; E_value=0.058; Accession=PF00132.14; Description=Bacterial transferase hexapeptide (three rep
  Pfam module annotation: Pfam domain module=Hexapep::Hexapep; Domain location=36-53::68-85
MEKYYTRVFGVDIHPAAKIGDGILVDHGTGVVIGETVIVGSRVSLMQGVTLGGTVKETGDRHPKISEGVLIGAHATILGNIRIGECVMIAAGSLVLQEVPPHSIVAGVPAKVIGRVHEHYPSLTMQQASTRVWYIYNFGAQLSHGESYSWHWSLSTGDLPTFALLKDTSPS

SEQ ID NO: 118074 - protein, 110 aa, Glycine max
  Coding DNA Sequence Number=SeqID_1296
FNPIDSFSFSFSMDLQDFLLRARVLMLYRQALRITGRAPSSAKGVQFFYVAAMHGAIGDGAFDRDEPRGCVATATGDSSDVATCNGALAMQGGVAGAAFAENASSFGDLG

SEQ ID NO: 118075 - protein, 77 aa, Glycine max
  Coding DNA Sequence Number=SeqID_1297
MQFFYVAAMHGAIGDGAFDKDEPRGCVATATGDKGLHIAALIGASKGAWKRWFDQRLQHLQAAGIGCNSTCSYSDRS

SEQ ID NO: 118076 - protein, 398 aa, Glycine max
  Coding DNA Sequence Number=SeqID_1298
  Gene Ontology: Mol. function=nucleic acid binding; Cellular component= intracellular; Biological process=regulation of transcription
  Homolog annotation: Hit_ID=Q1SGQ8; Match level="QueryCoverage=95%, HitCoverage=97%, E-value=6e-88, Identity=46%"; Hit description=Zinc finger, C2H2-type
MLEAWVSLKKTLQCKPQPNQVHDPKITRQQKGNQRTKSSNLESSNTKDFIQGSKKHLKKSLSYRGDIDITSPITHEIVLDSSNNGTCRCCPCPQSNNGNKGSEGSHRTRRSATSSKITMTYPVDYNEANVSSNTRALVQMDSDGCSTLTCHKCRKKMKNLDAVEAHHISQHSVTELEEDSSRQIIETICGSGTSSIINSENMLGQIDCILKVLNVPKTFACFEEYREKVKDNADKLQKKHPRCVADGNELLRFHGTTIACSLGTNSSSLCTLDYCGICQILRNGFSTNKEFHGALGVYTTSTSGKAFESISIMTSHERPFPRKSVIVCRVIAGKIHSPLEEERVDSEFDSLAEKINGHSSDAEELYVLNPKALLPCFVVIYKHQTDKVRRILGGSAQA

SEQ ID NO: 118077 - protein, 102 aa, Glycine max
  Coding DNA Sequence Number=SeqID_1299
  Pfam annotation: Domain name=DUF1218; Domain location=44-102; Score= -15.4; E_value=0.046; Accession=PF06749.3; Description=Protein of unknown function (DUF1218)
MTKNYGFLICILVIVLDIVAGILGIEAEIAQNKEKHMWVWIFECRYPSYQAFKLGLAAATFLALAHVIANLLGGCICVWSKEQYLSATANRKLAVAFLIFSW

SEQ ID NO: 118078 - protein, 57 aa, Glycine max
  Coding DNA Sequence Number=SeqID_1300
ERIIHKRWFKANLSQIWGRYYQGIKAKCLRKRASMGKEKNEGYSMDECSPRTYAFES

SEQ ID NO: 118079 - protein, 220 aa, Glycine max
  Coding DNA Sequence Number=SeqID_1301
  Gene Ontology: Mol. function=protein binding; Cellular component =membrane; Biological process=defense response
  Homolog annotation: Hit_ID=Q2HVE0; Match level="QueryCoverage=87%, HitCoverage=18%, E-value=8e-38, Identity=46%"; Hit description =Disease resistance protein; AAA ATPase
  Pfam annotation: Domain name=NB-ARC; Domain location=6-220; Score= -105.0; E_value=0.0014; Accession=PF00931.13; Description=NB-ARC domain
MKPPSLQRMPRPLVCFPEASIINSVGIHLKVVSQGKTTVAKVVYAKLCYEFESCCFLENVREQSQKHGLNYLHDKLLFELLKDEPPHNCTAEVVGSKFVLRRLANKKVLIVLNDVNGFEQLEYLAREFVCLGPGSRVIITTRDKHLLIRRVDKIHEVKELNFQDSLKLFSLVAFRDSNPQMEYIELSERAVAYTKGNPLALKVFGFTFPFQKYRSMGKCT

SEQ ID NO: 118080 - protein, 105 aa, Glycine max
  Coding DNA Sequence Number=SeqID_1302
MEIVVGVVEFSGTIESYNNYENMSTDFSHATIKSTRTEYSFNNLESGLQTFRGAEILYVDRSSAKQIAFSLPCWKPDRAVAHSGTLSSFNNSGTGSQTFDGLKFN

SEQ ID NO: 118081 - protein, 399 aa, Glycine max
  Coding DNA Sequence Number=SeqID_1303
  Gene Ontology: Mol. function=RNA-directed DNA polymerase activity; Cellular component=chromatin; Biological process=chromatin assembly or disassembly
  Homolog annotation: Hit_ID=Q6TU24; Match level="QueryCoverage=44%, HitCoverage=67%, E-value=4e-44, Identity=57%"; Hit description=TMV N disease resistance protein-like Mtg1957 protein
  Pfam annotation: Domain name=Chromo; Domain location=105-156; Score =24.9; E_value=0.00028; Accession=PF00385.14; Description='chromo' (CHRromatin Organisation MOdifier
  Pfam annotation: Domain name=LRR_1; Domain location=256-275; Score =1.2; E_value=1.7e+02; Accession=PF00560.23; Description=Leucine Rich Repeat
  Pfam annotation: Domain name=LRR_1; Domain location=277-298; Score =4.3; E_value=44; Accession=PF00560.23; Description=Leucine Rich Repeat
  Pfam annotation: Domain name=LRR_1; Domain location=300-321; Score =7.7; E_value=11; Accession=PF00560.23; Description=Leucine Rich Repeat
  Pfam annotation: Domain name=LRR_1; Domain location=323-348; Score =7.2; E_value=13; Accession=PF00560.23; Description=Leucine Rich Repeat
  Pfam annotation: Domain name=LRR_1; Domain location=374-395; Score =12.8; E_value=1.1; Accession=PF00560.23; Description=Leucine Rich Repeat
  Pfam module annotation: Pfam domain module=Chromo::LRR_1::LRR_1::LRR _1::LRR_1::LRR_1; Domain location=105-156::256-275::277-298::300 -321::323-348::374-395
MKDIADKKRCDVDFAEGDSVLVKLRPRRQSTVSGGNYTKLTKKFYGPFKVIQKIGPVAYKLDLPASSRIHPVFHCSLLRPYHPHSPSQETPATLPASAEDNYPLITPLTILDTKWQDSGNEKKLMVLVQWAGLLPEDTSWESWATLKETYNLEDKVVFDEGENVTINDSAQSNTEQSIIKHGEQGIESNTEAIQGVESKPETGTSMEKASRPKRGVIKPRLRCLHPSVLSSDTPVTLILDRCPKLERVEGEKHLKSLEKISVKGCSSLEKFAESSDLIENLDLSNTGIQTLNISIGRTHNLKWLNLEGLRLGHLLMELSCLISLKELKLSDSGFVIDKHQLHVLFDGLRPLQILYWKGCSNLFELPDNISVLSQLQELRLDGSNVKRLPESIKNLQVLE

SEQ ID NO: 118082 - protein, 92 aa, Glycine max
  Coding DNA Sequence Number=SeqID_1304
MNELLDKEAKKLDEKVRRFVEQKIGVEMKKAKLKETLERCEGQKMKLKQEAKNKQRLNEKWEGFRTAFADNCGAPVADDCWWHQPELLIFYY

SEQ ID NO: 118083 - protein, 303 aa, Glycine max
  Coding DNA Sequence Number=SeqID_1305
  Gene Ontology: Mol. function=protein binding; Cellular component =membrane; Biological process=defense response
  Homolog annotation: Hit_ID=Q2HVE0; Match level="QueryCoverage=93%, HitCoverage=31%, E-value=2e-37, Identity=36%"; Hit description =Disease resistance protein; AAA ATPase
  Pfam annotation: Domain name=LRR_1; Domain location=102-123; Score =8.9; E_value=6.3; Accession=PF00560.23; Description=Leucine Rich Repeat
  Pfam annotation: Domain name=LRR_1; Domain location=52-76; Score=7.0; E_value=14; Accession=PF00560.23; Description=Leucine Rich Repeat
  Pfam annotation: Domain name=LRR_1; Domain location=78-100; Score =8.2; E_value=8.5; Accession=PF00560.23; Description=Leucine Rich Repeat
  Pfam module annotation: Pfam domain module=LRR_1::LRR_1::LRR_1; Domain location=102-123::52-76::78-100
IFTDLRRNKRVELERDSNRNISISIGRLSKIEKLSVCQSLKYVPKELPSLTCLSELNLHNCRQLDMPNLHNLLDALRSVRKLILDECCNFSRVPCNIKHLWCLEYLSLRDCTGLRFIPQLPPSAEHLDAINCTSLETVLPLMPLRQPGQNDISISFENCLKLDEHSKYGITEYANFTMKHVAYANDSGSHHLNKRGGAVCFPGSKVPEWFENRTTTPACVTVQLPPPSHLLGFAFCVVLSQFQSNAKYEYHQIVCRWCLEDGKSVGYIRRWYYKAIRELNSDHVYVWYEPSCEKIIDILSDRH

SEQ ID NO: 118084 - protein, 77 aa, Glycine max
  Coding DNA Sequence Number=SeqID_1306
MAVGNSDETESNGIKTQVQNQEKDSSCYCLPGMSLVEAIMEIGKHLRWSNWEISGRFFVCLLIEKQMEKNRNRKMYS

SEQ ID NO: 118085 - protein, 109 aa, Glycine max
  Coding DNA Sequence Number=SeqID_1307
MTPSHDALLYHNGRWNMPRQGEFMGYLFTGKNPKRFDIPSGCSIDELKDVIKQVAPQGISPYGIHESQMVRRLFFRQPGHSEYSEKVIKFEIIDLKTDNDVLKVLVKSN

SEQ ID NO: 118086 - protein, 57 aa, Glycine max
  Coding DNA Sequence Number=SeqID_1308
  Homolog annotation: Hit_ID=Q1S0T1; Match level="QueryCoverage=96%, HitCoverage=4%, E-value=5e-09, Identity=65%"; Hit description=Cyclic peptide transporter
MARRVPTVIDSDMILSYGRQLVKYMMIDEPSKLMEVKLSSFAKLVAEYCSSCSRNSL

SEQ ID NO: 118087 - protein, 128 aa, Glycine max
  Coding DNA Sequence Number=SeqID_1309
  Gene Ontology: Mol. function=structural molecule activity; Cellular component=coated vesicle membrane; Biological process=intracellular protein transport
  Homolog annotation: Hit_ID=Q9MAZ9; Match level="QueryCoverage=80%, HitCoverage=57%, E-value=8e-42, Identity=86%"; Hit description =Nonclathrin coat protein zeta1-COP
  Pfam annotation: Domain name=Clat_adaptor_s; Domain location=2-100; Score=-23.4; E_value=2.7e-05; Accession=PF01217.10; Description =Clathrin adaptor complex small chain
MYFAEVTLLENNIIIYKFVQDLHFFVTGGEDENELILASVLQGFFDAVTLLLRSNVDKREALENLDLILLCLDEIVDGGMILETNGPLIAEKVTSHSLDADAPLSEQNNNVMLLDLQSDRKKLLIEIL

SEQ ID NO: 118088 - protein, 172 aa, Glycine max
  Coding DNA Sequence Number=SeqID_1310
MKKKKGTYLTWLVARLDTREKGAKRHRQWRDLTMVFPVARMSEERAMADWWSWRGVRYGGSFSSQIRNFGGRICDVVSGTGFACGYGGNEKVRVSVRERAPEMKKEHFPKTVLKSKPLLNTCVQRRKSVYKKTSYPIAQRLFAMRRYREGILYKRYCCIYILAFARCRTMVT

SEQ ID NO: 118089 - protein, 182 aa, Glycine max
  Coding DNA Sequence Number=SeqID_1311
  Gene Ontology: Mol. function=RNA-directed DNA polymerase activity; Biological process=RNA-dependent DNA replication
MEDGVSLKEKYPRLYQISQQQHQHIQQMGTIANTGWKWKLQWRRFFLEAEIDTVAKFMEDLQRLMGDSSGKYTMGSAYELLNRNLPLESQDETFKVLWKIKVSSKATVFAWRLIRKRLPTKNNLRRRNVEINDVTCPFCRSHDEDEAHLFFTCANMLPLWWESRSWVNIVGAFLENPKQHFL

SEQ ID NO: 118090 - protein, 107 aa, Glycine max
  Coding DNA Sequence Number=SeqID_1312
MRSNHVRLNWGITMPLIGLGTYSFPNDRKTTELAVNNALETNGSARVRMGATDVIASVKVGRGGDELRAKLSNALQCCLLGGKSGAGLFSPYSEDYAFPSMLRLFNL

SEQ ID NO: 118091 - protein, 68 aa, Glycine max
  Coding DNA Sequence Number=SeqID_1313
MRRSSWLNTGLKRLTAFGFIARSGFASWLITGLKRLTAFKFIDFTRIVEISSGLLGDWMQAWVMAEPG

SEQ ID NO: 118092 - protein, 121 aa, Glycine max
  Coding DNA Sequence Number=SeqID_1314
  Homolog annotation: Hit_ID=Q1PEY6; Match level="QueryCoverage=45%, HitCoverage=32%, E-value=9e-07, Identity=42%"; Hit description =Allergen-like
MIGGRLFCFLLAMQIVSLVSAVRKPFLPAQEQTLQSPPPDNIESKKGIEGTSETMKEAYDGGVSKIGSSPPSCEHKCYGCVPCEAIQVPSTSTRRSHLGIQYANYEPESWKCKCGLSFYSP

SEQ ID NO: 118093 - protein, 334 aa, Glycine max
  Coding DNA Sequence Number=SeqID_1315
  Homolog annotation: Hit_ID=Q2HVD0; Match level="QueryCoverage=95%, HitCoverage=74%, E-value=7e-57, Identity=44%"; Hit description=IQ calmodulin-binding region
  Pfam annotation: Domain name=IQ; Domain location=102-122; Score=20.9; E_value=0.0045; Accession=PF00612.17; Description=IQ calmodulin -binding motif
  Pfam annotation: Domain name=IQ; Domain location=80-100; Score=31.4; E_value=3.2e-06; Accession=PF00612.17; Description=IQ calmodulin -binding motif
  Pfam module annotation: Pfam domain module=IQ::IQ; Domain location =102-122::80-100
MSVLFRVRIHDRSTTEKGGGKSKRQWKLWKSTSEGFGIGSSMHKGQGGGGSFVVDGGAFAAALAAVVRTPLKDFMVIKQEWAAIRIQAVFRGFLARRALRALKAVVRLQAIFRGWQVRKQAAVTLRCMQALVRVQARVKARNVGNSQEGKYARCNEADPVKQAEQGWCDIPRTAEEAKLQMRQEGAIKRDRTKAYSQSKKKLTASPNSRASKSVIPLKNRKLDRKSSGWNMLDRWMAAKPWESRSMVEMYLDSPVMTPVTSKSDHLVLPFNSNQQIGTVKARRNGVTTRISTKSLTTSQSTPSSSAISSECMYDDSPMSTSCTSGSTARPSNNN

SEQ ID NO: 118094 - protein, 92 aa, Glycine max
  Coding DNA Sequence Number=SeqID_1316
MDVVYVTHTHPCEMKLIKLDCDTLRDTPLGNETLTIGVFASRIRVGLTIGASGTNVGTLAASTTAAGGVTSITTSSVTSAFGEQPFLHALNE

SEQ ID NO: 118095 - protein, 184 aa, Glycine max
  Coding DNA Sequence Number=SeqID_1317
  Gene Ontology: Mol. function=hydrolase activity; Biological process =aromatic compound metabolic process
  Homolog annotation: Hit_ID=Q6YVH6; Match level="QueryCoverage=87%, HitCoverage=50%, E-value=8e-43, Identity=49%"; Hit description =Hydrolase, alpha/beta fold family-like
  Subcellular localization annotation: CTP_CleavageSite=30; ConfidenceScore=5.08e-01
MVLGPLHSTGGTTFPNWLRNTSLGGFTALVAATGLPDLANGVALLNSAGQFGDGKRETKTSEETALQKFVLKPLKEVFQRVVLGFLFWQAKQPARILSVLKSVYINSSNVDDYLVESITRPAQDPNAGEVYYSQSESNQRVLSKNNSCELQAGHCPHDETPELVNKALLDWLTTLTSEVTLQTV

SEQ ID NO: 118096 - protein, 210 aa, Glycine max
  Coding DNA Sequence Number=SeqID_1318
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=63%, HitCoverage=70%, E-value=8e-62, Identity=84%"; Hit description =Anaphase-promoting complex subunit 10
  Pfam annotation: Domain name=APC10; Domain location=7-163; Score =188.5; E_value=1.6e-53; Accession=PF03256.7; Description=Anaphase -promoting complex, subunit 10 (APC10)
MAAESSEGEEETKLSGGSLLLTVDDDLTEMGKKAAWSVSSCKPGNGVSSLRDDNLETYWQSDGGQPHLVNIQFQKKVRLQLIVLYVDFKLDESYTPSKVSIRAGDGFHNLKEIKTVELVKPTGWVYLSLSGVDPRLEITELRCIGMMKSDLLPAFDHIVFGALSVLLNIFFDNLHKLLRPREAHHGSTIRHNGMFIWQSFSLPPCSAIHH

SEQ ID NO: 118097 - protein, 701 aa, Glycine max
  Coding DNA Sequence Number=SeqID_1319
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=93%, HitCoverage=93%, E-value=1e-155, Identity=46%"; Hit description=Bg55 protein
  Pfam annotation: Domain name=U-box; Domain location=272-344; Score =66.1; E_value=1.1e-16; Accession=PF04564.6; Description=U-box domain
MGTDGGEQIETLPNPRSFKVHRTMCTELRKLVDRILRIIPQIEAARPCGMQALCLLNKAIDKARQLLLYCSETSKLYLAITGDSILSKFQKARKSLAKSLVQILNMVPVMLAAEISRLIGDLECVTFVFDSAEEAAGKVVKRLLQQDPSTSDKDLMEESEIKDFQFVAARLGITSPTAILIEKRSIKKLLEKLKRNDQTKEIVLKNLLFLLIKHRKSITGEQMEVYSQIEVPITTENSGHESQENLHVKSDPYLSHGQYRTHAGDLSRLTPPKEYTCPISLRLMYDPVVIASGKTYERMWIQKWFDEGNTICPKTKKKLVHMALTPNIALKDLILKWCETNGVSIPDPSRLVQDCHSWEASSNSIRSFGSSLYDLNFPTDFSNMSLGSLDTNYNSDSSHTKANHSLNLMLNKSSDNSHRHQSRARIHDADWMHLSKLHERQWESQCQVIENIKMDFKCNCQAFCCVSSENFIDPLTRFLSTGCERHDVKALRAGTKLLLEFMKCCRNGMTNLSEDTCIMLESLLDTEVIGEALTIMEELTGNWYEKTNIAASSVLSSVSKILDSEGRVTVVETKGCISSVVEILETGSDEEKEPALVILLSLCSQRVEYCQLVMYEGIIPSLVNISNKGSDMAKAYALELLRLLKGDSEFEYEDCCEPNLNGSQEPNNNHYQEKKSSKKPSILKKLSLFSKSISVAPKTKR

SEQ ID NO: 118098 - protein, 138 aa, Glycine max
  Coding DNA Sequence Number=SeqID_1320
  Homolog annotation: Hit_ID=Q9LKZ6; Match level="QueryCoverage=28%, HitCoverage=3%, E-value=1e-12, Identity=82%"; Hit description =Receptor-like protein kinase 1
MPLLCHLYLGGNFFFGQIPLEYGTWQHIQYLALFGNEFAGNDLSYNMLSGEQVLLIWIWTESGIEEVGDGIGDGIVMAISEREGMKPLFFQRRVFFPLSESSVRYDRGELVAAEQVDSESDVSAVVRGGSRGGVLMIW

SEQ ID NO: 118099 - protein, 1445 aa, Glycine max
  Coding DNA Sequence Number=SeqID_1321
  Gene Ontology: Mol. function=heat shock protein binding; Cellular component=integral to membrane; Biological process=protein folding
  Homolog annotation: Hit_ID=O23230; Match level="QueryCoverage=98%, HitCoverage=96%, E-value=2e-54, Identity=25%"; Hit description =Trichohyalin like protein
  Pfam annotation: Domain name=TolA; Domain location=1006-1365; Score= -115.9; E_value=0.002; Accession=PF06519.2; Description=TolA protein
MESVAHSRQPPDKKITAGTGGFPAETLYDHVYGGAAKFTAGGHHHSLSPCFEDYGEIFASFHEPRASAIPVLDLPALDAAGEVFFDFRNAARDYSEIFRGFDGLDFWLSYEDLFRHGVSEEEDDDDDEEEEDWSPVETHSFSGDLELFGNNQGMSNGDHLRPFDGSTEFNISYHKVDGTSNEDISKGKSHISQLRADLEFTHVFDETTHFHRTDPSLQVVDDVDLDMEYNARQTKRNHLRKMDSQPGSFNSGELVLGGDLDWHDGCNRNGSHSSETFVTVSDISLRTLASQVPPPSRPPPALDAIQELTSRFHSNNEWVDSEETLGDTSPPFLDVEVDMNSSAAAVKEVMHRPEAKPRSAKELKERKKGVFQSNVHSSYDVKNNEAKVSVNITRFNSLNDEGMQATCDQRIGKNKVSATDERQKTRKAAPETLESLEEERLLQMFEEKHIKESRSSQESDRSTGVGTWKEATEFFELVGTEESGKLIQPINHSSTKSLVQDTRIHEHGKKEREAFNIEESKKKSKAGNGAYEQGKIIKKSKSSNEECRQRENVKNEEMVDIFELEMSEKARIVRSHGKTDKKVPKVDQSGSLKDMPETQCRELKRVEGEKPKKVDRQLLNEVQQSTKHIENEKKLKEDEQQQLSLRKLKQSKMKENGKIQREAFALGVAEVEQRVKGSVMLEKFERSNETFNLDSPEENMTGKRENIVILEQDKQFQNKKELKETCENEEIEKSLKGSFKLEENDEGLKHAPEQVQYEKGVQQDFELEMNEKITRVPFQQGENEAYERDQGKEKLGENYDGYRKGNRLKDVIDSKGVQKVLKQAPELEMYSGNEAQRKKEIESPSNQAFDREVIVAISHEDSHSKQSERMLKDADKNEKDKGLDKPLEQMEGGEGINMSFSKETNEAWKTESDENLLAAQSSSIHEENIRKPEVCQDPISDQEIEKTGSDCIVGGKKLEEVCVENLKDKGKKGASEMSQGEAEHSGKAASTATNVDGDEHSISCEMTRTEKTKTAPQMEFDPQSRERKIVTNGDYRRNTIAAEPATVQDPVNIQKPSQRSHVSHSTRSKEKILDETSASVDKDGERIRRERELEKDRLRKIEEEMERERERQKDRMAVDRAMLEAEREREREKDRIAVDKATLEARDRTFADARERAERAAFERATAEARQRALAEARERLEKACAEARDKTYADKAAAEARLKAERTAVERATAEARERAMEKVKVDRAAFESRERLERSVSDKFSVSFRNGGTQGSSSSDMLDPRCQNSTSFTHSRYPYSSVYGASSFSERSEREGESAQRCRARLERYRRTAERAAKALEEKNMRDLVAQKEQAERNRLAETLDTEVRRWSSGKEGNLRALLSTLQYILGPDSGWQPIPLTDVITSAAVKKAYRKATLCVHPDKLQQRGASIQNKYICEKLIYFEPSAKEDLSEQTIIMLHN

SEQ ID NO: 118100 - protein, 65 aa, Glycine max
  Coding DNA Sequence Number=SeqID_1322
MDVVTFSSSLSIHFLPLSEKHQRLLQGVDDNLYKVLSLSPNSATMDDIKKAYKSMALRLPPRCVP

SEQ ID NO: 118101 - protein, 388 aa, Glycine max
  Coding DNA Sequence Number=SeqID_1323
MQQILNNKDIHQIQNILLFNTNDDDDDAQIWKFALNGVVPTRFVTLRPLFFNRNKACSRKREEIMGSKNTSQSHASYLEDSTRFVFLPELGFVQKEFNALQQLALFCHNHLENPRHISFRFDHAVSVCLTLVDDRNLIDVGLSGYAYTCTRVGLSERLNRMLMNLEWHLLFQKPLCKSDHRLLLILQDRERTSIVFCEALRVVARIGIRGFSLSPMISKIGTGRVVAGIGASADTGGTIMASLVFKQSSGSSPCTTATIEQQTTDCDASTPPRGEDGAQTPPSCPRSYGDGEPDLKKDGDGGCELQCEHGLPRLLDAGNDGGLGGEVGGEEIGAFGATGDKATTIRGVEAEGVNIATGRDGDDGRGGGPNTTDNNLVRITKVNDEGKC

SEQ ID NO: 118102 - protein, 143 aa, Glycine max
  Coding DNA Sequence Number=SeqID_1324
  Gene Ontology: Mol. function=GTP binding; Cellular component =intracellular; Biological process=small GTPase mediated signal transduction
  Homolog annotation: Hit_ID=Q9FJZ2; Match level="QueryCoverage=84%, HitCoverage=34%, E-value=1e-47, Identity=72%"; Hit description=GTP -binding protein-like
  Pfam annotation: Domain name=KH_2; Domain location=72-136; Score =74.9; E_value=2.6e-19; Accession=PF07650.7; Description=KH domain
MCDDMHHCRNHAINIVPVSQIDIVSEHPERFFVAEIVREKIFMQYRNEIPYACQVNVVNYKARPNAKEYIQVEILVEKNSQKIILIGREGKALKLLATAARLDVEDFLQKKVYLEIEVKVRANWRQDEGLLNHYGYGGQIRVI

SEQ ID NO: 118103 - protein, 114 aa, Glycine max
  Coding DNA Sequence Number=SeqID_1325
  Homolog annotation: Hit_ID=Q1SKJ3; Match level="QueryCoverage=40%, HitCoverage=5%, E-value=6e-07, Identity=51%"; Hit description=Zinc finger, CCHC-type; Endonuclease/exonuclease/phosphatase
MDEIPCCNKKIFVTIIVPPVSALAPIPATTLVIYIAKHLPVPILEIIGERENPLIPIRATTLRASQKTIEVLVSQPRSKEMNQGKTFPYPEESTRACGPIYIEASGTANAIQGS

SEQ ID NO: 118104 - protein, 168 aa, Glycine max
  Coding DNA Sequence Number=SeqID_1326
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=O82782; Match level="QueryCoverage=97%, HitCoverage=47%, E-value=2e-54, Identity=66%"; Hit description=1-(5 -phosphoribosyl)-5-[(5- phosphoribosylamino)methylideneamino] imidazole-4-carboxamide ...
  Homolog annotation: Hit description=isomerase, chloroplast precursor
  Pfam annotation: Domain name=His_biosynth; Domain location=1-152; Score=-99.2; E_value=0.0006; Accession=PF00977.11; Description =Histidine biosynthesis protein
MDIGRLKDLVQIVGKERLVLDLSCRKKVLTFIFDVKGLKNPMCHNKGGEDGKYAIVTDRWQKFSDVFVDPDVMEFLANFADEFLVHGVDVEGKKLGIDEELVALLGKYSTIPVTYAGGVTEMADLERIRTAGMERVNVTVGSALDIFGGNLAYEDVVAWHAQQNASVV

SEQ ID NO: 118105 - protein, 143 aa, Glycine max
  Coding DNA Sequence Number=SeqID_1327
GEACRPARPGEPGCFLQKQQPSGGIFRKAQDAKYLKAANQRLHVIKLTCLLLTKGRITLGYLRMPPDLPSLDDKGVQITLGYLRMSSNLQSWMTKVRITLGYLRMSSDLQSGMTKARLPLVDKGADNPWVSSHVIGLAIWDEY

SEQ ID NO: 118106 - protein, 73 aa, Glycine max
  Coding DNA Sequence Number=SeqID_1328
  Subcellular localization annotation: CTP_CleavageSite=55; ConfidenceScore=5.25e-01
MWRLEFFKHLTHSISLTNSSYSHAVPSCIKFQSSSTRVWTYREMEIVEVAVALSNASALEESQLMRQNMEEQN

SEQ ID NO: 118107 - protein, 98 aa, Glycine max
  Coding DNA Sequence Number=SeqID_1329
  Homolog annotation: Hit_ID=Q304B9; Match level="QueryCoverage=57%, HitCoverage=7%, E-value=2e-15, Identity=73%"; Hit description =Neutral ceramidase precursor
AYIQEFKKIAEALVYGEPVEPGPQPPDLLEKQISLFPPVVVDATPLGVNFGDVCANVHRFTEDIDRCRIVNILRRSRDIDHLRMQCIYIGPSSLTVIE

SEQ ID NO: 118108 - protein, 105 aa, Glycine max
  Coding DNA Sequence Number=SeqID_1330
MENGIGLYILLLGSVQIKYTEAETNPFLSTPAMPLFVASITCHVLASMADTNLQAPFIIFHLSGIVGCEVLMWVLLTDIFWSYIFAVKDSRLVKARPVRRLALAY

SEQ ID NO: 118109 - protein, 174 aa, Glycine max
  Coding DNA Sequence Number=SeqID_1331
  Homolog annotation: Hit_ID=Q1T344; Match level="QueryCoverage=65%, HitCoverage=41%, E-value=1e-17, Identity=40%"; Hit description=RNA polymerase, RBP11-like
MDKDQWMYDSIMSEEVDMDDQNKQECGVNEQHIDSSDAFNTSQVFVIMRSDTQAGSRGRTSFVLIGCERSGQYRCRKKDCVRRDTGSRKCGCPFKFHGKPVIGEQGWMVKLMCGIQNHELAKSLVGHPYVGRLTMDEKTIIADKTKSMVKPRNILLTLKEPLKEHSVNSYTTIK

SEQ ID NO: 118110 - protein, 190 aa, Glycine max
  Coding DNA Sequence Number=SeqID_1332
MMLGEMESCLLVLTDIINVIARNPQGCREDIPAAKDVRSLSLGLSLGMKIHKAYLVLIALELTCIGIKYGVSNTNNPFQQSSLLMLFLTAIFSHVLASTADMTKQIIIITFHISGITGCETLLWILIHDFMCYCMVNLLLLLLAKFFFFNQVAQLVVYFFKYISQLLRQVSGSNVDQMSNLELQPQQDRV

SEQ ID NO: 118111 - protein, 230 aa, Glycine max
  Coding DNA Sequence Number=SeqID_1333
MSKYYKRVKTRNKCINLYLYLMYKEVQVQGFLLFPLQFSRLTTMLKVTTRCPCKGLLCSVFSPFGFYIALDGNLTRFHGKKANGGSKGDGALSCKGLLCLIFFALVLILLWTGKRCDLCLIPTRFHAKKANGGAEGHGALPMQGPSLFDFFSALVLILLWTGKRLTAVLKANSGAEGDGALPCKGLLCLIFFCLGFNIALDGKEKKGVTFHSNMIHRLTAVLKEKGVTFV

SEQ ID NO: 118112 - protein, 195 aa, Glycine max
  Coding DNA Sequence Number=SeqID_1334
  Gene Ontology: Mol. function=hydrolase activity, hydrolyzing O -glycosyl compounds; Cellular component=vacuole; Biological process =carbohydrate metabolic process
  Homolog annotation: Hit_ID=Q5UB04; Match level="QueryCoverage=99%, HitCoverage=38%, E-value=1e-47, Identity=52%"; Hit description=Beta -glycosidase
  Pfam annotation: Domain name=Glyco_hydro_1; Domain location=1-194; Score=-220.0; E_value=1.2e-07; Accession=PF00232.9; Description =Glycosyl hydrolase family 1
MILETMRNFVSKNLEIGSHGYAYGTKAPGRKSQGLRPDSGGTEPYRVSHNILLAHAKAVQLYRNSYKESQNGEIGITLDSRWFVPYSDASSDIEATERALDFEIGWFMEPLTSGKYPESMQLYVGRRLPEFSKEEAELVRGSFDFIGLNYYTTNTARVATGYTDSVHHHPDLSTDPNVELGLVTRLNGSSPIGPV

SEQ ID NO: 118113 - protein, 468 aa, Glycine max
  Coding DNA Sequence Number=SeqID_1335
  Subcellular localization annotation: CTP_CleavageSite=20; ConfidenceScore=5.55e-01
MDDEAIANGNGAPSPPCVVSVSALSGSRRRLSTSFVERSRLHFSSSEKLKPMAWVSLQGRLLNADEASSARTIGGGVFSAEQAIAWNLFPPIHRFLLVAVIGAAVARSRKDFQICQLKNSVQLRDQVLLNMQQKLDSLCELVVNNSKEHSTNKSCDKDGELQLNETLGAGKINFIDCGCWHCEQHSGFFNELMEGASIARSSGANEVLQYKMPFSNEDQEERRMSDMSDWASSVTSSADIQLNNLAVEQDMYNLRRDSEEKDTTIKELTSLLNSNEVANCKSTHYFYCYLKQRIAELEDFIRRKNATISKLKKDMLVLEQKVVQLTRLRRPSFSASGTNDGQPPHIMIDNLLYDMESTTSPSSSSDSDSSSVVKAPKLPTDVVLKQDFAPKLDQNPTPAKVSSSSGRVFERHSKSRSVSPRKEVSSSQKSNAASASAQKLLSARGDLKKNRRRSLNGDKSATAPKGWV

SEQ ID NO: 118114 - protein, 76 aa, Glycine max
  Coding DNA Sequence Number=SeqID_1336
MDHGGRGLYHVNIDPLREVENTLHITTSSLEYRLTWVVNVPKCSFGSEVPSYLSMFREFHVMGRGVSIMSSTKGCQ

SEQ ID NO: 118115 - protein, 288 aa, Glycine max
  Coding DNA Sequence Number=SeqID_1337
  Gene Ontology: Mol. function=zinc ion binding; Cellular component =nucleus; Biological process=transcription
  Homolog annotation: Hit_ID=Q9SWG3; Match level="QueryCoverage=95%, HitCoverage=34%, E-value=3e-63, Identity=45%"; Hit description=Far -red impaired response protein
  Pfam annotation: Domain name=FAR1; Domain location=28-229; Score =335.7; E_value=7.6e-98; Accession=PF03101.5; Description=FAR1 family
  Pfam annotation: Domain name=WRKY; Domain location=56-112; Score= -17.7; E_value=0.1; Accession=PF03106.6; Description=WRKY DNA -binding domain
  Pfam module annotation: Pfam domain module=FAR1::WRKY; Domain location=28-229::56-112
MDSSAVVGSTISEPHSDMEFESHEAAYAFYKEYAKSAGFGTAKLSSRRSRASKEFIDAKFSCIRYGNKQQSDDAINPRPSPKIGCKASMHVKRRQDGKWYVYSFVKEHNHELLPAQAHFFRSHRSSDPLSNDVRMRRRKNSNAVSKLFTAYQNVDCLENFVKHQHDKGRSLVLEAGHAHLLLELFMHMQEENPKFFYAVDLNEEHRLRNVFWVDAKGLEDFTYFSDVVSFDTTYFTSKYKIPLVMFIGVNHHIQPTLLGCALIADETIYTFAWLLQTWLIAMGERAPQ

SEQ ID NO: 118116 - protein, 205 aa, Glycine max
  Coding DNA Sequence Number=SeqID_1338
  Gene Ontology: Mol. function=metal ion binding; Biological process =metal ion transport
  Homolog annotation: Hit_ID=Q94CS5; Match level="QueryCoverage=75%, HitCoverage=81%, E-value=3e-19, Identity=36%"; Hit description=Heavy- metal-associated domain-containing protein-like
  Pfam annotation: Domain name=HMA; Domain location=105-167; Score =41.1; E_value=3.7e-09; Accession=PF00403.16; Description=Heavy-metal- associated domain
  Subcellular localization annotation: CTP_CleavageSite=10; ConfidenceScore=5.24e-01
MRNGFMCHSEASTAVCIAGSVVVPRTRSRRHQRSVSLDGTRLINYAKYSKLVDSSTSSRFNSAHKKCDSDSVSVPNIKHQENESRELQKKPTDNVFQGCLASMVVVMRVAIHCQGCAGKVKKHLSKMEGVTSFSVDVESKRVTVMGHISPVGVLESISKGCLRRDILFVEVFLEVQKAKKESIVNVNNRDKSQTSWLVSTLQDSY

SEQ ID NO: 118117 - protein, 244 aa, Glycine max
  Coding DNA Sequence Number=SeqID_1339
  Gene Ontology: Mol. function=transferase activity, transferring nitrogenous groups; Biological process=biosynthetic process
  Homolog annotation: Hit_ID=Q9ZQI7; Match level="QueryCoverage=82%, HitCoverage=49%, E-value=1e-76, Identity=64%"; Hit description =Putative aspartate aminotransferase
MAFQQQQVIKDMDQSKVKRSLYIIYVIQVIKCIYPAKTTFQTLRKAISLAFYKDQLLMGPNLKIAVQDPSFPAYIDSSVIIGQAAKFVDKAGKYKNIEYMTCGPQSDFFPDLPTISRTEPIFFNSPNNPTGHAATRKQLEQLVDFAKVNGSIIIFDSAYSAYVTDDSPKSIYETPGAREVAIEVSSFSKFAGFTGVRLGWTVVLEEILYSNGFPVVLDFNRIMCTCFNGASNITQAGGLASLSP

SEQ ID NO: 118118 - protein, 279 aa, Glycine max
  Coding DNA Sequence Number=SeqID_1340
  Gene Ontology: Mol. function=protein serine/threonine kinase activity; Cellular component=membrane; Biological process=protein amino acid phosphorylation
  Homolog annotation: Hit_ID=Q9LT38; Match level="QueryCoverage=95%, HitCoverage=72%, E-value=8e-73, Identity=59%"; Hit description =Protein kinase-like protein
MATGHIRNTWVGQAHDEVRQRRFLPHKLRRLEQHVSKRLLAIRPLERRRSVEHLVGQNSEGPPVDGEVVPLGAEDLRRDVLLGADEGGGSHETEFASVDRADSGGLGVFVFSVEWEWEWDPAAVFAGRRRSSGVGGNINGGREGTGEVEVGEGDVSGLLDEDVFGFEVAVGDVHGMEVLESAEDLGDIEADDGGGEDVISLAVAEGVEVAAGAPNKEGRKGCEWDKRERTFISQRARRGASWWEDDLSTTFSATWELLFSSWTRNTVPMPPLPNTFTAL

SEQ ID NO: 118119 - protein, 121 aa, Glycine max
  Coding DNA Sequence Number=SeqID_1341
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SKN4; Match level="QueryCoverage=88%, HitCoverage=26%, E-value=8e-39, Identity=68%"; Hit description =Glycoside hydrolase, family 1
MLKVFAVIELVLLIVYPGAHGLSRDDFPPGFVFGASTSAYQVEGAANEDGRKPSIWDTFSQAGNGNMYAGNGDVACDQYHKYKEDVQLMADTGLEAYRFSISWSRVIPGEIIKLLSWRFLN

SEQ ID NO: 118120 - protein, 368 aa, Glycine max
  Coding DNA Sequence Number=SeqID_1342
  Gene Ontology: Mol. function=protein serine/threonine kinase activity; Cellular component=cytoplasm; Biological process=protein amino acid phosphorylation
  Homolog annotation: Hit_ID=Q9LT38; Match level="QueryCoverage=91%, HitCoverage=89%, E-value=4e-89, Identity=51%"; Hit description =Protein kinase-like protein
  Pfam annotation: Domain name=Pkinase; Domain location=10-314; Score =187.8; E_value=2.7e-53; Accession=PF00069.15; Description=Protein kinase domain
  Pfam annotation: Domain name=Pkinase_Tyr; Domain location=10-297; Score=-54.5; E_value=4e-09; Accession=PF07714.7; Description=Protein tyrosine kinase
  Pfam module annotation: Pfam domain module=Pkinase::Pkinase_Tyr; Domain location=10-314::10-297
MAEELKLDNLKAVKVLGKGGMGTVFLVQLENNNSHVALKVVDKSSSHHDAPRRARWEMNVLSRLSHSHPFLPSLLGSFHSQNLMGWAVPYCPGGDLNALRYRQTDHVFSPAVIRFYVAEILCALQHLHSMNIAYRDLKPENVLIQQSGHVTLTDFDLSRTLSPSVNIPSNTTTPPPSRKHRRWVPLPLPLHAKNKNPKPARVSPVNRRKLSFVRSTSFVGTEEYIAPEVLRAEGHDFSVDWWALGVLTYEMLYGTTPFKGTNRKETFRNVLFKPPETPPSVWGYVRGASEIKEHQSFRGGKWDLLTEVLRPPFIPSRDDVDATTTKSFAAGLDIKGYFQSLKSPPSLPPSPLRSPSFEFQNNVSLPEF

SEQ ID NO: 118121 - protein, 129 aa, Glycine max
  Coding DNA Sequence Number=SeqID_1343
MLCSCSWLLWVYKFTIGTLLLTFDKNQLNVSAVYQGRERLVEWKKDPLFPNATLYWNTIIYGIYHLPHFLQNAGHFKIDALLKIHCFVDGKDEVSLKLQEEQHGHGKDEVSITKKSVTELTIKLTRTLR

SEQ ID NO: 118122 - protein, 87 aa, Glycine max
  Coding DNA Sequence Number=SeqID_1344
  Gene Ontology: Mol. function=protein binding; Biological process =protein amino acid phosphorylation
  Homolog annotation: Hit_ID=Q0R4K1; Match level="QueryCoverage=51%, HitCoverage=19%, E-value=2e-18, Identity=91%"; Hit description =Leucine rich repeat protein 1
  Pfam annotation: Domain name=LRRNT_2; Domain location=16-56; Score =43.2; E_value=8.7e-10; Accession=PF08263.3; Description=Leucine rich repeat N-terminal domain
MAWVRQFIGLHYLRMACQNGDALNALKSNLQDPNNVLQSWDATLVNPCTWFHVTCNSDNSVTRVSFWSTGFTTWSTYKFAVLYLYME

SEQ ID NO: 118123 - protein, 79 aa, Glycine max
  Coding DNA Sequence Number=SeqID_1345
MKSLSPCFFNLINNCFPNPHTPLDLHNIHQAQKHLDLVEQPKIELWVAPSSLLSALTSESEAKISVGCAQVTACYTYIA

SEQ ID NO: 118124 - protein, 217 aa, Glycine max
  Coding DNA Sequence Number=SeqID_1346
MDAEKHEELEPEKRNANRGRILAFQRSDFFSLFVAEYGSPSKEKVGPFCSTQMGTSKQKNLEALPLSHAAFSSFLPPPLLPNKASTFGANFRSKSQKEGISGVVKRVSTCGTSKFQLVLFECCITLMLGKLGRIDEDPVLRETRIWATWEYVSSVGGGQQGKYVGAPLVKWAKVEAMSSSRRKGSLMVEKGSPNDHYERGWCEKKNDDDDDVLDKWP

SEQ ID NO: 118125 - protein, 75 aa, Glycine max
  Coding DNA Sequence Number=SeqID_1347
MAMGLSVRRCAKPESTRGMEEEREHGKQEEVMAFALSMSIALGVRPGCYSCINGPTLGERDLLSAPRTTFFGLRS

SEQ ID NO: 118126 - protein, 109 aa, Glycine max
  Coding DNA Sequence Number=SeqID_1348
  Gene Ontology: Mol. function=DNA binding; Biological process=DNA integration
  Homolog annotation: Hit_ID=Q1SQ35; Match level="QueryCoverage=86%, HitCoverage=87%, E-value=2e-28, Identity=61%"; Hit description=Pol -related
MTLNVYESSKIYKQKMKAYHDQKLLKRNFQLGQQVLLFNSRLKLFPKRLKSKWSSPFTIKDVKPYEAIKLMDPSSTDPEQSWIMNGQRLKIYNGGNIERLATIIHLQDP

SEQ ID NO: 118127 - protein, 82 aa, Glycine max
  Coding DNA Sequence Number=SeqID_1349
  Subcellular localization annotation: CTP_CleavageSite=35; ConfidenceScore=5.20e-01
MDMDLGNMIKLLTSLSPILRESPSALPLAASLVTRGFLGAGRLARGPAFLCPGRGVTPLELELMLMSVMMMLQMVVMTRTML

SEQ ID NO: 118128 - protein, 398 aa, Glycine max
  Coding DNA Sequence Number=SeqID_1350
  Gene Ontology: Mol. function=protein-tyrosine kinase activity; Cellular component=chloroplast; Biological process=protein amino acid phosphorylation
  Homolog annotation: Hit_ID=Q56I14; Match level="QueryCoverage=98%, HitCoverage=79%, E-value=0.0, Identity=87%"; Hit description=TPR -containing protein kinase
  Pfam annotation: Domain name=Pkinase; Domain location=1-217; Score= -41.8; E_value=4.5e-06; Accession=PF00069.15; Description=Protein kinase domain
  Pfam annotation: Domain name=Pkinase_Tyr; Domain location=3-217; Score=-71.5; E_value=4.4e-08; Accession=PF07714.7; Description =Protein tyrosine kinase
  Pfam module annotation: Pfam domain module=Pkinase::Pkinase_Tyr; Domain location=1-217::3-217
MFVNCEWKEEARAVGQLRNERLANLVGCCCEGEERLLVAEFMPNETLSKHLFHWESQPMKWAMRLRVALYLAQALEYCSSKGRALYHDLNAYRVLFDQDGNPRLSCFGLMKNSRDGRSYSTNLAFTPPEYLRTGRITRESVIYSFGTLLLDLLSGKHIPPSHALDLIRGKNFLMLVDSCLEGHISNDDGTEIVRLASRCLQYEPRERPNAKSLVTALAPLQKETSVPSQVLLGIPDEITPSKEAVPLTPFGEACSRRDLTSIYEILETVGYKDDEDVANELSFQVWTDQIQETLNSKKQGDSAFHARDFSKAIECYTQFIDGGTMVSPTVYARRCFCYLMINMVQEALGDAMQAQSVSPTWPIAFYLQAVALFSLGMDHDAEESLKDATTLETRKHRN

SEQ ID NO: 118129 - protein, 96 aa, Glycine max
  Coding DNA Sequence Number=SeqID_1351
MPLVSSPATGGRDGGGSASVGRSFSDREKGIKVWLVDGGEMSRGGTAGGGAAGMSGMARVLTCFGPMKTLEDSTGFTTSLVSSSYRNIEFKCPQQD

SEQ ID NO: 118130 - protein, 246 aa, Glycine max
  Coding DNA Sequence Number=SeqID_1352
  Gene Ontology: Mol. function=metal ion transporter activity; Cellular component=membrane; Biological process=metal ion transport
  Homolog annotation: Hit_ID=Q6H7N1; Match level="QueryCoverage=72%, HitCoverage=64%, E-value=2e-71, Identity=77%"; Hit description =Putative Zinc transporter zupT
  Pfam annotation: Domain name=Zip; Domain location=6-234; Score=-24.0; E_value=5.8e-05; Accession=PF02535.12; Description=ZIP Zinc transporter
  Subcellular localization annotation: CTP_CleavageSite=83; ConfidenceScore=5.13e-01
MDSQVAVALALSLVGGVSTSIGALFVIVNKAPSLKMLGLLQGFAAGLMLSISFFDLAHNALNSLGFLKGNLWFFAGVIFFAVVASFIPEPTLTPTSDVKGRKKNGDEGGKDIMKKHRRQVLFSGIVTAVGISLHNFPEGMAVFLGSLKGLRVGINLALAIALHNIPEGVAVALPVYFATQRGSSLCEGMGEGCCTQPYPCICKEAVSGFEPMTNKSPKHNFTAAPGLALIYIYMFSWEICSQWLSR

SEQ ID NO: 118131 - protein, 88 aa, Glycine max
  Coding DNA Sequence Number=SeqID_1353
MKIYWCHRHVFNPDECNIIVLDEIAIKLQRTVTRARALIVGEVVATLEEDVDSIEGGRDGEVVVVDKGDGVNEGMKSELTIFSWEKFE

SEQ ID NO: 118132 - protein, 116 aa, Glycine max
  Coding DNA Sequence Number=SeqID_1354
MADHGTRKTTTDRLEDAIARLTNSQANLNERYTNISDKVDSILDHLRLRDEHQNQTSVSNTNGHRNTVKLDIPRFDGRDPMGWIFKMNQLFQYQHTPEEERITVASLYLDGAALHI

SEQ ID NO: 118133 - protein, 1098 aa, Glycine max
  Coding DNA Sequence Number=SeqID_1355
  Gene Ontology: Mol. function=RNA-directed DNA polymerase activity; Cellular component=chromatin; Biological process=chromatin assembly or disassembly
  Pfam annotation: Domain name=Chromo; Domain location=1002-1050; Score= 20.2; E_value=0.0041; Accession=PF00385.14; Description='chromo' (CHRromatin Organisation MOdifier
  Pfam annotation: Domain name=RVP; Domain location=8-112; Score=-13.8; E_value=0.088; Accession=PF00077.10; Description=Retroviral aspartyl protease
  Pfam annotation: Domain name=RVP_2; Domain location=11-126; Score= -32.2; E_value=0.00033; Accession=PF08284.2; Description=Retroviral aspartyl protease
  Pfam annotation: Domain name=RnaseH; Domain location=444-565; Score= -28.8; E_value=0.028; Accession=PF00075.14; Description=RNase H
  Pfam annotation: Domain name=rve; Domain location=699-855; Score =106.0; E_value=1.1e-28; Accession=PF00665.16; Description=Integrase core domain
  Pfam annotation: Domain name=zf-H2C2; Domain location=640-681; Score =14.0; E_value=0.005; Accession=PF09337.1; Description=His(2)-Cys(2) zinc finger
  Pfam module annotation: Pfam domain module=Chromo::RVP::RVP_2::RVT _1::RnaseH::rve::zf-H2C2; Domain location=1002-1050::8-112::11 -126::252-421::444-565::699-855::640-681
LHAMSGLPSSKTFRVYGSIRNTRITVLIDSGSTHNFLQPRVAHFLHLPIEDTQPLRVLVGNGSTLDCNKRCPNTPLHIQGHSFSITFHLLEISGADAVLGIEWLKQFGQVTTDYTFFMMRFNHLGQEVSLRADVATGPEPASATQVKRMLHTGSTSALFHLRIIPTNPIDETTTHLPHSLESITKLILRYDQLFQPPKSLPPSREVNHRITLLPSTAPVNVRPYRYPHFQKAEIERQIAELLSPGFVRPSTSPYSSPILLVKKKDGTWRLCVDYRSLNAITVRDRFPIPTIDELLDELGHASWFTKLDLRQGFHQILMNDADVEKTAFRTHHGHYEYLVMPFGLCNAPSTFQVAMNRLLAPFLRRFAAVFFDDILVYSSSLSSHVQHLDLIFQALLRNEFYLKRTKCLFAQRELEYLGHVVSEAFDTLKSAMINTPVLALPNFHEPFVVETDASGTAMGAVLSQQGHPLAFFSKNFNPRLLNASTYVRELHAITSAVRKWRQYLLGSSFTILTDHKSLRELMTQVIQTPEQHYYLSKLLGFDYTIQYKTGATNVVADALSRRPPEPGELLILSVPQFDFLRNIHQALVSDPEFQSLLTRVQENPSAYPQYRIHNGFLLFNNRIWLNKTNPYITTLLSEFHATPLGGHFGVAKTLHRLEASFFWQGQKQDVQKHIRECKVCQQSKTSTHRPAGLLQPLPAPVGVWEDISMDFVTHLPPSSGFTVIMVVVDRYSKGVHLGALPTGFSAFKVAMLFVEIVCKHHGFPKSIVSDRDPVFLSAFWRELFRLSGTHLRLSTTYHPQSDGQTEVVNRVLEQYLRCFVNSQPSSWFRYLALAEWCYNTSLHSSSGLTPFEVIYGKPPPTIPQYIPGFTNNEVVASLVQSRQDIHTKLQKQLKKAQASMKKYADAHRDDVTFNEGQWVYVKLRPTRQRSATGPHHPKLSKRYFGPFKILAKVGEVAYRLALPAEARIHPVFHCSLLRRHHGPSPSSTEPWNLEIVGQRPKQRPLCILDRRLDTSTYPPTKLVLVQWVGQPPEDISWESWLELQEAYHLEDKVVFEDDGIVSNQVHEEEDNTHEDASVVPTRPARAITKPRYLQDYVS

SEQ ID NO: 118134 - protein, 75 aa, Glycine max
  Coding DNA Sequence Number=SeqID_1356
  Gene Ontology: Mol. function=oxidoreductase activity; Biological process=response to oxidative stress
  Homolog annotation: Hit_ID=Q2WEC9; Match level="QueryCoverage=68%, HitCoverage=15%, E-value=1e-14, Identity=71%"; Hit description =Cationic peroxidase precursor
  Subcellular localization annotation: CTP_CleavageSite=39; ConfidenceScore=5.15e-01
MGTSACQFLSYRMHNFTANGGPDPSIITSFLSQLGALCPQNSGASNRVALDTETFVEDYSDSSMHCKVYGEDGQH

SEQ ID NO: 118135 - protein, 481 aa, Glycine max
  Coding DNA Sequence Number=SeqID_1357
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=97%, HitCoverage=96%, E-value=1e-152, Identity=55%"; Hit description =Glucosyltransferase-10
  Pfam annotation: Domain name=UDPGT; Domain location=13-480; Score= -10.7; E_value=4.4e-10; Accession=PF00201.9; Description=UDP -glucoronosyl and UDP-glucosyl transferase
MMGLLGGTKKPHAVLIPFPSQGHINPFLKLAKLLHSNGFHITFVNTDFNHQRLVKSRGPNALIGFPNFQFETIPDGLPPSNMDSTQSIPALCDSTRKHCLIPFCNLISKLNHSHAPPVTCIFSDGVMSFTIKASQQFGLPNILFWTHSACAFMSFKECKNLMERGLIPLKDANYLTNGHLDSAIDWIPGLKNITLRDLPGIYRTTDPNDILLDFLVEQIEATSKASAIILPTFDALEHDVLNALSTMFPKLYTIGPLELLLVQTSESTFDSIKCNLWKEESECLKWLDSQEPNSVLYVNFGSVIVMRHQQLVELAWGLANSKKKFMWVIRPDLVEGEASILPPEIVEETKDRGLLVGWCPQEQVLKHPAVAGFLTHCGWNSTLESITNGVPLICCPFFNDQTLNCRYISREWAFGMEMDSDNVTRAEVEKLVKELLEGEKGKEMKKKAIEWKKLAQEATHTNGSSFLNLEKLVNELLFVKS

SEQ ID NO: 118136 - protein, 175 aa, Glycine max
  Coding DNA Sequence Number=SeqID_1358
  Gene Ontology: Mol. function=RNA-directed DNA polymerase activity; Cellular component=chromatin; Biological process=chromatin assembly or disassembly
MADHGTRKTTTDRLEDAIARLTNSQANLNERYTNISDKVDSILDHLRLRDEHQNQTSVSNTNGHRNTVKLDIPRFDGRDPMGWIFKMNQLFQYQHTPEEERITVASLYLDGAALSWYQWMFTNGLITSWQGFLQALESRFAPTFYDDPKGTLFKLVQRGSVNEYLTEFERLANRV

SEQ ID NO: 118137 - protein, 110 aa, Glycine max
  Coding DNA Sequence Number=SeqID_1359
MQGDNDANSKKQFDPCSKETNKETNVEPGDVSNKKDDMCPTNVEHEDAEQRDVPNEKDDMECTTNSNIHVSDNNVRRLPMMINNNFASKENQMTKLWDYYTKYKRFYKDQ

SEQ ID NO: 118138 - protein, 191 aa, Glycine max
  Coding DNA Sequence Number=SeqID_1360
  Gene Ontology: Mol. function=DNA binding; Cellular component=nucleus; Biological process=regulation of transcription
  Homolog annotation: Hit_ID=Q9FLG5; Match level="QueryCoverage=89%, HitCoverage=91%, E-value=2e-59, Identity=60%"; Hit description =Similarity to NAM
  Pfam annotation: Domain name=NAM; Domain location=8-129; Score=151.8; E_value=1.8e-42; Accession=PF02365.6; Description=No apical meristem (NAM) protein
MGDNNVNLPPGFRFYPTDEELVVHFLHRKASLLPCHPDVIPDLEVYPYDPWELDGRALAEGNQWYYYSRRTQNRVTGNGYWKPTGIEEPVVSSTSNKRVGMKKYFVFHVGEAPAAGIKTNWIMQEYRLSDSSSSTRSSKRKSQPKIEYNKWVICRVYERNGDDDNGTELSCLDEVFLSLDDDLDEISLPNY

SEQ ID NO: 118139 - protein, 177 aa, Glycine max
  Coding DNA Sequence Number=SeqID_1361
  Gene Ontology: Mol. function=two-component response regulator activity; Cellular component=membrane; Biological process=negative regulation of ethylene mediated signaling pathway
  Homolog annotation: Hit_ID=Q9ZTP3; Match level="QueryCoverage=84%, HitCoverage=21%, E-value=3e-45, Identity=58%"; Hit description =Putative ethylene receptor
  Pfam annotation: Domain name=Response_reg; Domain location=40-156; Score=80.5; E_value=5.1e-21; Accession=PF00072.14; Description =Response regulator receiver domain
MDFSVVFLGLLWDMLQLVLPSLENSIFAPKDYSSSQFRGLKVVLTEDDGVNRTVTKKLLEKLGCQVISVSSGLECLSAISGASNSFRIILLDLRMPEMDGFEVAKRIRRFHSHSWPLIIALIASAEEHVREKCLLAGMNGLIQKPIVLHQIADELRTILQRAGESTVFESMLGFKKI

SEQ ID NO: 118140 - protein, 115 aa, Glycine max
  Coding DNA Sequence Number=SeqID_1362
  Gene Ontology: Mol. function=two-component sensor activity; Cellular component=membrane; Biological process=signal transduction
  Homolog annotation: Hit_ID=Q8W229; Match level="QueryCoverage=77%, HitCoverage=19%, E-value=2e-20, Identity=49%"; Hit description =Putative ethylene receptor
MASQARKSLQNVMSHGMWRAIHCIMGMLSLFQEDNLRSEQKIVGDIMLKMKPFLLHSMMREAASTAKCLCVYEGFGFEIDVQKSLPETVMVFLESDGGDRDDKNIGIWRSNSQNE

SEQ ID NO: 118141 - protein, 210 aa, Glycine max
  Coding DNA Sequence Number=SeqID_1363
  Gene Ontology: Mol. function=aminoacyl-tRNA ligase activity; Cellular component=mitochondrion; Biological process=tRNA aminoacylation for protein translation
  Homolog annotation: Hit_ID=O23627; Match level="QueryCoverage=65%, HitCoverage=20%, E-value=1e-52, Identity=70%"; Hit description =Glycyl-tRNA synthetase 1, mitochondrial precursor
  Pfam annotation: Domain name=WHEP-TRS; Domain location=4-54; Score =17.8; E_value=0.00014; Accession=PF00458.10; Description=WHEP-TRS domain
PSPAVEAQGNTVRALKASKAAQPEIDAAIEALNALKLEKSSIERSLLGGSDCRKAFRQSVVNTLERRLFYIPSFKIYRGVAGLFDYGPPGCSVKSNVLSFWRQHFVLEENMVEVDCPCVTPEIVLKASRRRDERENKRGTSLEEMREGVNTWRIVEAEEEPESLLLRRWRCRPRRWASERPRVIRRLAGGNHRTYGGGFLAVSAVLRGVV

SEQ ID NO: 118142 - protein, 102 aa, Glycine max
  Coding DNA Sequence Number=SeqID_1364
  Homolog annotation: Hit_ID=Q8W229; Match level="QueryCoverage=56%, HitCoverage=9%, E-value=2e-11, Identity=62%"; Hit description =Putative ethylene receptor
MGVMILRPNSAPGAASSGSSVELGAVAAIHIPFLHVSNFKVQALEVSANETEYGRAKLRTATGLLESNDGQPGKEVVSECHEPWNVEGYALYSGDAVIVSRG

SEQ ID NO: 118143 - protein, 494 aa, Glycine max
  Coding DNA Sequence Number=SeqID_1365
  Gene Ontology: Mol. function=nucleoside-triphosphatase activity; Cellular component=nucleus; Biological process=regulation of transcription, DNA-dependent
  Homolog annotation: Hit_ID=Q9FJW0; Match level="QueryCoverage=99%, HitCoverage=99%, E-value=0.0, Identity=73%"; Hit description=RuvB DNA helicase-like protein
  Pfam annotation: Domain name=AAA; Domain location=68-441; Score=-1.9; E_value=0.00029; Accession=PF00004.19; Description=ATPase family associated with various cellular activities (AAA)
  Pfam annotation: Domain name=Mg_chelatase; Domain location=56-184; Score=-157.3; E_value=0.099; Accession=PF01078.11; Description =Magnesium chelatase, subunit ChlI
  Pfam annotation: Domain name=TIP49; Domain location=120-462; Score =703.9; E_value=1.1e-208; Accession=PF06068.3; Description=TIP49 C -terminus
  Pfam module annotation: Pfam domain module=AAA::Mg_chelatase::TIP49; Domain location=68-441::56-184::120-462
MAELKLSESRDLTRIERVGAHSHIRGLGLDSSLEPRAVSDGMVGQTAARKAAGVILQMIKDGKIAGRAVLLAGQPGTGKTAIAMGMAKSLGLETPFAMIAASEIFSLEMSKTEALTQAFRKAIGVRIKEEAEVIEGEVVEVQIDRPAVSGAAAKTGKLTLKTTEMETVYDLGAKMIEALGKEKVSSGDVIAIDKASGKITKLGRSFSRSRDFDAMGPQVKFVQCPDGELQKRKEVVHCVTLHEIDVINSRIEFLKNNMGIYIDASNVHGVEMELEFRLVKRGFLALFTGDTGEIRAEVREQIDTKVAEWREEGKAEIVPGVLFIDEVHMLDIECFSFLNRALENDMAPILVVATNRGITTIRGTNYKSPHGIPIDLLDRLLIISTQPYTEDEIRKILDIRCQEEDVDMSEGAKCLLTKIGVETSLRYAIHLITAAALACQKQKGKTVELDDINRVYNLFLDVKRSTQYLMEYQSQYMFNETGEADEDEANAMVS

SEQ ID NO: 118144 - protein, 179 aa, Glycine max
  Coding DNA Sequence Number=SeqID_1366
  Gene Ontology: Mol. function=binding
MKGMGKMKRSINYFNTWDNFHVINIKGESVTTLGYWDNIKACGLSRRVARLVNISSTLHELPPPSSPSLTISAAMPTPSASSDPILDRLASSDCAVKFKAIREVKNHIIGNRTKKHSYIKLGAVPVVAAALADSDPNLIVQSAAALGSFACGVDDGVRAVLDAGAFPRLIGLLSAHDEK

SEQ ID NO: 118145 - protein, 45 aa, Glycine max
  Coding DNA Sequence Number=SeqID_1367
MEQQLTDIFEEVNEQLSDVVEEDEFGQHGGCKDMGKYSSEEKQKA

SEQ ID NO: 118146 - protein, 544 aa, Glycine max
  Coding DNA Sequence Number=SeqID_1368
  Gene Ontology: Mol. function=binding; Cellular component=cytosol
  Homolog annotation: Hit_ID=Q2R0N3; Match level="QueryCoverage=97%, HitCoverage=99%, E-value=1e-129, Identity=47%"; Hit description =Armadillo/beta-catenin-like repeat family protein, expressed
  Pfam annotation: Domain name=Arm; Domain location=229-269; Score=4.1; E_value=3.7; Accession=PF00514.13; Description=Armadillobeta-catenin -like repeat
  Pfam annotation: Domain name=Arm; Domain location=272-312; Score =19.0; E_value=0.017; Accession=PF00514.13; Description=Armadillobeta- catenin-like repeat
  Pfam annotation: Domain name=Arm; Domain location=314-354; Score =38.1; E_value=3.1e-08; Accession=PF00514.13; Description =Armadillobeta-catenin-like repeat
  Pfam annotation: Domain name=Arm; Domain location=448-491; Score=4.4; E_value=3.4; Accession=PF00514.13; Description=Armadillobeta-catenin -like repeat
  Pfam annotation: Domain name=HEAT; Domain location=107-143; Score =8.1; E_value=4.4; Accession=PF02985.12; Description=HEAT repeat
  Pfam annotation: Domain name=HEAT; Domain location=234-271; Score =25.1; E_value=0.00025; Accession=PF02985.12; Description=HEAT repeat
  Pfam annotation: Domain name=HEAT; Domain location=283-314; Score =7.3; E_value=5.5; Accession=PF02985.12; Description=HEAT repeat
  Pfam annotation: Domain name=HEAT; Domain location=325-356; Score =4.6; E_value=12; Accession=PF02985.12; Description=HEAT repeat
  Pfam annotation: Domain name=HEAT; Domain location=367-399; Score =9.8; E_value=2.7; Accession=PF02985.12; Description=HEAT repeat
  Pfam annotation: Domain name=HEAT; Domain location=461-493; Score =4.9; E_value=11; Accession=PF02985.12; Description=HEAT repeat
  Pfam annotation: Domain name=HEAT; Domain location=504-539; Score =6.6; E_value=6.7; Accession=PF02985.12; Description=HEAT repeat
  Pfam module annotation: Pfam domain module=Arm::Arm::Arm::Arm::HEAT::H EAT::HEAT::HEAT::HEAT::HEAT::HEAT; Domain location=229-269::272 -312::314-354::448-491::107-143::234-271::283-314::325-356::367 -399::461-493::504-539
VVDAAARSLRMIYQSMLAPKYDFFQEENMQFLLSLLKSENENLTGLGAGIVIHSCKTIGEQNILCHAGVLEKLTSLLEGSLSQRDASLESLAAIIRDNPVSVSEFVELHSGRALHSVTELTKDRYPRTRLLACLCLISVKNSSTCYLQDVGIKTKLVYILLELLDDSGQVGDEASFAFSRLIAEKEDLQKLAFEANAINKFNCLLQKRPVHPKRLEGVFLALADLCSKLECCRSSFLSLQVLNLVVDALTHEDASVRTAACICLRSVSRSIKNLSAGRFMNERVVFPLVQLLSDLSTSVQVAALGAISNIVVDFMPHKSTFIQCGGIKELVQLTKSMDSSLRLNAVWALRNMVFLADKICKEGIFVELTASSMASLICDPEPSVQEQALALVRNFVDGCVYSVEHAFAEDGIILDAVGRQLQKSSKIEIGIQGMYVLNNIASGNEFHKEAVMQLLFPQDENGSHSFFEQFLQSHDSRLRTAAVWVIVNLTFPASPGAFGRIVNLRSFGIVSRIKKMSNDSCMDVKLRARLALGQILTFGDSQMQ

SEQ ID NO: 118147 - protein, 75 aa, Glycine max
  Coding DNA Sequence Number=SeqID_1369
MGTLWPVVDDEKQQRLWNRITPAQQRQWLTVVDDEIQLERSSASKMKTRTGTCPEGTYEATGTGPVRFRSPEDDA

SEQ ID NO: 118148 - protein, 221 aa, Glycine max
  Coding DNA Sequence Number=SeqID_1370
MKALENSVEFLKWVTSKYNSQLLEIKKSVEQINSNKQMLGKWIIRSIGGAHFDLIRETVMKRLLRSYILYKGWWVCNFDPQMLIFVIMVEGAMFHLGEPLHFDLVSSKVQHHKHLSTKKLELDSFPMRSMSKAKEDVFHCGQPFGPVDKCPEKGMGVMILHSCLKMKTWLRTGRLSKLKGEMTSRNSHARGIPNFYLDDKIEFQSACYCYDIREREIVRES

SEQ ID NO: 118149 - protein, 182 aa, Glycine max
  Coding DNA Sequence Number=SeqID_1371
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=74%, E-value=2e-75, Identity=70%"; Hit description =Apocytochrome f precursor
  Pfam annotation: Domain name=Apocytochr_F_C; Domain location=123-182; Score=53.7; E_value=2.5e-14; Accession=PF01333.10; Description =Apocytochrome F, C-terminal
KQPVVLSVPIAILANKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAVIDIIPPGPELLVSEGESIKLDQPLTSNPNVGGFGQGDAEIVLQDPLRVQ

SEQ ID NO: 118150 - protein, 185 aa, Glycine max
  Coding DNA Sequence Number=SeqID_1372
QFKSDLTSKWALAQGKEDNVDKVNEKYGISNDKWNQFCQSRRDPSWEGVVPPAKLKVAPSTTRVYTKGSCIDPSGQDPNTAASNKCGLYVDDNTPHLVALGRIYEGSTTMPNVPLGNDMMKVGVKEVRDVDAHVPVPTEEDKQRPEGPTKPADRPKPDDDPICQRTLMIPQLFLKLMSWDATVFR

SEQ ID NO: 118151 - protein, 101 aa, Glycine max
  Coding DNA Sequence Number=SeqID_1373
MVNDIFTLSRHKENMVQPKPSAGLKGKPHQHALTHHAFLYFNKQKLGPPRPKSCFGIYPNSRKLSASKKWHFTEHLVGALLGTNNKGMGAMWLAPSSQYTT

SEQ ID NO: 118152 - protein, 141 aa, Glycine max
  Coding DNA Sequence Number=SeqID_1374
  Homolog annotation: Hit_ID=Q1SKD7; Match level="QueryCoverage=74%, HitCoverage=27%, E-value=7e-11, Identity=33%"; Hit description =Ankyrin
MYEYPRRTRALTCKHSFQNSYGCSCFVGKREMVPKKLSTKRSRRDAAAEGSSATREFDSHRFRSAEHQQRFEAIKGWSFHRERRVQLREDEYTDFQEEIACRRWTSLVTPMAKFDPKIVLEFYANAWPTEEGDVPLFSPIS

SEQ ID NO: 118153 - protein, 176 aa, Glycine max
  Coding DNA Sequence Number=SeqID_1375
  Homolog annotation: Hit_ID=Q5CEG7; Match level="QueryCoverage=59%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 118154 - protein, 60 aa, Glycine max
  Coding DNA Sequence Number=SeqID_1376
ASAARAGRRVPVGGRIGNGPFGASSPGVEQSTQNCEEINQARVNGGSNYDSLKVAKCLVI

SEQ ID NO: 118155 - protein, 76 aa, Glycine max
  Coding DNA Sequence Number=SeqID_1377
MEFLQISIGEIKRKMKKKKIASYGSRFDEEMSKIGRFGNGGTSQGGRGCAGVSEKRGIYRPGRIVIDYKYWPSVLV

SEQ ID NO: 118156 - protein, 179 aa, Glycine max
  Coding DNA Sequence Number=SeqID_1378
  Gene Ontology: Cellular component=1-2nm peptidoglycan-based cell wall
  Homolog annotation: Hit_ID=P58722; Match level="QueryCoverage=55%, HitCoverage=14%, E-value=1e-17, Identity=45%"; Hit description =Putative membrane protein igaA homolog
  Subcellular localization annotation: CTP_CleavageSite=29; ConfidenceScore=5.31e-01
ASSAATRMSSNLLSLNKRSQRPAIFRTDSANSVQENRIMPISTAEAVLGASWRFTPYNIQLFIRLAKFTARNPSALAHALPFIKPAHRKLTDEERAAVEFYLNQQNKLSNKLLPGGGATLPAAKLALTPQSDNVYPVTHAITRYGLASDDPNKWRYYLDAEEVHLPPFWDPISPPTTMW

SEQ ID NO: 118157 - protein, 146 aa, Glycine max
  Coding DNA Sequence Number=SeqID_1379
MTLLLSNIMPSDHNSNLPLPKCQLVYAILTQVSVHAAQLISDAIYQFAGMVPMRHPVDLEKSNRAQGFPTLIMGLYQFYRVPVAPNKVIRPPITRAFIEKYCIPKQAQGKAPQFPGDSHPQVANAPPSPPESTLAHLRRRIISNWA

SEQ ID NO: 118158 - protein, 71 aa, Glycine max
  Coding DNA Sequence Number=SeqID_1380
MDAAIPTGVKLVSPLAATGRKQSHCPCRYSNWRDMLTKHVAIGTGGTCQRGSPATGACGTRCSMWGCSVSV

SEQ ID NO: 118159 - protein, 34 aa, Glycine max
  Coding DNA Sequence Number=SeqID_1381
MTLAGVARAERFYNDCDCTLQLPEKVKFEDLTNM

SEQ ID NO: 118160 - protein, 109 aa, Glycine max
  Coding DNA Sequence Number=SeqID_1382
MKERSAHACIAGHHSENISVTCFAGGNGETGNSDQLVIGVPRVEAEAKARRIVAVTEGNDGGEKEIVEEGKGQGGGVGEEGVVTVERVAKEEKGGGVAVVEGDEGRTAY

SEQ ID NO: 118161 - protein, 1161 aa, Glycine max
  Coding DNA Sequence Number=SeqID_1383
  Gene Ontology: Biological process=biosynthetic process
  Homolog annotation: Hit_ID=O04697; Match level="QueryCoverage=38%, HitCoverage=89%, E-value=1e-62, Identity=39%"; Hit description=DNA -binding protein PD2
RLPVYEQMGWEHIVSHWRSAFSRASVVVFPDFTYPMLYSELDTGNFFVIPGSPVDVWAAESYHKTHAKEQLRELSGFGKNDMLVLVVGSSVFFDDLSWDYAVAMHSVGPLLTRYARRNDATDSFKFVFLCGNSTDGYDDALQGVASRMGLRQGSIRHYGLNGDVNSVLLMADIILYGSAQEIVDGVHGIFFSKHNPEALMNAFSLLLSNGRLSKFAQAIASSGRQLAKNVLALDCITGYARLLENVLNFPSDALLPGPVSQIQQGSWEWNLFRNEIDLSKIDGDFSNRKVSIVYAVEHELASLNYSTSIFENGTEVPLRDELTQLDWDILREIEISEENEMFEVEEAEERREKGVGVWDDIYRNARKSEKLKFEVNERDEGELERTGQPVCIYEIYNGAGVWPFLHHGSLYRGLSLSRRAQRQSSDDVDAVGRLPLLNDTYYRDILCEMGGMFAIANRVDNIHRRPWIGFQSWRAAGRKVALSAKAEKVLEETMQENFRGDVIYFWGRFDMDQSVIGNHNANSFWYMCDILNGGNCRTVFQEGFRQMYALPPHAEALPPMPEDGYWSALHSWVMPTPSFLEFIMFSRMFVDSIDALHRDSTKYSLCLLGSSEIEKKHCYCRVLELLINVWAYHSARKMVYINPNTGSMEEQHPIEQRKGFMWAKYFNISLLKSMDEDLAEAADDGDHPREMWLWPMTGEVHWQGIYEREREERYQELNNGNFPSLNLTHKEVGGSFYTVREIVRDVIQENRVLGPAKFTLEELNTDQFFEQNPLGSIARNPQPFLAASLIENHCEPDKLQDTNSKMISASDVSYTEAVHQAVDKGHVISIGHVDVTTNESIEVPVVAADGCDTGAELPMFDKGHIMNVSQVDVTSNESAESVVISDEYCCAGTEHKIIDKGHVLNGSQVNMITKESNETAIPETQVDDSSALNQNVEQELAAAAIPMAEVTAVTEDLIVETFPLSSVSGTTDGIRSLGGLGDSSNSPENDIKMLEVKQGEKYAPGNQILENSSNTGLDKEENVQDILEESSNHSTRKEHFDHHEFEDRTDSQVRASHQNTTTFKTIDQNQMIDGVKTSTHTNNLSKTCKPSEEDGSLLKADKHRVDDQLGGNSQRRKNTTVDRINLESWDGAAKKSAKQEPNPLLAVLKVFVDAFVKFWSG

SEQ ID NO: 118162 - protein, 164 aa, Glycine max
  Coding DNA Sequence Number=SeqID_1384
  Homolog annotation: Hit_ID=Q84KJ8; Match level="QueryCoverage=61%, HitCoverage=24%, E-value=8e-08, Identity=32%"; Hit description=S locus F-box protein d
MGSISSHVTDRSNAIKDPPRARFKRVKLNQGSRKAKAFIIHNARNPDNLVIAISGIKAEGNAGIVVARVVVGCGEADISSNTWIANDNGEASFTVGNANETITEGKDGELEIGEGGKAEEGVGEGEGGIVVVAAVGEEELVAEAKEEKGRGVAAVEGDEGFVAD

SEQ ID NO: 118163 - protein, 101 aa, Glycine max
  Coding DNA Sequence Number=SeqID_1385
MAMSTILFKASPWEGILILLPIALLDHLTLCVHCSPLSHYYKFVENSVIDLTYFILSEQVLDDTSSVRASLRKRLTADDPDLTTDEQLRIKEFLEACPDED

SEQ ID NO: 118164 - protein, 181 aa, Glycine max
  Coding DNA Sequence Number=SeqID_1386
MTERGTHESYPWRANANSRLGANRIESIAGEEPLRNLPGDEAERGAEADSSADVAGALGALAEDGGNGALHDQGGEGEEEDDGDDEGVESGLGLGERKEPQQQALALVEVRSVDIVVAVAVVVRTRQLPIEGATVPVVARVPLEGESAADRTESNVAAAAAVIDLRLRRRVARQSHRKINE

SEQ ID NO: 118165 - protein, 95 aa, Glycine max
  Coding DNA Sequence Number=SeqID_1387
MFAFLLDIITREKITHRSEGEQEEEAGEEEVQLIEPNAIGSKTKSLKKKKKITATMATPARAVKSTAGVEGEAAAAISQNLPPPPTERKVVSLLL

SEQ ID NO: 118166 - protein, 286 aa, Glycine max
  Coding DNA Sequence Number=SeqID_1388
  Gene Ontology: Biological process=biosynthetic process
MSDKELFNSICGIAIFLVCGPELDLVALGPKRLTPEILGHMTIDPQSLMLVTVIRNLQKLGYVFKIFAVGHGKARSIWENIGGGISPLSAKHQGLIDWSIFEGIIVDSLEAKVAISSVMQDPFCSVPLIWIIQEDSLSSRLPVYEQMGWEHIVSHWRSAFSRAGVVVFPDFTYPMLYSELDTGNFFVIPGSPVDVWAAESYSKTHAKDQLRELSGFGKNDMLVLVVGSSVFYDNLSWDYAVAMHSVGPLLTKYARRNGATDSFKFVFLCGNSTDGYDDALQVVFPF

SEQ ID NO: 118167 - protein, 150 aa, Glycine max
  Coding DNA Sequence Number=SeqID_1389
  Gene Ontology: Mol. function=protein tyrosine/serine/threonine phosphatase activity; Biological process=protein amino acid dephosphorylation
  Homolog annotation: Hit_ID=Q93X44; Match level="QueryCoverage=56%, HitCoverage=28%, E-value=1e-31, Identity=68%"; Hit description =Protein tyrosine phosphatase
MKGLKEALNTVILNWYGVFDNVIQNLARDFDAFDLRRRLPAVVSKLYKAINSNGGVTYIHCTAGLGRAPAVASKRSCFPKLDAIKSATADILTGLSKKSVTLSWEDKNCSTVEISGLDIGWGQKCLSSSIIEHVKFNTSHGNIIIQHHHH

SEQ ID NO: 118168 - protein, 121 aa, Glycine max
  Coding DNA Sequence Number=SeqID_1390
  Gene Ontology: Cellular component=endoplasmic reticulum; Biological process=protein transport
  Homolog annotation: Hit_ID=Q8GYE0; Match level="QueryCoverage=98%, HitCoverage=27%, E-value=1e-33, Identity=57%"; Hit description=Sec12- like protein 1
MTTYVLEAEEGDPVAITVHPSGDDFVCALSNGSCKLKYFPMACRLFELYGRETNMKLLAKELAPLQGIGPQKCISFSVDGSKFAAGGMDGHLRIMEWPSMRVILDEPRAHNSVQDMDFRLV

SEQ ID NO: 118169 - protein, 477 aa, Glycine max
  Coding DNA Sequence Number=SeqID_1391
  Gene Ontology: Mol. function=aminoacyl-tRNA ligase activity; Cellular component=ribonucleoprotein complex; Biological process=tRNA aminoacylation for protein translation
  Homolog annotation: Hit_ID=Q9LGT2; Match level="QueryCoverage=89%, HitCoverage=97%, E-value=1e-116, Identity=46%"; Hit description =Putative BING4-like protein
  Pfam annotation: Domain name=BING4CT; Domain location=297-377; Score =197.2; E_value=4e-56; Accession=PF08149.2; Description=BING4CT (NUC141) domain
  Pfam annotation: Domain name=WD40; Domain location=212-250; Score =39.3; E_value=1.3e-08; Accession=PF00400.22; Description=WD domain, G-beta repeat
  Pfam module annotation: Pfam domain module=BING4CT::WD40; Domain location=297-377::212-250
RGQNRLKPLNPATPFLVISLSGAPLSDETEAVSREQMGEIKENVPLPKTKPSTEQDVTDELDLRMKKYLRGEGANLEGLKDKKLKGQLAAKEDLYGKSAKAAAKAEKWLMPSEGGYLEAEGLEKTWRIKQEAIAHEEHGPVLRLQFLENHFLLASINKFGQLRYQDVTMGSMVGNFRTGLGRTNVMQVNPFNGVVSLGHSGGTVTMWKPTSASPLVKMLCHHGPVSALAFHSNGLLMATAGKDKKIKLWDLRKFEVLQTLPGHANTLDFSQKGLLACGNGSLIQILRDVSGTQNYSKYMTHSMVKGYQIGKLVFRPYEDVLGIGHSMGWSSILTPGAGEPNFDSWVANPFETSKQRREKEIRSLLDKLPPETIMLDPSKIGTVKPRRERPTKQEREAEIEAGVEAAKGMKLKKKTKGRNKPGKRVQKKQEAVSRVKRPYLEQKIQEEESISRKKQKTSEDVELPKSLQRFARKKASS

SEQ ID NO: 118170 - protein, 385 aa, Glycine max
  Coding DNA Sequence Number=SeqID_1392
  Gene Ontology: Mol. function=serine-type endopeptidase activity; Cellular component=periplasmic space; Biological process=proteolysis
  Homolog annotation: Hit_ID=Q5H6V7; Match level="QueryCoverage=95%, HitCoverage=68%, E-value=1e-157, Identity=75%"; Hit description =Protease DO
VDSRGSHVLPPPVPGHPAGTHQRIAGLGRDHRRQGGPGDTGRRAHGQGRIPRFGPRYRHRADPHSGAEPDRHQARQQRPAARGRLRGGHRQSVRLQPDGHLGHRLSGGPQRYPRAGLPELHPDRCVDQPGQLGWRTGRSAGPAGRHQYRQLQPAGQHGRQHRPGPGDSLQPGTQRGRPAGQARCGGARHAGRGKPEPDRADRAGPGPGRNPWRTDHARAGRFGRRRSRAKAGRRGGLGQRPTRGQRRSPAQRGRPGRGRQRIDAGRAPRGQAAADQGNVEGTGARGHRREPGPAPDRGHLRRPARVIAPVRCRRRAGQRGQARQPRGQQRPAAGRHHHRCHGGRIRRPGQLARQLPAAPADPGDTRAAQQWPAAGPARDALIALP

SEQ ID NO: 118171 - protein, 96 aa, Glycine max
  Coding DNA Sequence Number=SeqID_1393
MQRLKVPSTRSLERIVENQAKIEALGLSKLATIFNDRIQKAKKKDNKEANDDDEDYVPEYEGGLGSNFSSENYENDKRDEFAATDDLESRKRKATL

SEQ ID NO: 118172 - protein, 70 aa, Glycine max
  Coding DNA Sequence Number=SeqID_1394
MGGGGGGAGRVSVRKLDSAKEKVSGDEENGEEVEQQCPLEVVGNILASATHSPFFAFPFAIEDEYGDSGR

SEQ ID NO: 118173 - protein, 89 aa, Glycine max
  Coding DNA Sequence Number=SeqID_1395
  Gene Ontology: Mol. function=hydrolase activity
  Homolog annotation: Hit_ID=Q9C6Z2; Match level="QueryCoverage=100%, HitCoverage=40%, E-value=6e-26, Identity=66%"; Hit description =Diadenosine 5,5-P1,P4-tetraphosphate hydrolase, putative
MEGLPQGYRPNVGVCLINSDDQVFDKDLSLVLAEQFRTNKMIFVASRLNVPGAWQMPQGGIEDGEEPKSAAVRELREETGIVSAEIIAE

SEQ ID NO: 118174 - protein, 230 aa, Glycine max
  Coding DNA Sequence Number=SeqID_1396
  Gene Ontology: Mol. function=RNA-directed DNA polymerase activity; Biological process=RNA-dependent DNA replication
  Homolog annotation: Hit_ID=Q1SKV6; Match level="QueryCoverage=45%, HitCoverage=31%, E-value=4e-10, Identity=33%"; Hit description=RNA -directed DNA polymerase
MKEEVQFMCVQETKKEVINEEICQAMWGDAELQWVYQPTNNKCSIWKDDGVEVTFINVYSPCDMDAKRRLWGDLIPHKENKSWSNVGIIGDINSVRRIGEREEVNPRGVKYEKISLEDNNMLIGRFEEEEVREAIWECVNSKSLGLDGGANASFVALTPKVEDPKVHHGVIDERQSAFLGGSNLLHSAFIANEVVDEARRKNEKYLIIKVDMRKHMVQYVEASSFIFYKD

SEQ ID NO: 118175 - protein, 69 aa, Glycine max
  Coding DNA Sequence Number=SeqID_1397
MVVLGGAGQHTSLYKETLLVVIAQDDKNKILLIAFVVVEGQSNHYYNNLRKEADGDQGNNWLREIPREK

SEQ ID NO: 118176 - protein, 304 aa, Glycine max
  Coding DNA Sequence Number=SeqID_1398
MLVTGEVPTELHALPGFRSELELDKLCNGFQASAGGVVLQIYVEFIALACLVDGDFIFKWGMKTIAPSSLNVFLPIKAKELALTKGGHQVHVASSLNSLACKVKEWTDVRVARVEKGLESLEGFPVLDISGIALVNKDPGYHEICNEDGDNYGVVLVDVVDSLDVPIRKGDERKTLLYFLQNRGAIDCQGLGVYFVFVMLLSGLSDFIPKSGHFFHLDVALGSLAQFFHATEWFLAQIVCELVKAYGLHPKSIVCLHNVINKRMPTDNLSYWTVYVGETQIIYSVAYASGGALASNAKPSANHG

SEQ ID NO: 118177 - protein, 264 aa, Glycine max
  Coding DNA Sequence Number=SeqID_1399
  Gene Ontology: Mol. function=RNA-directed DNA polymerase activity; Cellular component=chromatin; Biological process=RNA-dependent DNA replication
MGEERRKAVKEEVDKLLHANFIREVRFSTWLANIVMVKKANSKWRICTDYTDMNRACSKDTYHLPNINRLVDGTSGFQVLSFLDAYPGYNKTRMHPPDLTTMSSTYTSTFHSISCLKTQSISRWELLKYDKLLNPEKYIFRIRGGKFLGFIIIQLGIEVNLDKCTTILEMHSPTNIQEVYKLNGPLGPSRRFLQKAVASGGSNPARLGELSSPGRAGKIVSVKKIQAKALPKRFRNVSVSDFAKVFDRSSTFFIRSSSFFGLQR

SEQ ID NO: 118178 - protein, 470 aa, Glycine max
  Coding DNA Sequence Number=SeqID_1400
  Gene Ontology: Mol. function=zinc ion binding
  Homolog annotation: Hit_ID=Q9FFU7; Match level="QueryCoverage=97%, HitCoverage=97%, E-value=9e-49, Identity=30%"; Hit description =Similarity to heat shock transcription factor HSF30
  Pfam annotation: Domain name=F-box; Domain location=9-56; Score=28.0; E_value=3.3e-05; Accession=PF00646.23; Description=F-box domain
  Pfam annotation: Domain name=FBD; Domain location=387-436; Score =13.5; E_value=0.0091; Accession=PF08387.1; Description=FBD
  Pfam module annotation: Pfam domain module=F-box::FBD; Domain location=9-56::387-436
MAWIRRKADKTSLLPEIVLITIVSFLPFKEAVRTSILSKRWSKIWLSTKNIEFNELFFLNPPETDATKQLQRRTLFFDFITHFMDNYRVINTVDKFSLKVSNPESCADIIERCVAFATERGVKELRLDFSDPTWEENEDDDNDHHDALFQLPNHVYRHASLEALELYACGFAMPDMCNLVELKDVSFGWIEMSTNTVKTLLSTLGKLENLSMKKCWNLEHFDMRTQEVGLRRLVIDKCHFVISDYVDLRAPNLKFLKYSGKLGIFEVKALPEVVQEAQLDFTPMPKFEEYGDELCQLLLDLSGVRVLTVCSFLLQALPTGEEQMRMQHDMEVRHLLVNTDLDNQELFGFVLLLSSCVYLEKLTLDIGQGKIYDEHVKPYPFDFAKFCCDQYAIFECVKDNLKVVEINGSRASKNELRLCFYLIQVGCVLEKLIINLAKEEGNEMLEIERHERASLLFDVPKASKNLQIWI

SEQ ID NO: 118179 - protein, 74 aa, Glycine max
  Coding DNA Sequence Number=SeqID_1401
  Gene Ontology: Mol. function=oxygen transporter activity; Biological process=oxygen transport
  Homolog annotation: Hit_ID=Q42801; Match level="QueryCoverage=92%, HitCoverage=45%, E-value=9e-33, Identity=100%"; Hit description =Leghemoglobin
MGAFTEKQEALVNSSFEAFKANLPHHSVVFFNSILEKAPAAKNMFSFLGDAVDPKNPKLAGHAEKLFGLGCILD

SEQ ID NO: 118180 - protein, 291 aa, Glycine max
  Coding DNA Sequence Number=SeqID_1402
  Gene Ontology: Mol. function=phosphatidate cytidylyltransferase activity; Cellular component=integral to membrane; Biological process=phospholipid biosynthetic process
  Homolog annotation: Hit_ID=Q2N2K1; Match level="QueryCoverage=99%, HitCoverage=100%, E-value=1e-141, Identity=88%"; Hit description =Probable phytol kinase 1, chloroplast precursor
  Pfam annotation: Domain name=CTP_transf_1; Domain location=113-287; Score=-29.3; E_value=0.00016; Accession=PF01148.10; Description =Cytidylyltransferase family
  Subcellular localization annotation: CTP_CleavageSite=57; ConfidenceScore=5.64e-01
MTLLSSHLLVFSAVHHRAPPTTTTRNSPTTNHTVRFLCSPGVPPAVRLDQRLPRFVVPGAGAEDLLYNAGATVGVLGGGYALVRAFDELTRRNILQQVPHFMFHTRKDSNSPKARYFAAFVPLVNCLRLLVNGLSLASDEGLIKSVTREGDPLELLRGPLYYVLILILSALVFWRESPIGVISLAMMCAGDGIADIIGRRYGSMKIPYNEHKSLAGSMSMLVFGFLVSIGMLYYYSVLGHVQLDWASTLPRVAFISFVATLVESLPITKVVDDNISVPLATMAVAFFTFHH

SEQ ID NO: 118181 - protein, 416 aa, Glycine max
  Coding DNA Sequence Number=SeqID_1403
  Gene Ontology: Mol. function=protein serine/threonine kinase activity; Cellular component=plasma membrane; Biological process =protein amino acid phosphorylation
  Homolog annotation: Hit_ID=Q5I6E8; Match level="QueryCoverage=99%, HitCoverage=75%, E-value=1e-173, Identity=75%"; Hit description=3 -phosphoinositide-dependent protein kinase-1
  Pfam annotation: Domain name=Pkinase; Domain location=12-239; Score =103.2; E_value=7.5e-28; Accession=PF00069.15; Description=Protein kinase domain
  Pfam annotation: Domain name=Pkinase_Tyr; Domain location=3-210; Score=-104.8; E_value=4.8e-06; Accession=PF07714.7; Description =Protein tyrosine kinase
  Pfam module annotation: Pfam domain module=Pkinase::Pkinase_Tyr; Domain location=12-239::3-210
MALESCEGGELFDQITRLCQGTLKNLCTLSTVRNMEVVNFNLSDFYVQKGRLSENEARFYAAEVIDALEYIHNLGVIHRDIKPENLLLTAEGHIKIADFGSVKPMQDSQITVLPNAASDDKACTFVGTAAYVPPEVLNSSPATFGNDLWALGCTLYQMLSGTSPFKDASEWLIFQRIIARELRFPDYFSDEARDLIDRLLEAGSYTCRLLDNRHRDLDPSRRPGAGPDGYAILKSHPFFKGVDWDNLRAQIPPKLAPEPGTQSPASDDVHDSSWSPSHIGDGSAASVRQPDGATSSEGTGHITRLASIDSFDSKWQQFLEPGESVLMISMVKKLQKLTSKKVQLILTNKPKLIYVDPSKLIVKGNIIWSDNPNDLSIQVASPSNFKICTPKKVMSFEDAKQRAWQWKKAIEGLQNR

SEQ ID NO: 118182 - protein, 356 aa, Glycine max
  Coding DNA Sequence Number=SeqID_1404
  Gene Ontology: Mol. function=transferase activity
  Homolog annotation: Hit_ID=Q53WK1; Match level="QueryCoverage=99%, HitCoverage=47%, E-value=1e-103, Identity=49%"; Hit description =Putative glycosyltransferase
MEKGNTFYLFYETKNSITMQGDIGVSKSTDKGATWQQLGIALNEDWHLSYPYVFEHDGQIYMMPEGSQKGDLRLYRAVNFPLQWRLEKVVMKKPLVDSFVINHGGRYWLFGSDHSGFGTQKNGQLEIWYSNSPLGPWNPHKKNPIYNIDRSLGARNGGRPFKYEGNLYRMGQDCGDTYGRKLRVFKIETLTIDEYKEVEVPLGFVESNKGRNAWNGARYHHLDVQHLPSGGWVGVMDGDHVPSGDSVRRFTVGCASVAVAAILIVLLGVLLGFVNCIVPLNWFIHNSGKRNFTVLSWERSNVYCSRVRRFCRRLNRAPTFLRGKIKHNACARRFILAIIFAVGVGLMCIGVKNIYG

SEQ ID NO: 118183 - protein, 168 aa, Glycine max
  Coding DNA Sequence Number=SeqID_1405
  Gene Ontology: Mol. function=transferase activity
  Homolog annotation: Hit_ID=Q9AUK5; Match level="QueryCoverage=38%, HitCoverage=8%, E-value=3e-17, Identity=64%"; Hit description =Putative exostoses
MGSGQIGGGGNGGGCSNGGSCCDMSVKCSCRWRLENQQYYKRLFSSGFIFFFGCFVLFGSIATLYGWFAFSPTVHTALSSSFGCREDNEGSWSIGVFYGDSPFSLKPIEAANVSNDETAAWPVANPVVTCASVSDVGYPSNNNNNRFLLPPLVPSFITFLSGASDSVK

SEQ ID NO: 118184 - protein, 52 aa, Glycine max
  Coding DNA Sequence Number=SeqID_1406
MEVKTEEYAAAGKELGFPFCHCYLFIFIGFHMRGQEGAVKLGKPESLRLADC

SEQ ID NO: 118185 - protein, 254 aa, Glycine max
  Coding DNA Sequence Number=SeqID_1407
  Gene Ontology: Mol. function=RNA-directed DNA polymerase activity; Biological process=RNA-dependent DNA replication
PGAPLLMYLSVAGKAVSSVLIQEEGKHQHPVYFTSRMLHDAEKRYQMIENVALTLIISARQLRPYFQSHQLVVKTNYPMKQVLRKPELAGRMVACGAGIILEVPNNITLEQALKLNFRVSNNQTRHEALIAGLKLAREVRAKRLRCYIESQLVQCFKMYYIPRETNTRANLLSKLANTKKVERLKTIIQETLQTPTIDAEKIMVGEEEEPNWMTLNKNFLIRESGQTPSTLPGGADDAKSLQTCHTLLPTIFIN

SEQ ID NO: 118186 - protein, 138 aa, Glycine max
  Coding DNA Sequence Number=SeqID_1408
MKADMEAMKEQMATMMEAMMSMKKILKPDAVIVAATSAVAKVNPMPPSGLNQMNHPTSNMVGKDLGSTDDPMMCKFKTSTLSHHMACLPTIHHPMWHTLSMKISITPLRYSLRTNNLNLIRHISLKPWGRHMKFPTTI

SEQ ID NO: 118187 - protein, 231 aa, Glycine max
  Coding DNA Sequence Number=SeqID_1409
  Gene Ontology: Mol. function=DNA binding; Biological process =regulation of transcription, DNA-dependent
  Homolog annotation: Hit_ID=Q1SCZ2; Match level="QueryCoverage=85%, HitCoverage=38%, E-value=5e-34, Identity=40%"; Hit description =Transcriptional factor B3
  Pfam annotation: Domain name=B3; Domain location=15-110; Score=44.7; E_value=3.2e-10; Accession=PF02362.12; Description=B3 DNA binding domain
MTKLKKKHPLPSEILFFKIISEASLQDGKLKIPNKFTREYGVNLSNPVFLKPPDGIEWKIFWTKHDGDIWFQKGWKEFATYYSLSHKYLVLFKYQETSHLEVHIFDQSALEVDYPFCGIKIEHENLDHVSNDSVEVSDDSIEVLDELTPSQKKTRLKSTSCSRPRKKLNTGPSEVFEESSNLPQHVQIKGEQSQGTNLGMSSDKQVPSDPILMSYVLTESLAKREKAMDVL

SEQ ID NO: 118188 - protein, 423 aa, Glycine max
  Coding DNA Sequence Number=SeqID_1410
  Homolog annotation: Hit_ID=Q1SKD7; Match level="QueryCoverage=46%, HitCoverage=52%, E-value=1e-09, Identity=23%"; Hit description =Ankyrin
MAPEQPPAKRQKKDQSSSQSAHRTEYPTKFRTVTHEQRYETEIKMRNFIPEKNFKLKPGEYDEIQKVITWRKWEKLCSFAQNFHPQIVREFYANAYGIEGDTTPLHTSWVRGKMVSYEEETINSFFGTQAAADCSYKAGGDLVKDYGEMKKLLARPGAIWIGKKVKPRCLRSIDLYPVVHAWSSWMHHTVLPCANESNVTVVRSQFLIATILNEPLDIGRIISSDIHQVAQTNKPKATLSHPSLICFLCERAGVGIPWDEPTATIPRPITAAWIDSRLDGPMGAPPQPQEQQPQPQPQQEQEQHAQEDQPPAPSSLDQCLMLLVQTQTQLSQDIHRLVTEARVQSRGTNALCRLLALQFRSQQQQELLKPQGQLTEADILQMVGLEKPAKPSSWHPAKVPTADGAGEDLQDEDLIYPSSSQPI

SEQ ID NO: 118189 - protein, 87 aa, Glycine max
  Coding DNA Sequence Number=SeqID_1411
  Subcellular localization annotation: CTP_CleavageSite=39; ConfidenceScore=5.28e-01
MKGQIRVSFSTETASQVGRFRSNRRVPLIVESQRRTTTKCSRERKLRAYSRHFLNDPNGQIVKLQTKFREDPTVNEGWAAFLPRQIM

SEQ ID NO: 118190 - protein, 32 aa, Glycine max
  Coding DNA Sequence Number=SeqID_1412
MEDAKLMKTPMHASNLLSKDESDFSLILENHI

SEQ ID NO: 118191 - protein, 266 aa, Glycine max
  Coding DNA Sequence Number=SeqID_1413
  Gene Ontology: Mol. function=monooxygenase activity; Cellular component=membrane; Biological process=electron transport
  Homolog annotation: Hit_ID=Q1S220; Match level="QueryCoverage=94%, HitCoverage=49%, E-value=4e-95, Identity=67%"; Hit description=E -class P450, group I
MNLLLAAVTLLVFYAAKFFYSNFWVPWRTERHFKRQGIGGPGYRPIFGNTSEIRRLYAEAKSEASASPPPFHHDIMGRVAPFYDRWSRAYGKTFLYWFGSTPRLAVTEPDMIKEVLMNTRGEYVKVPFNPQSKLLFGQGLVGLEGDQWALHRRIINLAFNLELVKGWVPDIVASVTKKLESWEDQRGGRDEFEIDVLRELHDLSADVISRTAFGSNYEEGKHIFNLQEQQMHLFSQAVRSVYIPGFSLGITNKLPISSWKYYSLPE

SEQ ID NO: 118192 - protein, 61 aa, Glycine max
  Coding DNA Sequence Number=SeqID_1414
MENWRTALRNNFAGLQTRRVSEKSGEWRIGGQRYAITSRGSRLEGGGHMNSARQLHSWVSE

SEQ ID NO: 118193 - protein, 348 aa, Glycine max
  Coding DNA Sequence Number=SeqID_1415
  Gene Ontology: Mol. function=3'-5'-exoribonuclease activity; Cellular component=integrator complex; Biological process=snRNA processing
  Homolog annotation: Hit_ID=Q7TPD0; Match level="QueryCoverage=83%, HitCoverage=35%, E-value=8e-22, Identity=32%"; Hit description =Integrator complex subunit 3
SLRQAFESLQPSLRPPFSLSILTPDQYALLNRAILHGVLTEPHLANTHIKHLHAIVADAHATFLSLLLNAVLQLYPKLLHSVKTQLLRLTEEMLRVLGIGYDAVLLFLLRQIAAADCTDANLSLCSELLTLFLKQFEPLLEGAPHVLSSALYTFLRVLSDKFRVSIEKLEILKRREIHLCVKIVREEFRLCLKIGRDFIRLLQDLAHVPEFKAILQDIVFNPSVFNVFGFKDRDKEFVIVDIVRSKQVEESVKLALFYDWLFYDERMDGIMNIKPAVLLMVHSVPKFINVTCALLEFLSHLVDRYDVGRKGVIVKGSEKVVIRWEGWKLLRDFCQKDSCYLLIHNGHL

SEQ ID NO: 118194 - protein, 540 aa, Glycine max
  Coding DNA Sequence Number=SeqID_1416
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=96%, HitCoverage=43%, E-value=0.0, Identity=88%"; Hit description =Coatomer WD associated region; Coatomer alpha subunit, C-terminal; Cytochrome cd1-nitrite ...
  Homolog annotation: Hit description=reductase-like, C-terminal haem d1
  Pfam annotation: Domain name=Coatomer_WDAD; Domain location=36-482; Score=866.5; E_value=1.3e-257; Accession=PF04053.4; Description =Coatomer WD associated region
MNLLAAGHDSGMIVFKLERERPAFVVSGDSLFYTKDRFLCFYEFSTQRDAQVLPFRRPGSLSLNQSPKTLSYSPTENAFLLCSDVDGGSYELYCISKDSYGRGDVQDAKKGHGASAVFVARNRFAVLEKSSNQVLIKNLKNDIVKKSVLPIATDAIFYAGTGNLLCRSEDRVVIFDLQQRIVLGELQTPFIKYVVWSDDMEHVALLSKHAIIIASKKLVHQCTLHETIRVKSGAWDENGVFIYTTLNHIKYCLPNGDNGIIKTLDIPIYITKVSGNTIFCLDRDGKNRSIIIDATEYIFKLSLLKKRYDHVMNMIRNSQLCGQAMIAYLQQKGFPEVALHFVKDEKIRFNLALESGNIQIAVASATAIDEKDHWYRLGVEALRQGNAGIVEYAYQRTKNFERLSFLYLVTGNMEKLSKMLKIAEVKNDVMGQFHNALYMGDVRERVKILENVGHLPLAYITASVHGLHDVAERLATELGDNVPSLPAGKVPSLMMPPSPVICGSDWPLLRVMQGMFDGVLDNTGRGVADEEEYEAADGDW

SEQ ID NO: 118195 - protein, 81 aa, Glycine max
  Coding DNA Sequence Number=SeqID_1417
MYDTFDRGCEKSSARIVCCALALYVWLVSHLFSPRRSQELPRLLAKAKAVADTYSAPEEIHGLLSYCQHMIDLMDHMIRNR

SEQ ID NO: 118196 - protein, 102 aa, Glycine max
  Coding DNA Sequence Number=SeqID_1418
LLCFKILILVTYDCDVAQDNSSVNFKLTREMIKPDCGGVSEVCGCAVVLIAARVLRPSAMQRTFSARRELQKRWEPCPPPQVATVDEAPTVQTVDASLLPSE

SEQ ID NO: 118197 - protein, 109 aa, Glycine max
  Coding DNA Sequence Number=SeqID_1419
  Gene Ontology: Mol. function=nucleoside-triphosphatase activity; Cellular component=membrane; Biological process=response to abscisic acid stimulus
  Homolog annotation: Hit_ID=Q1T1A0; Match level="QueryCoverage=57%, HitCoverage=15%, E-value=1e-18, Identity=64%"; Hit description=AAA ATPase
  Subcellular localization annotation: CTP_CleavageSite=48; ConfidenceScore=5.28e-01
MSILPGLNSAGSSLSLWLVVNMMILSSPQLDHSPSMKFSNPDKVNCIRPSDARSFTRKIVLFGIHYPMTFNSDLRTTENNKQEENNNQMSEILRGLMVKCLLGSLEVAL

SEQ ID NO: 118198 - protein, 158 aa, Glycine max
  Coding DNA Sequence Number=SeqID_1420
  Gene Ontology: Mol. function=nucleoside-triphosphatase activity; Cellular component=nucleus; Biological process=negative regulation of transcription
  Homolog annotation: Hit_ID=Q2PEP9; Match level="QueryCoverage=66%, HitCoverage=28%, E-value=2e-32, Identity=70%"; Hit description =Putative RuvB DNA helicase-like protein
MIKDRKIASHTVFLVGKPSTGKTAIAMGMAKSLELETPFTMITASEIFSLEMWKTKALTQAFHKAINIGIKEETKVVEVQIDHPAVADAIVKTGKLMLKSTWMETYQMSCFKGKRVHILGMRRKLSILVFCALPPAPKSATMLKLGSGSYGNPLSSTC

SEQ ID NO: 118199 - protein, 93 aa, Glycine max
  Coding DNA Sequence Number=SeqID_1421
MGKDNPEFSVDDQKVTFDLFDAAKHSIDRNVYSKGLAKVSLEQWMRKELRKKFSHPLAQRVMCAKRPNPHPLAEGVLLSETIAVIPKTSMDCI

SEQ ID NO: 118200 - protein, 213 aa, Glycine max
  Coding DNA Sequence Number=SeqID_1422
MAECYSSLAYIESRDVLYEICGPKEDKVQVVDDSLSEADPLSECHSLIEEYNSLSCGSNDFQDYFDDAKESRVKQVPKNQASRIKSQRIKIQEQLSFKIQEQSRSRFKIQEKLISRFKRRNREAIVKTSQGKHEESIKGTSFVVQVEGTSTWVVILRTREGISHCGSVQEEGTSTWLFKENKGGYIPCGSLACKGFYKVERNLKNRWLLGDWM

SEQ ID NO: 118201 - protein, 106 aa, Glycine max
  Coding DNA Sequence Number=SeqID_1423
MGIAPAKTPNGPEEVQQGPGVSSSGYGPLDCARKTPSGPEEGQQGLGVASSKYGSLSVLRSARRPNKRAIDAPPPPLEFTPAHPQKGLSIAYTTWLTNRRPSPKPK

SEQ ID NO: 118202 - protein, 147 aa, Glycine max
  Coding DNA Sequence Number=SeqID_1424
  Gene Ontology: Mol. function=DNA binding; Biological process=DNA integration
MWQGIMAETKQQLRSYRNEYILVAVDYVSKWVEAMATSRNDAKTVVKFIKTNIFARFGVPQILISDGGSHFCNTEPRLGYAPEGQAVSGVPLPNTLEGPQFCPQPQPLHVVAGRIPHAMAKKGKLDHIEEWLRAIEGGRDHAFADMA

SEQ ID NO: 118203 - protein, 157 aa, Glycine max
  Coding DNA Sequence Number=SeqID_1425
MTITPPRAKGIVIGSSKKRSSMKVEKSGKKKQRTEYQTPSLFQDMKFKDKFDVGWFNKQVVNGRYIDLLDIKECEHLLADIMRVPKDSSRLYEDWLEGKGLRKTKVQKKFLENKRDDFKSKSLKSFGRIIHWMCMHYVLPKVGTFQEVNNYDLLVIY

SEQ ID NO: 118204 - protein, 59 aa, Glycine max
  Coding DNA Sequence Number=SeqID_1426
MKKVREEALTIELKKNLSYSLCFKLATTFVTCMAAWLLLQSQRPLSLASVRSTTTRSSS

SEQ ID NO: 118205 - protein, 149 aa, Glycine max
  Coding DNA Sequence Number=SeqID_1427
  Gene Ontology: Mol. function=nucleic acid binding; Biological process= transport
  Homolog annotation: Hit_ID=Q8H6Q8; Match level="QueryCoverage=98%, HitCoverage=4%, E-value=2e-27, Identity=40%"; Hit description=CTV.20
MCLRDIRHNKFENSLIGIVETSLGQGPIYFNCYPNKTVSLMDRNILDSLFLNIHFHGLDMKEGSIPAALIYRIQYKVMNTCASRVLLKPQKRETTLFITDMTKANVFLPRTIKWDEVTLPEKWVIDKVTPSVPRPAPTIEQIKQDNSGK

SEQ ID NO: 118206 - protein, 743 aa, Glycine max
  Coding DNA Sequence Number=SeqID_1428
  Gene Ontology: Mol. function=double-stranded RNA binding; Cellular component=intracellular; Biological process=protein modification process
  Homolog annotation: Hit_ID=Q8S8F6; Match level="QueryCoverage=81%, HitCoverage=99%, E-value=0.0, Identity=63%"; Hit description =Putative RNA helicase A
  Pfam annotation: Domain name=DUF1605; Domain location=402-513; Score =91.7; E_value=2.2e-24; Accession=PF07717.6; Description=Domain of unknown function (DUF1605)
  Pfam annotation: Domain name=HA2; Domain location=278-365; Score =107.8; E_value=3.2e-29; Accession=PF04408.13; Description=Helicase associated domain (HA2)
  Pfam annotation: Domain name=dsrm; Domain location=655-717; Score =53.3; E_value=8.1e-13; Accession=PF00035.15; Description=Double -stranded RNA binding motif
  Pfam module annotation: Pfam domain module=DUF1605::HA2::dsrm; Domain location=402-513::278-365::655-717
MSVLDWCLELTFRERSNVWRRITHVVTIGIGVVGGGLSTNNALGCGTQEQKDATVMKADTGFTYPVRTQFLEDILEMSGYRLTPDNQIDDYGQERIWKMNKQAPRKRKSQIASSVEDALRAADLSDYSLQTRESLSCWYPDCIGFNLIQYILCNICEHERPGAILVFMIGWDDINALKEKLLTHPVLSDPSRVLLLMCHSSMDSLEQRRGRAGRVQPGECYHLYPRCVYDSFAEHQLPEILRMPLQSLCLQIKSLKLGSISEFLSRALQSPEILAVQKAIEYLKTIGALDENENLTILGHNLTMLPMEPKLGKMLIFGVIFNCLDPILTIVAGLSVRDPFLTPLDKKDAAKSQFSQDYSDHLAIVRAYEGWKDAEKDLNGHEYCWKNFLSAQSMRVIDALRMEFLSLLKDIGLVDSNTSSCNAWSYDMYLIRAAVCYGLYPGICSVVHKDTSFSLKTMEDGQVLLHSNSVNARETRIPYPWVVFNEKIKVNSVFLRDSTAVPDSVVLLLGGSISKGDTDGHLKMSGGYLEFFMKPAVANMYQSIRKELDNLIRSKLHNFLMQLIRKNPSLTLARNSVKIEYISEGKLSSYELAFGVELVQNPHSKMISESILDPFKGPCTKPKSAGREGLLKPSMMALQQASVSRTDSGPGGDNSKSQLQTLLTRAGYGAPFYSTKQLKNNQFQATVEFNGVQIMGQPYINKKNAEKDAAAEALQWLMGRRETGNEDINHMTMLLKKSKKDHN

SEQ ID NO: 118207 - protein, 134 aa, Glycine max
  Coding DNA Sequence Number=SeqID_1429
MDCIVPSPKSQTKQYLKKGKQNELQLCVRMDAPFEAKLSGYARTRGATPAVEVQPKTVQIGGRRCWWWVHLLETSPELHRRTAAAGKGGKLLERRQQAERSTGMQKNVIGKRRNKCNSQKGPPEIGRRLIEERQ

SEQ ID NO: 118208 - protein, 111 aa, Glycine max
  Coding DNA Sequence Number=SeqID_1430
MNFSPRKSALRGVAKAVCCVGCAHGRHGVLERSLMQTNKRTVHWLPNRPNSGCGYSSPIKKVVHRCVYARNIGERHSGSGVNVIGEEDSEGGVQKGRETAVYTYTIQLSPQ

SEQ ID NO: 118209 - protein, 110 aa, Glycine max
  Coding DNA Sequence Number=SeqID_1431
YWPSYNTSSKQLYPAQFKVKSCWPDTECVDRGELVDSSRIQLNAKPNESILEEDANWNEEGGYYCIGRIWGNSNIKYVISQFLSNMRTRLTFRRSGIVRNVEKGGVSKDS

SEQ ID NO: 118210 - protein, 96 aa, Glycine max
  Coding DNA Sequence Number=SeqID_1432
MEREARGFACTCMSSRLPFLAMNSHRPVQVAAADNGVNRDVEFGASSLPLLLSVCHCAFFSLSFLPKRFSFVSFVSAAVSEAVSVSGCNTNNVWHK

SEQ ID NO: 118211 - protein, 218 aa, Glycine max
  Coding DNA Sequence Number=SeqID_1433
  Gene Ontology: Mol. function=transition metal ion binding; Cellular component=membrane fraction; Biological process=iron ion homeostasis
  Homolog annotation: Hit_ID=Q0F762; Match level="QueryCoverage=70%, HitCoverage=100%, E-value=5e-40, Identity=52%"; Hit description =Bacterioferritin subunit 1
MPAASKTGAAQPSDAEEGPPRTEAVVPLPRSERGGRREATQGELHSGRFAHLALQVVGQADLLDQAQLLLQPVGVVFFGVAQLGQQQVAAVVVAVALAQGHGRAQAVTHAVFGGQVLAQHLFDGLAGRELVRAHVGAAAQEQDAAQDGVGVLGFLFHLMADALEQAQQALVLVLARVDEVLVACGKFAAQQLYEAFDDFWLALHVLLLLTVLNTASIA

SEQ ID NO: 118212 - protein, 148 aa, Glycine max
  Coding DNA Sequence Number=SeqID_1434
  Homolog annotation: Hit_ID=Q2NWD7; Match level="QueryCoverage=29%, HitCoverage=20%, E-value=1e-14, Identity=81%"; Hit description=3,4 -dihydroxy-2-butanone 4-phosphate synthase
  Pfam annotation: Domain name=Hydrolase_2; Domain location=8-131; Score=8.0; E_value=4.5e-05; Accession=PF07486.3; Description=Cell Wall Hydrolase
MNIYHEARGEPVKGQIAVGTVTMNRANWDVKEICPVVYAPKQFSWTSLHKHPHRHPPQHDKSWQRAQRLAQRIVEAVNHKKRPDASHPALFISRRLSWPDGFHAGGARPPGLQWSPPAWRAASQTQSLPARAPCCRHHWSIRTAHPQV

SEQ ID NO: 118213 - protein, 114 aa, Glycine max
  Coding DNA Sequence Number=SeqID_1435
MKIVKGYTKNLHRPEASIVERLPKGQHDERVGGKGSRLHVITQSVEDLQQAHLYVLNNSNEVLSYILYHEGLVKESNPKMTKNRVMKEHNKTFLDWFKDTIFADEPKRNVVTWK

SEQ ID NO: 118214 - protein, 138 aa, Glycine max
  Coding DNA Sequence Number=SeqID_1436
  Gene Ontology: Mol. function=chitin binding; Cellular component =extracellular region; Biological process=chitin metabolic process
  Homolog annotation: Hit_ID=UPI00006BB294; Match level="QueryCoverage =88%, HitCoverage=53%, E-value=4e-10, Identity=30%"; Hit description =N-acetylmannosamine-6-phosphate 2-epimerase
MTDPLDESISCFLIRVNPWVLVPSPPEDYSSSLSKGHVPSPSEDYTSSPPEDYTSSPSEGRTPSPSEDYTSSPSEDFASSPLEGYTSSPSEHYTSSPSKGHVPSPSEDYTSSPSKGHVPSTSEDYTSSLSKGHVPSPL

SEQ ID NO: 118215 - protein, 132 aa, Glycine max
  Coding DNA Sequence Number=SeqID_1437
  Gene Ontology: Mol. function=glycerophosphodiester phosphodiesterase activity; Biological process=glycerol metabolic process
  Homolog annotation: Hit_ID=UPI00005F956B; Match level="QueryCoverage =75%, HitCoverage=40%, E-value=4e-27, Identity=60%"; Hit description =COG0584: Glycerophosphoryl diester phosphodiesterase
MANIEIKPSSGTEVETGRDVALAARTLWQGQTAPLLSSFSYAALEAAMQAAPELPRGLLLDEWHDDWQALTAALDCVSIHLNHRLLDVGRTAALKAAGLRILHVRHAAQRHQCRDNNQPFFHGVPPSVRPAV

SEQ ID NO: 118216 - protein, 88 aa, Glycine max
  Coding DNA Sequence Number=SeqID_1438
MESGDMRGYRMVIRTFRQPGANEPVDAQRLTSSSAPFVILTHGFRFTLVVWRHSSPMTHEILLCWAGTIKFDGVGKCRGCPTLSLSRH

SEQ ID NO: 118217 - protein, 284 aa, Glycine max
  Coding DNA Sequence Number=SeqID_1439
  Gene Ontology: Mol. function=DNA binding; Biological process =phosphorylation
  Homolog annotation: Hit_ID=Q5PD31; Match level="QueryCoverage=74%, HitCoverage=100%, E-value=8e-86, Identity=71%"; Hit description =Sugar fermentation stimulation protein A
  Pfam annotation: Domain name=SfsA; Domain location=85-281; Score =275.0; E_value=1.5e-79; Accession=PF03749.4; Description=Sugar fermentation stimulation protein
MDTFARGLAGHAPATARIIAAGEYAARAGGAQRLLSESAAISSAYHAAARCRTHTLYAATALDAGRHDEGILMKFSPALQPATLIQRYKRFIADVVTPEGKTLTLHCPNTGAMTGCATPGDTVCGAFICVNTLRANQLVKEALTHGTIPELVGYGTHKSEVKYGDESSRIDFMLQAEDRPECYIEVKSVTLAEQENGYFPDAVTLRGQKHLRELMSVAAAGKRAVLLFAVLHSAIERFSPARHIDPKYAQLLNEAQKQGVEVLAYKAELSADNMTLRSSLPIVL

SEQ ID NO: 118218 - protein, 333 aa, Glycine max
  Coding DNA Sequence Number=SeqID_1440
  Gene Ontology: Mol. function=protein serine/threonine kinase activity; Cellular component=membrane; Biological process=protein amino acid phosphorylation
  Homolog annotation: Hit_ID=P93068; Match level="QueryCoverage=93%, HitCoverage=38%, E-value=3e-73, Identity=39%"; Hit description =Receptor-like kinase
  Pfam annotation: Domain name=B_lectin; Domain location=1-109; Score =102.9; E_value=9.4e-28; Accession=PF01453.15; Description=D-mannose binding lectin
  Pfam annotation: Domain name=PAN_2; Domain location=259-314; Score =85.9; E_value=1.3e-22; Accession=PF08276.2; Description=PAN-like domain
  Pfam annotation: Domain name=S_locus_glycop; Domain location=123-250; Score=135.7; E_value=1.3e-37; Accession=PF00954.11; Description=S -locus glycoprotein family
  Pfam module annotation: Pfam domain module=B_lectin::PAN_2::S_locus _glycop; Domain location=1-109::259-314::123-250
MSDGETLVSKGGKFEFGFFSPGNLVLTKNESLVWYTNNSHNQAQNPVAELLDSGNLVIRNDGETNPEAYLWQSFDYPSDTFLPGMKLGWNLRIGHEWKQTAWKSPDDPSPGDVYRVLELYNYPEFYVMKGTKKAYRFGPWNGLYFSGLSDFENGTMYSFCYVSNKHEISFTYSIANDSFIARSVANQTAITIYRYMWVVGEQDWKMSRSFPQEFCDTYSLCGAYGNCVSSTQRQACQCLKGFSPKSPEAWNSSDWSGGCLKVPDTTHTWWDESIGLEECRVKCLNSCSCMAYSNSDIRGEGSGCVMWFGDLIDMKQLQTGKQDLYIRMAASEL

SEQ ID NO: 118219 - protein, 239 aa, Glycine max
  Coding DNA Sequence Number=SeqID_1441
  Homolog annotation: Hit_ID=UPI0000E44EDA; Match level="QueryCoverage =41%, HitCoverage=24%, E-value=3e-11, Identity=37%"; Hit description =putative inner membrane protein
LGDRRLRCRFPLRFAGAVGAAFSPCRRQCEAGAPHTLDDRFHAARQSGTGNARGAVGQRAPSRHRRAGLPGCRPHHGGRPAIRRRRRAGADRFCARSEEPDRHRLRHGAHGGAGADAFSASKVLVAIGSLHPANDAQLASLRQAGAVLVTLPEAADPEAVAQEVRTAFARADVVCLMSPRSRAATADHAAALGAVVSRCTPAFDGLVATGGDTARRIVDAMAAGSLTLFGEVEPGVPFG

SEQ ID NO: 118220 - protein, 71 aa, Glycine max
  Coding DNA Sequence Number=SeqID_1442
MSFFFVFLTERFYQFSKWLTKNFEPVVLHIAAVEEDKEWNHEADNVGVHIADPTIAEQFGGNVVLFWWLLQ

SEQ ID NO: 118221 - protein, 122 aa, Glycine max
  Coding DNA Sequence Number=SeqID_1443
  Gene Ontology: Mol. function=nucleic acid binding; Biological process= DNA integration
MPLYAKFLKDTLTKKNRYILSDRIVMEGNCSVVIQCILPIKHKDPGVVTISCSLRLGEIEIMPTCLTLQLADRSITRPYGVIEDVSVKVKHLIFPSDFVVMDIEEDVDIPLILGQPFISTAS

SEQ ID NO: 118222 - protein, 123 aa, Glycine max
  Coding DNA Sequence Number=SeqID_1444
MSVIDIEHDINILIVTNNSNLVIEHARPSRNGALKVMPDVSSIGACRPRIFFINGFLCFLEDEWQRNGEGRGRRHFKEKMSLEEIHHHRRPWIRAWRKKEMNEGRGREEHEILCSKRTLKYEV

SEQ ID NO: 118223 - protein, 226 aa, Glycine max
  Coding DNA Sequence Number=SeqID_1445
  Gene Ontology: Mol. function=transcription factor activity; Biological process=regulation of transcription, DNA-dependent
  Homolog annotation: Hit_ID=Q5PJW0; Match level="QueryCoverage=88%, HitCoverage=91%, E-value=7e-64, Identity=60%"; Hit description =Transcriptional repressor for envCD
  Pfam annotation: Domain name=TetR_C_2; Domain location=84-203; Score =166.8; E_value=5.5e-47; Accession=PF08361.2; Description=MAATS-type transcriptional repressor, C-term
  Pfam annotation: Domain name=TetR_N; Domain location=16-62; Score =73.0; E_value=9.6e-19; Accession=PF00440.13; Description=Bacterial regulatory proteins, tetR family
  Pfam module annotation: Pfam domain module=TetR_C_2::TetR_N; Domain location=84-203::16-62
MARKKKEEAQQTRQQLIEAAIGQFATRGVANTTLTDIADAARVTRGAIYWHFTSKSEIFNAIWEQQLPLRDIIRDRLSLSENDDPLLMLREQFITALQYIAHEPRQCALLQILYHKCEFSSDMISESEIRKRIGFNDDALRVTLEGCISRGIISPRMNVDLTLIVFHGFFSGIIKNWLMNNDSFNLYQQAPALVDSILATLPIVRVSPHDDYSSAPGRQALEIEQA

SEQ ID NO: 118224 - protein, 67 aa, Glycine max
  Coding DNA Sequence Number=SeqID_1446
MVMDMADTFGEDFGIHFNQWSSNIRAGFNHIFFYSIITPDCWNGEGVALMQKFPQNHQCQDCSSSAL

SEQ ID NO: 118225 - protein, 255 aa, Glycine max
  Coding DNA Sequence Number=SeqID_1447
  Gene Ontology: Mol. function=protein kinase activity; Biological process=protein amino acid phosphorylation
  Homolog annotation: Hit_ID=Q1SN45; Match level="QueryCoverage=97%, HitCoverage=16%, E-value=2e-60, Identity=46%"; Hit description=AAA ATPase
MFYTLHIEKHALQWVFCKMTENLWKQSKKLRTRVSLLNLKNFGIRHGIELHIDDKQLKNLTLLEIEKLLHPNQKSLKDYPTMPYPEGGNPASCLENSLILSELNYNNDQARSEFKNLFLSMTDEQKQIYHKIMEAVNNNEGDMFFLYGYGGTGKTYIWRTLASSLRAKNQIVIMVASSGIASLLLPGGRTAHSKFKIPVPIFEDSTCNILQGSQLAELLNQTNLIIWDEAPMAHKFCFEALDQTLRDIIKEKKSQ

SEQ ID NO: 118226 - protein, 65 aa, Glycine max
  Coding DNA Sequence Number=SeqID_1448
MKKNALVAKINKVQHGSNNFYGLSFEVGEEDVRRLSQAVVAAVWSCDAAKSPAPDGFSLEIFKSC

SEQ ID NO: 118227 - protein, 134 aa, Glycine max
  Coding DNA Sequence Number=SeqID_1449
  Gene Ontology: Mol. function=RNA-directed DNA polymerase activity; Biological process=RNA-dependent DNA replication
MALLRKKVCWIKWDMVCKSKKDGGLGVKELEMFNDSLLSNWRWRLLQDEESMWSRFLSFRYGNVHMLPLKLQNRSTSSIWWHDLVGLGATKMQQEGWLKEVIVKRVGEETRTLFWSESRRGIAASRIHILDYSK

SEQ ID NO: 118228 - protein, 158 aa, Glycine max
  Coding DNA Sequence Number=SeqID_1450
  Gene Ontology: Mol. function=RNA-directed DNA polymerase activity; Cellular component=nucleus; Biological process=RNA-dependent DNA replication
  Pfam annotation: Domain name=AT_hook; Domain location=113-125; Score =14.9; E_value=0.061; Accession=PF02178.9; Description=AT hook motif
SGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVNQMERRQTIRGRGRPKKTIREVIKKDLELNDLDRSMGFEEDVWTWSRMEWSLLP

SEQ ID NO: 118229 - protein, 48 aa, Glycine max
  Coding DNA Sequence Number=SeqID_1451
MSTVQRQMMHKPFIKEIATWRREGDTFGSDPLGMTLGEIEDYKLFMID

SEQ ID NO: 118230 - protein, 192 aa, Glycine max
  Coding DNA Sequence Number=SeqID_1452
MTAREGAACVVPGLRGESALSVTDRRSPQCRPRRPGGQGILRSGELTLFYAAAKAADIGITPKAPLPLIAQLNVVIGILIGGIRIGLAAAIGFLHRAFIRGIRFGARFAAARMIALDIDAKTAFISRLCPGNRRAPNGALQAAKASRMALAAGNATIKQQNENYYHLPWALRASQAAIPSADGVKSCAFSRD

SEQ ID NO: 118231 - protein, 51 aa, Glycine max
  Coding DNA Sequence Number=SeqID_1453
AARMPEAGGANEVRTRSRVQFSVTSRSKAIGNKATLLTEGHSGYSNHKEKE

SEQ ID NO: 118232 - protein, 71 aa, Glycine max
  Coding DNA Sequence Number=SeqID_1454
MRILSWAKVQSSSRLCPNMVFSSCEPDFDIWGKTNSCVKVSVSGRISISFPRGTRNNDDLETTCKISHGYS

SEQ ID NO: 118233 - protein, 101 aa, Glycine max
  Coding DNA Sequence Number=SeqID_1455
  Subcellular localization annotation: CTP_CleavageSite=62; ConfidenceScore=5.55e-01
MSLPGAVHASSTNESGAPRSYCVALFTNSPFSTFLRSPMNVIAWRCSCILHLRVWNPAKLLRSALRQFSVLHFLTEPHECHCLSLFMHPPPTTLEPREVIA

SEQ ID NO: 118234 - protein, 264 aa, Glycine max
  Coding DNA Sequence Number=SeqID_1456
  Gene Ontology: Mol. function=hydrolase activity; Biological process =intracellular signaling cascade
  Homolog annotation: Hit_ID=Q9SK32; Match level="QueryCoverage=90%, HitCoverage=58%, E-value=1e-67, Identity=48%"; Hit description =Expressed protein
  Pfam annotation: Domain name=DUF1723; Domain location=2-50; Score =72.3; E_value=1.5e-18; Accession=PF08330.1; Description=Protein of unknown function (DUF1723)
MSLDNALIAALVERWRETNSFHLAVGELTITLEDVSLLLGLAIDGEPVIGPISAPSSVCEKLLGRVPEDLNGGMVKLTWLKEFFSECPEDASQEEIERCTCAFLLYLVGSTIFSTTTGNKVPVIYLSLFEDFDKAGKFAWGPGALAFLYRALGNASLKSQSTISGCLTLVQVQWLPYNDMDCSSIPEDIKASLILWESRTMLLCFDKVERHLPDRCLRQFGMHQTIPKYVERWERKSCIVDHGVDLMEKMEFGSQSGQNLGLCC

SEQ ID NO: 118235 - protein, 450 aa, Glycine max
  Coding DNA Sequence Number=SeqID_1457
  Gene Ontology: Mol. function=hydrolase activity, hydrolyzing O -glycosyl compounds; Cellular component=apoplast; Biological process =carbohydrate metabolic process
  Homolog annotation: Hit_ID=Q7XA49; Match level="QueryCoverage=99%, HitCoverage=89%, E-value=0.0, Identity=67%"; Hit description=Beta -fructofuranosidase
  Pfam annotation: Domain name=Glyco_hydro_32C; Domain location=300 -402; Score=33.7; E_value=6.6e-07; Accession=PF08244.2; Description =Glycosyl hydrolases family 32 C termi
  Pfam annotation: Domain name=Glyco_hydro_32N; Domain location=1-303; Score=530.3; E_value=2.1e-156; Accession=PF00251.10; Description =Glycosyl hydrolases family 32 N termi
  Pfam module annotation: Pfam domain module=Glyco_hydro_32C::Glyco _hydro_32N; Domain location=300-402::1-303
MRYGGLYHVFYQYNPRGATWGNIVWAHSVSKDLVNWTPLDPALFPSQPSDINGCWSGSATLLPGNKPAILYTGIDSMNRQVQNLAQPKNLSDPFLREWVKSPKNPLMEPTSANNIDSSSFRDPTTAWLGKDGQWRVLVGSLRETSGTALLYKSKDFVDWVQAEQPLHSTLGSGMWECPDFFPVLSNGQLGVDTSLNGDHVRHVLKASLSAKQHDYYMIGSYNATKDVFIPDNGTNQFVLSYDYGKYYASKTFFDDGKKRRILLAWVSESSSSADDKKKGWSGIYTIPRTIWLHKSGKQLVQWPVVEIEKLRAYPVNLPPQVLKGGQLLHINGVTATQADIEISFKVNKLKKAEVFPNSVSSLNKDNDLATYGTFVDVDPLHEKLSLRTLIDHSVVESFGGEGRACITARVYPTLAINDKAQIYAFNNGTVDVKITKLNAWSMKKAQINRN

SEQ ID NO: 118236 - protein, 70 aa, Glycine max
  Coding DNA Sequence Number=SeqID_1458
MREIANIADIVSAEGLDSYNRELLDEVINIVHKCLTGQFEEIPNEKVKKKGKRKGIYWIHPHVADVWPGF

SEQ ID NO: 118237 - protein, 102 aa, Glycine max
  Coding DNA Sequence Number=SeqID_1459
  Gene Ontology: Mol. function=hydrolase activity, hydrolyzing O -glycosyl compounds; Cellular component=apoplast; Biological process =carbohydrate metabolic process
  Homolog annotation: Hit_ID=Q7XA49; Match level="QueryCoverage=87%, HitCoverage=15%, E-value=2e-42, Identity=93%"; Hit description=Beta -fructofuranosidase
  Pfam annotation: Domain name=Glyco_hydro_32C; Domain location=1-56; Score=26.4; E_value=7.3e-05; Accession=PF08244.2; Description =Glycosyl hydrolases family 32 C termi
MEPNSYDIQMHDRSSLNKDNDLTSYGTFVDVDPLHDKLSLRTLIDHSVVESFGGEGRACITARVYPTLAINDKAQLYAFNNGTADVKITRLSAWSMKKAQIH

SEQ ID NO: 118238 - protein, 396 aa, Glycine max
  Coding DNA Sequence Number=SeqID_1460
  Gene Ontology: Mol. function=hydrolase activity, hydrolyzing O -glycosyl compounds; Cellular component=apoplast; Biological process =carbohydrate metabolic process
  Homolog annotation: Hit_ID=Q7XA49; Match level="QueryCoverage=98%, HitCoverage=70%, E-value=0.0, Identity=91%"; Hit description=Beta -fructofuranosidase
  Pfam annotation: Domain name=Glyco_hydro_32N; Domain location=45-359; Score=610.3; E_value=1.7e-180; Accession=PF00251.10; Description =Glycosyl hydrolases family 32 N termi
MTMSTIWLLTLFSVIYGSAATHHIYRNLQSVSSDSSNQPYRTAYHFQPPNNWINGPLRYGGLYHLFYQYNPKGAVWGNIVWAHSVSRDLVNWTPLDPAIFPSQSSDINGCWSGSATLLPGNKPAILYTGIDSLNQQVQNFAQPKNLSDPFLREWVKSPKNPLMAPTSANKINSSSFRDPTTAWLGKDGHWRVLVGSKRRTRGMAILYRSKDFVKWVQAKHPLHSTLGSGMWECPDFFPVLSNGQLGVDTSVNGEYVRHVLKVSLDDKKHDYYMIGSYNAAKDAFIPDEESNIFVLRYDYGKYYASKTFFDDGKKRRILLGWVNESSSVADDIKKGWSGIHTIPRAIWLHKSGRQLVQWPVEEVEKLRAYPVNLLPQVLKGGKLLPINGVTASQEFR

SEQ ID NO: 118239 - protein, 159 aa, Glycine max
  Coding DNA Sequence Number=SeqID_1461
  Gene Ontology: Mol. function=hydrolase activity
  Homolog annotation: Hit_ID=Q1SK24; Match level="QueryCoverage=99%, HitCoverage=39%, E-value=2e-34, Identity=62%"; Hit description=Beta -lactamase-like
  Subcellular localization annotation: CTP_CleavageSite=43; ConfidenceScore=5.50e-01
MVVASIRLLPSPFLSFAPRFSPYSYSWRCRPSSTIPFSSIHSKASTKGDGGVVEFGGDQTELIFLGTGTSEGVPRVSCLTNPLHKCEVCSKAAQPGNKNRRLNTSILIRHPGSSGTHNNILIDAGKRSLKLIHLELKDTPLFFITIFLSQCSPVVSCFW

SEQ ID NO: 118240 - protein, 169 aa, Glycine max
  Coding DNA Sequence Number=SeqID_1462
MTCDSRTRASSLSLTHLLSQGGNPEPQSREGGGEDGSGNGNGKDAAKKNNHHPRPENVMLLRRAATSSARAPLFELPIMNPAQYESESETIFGALNLNLQLFCNEVLNIVDGTHPQSKLNIKATQRSQDLKKLYLTYHCYNVLNIVAEEKMVPFDYGPLAQVTNEDIVL

SEQ ID NO: 118241 - protein, 52 aa, Glycine max
  Coding DNA Sequence Number=SeqID_1463
MVVPRASHVNLMHFFVHRISMPGSFISMRKKCTLRQPYRMDARARVMGEVDE

SEQ ID NO: 118242 - protein, 43 aa, Glycine max
  Coding DNA Sequence Number=SeqID_1464
MAAAAPDEADVDVHRPGHAVDGYVAIADKLERLLNLRILIEGT

SEQ ID NO: 118243 - protein, 117 aa, Glycine max
  Coding DNA Sequence Number=SeqID_1465
MCPVVGFGPWLGLGKPLVEILPPGQLRGFCPLLAWLGSAVLGYGPVLSFGLVGPLLPPVISFVARILPTLACAPLAKSVPRWVCGDLEGRDESSDRAESQWIVAARPLCHLQYPVAY

SEQ ID NO: 118244 - protein, 108 aa, Glycine max
  Coding DNA Sequence Number=SeqID_1466
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=82%, HitCoverage=17%, E-value=1e-29, Identity=65%"; Hit description =Glycoside hydrolase, family 1
MVVTLNIIFSILARINELDDPTLSPEESLMDFYRIDYHYRHLLNVDYAIRDGVRVKGYFVWSLLDCFEWSNGYIPRFGLIFVDHKNNLNRSPKLSAKWFRKFLQNRLL

SEQ ID NO: 118245 - protein, 344 aa, Glycine max
  Coding DNA Sequence Number=SeqID_1467
  Gene Ontology: Mol. function=oxidoreductase activity; Biological process=electron transport
  Homolog annotation: Hit_ID=Q1RYZ3; Match level="QueryCoverage=97%, HitCoverage=96%, E-value=1e-107, Identity=64%"; Hit description =Oxidoreductase, C-terminal
  Pfam annotation: Domain name=GFO_IDH_MocA; Domain location=9-123; Score=-16.2; E_value=0.033; Accession=PF01408.12; Description =Oxidoreductase family, NAD-binding Rossmann fold
MATKQLPQIAILGAGIFVKTQYLPRLSEISHLFILKSIWSRTQESATAAVDIARKHFPQVETKWGDNGFDDIIHDGSIDAVAVVLAGQNQVDISLRLLKAGKHVLQGTSELEAALSSYKSISSDAPGQLIWSVAENYRFEPGLVECKKLIAGIGKMMSVQVIIEGSMNSSNPYFSSSWRRNFTGGFILDMGVHFIAGFTIHDWKSKIKFGMFCLSHLENGCSGVFTLWRVVGLNGTLQVERGFQGQHGYLVGSELYFKITEVATYFNQSTVSFYGTDGQNKSSFFPFSGVTEELKAFINDVSEITLKQKRNQFVTEPRLSYVEGARDVAVLEAMLESGARQGFA

SEQ ID NO: 118246 - protein, 71 aa, Glycine max
  Coding DNA Sequence Number=SeqID_1468
MVGAFSQNIVTLTGLPMILLSESDLTNPLCGVSCYVLLSAPAWFFTDMMNRWMTMKNLMLEDTGTPRSDRM

SEQ ID NO: 118247 - protein, 329 aa, Glycine max
  Coding DNA Sequence Number=SeqID_1469
  Gene Ontology: Mol. function=phospholipid binding; Cellular component= coated pit; Biological process=endocytosis
  Homolog annotation: Hit_ID=Q9SA65; Match level="QueryCoverage=97%, HitCoverage=55%, E-value=1e-126, Identity=67%"; Hit description =Putative clathrin assembly protein At1g03050
  Pfam annotation: Domain name=ANTH; Domain location=31-318; Score =381.8; E_value=1.1e-111; Accession=PF07651.6; Description=ANTH domain
  Pfam annotation: Domain name=ENTH; Domain location=31-152; Score= -3.5; E_value=5.4e-05; Accession=PF01417.11; Description=ENTH domain
  Pfam module annotation: Pfam domain module=ANTH::ENTH; Domain location=31-318::31-152
MAPSSKFRRALGAVKDQTSISLAKVGSSTSVADLDVAIVKATRHDEYPAEEKHIREILSLTCYSRAFISACVNTLTRRLNKTKSWTVALKTLVLIQRLLLEGDPAYEQEIFFSTRRGTRLLNMSDFRDNSKSDSWDFSAFVRTYALYLDERLEYKMQSRRGMRSMYGLDEDEEEREREKEIIVRSTPVRDMKLDQIFSKMQHLQLLLERFLACRPTGGAKNHRIVIVALYPIVKESFRIYYDISEILSILIDRFPDMEVSDCVKVYDIFCRVGKQFDELDLFFGWSKSIGIARSSEYPEIERVTLKKLEVMEEFIKDKSALAQSNKLEA

SEQ ID NO: 118248 - protein, 439 aa, Glycine max
  Coding DNA Sequence Number=SeqID_1470
  Gene Ontology: Mol. function=DNA binding; Cellular component=nucleus; Biological process=regulation of transcription
  Homolog annotation: Hit_ID=Q2QXB1; Match level="QueryCoverage=76%, HitCoverage=80%, E-value=1e-67, Identity=42%"; Hit description =Expressed protein
MSSSGLGGGILDLESPFHRHQHTQLGQQSITGQQHINIMSGLESDHPIGLIEVKSLNVALNFGKAKALAPSNSNELSEEDEPSYAEEGNCENLDGGNSKKGSPWQRMKWADNVVRLLITVVSCVGDDGTIGGMDGHKRKSGVLQKKGKWKMVSKIMIGKGCHVSPQQCEDKFNDLNKRYKRLNDILGRGTCCQVVENPVLMDSMPNLSAKMKDDVRKILSSKHLFYKEMCAYHNGQRIPNSHELDLPGYSLEHGRDSRDNNGSEDEDEDNNDSEDDESDDEINTNAHEDGGRMQELCDRNKLSDEDVHFGPQTSRMDKFEVEMARVFQDPTKLLREQREWIKIQMLQLQEQNISYQAQALELEKQRLKWLRYCSKKDRELGKLRLENKRMKLENEHRILKLKQKELEADFSTSEMSLDPASLGINRTQGREHISLGRQQ

SEQ ID NO: 118249 - protein, 395 aa, Glycine max
  Coding DNA Sequence Number=SeqID_1471
  Gene Ontology: Mol. function=transporter activity; Cellular component= mitochondrial inner membrane; Biological process=transport
  Homolog annotation: Hit_ID=P25083; Match level="QueryCoverage=99%, HitCoverage=100%, E-value=1e-157, Identity=73%"; Hit description=ADP, ATP carrier protein, mitochondrial precursor
  Pfam annotation: Domain name=Mito_carr; Domain location=199-295; Score=102.5; E_value=1.3e-27; Accession=PF00153.17; Description =Mitochondrial carrier protein
  Pfam annotation: Domain name=Mito_carr; Domain location=299-389; Score=96.1; E_value=1e-25; Accession=PF00153.17; Description =Mitochondrial carrier protein
  Pfam annotation: Domain name=Mito_carr; Domain location=94-191; Score= 125.4; E_value=1.6e-34; Accession=PF00153.17; Description =Mitochondrial carrier protein
  Pfam module annotation: Pfam domain module=Mito_carr::Mito_carr::Mito_ carr; Domain location=199-295::299-389::94-191
MMVDKQRYPTIEQKLAGQLHLRSNSNLSPHVGTCYERLKRPALFQQRFSLKNHSNAGLLCPLVPAWKATSHLHSVASAASPVLVPSPSEKNFASFATDFLMGGVSAAVSKTAAAPIERIKLLIQNQDEMIKAGRLSEPYKGIGDCFGRTTKDEGLVSLWRGNTANVIRYFPTQALNFAFKDYFKKLFNFKKDRDGYWKWFAGNMASGAAAGALSSVFVYSLDYARTRLANDAKAGKTGGERQFNGLVDVYRKTLRSDGVAGLYRGFNVSCVGIIVYRGLYFGMYDSLKPVLLVGTLQDSFLASFALGWMVTIGASIASYPLDTVRRRMMMTSGEAVKYKSSFDAFSQIVKNEGSKSLFKGAGANILRAVAGAGVLSGYDKLQVLVLGKKYGSGGA

SEQ ID NO: 118250 - protein, 128 aa, Glycine max
  Coding DNA Sequence Number=SeqID_1472
MANATLLPCSSVCMGGGGGVDSAPRLESLYISAATIALLHCGIPCIWGRNSVYYCNCYGCRGCGMHPESSCNLLHKYLSQDKSKYAVNKLFYTNPKYLSHNYGRVDTKLQKELNKKQGLKITALRTWG

SEQ ID NO: 118251 - protein, 268 aa, Glycine max
  Coding DNA Sequence Number=SeqID_1473
  Gene Ontology: Mol. function=zinc ion binding
MKLLESKKRAESRPESSENPSDTDPPHKKTRDLPNLTECHACGFKVDVCTGKNRLRTLYSEWRVVLLCKKCFSSVESSQICSYCFSGASPESFRCNQCLHSVHKSCFLKYKNAAPWSYACLGSEFSVCVDCWIPKHLAISRRRNKIGVKNGKNGRVMPEKGSPRVFGGGNLVRSMEDLVEDAKRAVGEKVEAAARARDEAMQKAMVARSALEIANNALSLVANREESSLNLPPKMDAVKVLDGSELTFELHPRFNSLPRISKSCCLLN

SEQ ID NO: 118252 - protein, 147 aa, Glycine max
  Coding DNA Sequence Number=SeqID_1474
MMFGAFDMRGGGGTMSLPTFFLDFVANPYRSGCILCKASIEHRSSKQRMVMIILTMHPSQPITPQQRMKNTHPTITYHLQAKENTHPMSLSHHHPLLMSISLLHCHLLHRLHHMCINLLLLLMPTSLLYHHLIHHLLHMSFCNNLLS

SEQ ID NO: 118253 - protein, 875 aa, Glycine max
  Coding DNA Sequence Number=SeqID_1475
  Gene Ontology: Mol. function=iron-sulfur cluster binding; Cellular component=peroxisome; Biological process=electron transport
  Homolog annotation: Hit_ID=Q1SCP9; Match level="QueryCoverage=98%, HitCoverage=76%, E-value=0.0, Identity=77%"; Hit description =Aldehyde oxidase and xanthine dehydrogenase, molybdopterin binding domain, putative
  Pfam annotation: Domain name=Ald_Xan_dh_C; Domain location=572-679; Score=158.2; E_value=2.1e-44; Accession=PF01315.12; Description =Aldehyde oxidase and xanthine dehydrogenase, ab hammerhead domain
  Pfam annotation: Domain name=CO_deh_flav_C; Domain location=410-521; Score=153.3; E_value=6.4e-43; Accession=PF03450.7; Description=CO dehydrogenase flavoprotein C-terminal domain
  Pfam annotation: Domain name=FAD_binding_5; Domain location=222-403; Score=242.7; E_value=7.9e-70; Accession=PF00941.11; Description=FAD binding domain in molybdopterin dehydrogenase
  Pfam annotation: Domain name=Fer2_2; Domain location=59-135; Score =161.1; E_value=2.8e-45; Accession=PF01799.10; Description=[2Fe-2S] binding domain
  Pfam module annotation: Pfam domain module=Ald_Xan_dh_C::CO_deh_flav _C::FAD_binding_5::Fer2_2; Domain location=572-679::410-521::222 -403::59-135
MGSLKTEEDLKVSNEAILYVNGVRRLLSDGLAHFTLLEHYAINACLAPLYSVEGMHVITVEGLGSCKRGLHPVQESLARAHGSQCGFCTPGFVMSMYALLRSSQTPPSEEQIEECLAGNLCRCTGYRPIFDAFRVFAKTSNDLYTGVSSLSLEEGKSVCPSTGKPCSCNLSNTNDKCVGGDNGYEPTSYNEIDGTKYTERELIFPPELLLRTPTSLNLTGFGGLMWYRPLTLQHVLDLKAKYTDAKLLVGNTEVGIEMRLKRMPYRVLISVMHVPELNVLGAKDDGLEIGAAVRLSDLMNFFKKVVTERAAHETLSCKAFIEQLKWFAGTQIRNAASVGGNICTASPISDLNPLWMAARAKFRIIDAKGNIRTVLAENFFLPGYRKVNLASGEILLSVFLPWNRTFEFVKEFKQSHRRDDDIAIVNAGIRVHLQEHSENCVVADASIFYGGVAPYSLAATKTKEFLIGKNWNQDLLQNALKVLQKDILLKEDAPGGMVEFRKSLTLSFFFKFFLWVSHQMDSVKESIPSSHLSAVHSVHRPPVTGSQDYEIRKRGTSVGSPEVHLSARLQVTGEAEYADDTPMPPNGLHAALVLSKKPHARIIKIDDSEAISSPGFVSLFLAKDVPSDNKIGPVVADEDLFAVDYVTCVGQVIGVVVADTHENAKIAARKVIVEYEELPAILSIRDAINARSFHPNTEKCLSKGDVDHCFQSGQCDRIIEGEVQMGGQEHFYLEPHSTLIWTVDGGNEVHMISSSQLLWLESPRLYKPHIRFLYFQRGTQVPYLAPQKHQKYVSHVLGLPMSKVVCKTKRIGGGFGGKETRSAFIAAAASVPSYLLNRPVKITLDRDVDMMITGQRHSFLGKYKVILMHFVCTTI

SEQ ID NO: 118254 - protein, 112 aa, Glycine max
  Coding DNA Sequence Number=SeqID_1476
  Gene Ontology: Mol. function=transition metal ion binding; Cellular component=endoplasmic reticulum; Biological process=nitrogen fixation
  Homolog annotation: Hit_ID=Q9M2C3; Match level="QueryCoverage=72%, HitCoverage=39%, E-value=9e-30, Identity=81%"; Hit description =Nodulin-like protein
  Pfam annotation: Domain name=DUF125; Domain location=46-110; Score= -26.4; E_value=0.0087; Accession=PF01988.9; Description=Integral membrane protein DUF125
MANNVQPCHDLDPREAKSPSKMLNLDVEAQLREEEKGFDYAKRAQWLRAAVLGANDGLLSTASLMMGVGAVRKDVKSMILTGVAGLVAGACSMAIGEFVSVYSQLLISSWLR

SEQ ID NO: 118255 - protein, 105 aa, Glycine max
  Coding DNA Sequence Number=SeqID_1477
  Subcellular localization annotation: CTP_CleavageSite=84; ConfidenceScore=5.19e-01
MKSCLLCNLLRLQAVATSLCPSCPCCACLANGRGDSNSMSPDSPLSMTVSSTYWSHQRVSPTSMAACPRHCIVLPLFNVVSLPCFSLRQDSALEIWKKEHNTTHI

SEQ ID NO: 118256 - protein, 80 aa, Glycine max
  Coding DNA Sequence Number=SeqID_1478
  Homolog annotation: Hit_ID=Q9SU24; Match level="QueryCoverage=66%, HitCoverage=6%, E-value=6e-16, Identity=70%"; Hit description=Origin recognition complex subunit 1-like protein
MQLAMRVSCFCTSNGEVFPGYDTLLQIGCRLGECRIILCEAGAKHKLQKLQLNFPRLVLKAPIISSADPTETNDGIMSSA

SEQ ID NO: 118257 - protein, 122 aa, Glycine max
  Coding DNA Sequence Number=SeqID_1479
  Gene Ontology: Mol. function=DNA binding; Biological process=DNA integration
MGNNDPCKSIDICSIQIRMHDGIVRTLTEEATPNEIRKGYGHTKAMLDYVYSNYWGPLRVPSLGGARYFLSIINYYSRMTWVFMMKKKFKAFECFKHWTILMKNQAGKTVKCLGPIMDYEIQ

SEQ ID NO: 118258 - protein, 760 aa, Glycine max
  Coding DNA Sequence Number=SeqID_1480
  Gene Ontology: Mol. function=nucleoside-triphosphatase activity; Cellular component=nuclear origin of replication recognition complex; Biological process=DNA replication initiation
  Homolog annotation: Hit_ID=Q9MB44; Match level="QueryCoverage=92%, HitCoverage=82%, E-value=0.0, Identity=61%"; Hit description=Origin recognition complex 1
  Pfam annotation: Domain name=AAA; Domain location=531-740; Score =53.1; E_value=9.2e-13; Accession=PF00004.19; Description=ATPase family associated with various cellular activities (AAA)
  Pfam annotation: Domain name=BAH; Domain location=229-404; Score =34.6; E_value=3.4e-07; Accession=PF01426.8; Description=BAH domain
  Pfam annotation: Domain name=PHD; Domain location=197-244; Score =38.1; E_value=3e-08; Accession=PF00628.19; Description=PHD-finger
  Pfam annotation: Domain name=zf-C3HC4; Domain location=198-241; Score= 5.0; E_value=0.048; Accession=PF00097.15; Description=Zinc finger, C3HC4 type (RING finger)
  Pfam module annotation: Pfam domain module=AAA::BAH::PHD::zf-C3HC4; Domain location=531-740::229-404::197-244::198-241
  Subcellular localization annotation: CTP_CleavageSite=72; ConfidenceScore=5.75e-01
MAATPSKSFQTPSNPKLRSKSNPKSSPAVTPDTPQTLHIRRSTRAKSLLFDAPKPPHSPLQISLTTPKRRTRRSIVEEDSAEDKATPSKISPKNKAPVVDASKKKNGKSSIEFFFAPVTPASSEKASTRKREGEGGVVSRAKRGKSENREKSAKLPQRRVYYKKVIYDGGEFELGDDVYVKRREDASSDDEDPEMEECRMCFSSNDEVMIECDDCLGGFHLKCLRPPLKDVPEGDWICGFCEARKMGKEVQLPKPPKGKKLVRTMREKLLSSDLWSGRVESIWREVDGNYWCRVRWYTIPEETSVGRQPHNLRRELYRTNDFADIEISNKGELGCHNNETVDAANAYIIRMILRSGIMFKMESVLRHCHVMTPKEYAKASNEGDDVFLCEYEYDIHWHSFKRLADIDNETENGEESDSDEDWNVGKESDSDTDEDVEYEEENIKNAQSQPSRSHHLAANLYKGRFFGLQKIGTKTIPQHVRSHKQTDLERAKATLLLASLPKSLPCRNKEMEEITTFIKGAISNDQCLGRCLYIHGVPGTGKTMSVLSVMRSLKSEVDAGNIKPYSFVEINGLKLASPENIYKVIYEALNGHRVSWKKALHLLNERFVEGKKTRDEADQPCILLIDELDLLVTRNQSVLYNILDWPTKPHSKLIVIGIANTMDLPEKLLPRISSRMGIQRLCFGPYNYQQLQEIISSRLKGIDVFEKQAVEFASRKVAAISGDARRALEICRRAAEIADYRVKKLISNPDCVTAGIYFTS

SEQ ID NO: 118259 - protein, 378 aa, Glycine max
  Coding DNA Sequence Number=SeqID_1481
  Gene Ontology: Mol. function=nucleic acid binding; Cellular component= signal recognition particle, endoplasmic reticulum targeting; Biological process=SRP-dependent cotranslational protein targeting to membrane
  Homolog annotation: Hit_ID=Q8S8M1; Match level="QueryCoverage=66%, HitCoverage=23%, E-value=1e-46, Identity=37%"; Hit description =Putative retroelement integrase
  Pfam annotation: Domain name=zf-CCHC; Domain location=147-164; Score =25.8; E_value=5.5e-05; Accession=PF00098.13; Description=Zinc knuckle
GDAELKLFMKAIQEQVMTLNARLDDLQSTSSNEPRVDNYLGNIKINIPPFQGKNDPKLYLEWEKKDYFKEMQIVMIKANVKEDWEATMARFVAGLKKEIVGVVKLQHCVEMDDLLHKTIQLERQMKSKVVAPKGKMENNISSRSRDIKCFRCQAVGHIASQCLNKRILIVSDNGDIEIEGSSDDEMPTLEDCSDVEVAELVHGVALVTRRALSIQPKEDGDVEQRELIFHTRCHINDKVCSMIINSGTFTNVASTLLVEKLNLPTKKHPNPYRRQWLNDYGDRRVTKKILVSFSIGKYKDEVLDVALMHARHIILSKEENKRVGAFAKKTEVESALFEGDWNSLMFSRRFASRITSFKRLLEKEVDDIVYIVQCIPLS

SEQ ID NO: 118260 - protein, 71 aa, Glycine max
  Coding DNA Sequence Number=SeqID_1482
MHAQGVGPLPFSLPMAFYSKMREVVAAQTSWVAVEAMTFKIILMMPKNQELSKFQRIRSQKASRIKIQEQS

SEQ ID NO: 118261 - protein, 232 aa, Glycine max
  Coding DNA Sequence Number=SeqID_1483
  Gene Ontology: Mol. function=phosphoric ester hydrolase activity; Cellular component=chloroplast; Biological process=carbohydrate metabolic process
  Homolog annotation: Hit_ID=Q9SEC1; Match level="QueryCoverage=77%, HitCoverage=83%, E-value=1e-40, Identity=54%"; Hit description =Cytosolic fructose-1,6-bisphosphate
  Pfam annotation: Domain name=FBPase; Domain location=4-227; Score= -83.8; E_value=1.5e-08; Accession=PF00316.10; Description=Fructose-1 -6-bisphosphatase
MLVRLCSESIPNHVAISPSFSITFFLAANSFVLLLTRRDWRNSYAGETNAKGEEQKKLDVLSNELFVKALISSGRRRLKRLYLCHHHIVASQFKALEPTNTPSFSGIVKIHYLIKIFGIYVVKNEAEVSLEDALQPGNQMLAAGYCMYGSSCTFVLSKGNGVKFILTHPNIKLNWHIKLLEFFTGNSKCSSIKQEVRLSQEKIHEGLPVFLGSYDDMEQMKELYAASKEDDY

SEQ ID NO: 118262 - protein, 195 aa, Glycine max
  Coding DNA Sequence Number=SeqID_1484
  Gene Ontology: Mol. function=oxidoreductase activity; Cellular component=cytoplasm; Biological process=response to gibberellin stimulus
  Homolog annotation: Hit_ID=O04281; Match level="QueryCoverage=97%, HitCoverage=50%, E-value=1e-106, Identity=94%"; Hit description =Gibberellin 20-oxidase
  Pfam annotation: Domain name=2OG-FeII_Oxy; Domain location=41-140; Score=169.7; E_value=7.3e-48; Accession=PF03171.10; Description=2OG -Fe(II) oxygenase superfamily
MRKVYQDYCDAMSNLSLGIMELLGMSLGVGRACFREFFEENSSIMRLNYYPPCQKPDLTLGTGPHCDPTSLTILHQDQVGGLQVCVDNEWHSIKPDLNAFVVNVGDTFMALSNGRYKSCLHRAVVNSQTTRKSLAFFLCPRSDKVVSPPCELVDNLSPRLYPDFTWPMLLEFTQKHYRADMKTLEAFANWLRKSN

SEQ ID NO: 118263 - protein, 90 aa, Glycine max
  Coding DNA Sequence Number=SeqID_1485
MVAITPTKVHQPPFLREYDSNAMCACHGKAPGHSIEHCRGLKRKVQGFSTFTGSGCKPLVCLLKRPVLLSLDFQDRSIRDYSSCTLVGVP

SEQ ID NO: 118264 - protein, 347 aa, Glycine max
  Coding DNA Sequence Number=SeqID_1486
  Homolog annotation: Hit_ID=Q123Z1; Match level="QueryCoverage=58%, HitCoverage=90%, E-value=2e-62, Identity=57%"; Hit description =Putative lipoprotein precursor
RRARRHSRRGLSPGLAGVAAVADPAGGGQRAGLRPCTSPGCHTAAVDGLRCFGGQWQYCPPTPGGHGGHPRGAARQPVAAAAQGAGQRQPALPGRRAGGDARRKPPVPAGRPADAPAGEHGACAHRQELHERPGHQPLPVADEGAPVALGGVVGDQVQPSDDLAHLALEAEVARVVAENPVGHFHVACGVVDQLRVQPMDQGEAGAPAVGGDDGVGQRMDEGGHAVALEIGLQRQRECGHVLGTVQVGPGLALGDGDAHVGGCGLAAFGGFLPFGGVAQVQLVHDAHQAVQVLLHGQGRHAVAVGLHDFTGLERGALHLAARRGRVGTARCQQQRQHRRKAARRATS

SEQ ID NO: 118265 - protein, 110 aa, Glycine max
  Coding DNA Sequence Number=SeqID_1487
MDEDQWRYDFAMSQEVHMDYDYDNQEECGVNEPHVDCSNAFNTSQVFATRDDVLQWARTVAHENGFVAVIMRSDTETEIKNSLEKTPGVGNVVVPSGFVGNQCVEGKVGW

SEQ ID NO: 118266 - protein, 57 aa, Glycine max
  Coding DNA Sequence Number=SeqID_1488
MREGMPLKEYLDELNFIMIELRDIDVKMEDEILVMTPLKVAGRAKLILRISSIIAKN

SEQ ID NO: 118267 - protein, 796 aa, Glycine max
  Coding DNA Sequence Number=SeqID_1489
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=64%, E-value=1e-147, Identity=38%"; Hit description =Chromo
  Pfam annotation: Domain name=zf-H2C2; Domain location=557-598; Score =10.7; E_value=0.014; Accession=PF09337.1; Description=His(2)-Cys(2) zinc finger
  Pfam module annotation: Pfam domain module=RVT_1::zf-H2C2; Domain location=189-387::557-598
MEMQQKRRRGERRRHPLGDKPWKKEFRHQECALDKKLREDASMEEKKEREIERGEHEIEGREEGEKQLLLLQSETNDAELEFHDSEDKFDGMADSSNVVIEDHHLSLNALKGGMGVSTIRFMAYIGKLPVKVLVDGGSSDNFLQPRVAKFLKLPIEPAPFFKVMVENGNYMDAGACTVFDTPTSLPPPRSHDHSITLIEGSQPVKVNPYRYPHSQKEEIEKLVNGMLEEGTIQPSKSPFSSPIILVKKKDDSWRVCTDYKALNAIIVKDTFPIPTVDELIDELYGAVFFSKLDLRTHHGHYEWLVMPFGLTYAPATFQSLMNDIFKGALRRFVLVFFDDVLIFSSSWKDHLSHLEFVLNTLKHHQLFARFSKCAFGVREIDYLGYYRRFVKGYASIAAPLTDLLKKDSFKWSVSATTAINKLKEVMTSAPFIIRTDQKSLKELLEQRLQTPEQQQWLPKFLGYDFVIQYKPGRENLPANALSRSFLMAWLEAVGVWMNQVSALLQEDNSLAAIYKQCMEGTVQGTEYAVKDGLLFWKGRMMIPSNKELKEQIMQEFHASKIGGHEGVTKSVSRICKQFYWPKMQQDIRDFVRQCIICQQAKVEQALPAGLLQPLPIPQIFWEDIAMDFISNLPPSRGYATIFVVVDRLSKFAHFIPLKAAFNSKSVLFKAQGTILAMSSVYHPQSDGQTEAHSIGMPPFKAVFGRDPPSVIPYESDPKDPAAVQDSLINRDNLLQQLKTNLLKAQNYMKHNANKKRRDCQLEIGDLALNSDYTAILYPAIAVFGQTATATIQDSKY

SEQ ID NO: 118268 - protein, 326 aa, Glycine max
  Coding DNA Sequence Number=SeqID_1490
  Gene Ontology: Mol. function=transporter activity; Cellular component= outer membrane-bounded periplasmic space; Biological process=transport
  Homolog annotation: Hit_ID=Q00SQ2; Match level="QueryCoverage=34%, HitCoverage=25%, E-value=1e-07, Identity=32%"; Hit description =Homology to unknown gene
  Subcellular localization annotation: CTP_CleavageSite=17; ConfidenceScore=5.06e-01
MALLLQTHYPLSLRSPRCPYLFPNPYYHSFLIIPTNPLPRFNAAITFSGHRTPSRPSSAPPAASAFDRHARPATPLLKAFARAAVSALLFLCFGVRMCLASSPPAPALPTVQEEQTVQDDHDGIKQDDKETVVDKELEEAFNAWKSKTFALTVPLKVVALRGSIPPSWIKDFINSQGRRMKFNVKYYASLENIFSDLSIPFTKGKIGPASALAADIVGIGDSWVKFAINKAIIEPIRDVEDQEWFKSLDDKWKRETVRSGTTQIESGPETVNGPRVLEVYNRRDKGVMKKGESWLGKFNKKGCTILPQRSVVGMKLYGILGKKGKF

SEQ ID NO: 118269 - protein, 157 aa, Glycine max
  Coding DNA Sequence Number=SeqID_1491
  Homolog annotation: Hit_ID=Q1T2D5; Match level="QueryCoverage=36%, HitCoverage=3%, E-value=5e-10, Identity=47%"; Hit description=Chromo
MAEHNERTRLQQLQSEVATLTTNVPRTRNYKIVSVQMQRSIELLIQNQAADTGGSSSNRGTPNTPVIHSVPISSTIGVKEISLSFPHFDGQSPIIEWIFKAEKFFNYHHTPDQDRVDIASIHFEKDVIPCGLNKDIHRDVVAQAPADLLCAVMEACL

SEQ ID NO: 118270 - protein, 279 aa, Glycine max
  Coding DNA Sequence Number=SeqID_1492
  Gene Ontology: Cellular component=membrane
  Homolog annotation: Hit_ID=Q9C9F2; Match level="QueryCoverage=65%, HitCoverage=83%, E-value=3e-28, Identity=49%"; Hit description=MtN21- like protein; 91922-89607
MDMCNVVHALKPVMLMVLVQVANAWVNVLYKLALNDGMNLSVIVAYRYVFATAFIAPLAFILERFFFCSWFYVTEDEDKDDLEDTVSGISLRLNWAKMSERYPCPYSSTALMSLMGALLSISFAFCVERDLSQWRLDWNVRLLTVAYAGIVVSGVMVAVISWCVRTRGPLFVSVFSPLMLVVVAFAGSTILDEKLYLGSKEMKKNQSVPPESIHKSDTVEIMVKSRVEDKSNNKSNTLVNSVNATADNKDSWENRCENNVTHIHCCKEREEEVTSQNGS

SEQ ID NO: 118271 - protein, 166 aa, Glycine max
  Coding DNA Sequence Number=SeqID_1493
  Homolog annotation: Hit_ID=Q00M75; Match level="QueryCoverage=18%, HitCoverage=5%, E-value=6e-10, Identity=100%"; Hit description=PPR -repeat containing protein
MREGYCTQPYPCICKEAVSGFEPMTNKSPRHNFTAAPGLALRLSKHNGGCGLEKNKPVRNAGFARWTSWDGLTCMPSSTCSAQRESLFLAFMKQHCERWKKENTVEIDAEREKKNGRDGRRPQESPPMSDIMEEFGLAILLARRYTWQQIRIAWKSGKAHAQGERI

SEQ ID NO: 118272 - protein, 82 aa, Glycine max
  Coding DNA Sequence Number=SeqID_1494
MQIDGFLDAPTVSLTDHSALRVLLGAPRIITSAPNTFLKWYNCLCLIFFKMGLRGSSSMKVKVLPVLCFFNGDEVLRIKAYG

SEQ ID NO: 118273 - protein, 53 aa, Glycine max
  Coding DNA Sequence Number=SeqID_1495
MDKAVILSDAVRVVSQLREEAQKLRESTENLQEKINALKLKLIETPWNSFVSK

SEQ ID NO: 118274 - protein, 109 aa, Glycine max
  Coding DNA Sequence Number=SeqID_1496
  Gene Ontology: Mol. function=electron carrier activity; Cellular component=extracellular region; Biological process=response to biotic stimulus
  Homolog annotation: Hit_ID=Q9XFB4; Match level="QueryCoverage=95%, HitCoverage=64%, E-value=1e-47, Identity=80%"; Hit description=PR1a precursor
  Pfam annotation: Domain name=SCP; Domain location=7-109; Score=56.2; E_value=1.1e-13; Accession=PF00188.16; Description=SCP-like extracellular protein
MLKIQHVDAHNAARSEVGVPDLAWDDSVAAYAENYANQRKGDCALIHSGGEYGENIAMSTGELSGTDAVKMWVDEKANYDHDSNSCVGGECLHYTQVVWRDSVRLGCAK

SEQ ID NO: 118275 - protein, 174 aa, Glycine max
  Coding DNA Sequence Number=SeqID_1497
  Gene Ontology: Mol. function=electron carrier activity; Cellular component=extracellular region; Biological process=response to biotic stimulus
  Homolog annotation: Hit_ID=Q9XFB4; Match level="QueryCoverage=99%, HitCoverage=100%, E-value=8e-92, Identity=90%"; Hit description=PR1a precursor
  Pfam annotation: Domain name=SCP; Domain location=35-160; Score =103.0; E_value=9.1e-28; Accession=PF00188.16; Description=SCP-like extracellular protein
MGYLCIKVSFCVMCVLGLVIVGDVAYAQDSAQDYVNAHNAARAEVSSQSPRANVIVPSLAWDDTVAAYAESYANQRKGDCALIHSGGKYGENIAMSTGELSGTDAVKMWVDEKANYDYNSNSCVGGECLHYTQVVWAHSLRLGCAKVTCDNGGTFITCNYDPPGNLVGESPYEL

SEQ ID NO: 118276 - protein, 88 aa, Glycine max
  Coding DNA Sequence Number=SeqID_1498
MGATVLSLGWWKTFKGGGADVGAIVGGGCAEEDEVDVSVVGGSGYVEEDGAVVSGGGNSGVGMFVGRKKGSGGRIAEAILGERHPVRI

SEQ ID NO: 118277 - protein, 404 aa, Glycine max
  Coding DNA Sequence Number=SeqID_1499
  Gene Ontology: Mol. function=carboxypeptidase activity; Cellular component=membrane; Biological process=auxin mediated signaling pathway
  Homolog annotation: Hit_ID=Q4PT23; Match level="QueryCoverage=81%, HitCoverage=91%, E-value=1e-56, Identity=35%"; Hit description =Nodulin MtN21 family protein
  Pfam annotation: Domain name=DUF1538; Domain location=114-312; Score=- 142.9; E_value=0.061; Accession=PF07556.2; Description=Protein of unknown function (DUF1538)
  Pfam annotation: Domain name=DUF6; Domain location=207-336; Score =35.4; E_value=2e-07; Accession=PF00892.11; Description=Integral membrane protein DUF6
  Pfam annotation: Domain name=DUF6; Domain location=25-158; Score =59.1; E_value=1.5e-14; Accession=PF00892.11; Description=Integral membrane protein DUF6
  Pfam annotation: Domain name=TPT; Domain location=198-336; Score= -23.1; E_value=0.013; Accession=PF03151.7; Description=Triose -phosphate Transporter family
  Pfam module annotation: Pfam domain module=DUF1538::DUF6::DUF6::TPT; Domain location=114-312::207-336::25-158::198-336
MVEMRGICNVLHGLKPVLLMVLVQIAYTAVNVLFKLAINDGMSVKVATAYRLAFGSAFTVPLALISERNKRPKMTWRVLFMACLCGLFGGSLFQNLFYESLALTSATFASALYNLIPAITFVLAISCGFERLNLKAAAGKAKVLGTLLGIGGAMLLTFIKGAEINIWPFHINLMHPHQHQNGQVASLNADSGNNKLLGAICSLASCFSFALWLIIQAKMSKEYPCHYSSTALMSTAGAIQATAFGFCFERDLTQWKLGWNIRLLAVAYSGIVASGIVVIITAWCIQMRGPLFASVFNPLMLVLVAITGSLMLNENLYVGSVVGAVLIVCGLYMVLWGKSKEMKNITQLVPSETIREAEAIEVVVMPMSTPIDYEKCDQNNQGERNVDKEHCDDLTKNKEDDIRI

SEQ ID NO: 118278 - protein, 874 aa, Glycine max
  Coding DNA Sequence Number=SeqID_1500
  Homolog annotation: Hit_ID=Q10NJ8; Match level="QueryCoverage=94%, HitCoverage=90%, E-value=6e-37, Identity=32%"; Hit description =Expressed protein
MVYSADARLKPEKASLSYADFHHEITKNVEDNSLKPYRNKQKQATYRRASEEDELVKYMSNLPGYLEKGEKIPDKALNVGVLDWATLQQWQYSHKHLPLSSRSSTSTGNTSSSVSAEELSGNSSKGPVCSPSRQRIFRPSLKSHFMASPMQDYSASVKSSGGSFGNCQNLRGGCSNIDTHGKYAQVGDHLSQNHPASIPKGCDRRQLNPHISKESDILPNGGMYEAASHTTTEMSSQDDRPEKKVENFRQPNIDADEQVMLGKSKPIVLILPRDIPQNNHCEVPDMQTSLGQKLGSPTGTRFSEKPKEPPCRYPNSNISKTCPLPDEIRGIRYQPERSGSSSTDPEGIKIPASTLSAPVPVRTGIISPCRSRKAEEKKHNIGASSSANGSLKGLDQKVTTEKPRSSSPFRRFSFSIGFTGKGSGCKEVAHVPHQSSIAALKSSSENVRGYASSKISGNDKPGNAVKSRSSSPLRRLLDPLLKPKTSDHRSVESSQKDSVVIKKNCRSANGGFAMEKELDRDQRVGCTNTAINTVDLSKNKKYVPSTFQALLRIAVKNGQPLFTFAVDNNSNILVATVKNLAVSKEDECNRIYTFFTFREGKKKNGSWMNQASKTQGPDYIHHAVAQMKVSDSHHYDSTSQNCVDSSTSKEFVLFSVKLKQGDAQVTDYKPNDELAAIVVKSAKAVNFINYAHQSSRQNDSQDLHVTVVLPTGVHSFPSNGGPSSLIERWRTGGSCDCGGWDMACKLKILANESQACRKSRISKACFPHPFELFLQVNDQDLENQPAFSFSPFKPGVYSVAFDSSFSLLQAFSICIALVDGLISYELSGSRNYIEGKNSRETLLVQTDELKAFGKLEDIPASYVAYPPLSPVGRV

SEQ ID NO: 118279 - protein, 57 aa, Glycine max
  Coding DNA Sequence Number=SeqID_1501
MQRNGRLSSLEKKQGVSVRSFGVIVKEGGAGLKDSEIGWGPHGFIIRRLKEGGVIGR

SEQ ID NO: 118280 - protein, 129 aa, Glycine max
  Coding DNA Sequence Number=SeqID_1502
  Gene Ontology: Mol. function=drug transporter activity; Cellular component=membrane; Biological process=multidrug transport
  Homolog annotation: Hit_ID=Q1SCN3; Match level="QueryCoverage=90%, HitCoverage=69%, E-value=7e-41, Identity=60%"; Hit description=MatE, putative
  Subcellular localization annotation: CTP_CleavageSite=14; ConfidenceScore=5.08e-01
FIASKVTCQFQAILAGAFANKDFNRATATASRVLQMGLVLGLALAFILGTGLHFGAKIFTQDANVLHLIQIGIPVVVAILSIISLLILSSAGGFIGIWVALTIYMGLRAFAGFLRIGTGSGPWEFLRSS

SEQ ID NO: 118281 - protein, 71 aa, Glycine max
  Coding DNA Sequence Number=SeqID_1503
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XH47; Match level="QueryCoverage=90%, HitCoverage=92%, E-value=6e-24, Identity=69%"; Hit description=Small zinc finger-like protein
  Pfam annotation: Domain name=zf-Tim10_DDP; Domain location=14-67; Score=16.6; E_value=0.00011; Accession=PF02953.6; Description =Tim10DDP family zinc finger
MASNISPSALDKEQIFGMAEKEMEYRVELFNKYKESELNMGENSCIDRCVSKYWHVTNLIGQLLGSGRPPM

SEQ ID NO: 118282 - protein, 122 aa, Glycine max
  Coding DNA Sequence Number=SeqID_1504
MKADMEAMKKQMTMMMEATMDMRKIMGASIATVVAASTATERDPAHPPSFNQESHLVTDMEGQGGVTGVATYGPQYTQSHTFPPYSLPPNYTPSMAVPVPAINVTNPTPICTENNPAQPNQT

SEQ ID NO: 118283 - protein, 321 aa, Glycine max
  Coding DNA Sequence Number=SeqID_1505
  Homolog annotation: Hit_ID=Q2HS22; Match level="QueryCoverage=85%, HitCoverage=93%, E-value=9e-57, Identity=46%"; Hit description=IMP dehydrogenase/GMP reductase
MAVELHTSLPSHFLPDDDDHDDIVSSQHSHRNDIHHALALNPLPEVPMNDNDDDFISELTHRMTRFLLPDDDTSDFSSIGSHSMDLENSSRDSKHSPEDSGSSQEASPPATPEERCWKIDMIGTFEKMKPNETGNFNNQFQNSNTGLYSYQSLIREQIRAIELSGVKQEHVAVSPKPKSNPRRKSQAQEANKGNGRRARPPQVPHQGGAGMRALFLDGSGSRGGTGVFLPRGGGATTPSESTNKQGKGCSTVLIPARVVQALQLHFDQMAATSGPKAGGFPPLHDVLVSNRDGMYSLQKPESRKAPASIQNDTILPQEWTY

SEQ ID NO: 118284 - protein, 333 aa, Glycine max
  Coding DNA Sequence Number=SeqID_1506
  Gene Ontology: Mol. function=protein binding; Biological process =regulation of transcription
  Homolog annotation: Hit_ID=Q75HX5; Match level="QueryCoverage=99%, HitCoverage=81%, E-value=1e-114, Identity=62%"; Hit description =Putative tubby protein
  Pfam annotation: Domain name=F-box; Domain location=51-106; Score =30.9; E_value=4.5e-06; Accession=PF00646.23; Description=F-box domain
  Pfam annotation: Domain name=Tub; Domain location=113-333; Score =251.4; E_value=1.8e-72; Accession=PF01167.8; Description=Tub family
  Pfam module annotation: Pfam domain module=F-box::Tub; Domain location=51-106::113-333
MSFRSIVRDVRDSFGSLSRRSFDVRLTGHHRGKSQGSVQDLHDQPLVIQNSRWASLPPELLFDIIRRLEESENTWPARKHVVACAAVCQSWRNMCKDIVKSPEFCGKLTFPVSLKQLFLDVDQMKVQVIFALAGALLVENGKFLLSAKRTRRTTYTEYVISMDADNISRSSNTYIGKLRSNFLGTKFIIYDTQPPYSSAHICPPGTGKTSRRFYSKKVSPKVPSGSYNIAQVTYELNVLGTRGPRKMHCVMHSIPASALDAGGTVPGQPELLPRSLEDSFRSISFSKSLDHSIEFSSSRFSEIGESCIEDDDGKMRPLVLKNKPPRWHEQLQC

SEQ ID NO: 118285 - protein, 80 aa, Glycine max
  Coding DNA Sequence Number=SeqID_1507
  Subcellular localization annotation: CTP_CleavageSite=34; ConfidenceScore=5.56e-01
MLKPLQFQAKKKRSSLSVLGNPRRGSARDMRAPRAANLPNESFVPSRTQRAQLAKPEFTNSRARLQNMKHQGAFKTMKWA

SEQ ID NO: 118286 - protein, 37 aa, Glycine max
  Coding DNA Sequence Number=SeqID_1508
STLSGTCLVIERKTMMLAWSGCCAHANRDVSLVFGRY

SEQ ID NO: 118287 - protein, 418 aa, Glycine max
  Coding DNA Sequence Number=SeqID_1509
  Gene Ontology: Mol. function=transferase activity; Biological process= biosynthetic process
  Homolog annotation: Hit_ID=Q9FGU6; Match level="QueryCoverage=97%, HitCoverage=84%, E-value=1e-146, Identity=59%"; Hit description =Glycosyl transferase-like
  Pfam annotation: Domain name=Glycos_transf_1; Domain location=214 -383; Score=51.9; E_value=2.1e-12; Accession=PF00534.10; Description =Glycosyl transferases group 1
MAKDREPPSKFLKIALFVKKWPQKSHAGGLERHALTLHLALAKRGHDLHIFTTSTDSSFSNYSINNIHFHFSKPTPAGYLDQALVWEQFQAQNSTSKPFDIVHTESVGLRYTRSRYVTNLAVTWHGIAYETFHSDIIQELLRTPQEPQTKALTERAVKVVEEVKFFPNYAHHVATSDHAGDILKRVYMIPEERVHIILNGVDQHIFRPNVSKGKDFKKRHGIPDSKSLVIGLAGRLVKDKGHPLMFEALKQIIEENSTFQESSMVVVAGDGPWGARYTDLGANMLVLGPLEQAELASFYNAIDVFVNPTLRAQGLDHTLLEAMLTGKPVMATRLASIIGSVIVGNEMGYTFAPTVSALKKAIYELWVSGREVLDKKGHVALQRGVQLFTATKMVYAYERLFLCLSSVTHEEHFCEYQP

SEQ ID NO: 118288 - protein, 74 aa, Glycine max
  Coding DNA Sequence Number=SeqID_1510
MHKFPMCGVSRYKVKDDDKCSSDKSTPPVKVLWYLPNILRFKRLFTNADDAKNLIWHTDRRNCDGMLRHSVDSS

SEQ ID NO: 118289 - protein, 166 aa, Glycine max
  Coding DNA Sequence Number=SeqID_1511
  Gene Ontology: Mol. function=transcription initiation factor activity; Cellular component=nucleus; Biological process =transcription initiation from RNA polymerase II promoter
  Homolog annotation: Hit_ID=Q2HS29; Match level="QueryCoverage=99%, HitCoverage=100%, E-value=1e-43, Identity=59%"; Hit description =Transcription factor IIA, beta-barrel
MSADLERSTSRIPQLDGPIPYDDDDVLSTPNIYNYGEVFSEDYNISNTPAPPEVPASTPALLVQNEVGNDFDDDDDDEPPLNEEDDDDLDDMEQGEDQNTHHLVLAQFDKVVVQGWINIVALIGFLLLQIQVTRTKSRWKCTLKDGIMHINNKDILFNKATGEFEF

SEQ ID NO: 118290 - protein, 101 aa, Glycine max
  Coding DNA Sequence Number=SeqID_1512
MGTYLDCREVTSKTETKKQRTRKHSADECQMIARFQTHALSGTDSLSPIQELENPRSATVSLSETPSANGWGLAHLAQGATCSAHKVRLALHIGHAERVDD

SEQ ID NO: 118291 - protein, 167 aa, Glycine max
  Coding DNA Sequence Number=SeqID_1513
MSEDKESHNISPVNERAGSGSGERGLNSDDISATSPVAKNEIKEHDDKDDKNVAGLSGVKIGDLCASATSPTGAKNEVKEHDVGEHSGSDNKNVAGPSGVNTASDDDTFVDVVNFDENENNGLTAADILIAQIEAEKQKKASSSSSNDAESSGKNKNEPTSKRQRLD

SEQ ID NO: 118292 - protein, 333 aa, Glycine max
  Coding DNA Sequence Number=SeqID_1514
  Homolog annotation: Hit_ID=Q9SLU9; Match level="QueryCoverage=70%, HitCoverage=29%, E-value=3e-64, Identity=53%"; Hit description=ZW18 protein
MFRKLGWFVGLNQNNLATKRLLNADQTASARPNHQLPMLDAVHEVAVYIHRFHNLDLFEQGWYRIKVTLRWEDGEDSYPGIPARVVQYEAPEVGADNLCGVWMIDDKDNSFSTPSFRIRYARQDVFLAIMISFYLSYGGYEGKSSAVILKFELFHTPTPEMRPELQSSLDGCAASVHEYRIPPKALLGLHSYCPVHFDAFHAVLVDTSVHISLLKSGYHTPQLKVPSYSLASKGTYGEDYVRSNKAALIKALIAAHDILLDDLRRISKGINQAIDLTGITFEPYVTKSLNSTSPAHEKSADDEASLQLSDGTQISAEVLNSGNVNASLSVMPF

SEQ ID NO: 118293 - protein, 247 aa, Glycine max
  Coding DNA Sequence Number=SeqID_1515
  Gene Ontology: Mol. function=catalytic activity; Cellular component =intracellular; Biological process=superoxide metabolic process
  Homolog annotation: Hit_ID=Q2QX94; Match level="QueryCoverage=98%, HitCoverage=32%, E-value=1e-100, Identity=68%"; Hit description=ZW18 protein, putative, expressed
  Pfam annotation: Domain name=DUF676; Domain location=1-167; Score =143.2; E_value=7.1e-40; Accession=PF05057.5; Description=Protein of unknown function (DUF676)
MGHHLDLRLIRNQWLLIDPKIQVLMSETNEDKTSEDFREMGSRLAQEVISFLKKKMDKASRVGNLKDIKLSFVGHSIGNLIIRAALAGYMYSSNSIFNSGLWLLKKIKGTQCIHQLTFTDDHDLENTFIYNLSKKKTLANFKNVILLSSPQDGYVPYHSAKIELCPAATLDFSKQGKVFLEMLNNCLDQMRTHSEHRIVMRCDINFETSSYGRRSFNTLIGRAAHIEFLECDIFVKFIMWSFPELFS

SEQ ID NO: 118294 - protein, 162 aa, Glycine max
  Coding DNA Sequence Number=SeqID_1516
MWAFLTGHQINWAHLVRYRMHKALRANAPLPYPQLITLFLRHFQIPLDDEPFVQVKCSFAIGAGAMTSFGYRKDRNGQWLKKDALPPQDERTPSPPPQRDDSALMTEVLSELRGLCSYVGERFDSLDTLLPEWIFASHSLKRMWVTFVRVSIFHHHLHLLRI

SEQ ID NO: 118295 - protein, 169 aa, Glycine max
  Coding DNA Sequence Number=SeqID_1517
MVTHPPERVVRQFGYVQTIPPQPTSVRLSFEDIDNRWMHYSEHLVAAGQICLVPEQCASDYMDWFFRISHLFMTPTQAADPPKHPLVPQHDTYVEPDITEVLVAPEAGPSHAPFDVEQPRHAVDGCQAIAERLERLLNLRIVTTDTKIHEVMEDCIRIARGVTTDGNVY

SEQ ID NO: 118296 - protein, 362 aa, Glycine max
  Coding DNA Sequence Number=SeqID_1518
  Gene Ontology: Mol. function=two-component sensor activity; Cellular component=membrane; Biological process=two-component signal transduction system (phosphorelay)
  Homolog annotation: Hit_ID=Q3QHT4; Match level="QueryCoverage=95%, HitCoverage=81%, E-value=9e-88, Identity=42%"; Hit description=PAS
  Pfam annotation: Domain name=MCPsignal; Domain location=247-362; Score=-104.0; E_value=0.033; Accession=PF00015.11; Description =Methyl-accepting chemotaxis protein (MCP) signaling domain
  Pfam annotation: Domain name=PAS; Domain location=145-255; Score =16.1; E_value=0.013; Accession=PF00989.14; Description=PAS domain
  Pfam annotation: Domain name=PAS; Domain location=19-133; Score=30.0; E_value=8.1e-06; Accession=PF00989.14; Description=PAS domain
  Pfam annotation: Domain name=PAS_3; Domain location=165-258; Score =86.0; E_value=1.2e-22; Accession=PF08447.1; Description=PAS fold
  Pfam annotation: Domain name=PAS_3; Domain location=43-136; Score =55.2; E_value=2.2e-13; Accession=PF08447.1; Description=PAS fold
  Pfam annotation: Domain name=PAS_4; Domain location=150-260; Score =21.3; E_value=0.0016; Accession=PF08448.1; Description=PAS fold
  Pfam annotation: Domain name=PAS_4; Domain location=25-138; Score =41.8; E_value=2.4e-09; Accession=PF08448.1; Description=PAS fold
  Pfam module annotation: Pfam domain module=MCPsignal::PAS::PAS::PAS _3::PAS_3::PAS_4::PAS_4; Domain location=247-362::145-255::19 -133::165-258::43-136::150-260::25-138
MFSTITSGILSRLAWQKRSHSSATLSSLQEAIAMVEFTPDGHILTANALFLERMGYTLAEIVGQHHSLFCTPDMVQSPQYREFWQRLNRGEGFSDKFLRVAKHSRPIWLEANYVPVQDRHGRVIKIVKLASDITARIMDAQEQRAMTTAIERSMAVIAFNLKGEVLMANDNFFNTMGYRADEIIGRHHSLFCPPEMRTSEAYRRFWHKLNQGEYISGQFERVNKQGNTVWLRATYNPVFNSAGELYKVVKFATDVTAQVEKNQLEREAAQQAWQTALHTSESTQQGAAVIENSVQNINALASELHGISGDINDLSDSSDRIGAIVESIRRIADQTNLLALNAAVEAARAGHHGRSFAVVASE

SEQ ID NO: 118297 - protein, 660 aa, Glycine max
  Coding DNA Sequence Number=SeqID_1519
  Gene Ontology: Mol. function=protein translocase activity; Cellular component=chloroplast outer membrane; Biological process =intracellular protein transport
  Homolog annotation: Hit_ID=Q9STE8; Match level="QueryCoverage=78%, HitCoverage=63%, E-value=0.0, Identity=85%"; Hit description=Protein TOC75-3, chloroplast precursor
  Pfam annotation: Domain name=GRP; Domain location=48-112; Score= -22.7; E_value=0.016; Accession=PF07172.2; Description=Glycine rich protein family
  Pfam annotation: Domain name=Surf_Ag_VNR; Domain location=152-228; Score=26.5; E_value=9.6e-05; Accession=PF07244.5; Description =Surface antigen variable number repea
  Pfam annotation: Domain name=Surf_Ag_VNR; Domain location=346-430; Score=1.2; E_value=1.1; Accession=PF07244.5; Description=Surface antigen variable number repea
  Pfam module annotation: Pfam domain module=GRP::Surf_Ag_VNR::Surf_Ag _VNR; Domain location=48-112::152-228::346-430
  Subcellular localization annotation: CTP_CleavageSite=46; ConfidenceScore=5.82e-01
MASFAAPNNIGSAVLPSRQRKPSRPPPLKCSLLPSSNNNDSLSNPSSSHTPPLFKAIAISSAASILLQCTPLSPFFPNPLTKLGGGGNTGGGGGDDGWFGGHGGGGGGGNGGFWSRMFAAVADENQPQEWDSHGLPANIVVQLNKMSGFKKYKVSDISFFDRNRKTKVGTEDSFFEMVSLRPGGVYTKAQLQKELETLATSGMFEKVDLEGKTNPDGSIGVTISFSESTWQSADGFRCINVGLMQQTKPVEMDADMTDKERLEYYLSQEREYKRRIERARPCLLPRYVHNEILDMLKRHGMVSARLLQRIRDRVQKWYHDEGYACAQVVNFGNLNTKEVVCEVVEGDITQLDIQFQDKLGNVVEGNTQVPVIQRELPRQLRSGYTFNIEAGKQALRNVNSLALFSNIEVNPRPDETNEGGIIVEIKLKELEQKSAEVSTEWSIVPGRGGHPTLASLQPGGTVSFEHRNLQGLNRSINGSITTSNFLNPQDDLAFKLEYVHPYLDGVYYSRNRTLRVSCFNSRKLSPVFTGGPGVDEVPPIWVDRTGVKANITENFTRQSKFTYGLVMEEITTRDESSHICANGQRVLPSGGISADGPPTTLSGTGIDHMAFLQANITRDNTRFVNGTVVGDRNMFQVTLILHSVPLKLYMWKHYTFLSVL

SEQ ID NO: 118298 - protein, 204 aa, Glycine max
  Coding DNA Sequence Number=SeqID_1520
  Gene Ontology: Mol. function=heat shock protein binding; Cellular component=integral to membrane; Biological process=protein folding
  Homolog annotation: Hit_ID=Q2HS35; Match level="QueryCoverage=99%, HitCoverage=75%, E-value=2e-82, Identity=76%"; Hit description=Heat shock protein DnaJ, N-terminal
  Pfam annotation: Domain name=DnaJ; Domain location=10-71; Score =118.4; E_value=2.1e-32; Accession=PF00226.21; Description=DnaJ domain
MVVRARRSESPYEVLGVSPSATVDQIKKAYRKLALKYHPDVNKEDKAQEKFMRIKHAYNTLLNSRSRKKYDSGSRGYDFSQGSRTRNIQAEEEFYGLEDFFKDLQQEFRNWEANTASQGKPKSLWEELAEIGEEFVEFLEKELNITDQNDDYKTPQGGNTSNFPGTETPSNSSQGQAGKGSRGVEDNLEEIEATLAQLKKELGL

SEQ ID NO: 118299 - protein, 393 aa, Glycine max
  Coding DNA Sequence Number=SeqID_1521
  Gene Ontology: Mol. function=kinase activity
  Homolog annotation: Hit_ID=Q2HS33; Match level="QueryCoverage=99%, HitCoverage=100%, E-value=4e-46, Identity=38%"; Hit description=IMP dehydrogenase/GMP reductase
MPLPAERTYRYVDTSRSPTAIISVEQFLRATPGGESCRKSPTYSPTSSSPSSPYFEKLKNQDPEEDHGLYQKKSVLTKVKERARKFRYSLSKRRMDDENVTPSWGVSLEEDEEEEDPEYLGAPMYESELAPEEYKEYARQHPRANPVISEKHVLHNAVKLGAEQDQQKSRGAVSARFTTTTPNMTSETTAQKLTPVYVGVSNAANAISSKIQAVSSSTTAPAANDMSSHTSSLPSSSMQNSSSASLSGKNTSCQKSASLRDNLMNQCEQGDRARNVPTMQKSSSLSASMTENKNITSLMSASVKDYSMNKSEPRDDAKTVSQPQVMISEATSPKRTSSNAGVMDKVRGAVNSLLGNEEPSQQYGVKTPTTRTSSQQTQQVDQEENRRRILQEN

SEQ ID NO: 118300 - protein, 88 aa, Glycine max
  Coding DNA Sequence Number=SeqID_1522
MALDANGLSSNVYVGMLYCTEEAIQQLPVSIINIVSSKLVAMNLTPLAVSSTASRATMGFSRCGWVGGWGRGGQRAKWKRGKREKRYA

SEQ ID NO: 118301 - protein, 127 aa, Glycine max
  Coding DNA Sequence Number=SeqID_1523
MFYKEETVRKKKFERKTNKQRRRKNDPVQCDGWLRERERERERERERDLGVLVDGGIKIEEEIKAEEWKLQIGNSKSQTSEFVREVIRENLNPTPNPINAVFLRQSWGKFDLVPTGLDSTAMPAFKD

SEQ ID NO: 118302 - protein, 159 aa, Glycine max
  Coding DNA Sequence Number=SeqID_1524
MQSQGLTLPPESKDPDTGDSEKCGLYVDEIPPRLVALGRVYERSTTIHSVPLGNDQMKVGVEEVGDVDACIPVPTKEDKQGAEGSTKPLDKPDPNVDPLYLMALTIPQFFLKSLQVSWDATMFGVYNDNFLLYIKHEDLFEIAHSGQCLSISVIQLWIL

SEQ ID NO: 118303 - protein, 61 aa, Glycine max
  Coding DNA Sequence Number=SeqID_1525
  Gene Ontology: Mol. function=protein serine/threonine kinase activity; Biological process=protein amino acid phosphorylation
  Homolog annotation: Hit_ID=Q8LPH3; Match level="QueryCoverage=70%, HitCoverage=4%, E-value=2e-16, Identity=86%"; Hit description=MAP kinase, putative
MQQPWGGMNPMQVVGAVGFQHRRLDIPDDMDPTIADIIRKCWQTICNIFWIAERSVSNKIV

SEQ ID NO: 118304 - protein, 499 aa, Glycine max
  Coding DNA Sequence Number=SeqID_1526
  Gene Ontology: Mol. function=transcription factor activity; Cellular component=nucleus; Biological process=regulation of transcription
  Homolog annotation: Hit_ID=Q1S6U1; Match level="QueryCoverage=99%, HitCoverage=100%, E-value=1e-180, Identity=65%"; Hit description =GRAS transcription factor
  Pfam annotation: Domain name=GRAS; Domain location=97-408; Score =315.6; E_value=9.1e-92; Accession=PF03514.5; Description=GRAS family transcription factor
  Subcellular localization annotation: CTP_CleavageSite=28; ConfidenceScore=5.44e-01
MDTLFRLVSFHQQQQPDPSLNSTTSRTSSSSRSSRQNYYPYSSYQEEEECFNFYMDEEDLSSSSSKYYYPYQPHHQQQQQQQHNVSNISTNTFSTTPNTDYSYSFSPTPQVQDFNFEFSPNWSHNLLLESARAVADNNSTRLHHLLWMLNELSSPYGDTDQKLAAYFLQALFSRVTEAGDRTYGTLASASEKTCSFESTRKTVLKFQEVSPWTTFGHVASNGAILEALEGNPKLHILDISNTYCTQWPTLLEALATRSDETPHLRLTTVVTGRTSNSVQRVMKEIGTRMEKFARLMGVPFKFNVIHHYGDLSEFNFNELDIKEDEALAVNCVNRLHSVSAVGNNRDALISSLQALQPRIVTVVEEEADLDVGIDGYEFVKGFEECLRWFRVYFDALDESFVKTSNERLMLERAAGRAVVDLVACSTAESVERRETAARWVARLHNGGLKAAPFSEEVCDDVRALLRRYREGWSMAACSDAGIFLSWKDTPVVWASAWRP

SEQ ID NO: 118305 - protein, 301 aa, Glycine max
  Coding DNA Sequence Number=SeqID_1527
  Gene Ontology: Cellular component=integral to membrane; Biological process=defense response to bacterium
  Homolog annotation: Hit_ID=Q1S7E5; Match level="QueryCoverage=79%, HitCoverage=88%, E-value=4e-65, Identity=57%"; Hit description=MtN3 and saliva related transmembrane protein
  Pfam annotation: Domain name=MtN3_slv; Domain location=183-269; Score= 106.1; E_value=1.1e-28; Accession=PF03083.6; Description=MtN3saliva family
  Pfam annotation: Domain name=MtN3_slv; Domain location=61-150; Score =104.6; E_value=2.9e-28; Accession=PF03083.6; Description=MtN3saliva family
  Pfam module annotation: Pfam domain module=MtN3_slv::MtN3_slv; Domain location=183-269::61-150
MAKEYGVVWLWTPAINELQQEVAEEGVAHHIPHSFTRLRGPLTKPNSFRGSIMPTHHASAAIFGIIGNMISVMVYLAPVPTFYQIYKKKCTDGFHSLPYLLSLMSSMLWLYYAFLKIHDGVVPLITINSIGCVIELIYILTYIKYAHKDARNLTYTLFAAMNIAFLTLVLSSHFALHGSHRVKVIGWICDAVSLSVFASPLSIMAKVIRTKSVQFMPFYLSFFLTLNAITWFVYGLSIQDKCIYVPNVGGFGLGLVQMVLYGIYRNGGESEKEQALAEGAINIVVVNPLGPAEVFNRRGSG

SEQ ID NO: 118306 - protein, 131 aa, Glycine max
  Coding DNA Sequence Number=SeqID_1528
  Homolog annotation: Hit_ID=Q0WLD8; Match level="QueryCoverage=40%, HitCoverage=12%, E-value=7e-07, Identity=45%"; Hit description =HSR201 like protein
DVELHVLVRRMREGMREFVETKAERFKEDGAFGVVMESLKERGEAVWMCSVNKMVSNTIALMDTRDGHGVEAFVTLDHQDMTFFEQHQELLHYALLNPTSNDETGIEEFLNLGSSSKTLVKDTLRFEKFMN

SEQ ID NO: 118307 - protein, 492 aa, Glycine max
  Coding DNA Sequence Number=SeqID_1529
  Gene Ontology: Mol. function=transferase activity, transferring glycosyl groups; Cellular component=integral to membrane; Biological process=response to oxidative stress
  Homolog annotation: Hit_ID=Q9LXU2; Match level="QueryCoverage=100%, HitCoverage=63%, E-value=0.0, Identity=76%"; Hit description =Anthranilate phosphoribosyltransferase-like protein
  Pfam annotation: Domain name=C2; Domain location=203-285; Score=76.5; E_value=8.2e-20; Accession=PF00168.20; Description=C2 domain
  Pfam annotation: Domain name=C2; Domain location=366-457; Score=85.0; E_value=2.3e-22; Accession=PF00168.20; Description=C2 domain
  Pfam annotation: Domain name=C2; Domain location=42-122; Score=97.7; E_value=3.5e-26; Accession=PF00168.20; Description=C2 domain
  Pfam module annotation: Pfam domain module=C2::C2::C2; Domain location=203-285::366-457::42-122
MHKPAEALDFALKETSPNIGAGAVMRDKLSCTYDLVEQMQYLYVRVVKAKDLPGKDVTGGVDPYVEVKLGNYKGLTKHFEKNSNPQWNQVFAFSKERIQASVLEVVIKDKDVVVDDFVGRVMFDINEIPKRVPPDSPLAPQWYRLEDRRGGKAKGELMLAVWMGTQADEAFPDAWHSDAATVGPEAVANIRSKVYLSPKLWYVRVNVIEAQDLVPSDKTRYPEVFVKANLGVQFLRTRVSQSKTINPMWNEDLMFVAAEPFEEPLVLTAEDRVGPSKDEILGRCVIPLHNVQRRLDHKPVNTKWFNLEKHVVVEGEQKKKEIKFSSRIHLRVCLEGGYHVLDESTHYSSDLRPTAKQLWKASIGILEVGIISAQGLMPMKTRDGRGTTDAYCVAKYGQKWIRTRTIVDSLAPRWNEQYIWEVFDPCTVITVGVFDNGHLHGGDKSGGSKDSRIGKVRIRLSTLEADRVYTHSYPLLVLHNSGVKKMGEVQLA

SEQ ID NO: 118308 - protein, 60 aa, Glycine max
  Coding DNA Sequence Number=SeqID_1530
MLLHKIVLLVGSLSYDSYGSYPYKSNLTYTVKCGPAENGIVSVGRKRTTQKEPFYTATFG

SEQ ID NO: 118309 - protein, 98 aa, Glycine max
  Coding DNA Sequence Number=SeqID_1531
  Homolog annotation: Hit_ID=Q1SGI5; Match level="QueryCoverage=43%, HitCoverage=42%, E-value=1e-17, Identity=90%"; Hit description=DVL
  Pfam annotation: Domain name=DVL; Domain location=73-91; Score=42.5; E_value=1.4e-09; Accession=PF08137.3; Description=DVL family
  Subcellular localization annotation: CTP_CleavageSite=55; ConfidenceScore=5.94e-01
MDEKRKSSSKKDTGSSSTRSLFSRSTSTSNSPLLRSLSQKSSSSSSKCNNNNLPRSFSQKNPSIGRKCTKLAKEQKARFYIMRRCVAMLVCWHKHGDS

SEQ ID NO: 118310 - protein, 61 aa, Glycine max
  Coding DNA Sequence Number=SeqID_1532
MKPGALITCLSQSMQLFKEKNKMYLVQLDEVRHKTNIKESSLNHNLMASVSLKHRIQRLRF

SEQ ID NO: 118311 - protein, 235 aa, Glycine max
  Coding DNA Sequence Number=SeqID_1533
  Homolog annotation: Hit_ID=Q9LTI4; Match level="QueryCoverage=77%, HitCoverage=100%, E-value=1e-25, Identity=38%"; Hit description =Arabidopsis thaliana genomic DNA, chromosome 5, BAC clone:F2O15
MARRELSSTLKNLKFMQRAALREERTKKEEEVKPDVSVGTSTAVTRKCVVIMEGDPHPGAAKGRMSFQSFNPLVDKLNEEEARLHQPAAETTMSRNQNANANIRENRSPVEGPECGNMDKKIVEVNGNAKRKQSDYEAQYPNKSPKNDHDDKHSSPSNSLGSFKKPSGDKLDWKVLRPSSVKQKRLGQPLAPKYEWCVVYIYGQEFELALNDDSVLRVETIGYIVEKYGDKSNSS

SEQ ID NO: 118312 - protein, 436 aa, Glycine max
  Coding DNA Sequence Number=SeqID_1534
  Gene Ontology: Mol. function=DNA binding; Cellular component=nucleus; Biological process=regulation of transcription
  Homolog annotation: Hit_ID=Q1SLX7; Match level="QueryCoverage=98%, HitCoverage=100%, E-value=8e-95, Identity=52%"; Hit description =Homeodomain-related
  Pfam annotation: Domain name=Myb_DNA-binding; Domain location=104 -150; Score=53.4; E_value=7.8e-13; Accession=PF00249.21; Description =Myb-like DNA-binding domain
  Pfam annotation: Domain name=Myb_DNA-binding; Domain location=156 -201; Score=52.5; E_value=1.4e-12; Accession=PF00249.21; Description =Myb-like DNA-binding domain
  Pfam module annotation: Pfam domain module=Myb_DNA-binding::Myb_DNA -binding; Domain location=104-150::156-201
MGMVYADMDSLSLCSNYGVVSSHQDNCYVSNGGTNWGFPFMRECPNFEDHPNNSDDVAEEGKGSYSSGEDSDKVNHNANNFNDENSPNENSNSGGSGHSKLCARGHWRPAEDSKLKELVALYGPQNWNLIAEKLEGRSGKSCRLRWFNQLDPRINRRAFSEEEEERLMQAHRIYGNKWAMIARLFPGRTDNAVKNHWHVIMARKYREQSSAYRRRLSQSSSVYRRVEELNTTTTTSSTLVSRNTAAAEQQPPPPYCLNLPNNGGLANNINMPSSPYAATPFHGGVVAVAPSSGVEFGLLNGSPHMTAAKEAFSTPKLVPHIALYPQQTPLDFFSGVRSSNDMVGEYFGQNDHHQPSFGFNPQYPQYVMLMQQHQQNNHNYGFSNSTAQILGHSEASLSSVAAEHRDHQNVSSDQCPPDATTTIPPPFIDFLGVGAT

SEQ ID NO: 118313 - protein, 657 aa, Glycine max
  Coding DNA Sequence Number=SeqID_1535
  Gene Ontology: Mol. function=protein-methionine-S-oxide reductase activity; Cellular component=nucleus; Biological process=regulation of transcription
  Homolog annotation: Hit_ID=Q00LP5; Match level="QueryCoverage=90%, HitCoverage=88%, E-value=1e-150, Identity=48%"; Hit description=GRAS4
  Pfam annotation: Domain name=GRAS; Domain location=261-564; Score =440.0; E_value=3.2e-129; Accession=PF03514.5; Description=GRAS family transcription factor
MSSNFLVEFNMNSLVQNFGGPISVFSNQDQVEKGFDFEFDDSSSPSSGTSSGGESTEVTKYSNPILRYISDILMDEEDDLERKPCMLQECLRLQAAEKSFHDALLHQNPSSCFSDENYGRTVSFESCTTDNSCESELVNGVGEFDSSFLQLQTPLVHDPFGESQAAGYFHDGTWNLFQSQSQTKPLMVEEGSSASAPREKRSHGMDDYASHEQEGRRGSKVSAVFSDESESPEILDEVLLCQSGRSQALLCAATEPSQSVDLGGSNGKATRSRSKKVSAKAGTAVDLWTLLTQCAQAVASFDQRNANDLLSQIRQHSSAFGDGLQRLAHYFANGLQIRLAAGTPSYTPLEGTTSADMLKAYKLYVTSSPLQRLTNYLATKTIVSLVGNEGSVHIIDFGICYGFQWPCLIKKLSERHGGPPRLRITGIELPQPGFRPAERVEETGRRLANYCKKFKVPFEYNCLAQKWETIKLADLKIDRNEVTVVSCFYRLKNLPDETVDVKSPRDAVLKLIRRINPNMFIHGVVNGTYNAPFFLTRFREALYHFSSLFDMFEANVPREDPERVMLENGLFGRDAINVIACEGAERVERPETYKQWQVRNQRAGFKQVRFDPLLVNDEKEMVKKEYQKDFVVAEDGKWVWLGWKGRILNAISAWTPA

SEQ ID NO: 118314 - protein, 288 aa, Glycine max
  Coding DNA Sequence Number=SeqID_1536
  Gene Ontology: Mol. function=ubiquitin-specific protease activity; Biological process=ubiquitin-dependent protein catabolic process
  Homolog annotation: Hit_ID=Q8LB95; Match level="QueryCoverage=85%, HitCoverage=96%, E-value=8e-51, Identity=55%"; Hit description =Putative ubiquitin fusion-degradation protein
  Pfam annotation: Domain name=UFD1; Domain location=1-153; Score=47.6; E_value=2.6e-11; Accession=PF03152.5; Description=Ubiquitin fusion degradation protein UFD1
  Subcellular localization annotation: CTP_CleavageSite=18; ConfidenceScore=5.26e-01
MKTITVLTYKSCNRVFFRSMHTQTISHLSSLLITMRCSICKPLNSFIVVTLFPSLRSQIWKKVIKLSCLPQPLIALMMENMLLQEGDIVKVKIATLAKGTLETTLRSYSCLTAGDTIMVPYNNKKYYIDIVETIPSPAVIIIETDCEVDFAPPLDYKEPEKQAKPVVFDRKQPEVEDEPPAKIARLTPFTVSGRHLDGKPSAQSVEQASSSELKQKQTDKEIKGSDSKSSNTVSRRHSGKLVFGSNATTSDVQTTPKVSQENTCKEKSQKEQEPKFKAFTGKKYSLKS

SEQ ID NO: 118315 - protein, 611 aa, Glycine max
  Coding DNA Sequence Number=SeqID_1537
  Gene Ontology: Mol. function=protein-methionine-S-oxide reductase activity; Cellular component=nucleus; Biological process=regulation of transcription
  Homolog annotation: Hit_ID=Q00LP5; Match level="QueryCoverage=88%, HitCoverage=88%, E-value=1e-131, Identity=44%"; Hit description=GRAS4
  Pfam annotation: Domain name=GRAS; Domain location=252-518; Score =299.5; E_value=6.1e-87; Accession=PF03514.5; Description=GRAS family transcription factor
  Subcellular localization annotation: CTP_CleavageSite=36; ConfidenceScore=5.01e-01
MVVTIDNNDGGSDNRVMTATVVIMVVTTVTLMIMVVENQVAKGFEFVDSSSPSSGTSSSGESMEFTKYSNPILRYISDILMDEEDDLERRPCMLQDCLRLQAAEKSFHDVLLHQNPSPFRDESVGIIHSDEIFGRTPKTPLVDSPDAVPDPPFGESRPIGYFLDGTWNLFQSHTKMVEKGSSASALREKRNHQMDDYESHEQEARKGSKVSAVFYDESEPPEILDEVLLYQTGRSQPLYSSPTVPSQTQRVDLGRSSGKEARARSKEVSSNTETAIDLWTLLTQCAQAVANYDQRNANELLSQIRQHSSPYGNGLQRLAHYFSNGLQIRLAAGTPSYMPLEVATAADMLKAYKLFVTSSPLQRLTNYLTTKSIISLVKNESSVHIIDFGICYGFQWPCLIKKLSDRLGDRPRLRITGIDLPQPGFRPKERVEETGRRLVNFCKKFNNLPDETVDVKCPRDAVLRLIRRINPNMFIHGVVNGTYSAPFFLTRFREALHHFSSLFDVYEANVPREDTQRVMLEKRLFGRDAINVIACEGAERVERPETYKQWQVRNQRAGFEQVPLDPQLVVDATDIVKREYHEDFVVAENDKWVLLGRKGRILNAISAWTPD

SEQ ID NO: 118316 - protein, 345 aa, Glycine max
  Coding DNA Sequence Number=SeqID_1538
  Gene Ontology: Mol. function=protein-methionine-S-oxide reductase activity; Cellular component=nucleus; Biological process=regulation of transcription
  Homolog annotation: Hit_ID=Q00LP5; Match level="QueryCoverage=92%, HitCoverage=47%, E-value=1e-112, Identity=60%"; Hit description=GRAS4
  Pfam annotation: Domain name=GRAS; Domain location=1-243; Score =268.4; E_value=1.5e-77; Accession=PF03514.5; Description=GRAS family transcription factor
LSPYVANALEARLVGDGTATQIFYMSYKKFTTTDFLRAYQVFISACPFKKFAHFFANKMIMKTADGAETLHIIDFGILYGFQWPILIKFLSRRPGGPPKLRITGIEYPQPGFRPTERIEETGRRLAKYCKRFNVPFEYKAIASRNWETIQIEDLKIERNELLAVNCLVRFKNLLDESIEVNSPRNAVLNLIRKMKPDIFVHSVVNGSYNAPFFLTRFREALFHYSSIYDMFDTLISRENEWRLMLEREFLGREIMNVVACEALERVERPETYKQWQARNTRAGFKQLPLDKEIMTKFRGKLREWYHRDFVFDEDGNWMLQEFILDGRSPSAVVNCDEYSSQVCTK

SEQ ID NO: 118317 - protein, 1509 aa, Glycine max
  Coding DNA Sequence Number=SeqID_1539
  Gene Ontology: Mol. function=RNA-directed DNA polymerase activity; Cellular component=chromatin; Biological process=chromatin assembly or disassembly
  Pfam annotation: Domain name=Chromo; Domain location=1404-1455; Score= 16.7; E_value=0.011; Accession=PF00385.14; Description='chromo' (CHRromatin Organisation MOdifier
  Pfam annotation: Domain name=RVP_2; Domain location=335-452; Score= -51.8; E_value=0.011; Accession=PF08284.2; Description=Retroviral aspartyl protease
  Pfam annotation: Domain name=RnaseH; Domain location=851-969; Score= -30.8; E_value=0.043; Accession=PF00075.14; Description=RNase H
  Pfam annotation: Domain name=rve; Domain location=1102-1258; Score =123.8; E_value=4.9e-34; Accession=PF00665.16; Description=Integrase core domain
  Pfam annotation: Domain name=zf-H2C2; Domain location=1043-1084; Score=7.4; E_value=0.037; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1404 -1455::335-452::591-760::111-201::851-969::1102-1258::1043-1084
MLSNAFRRVKSPLPKGQASLSQNHHSLNIKIDNIHASLTTQIESLFDRLAAVAVPHSSPVSATQPPPSPISRHHHLKLDVPRFDGHDPLGWIFKVSQFFDYQGIPEPERLTIASFYMDGPALSWYQWMHRNGYFPSWPAMLQALESRFAPSFYDDPQGSLFKLQQTGSVTDYLTAFERLANRTIGIAPSSLLSCFVSGLIPELRREVQALRPMSLPQAIELARLQEDKLIDRRRGSRPPFPAPPHPSPAPPQSFSPKPTTSPFPKSPTPLPSPRIPVKRLSAEELAIRRDQGLCYHCDDKWSHGHRCRSRLHLLLADEDIENPNIPPDPNPDPPLVSQISLNAMEGTVAPQTFRLLGMIGHHQLIVLVDGGSSHNFIQTRITRFLALPTAPTPPLRVMVGNGNTLDCDTLSPQTLISLQGHDFALDLFHLPLCGADIVLGVQWLKLLGPVTTDYSALTMTFPYLGHTITLFADAPPTLTSASAHQLKRFAQTHSISALYHITPIPAQPISPLPASPPTPPSITIVLNRYASIFTEPDHLPPSRNIQHHIHLLPNSTPVNVKPYRYPHFQKTEIETQISSMLASGLIQPSHSPFSSPILLVKKKDGSWRCCVDYRALNSITVKDRFPMPTIDELLDDLGKASCFSKLDLRQGFHQIRMAASDIPKTAFRTHQGHYEYCVMPFGLCNAPSTFQAAMHDALRPFLRKFVAVFFDDILVYSPDIPTHASHLDSVLSTLLAKQFFLKASKCLFAQSQLNYLGHIISAQGIAPDPDKVQAMLDWPIPTTTTALHGFLGLTGFYRKFIQGYASVAAPLTALLRKDQFLWSPTASTAFDTLKTLMTQAPVLATPDFSLPFILETDASAVAIGAVLLQRHHPIAYFSKVLCPRLQRASAYVRELHAITAAIRKWRHYLLGSSFTILTDHRSLKDLMSQVIQTPEQQTYLVKLLGYDYDIKYKPGSSNIVADALSRLPQGECFSFSVPHYDFMDKLRHTLMQDPQYRDLVHQVQSTPAAHPSLSVHNDLLFRHHRLWLPFPTHFTEVLMEEFHSTPLGGHTGATKTLHRLRQSFDWPNIRSDVRRFVAQCTTCQQTKYEPQKPPGLLQPIPLPSAVWEDLSIDFITGLPLSKGYTVILVVVDRYSKGAHFGPLPTSHTAHTVACLFFDMVCKHHGFPRSLISDRDALFLSSFWRELFKLSGTKLRMSTAYHPQSDGQTEVVNRVLEQYLRSFVHHKPHHWSRFLSLAEWSYNTTVHSSTGYTPFEVTYGKAPPSLIDYVRGTSPIDAVDSMLTDRTELHNTLLRRLRKAQEFMTTSANKHRRDLQFSVGDWAYVKLRPYRQKSVAPAYSKLSKRYYGPYQVIERIGSVAYRLQLPPSSRIHPVFHVSLLKRHQGPLSLTSAALPPSSVEHHPLVTPLAFLDWQWDTSVTPAARKVLVQWAGLPPENASWESWSDVKHTFNLEDEVPFEGEGDDSNIQITEHIETAAVPNYTTDNKEEFTAMNSRSKRDTHRPKYLADYV

SEQ ID NO: 118318 - protein, 105 aa, Glycine max
  Coding DNA Sequence Number=SeqID_1540
MLGTDLALVKEFYANLYSYEGPSPKKARVKGHLVKIDADSLNTFLETPVVLAEGETLPTYSRYCRLPTDYREIEAALCIPGRGFLLNAEGHPGRILRKYLTMLAQ

SEQ ID NO: 118319 - protein, 287 aa, Glycine max
  Coding DNA Sequence Number=SeqID_1541
  Gene Ontology: Biological process=regulation of transcription
  Homolog annotation: Hit_ID=O81074; Match level="QueryCoverage=72%, HitCoverage=14%, E-value=2e-16, Identity=32%"; Hit description =Putative SCARECROW gene regulator
MDPNFIISGYDFDESNHWDLNGHYANLLNDAFSDVGPLGLSQNAILNSEPFVSSSGSAATDPAATTATLADPSPEEDTDFSETFKFISQILLEENFEQKPCMCYDPLTLQHTEKSFYEALELEPSLPLSPNQHPLESPDGNSSNSISDSANSHDLKPSSPNTPVSDALHSSSHAPSFVVPPHALNKINDGTVDLDSSVTKLLAENIFSDTDSMLQFKRGLEEASKFLPRRPQLFTGLESTAVSAEPKGKGVALKMENSIGVRSRKNHARQDEEEEEERSNKQSAVSA

SEQ ID NO: 118320 - protein, 982 aa, Glycine max
  Coding DNA Sequence Number=SeqID_1542
  Gene Ontology: Mol. function=RNA-directed DNA polymerase activity; Cellular component=chromatin; Biological process=chromatin assembly or disassembly
  Pfam annotation: Domain name=rve; Domain location=625-780; Score= -0.4; E_value=0.0064; Accession=PF00665.16; Description=Integrase core domain
  Pfam module annotation: Pfam domain module=RVT_1::rve; Domain location=261-596::625-780
MALQTISLLQATTIAKLQEDKLRDRATSNSRNSYQPKPLPSHIPNSTMKAKPPYVQRTPAEMAFRREKGLCYNCDEKWNANHQCKGRVMFLIADEQSPDPDASTPEFKEEQLALASDHTESPSDTSCSHISLHALSGLPSSETFRIYGTIKNVRLTILVDSGSTCRKWFYVSLQSGLPRNFGHLGQDISLTTDRPTGKSTRANHDPTPHPFHSASSSQIRSSISDPLAATTTTPGGTSHYSRSVHSPIATRISKRTKSRDSPYSSLVLLVKKKDGMQRLCVDYRALNVVTVHDHFPIPTIDELLDELGHASWFSKLDLRQGFHQILMNDADVEKTTFRTHNEHYEYLVMPFGLSEFYLKQSKCLFAQENIEYLGHIVSGKGVTPEPSKIQAMVRWPNPMTVKELCVFLGLTRFYRKFIKGYAAIAAPLTSLLCKDAFTWTFESQIAFDQLKSAMTNTPVLALPNFSEPFVIETNASGTAIGAVLMQNKHPLAYFKLHAIVAVVRKWRQYLLGRSFTILTDHKSLRELMTQYKADAINVVADALSRAPEPTGQLLILSVPQLDFLNDIRKSLEVTLEFQQLKNSIQSNPANHPNYTLCNDLILFKGRIWLNNDNSCIPILLTEYHATPLGGHLGLAKTTHRIESSFFWMNLKQDPSVTITDTGRGVGRPIYGLHHTPTPLQWLHGYICRGRSIFQGSTPRSFAYWLHRVQGRKLILGYRITAYHPQSDGQTEVMNRILEQYLHCFVHSQPAAWFSYLALAEWSYNTSLHSSSGLTPFEIIYGKPPPAVLDYVAGATNNEATQSLLTSRQALHSKLQKRLQKAQDTMKRYTDPKRDDVSFEIGQWVYVKLRPGRQSSVVGRHHSKLSKCFFGPFQIEERIGAVAYQLRLPPESQIHPVFHCSLLRAHHGPQPPAKESEPPEDTSWEPWLDLCKTYHLEDKVDLGEGGIVNNQAQTQPAPTRPARIRTTPSHLYDYYVDGLPGSP

SEQ ID NO: 118321 - protein, 72 aa, Glycine max
  Coding DNA Sequence Number=SeqID_1543
MPEIKRKHCYAICEDVPPEGGCFWRKQPGSPGRAGKSKLRRFRNVSMGDFAKIFNRSSSFVIRSSSFFSLQP

SEQ ID NO: 118322 - protein, 195 aa, Glycine max
  Coding DNA Sequence Number=SeqID_1544
  Gene Ontology: Biological process=multicellular organismal development
  Homolog annotation: Hit_ID=Q9XGW1; Match level="QueryCoverage=63%, HitCoverage=15%, E-value=3e-26, Identity=45%"; Hit description =Protein PINHEAD
MLVRQIWEGLEQQLVNKPHLQNPINGAKKVPRAVGNGKGPPPPLPQQELPQNQTSPQARNNRRRRSRGEGRKFDQGDILMRPIVTRGVENGSIMCGEKDMSYPTSSKSLSFASRPGYGQVGRKCIVNITAEVSSKAVNRSIIAELVRLYKESDLGMRLPTYDDTKSLYTAEPLPFSWREFKIKVVDDEDGVNGSK

SEQ ID NO: 118323 - protein, 395 aa, Glycine max
  Coding DNA Sequence Number=SeqID_1545
MADSDSRGLIQQPLMDKEVISIGGSSSEDTHYGASNSESSSSERELVPVTIILPPSAFEGVRSSGNGDVKASPHARRSHSAGSPSSPPTVAGYDERRYFVMPSETGWRQVVRPSSLCMGACLSVSKKLFEFDLNSFFHFKDRFFKVLDLGVMVDEGGQGHLGAATDLARRMGYFVPSLDEQSSRCLGRLELTLACVVVAHFARIMGNFAWWPLVKLVRLAGGTVPSSTVAPTEGGQPVIEVDPILIGTTDIALSAPSSVLSKRKQDDSVGLTLVAGRTSSVQDVPSAPPTVEALATDVVVVVVVAAPVAAEVSVLAALAGFVVAPSSIIVVPLLSAGVVTTSAPMVPPSSSSTPMVPLSIALASHSIFSNPRVSLDHIYTSNDANSLWGMGHKPE

SEQ ID NO: 118324 - protein, 146 aa, Glycine max
  Coding DNA Sequence Number=SeqID_1546
MGNSAKVVIKQDMKGRTHKYGFNNNKREKAQKKRVVDDETGDRHQLDEVVDITYENWKEFPTAQKDLIWEDIQAEFDILEASYSRTKRKLLQTVGERWRQFKSDLTRKWAHAADQDGVEDTVCDKYSINKGKWVQFCQTRRDSSWE

SEQ ID NO: 118325 - protein, 98 aa, Glycine max
  Coding DNA Sequence Number=SeqID_1547
MNCDLAGGEHHHDSCYFYSINNFDQRQELAMYDYHEKERTPDLESILADFMTYQASSKGYCYSMHQQGTLFERDYSSTDYQRESLFGFWQVHRIAQVV

SEQ ID NO: 118326 - protein, 76 aa, Glycine max
  Coding DNA Sequence Number=SeqID_1548
VGRLKERVPEFPEVQRSRKKKIEEKRRRKKRKKVKTFPNRIRDRLLHRSSFVLWSFFVHSSFVLHSSSGWCLSLRI

SEQ ID NO: 118327 - protein, 126 aa, Glycine max
  Coding DNA Sequence Number=SeqID_1549
  Subcellular localization annotation: CTP_CleavageSite=45; ConfidenceScore=5.79e-01
MESDSFRRASRSTTFLASSSFFIATSSTLPAKFFFSSCKSLQHLNSSSLSNLMHKNLANTLPTLEDSWWALHSLDSASDRPPFGNFNLLKGHFAQCLLMSLPIFFKNYQTPLKEDLGIIRSMLKSD

SEQ ID NO: 118328 - protein, 106 aa, Glycine max
  Coding DNA Sequence Number=SeqID_1550
  Subcellular localization annotation: CTP_CleavageSite=64; ConfidenceScore=5.42e-01
MAFSGLTRLSSIGKSTRNGVDYTFDLLNRFLFLWRFSIVPLLLVSLSTSTFHSISSFCLLRGSYAASFSVLQVSSNPDLGGFVEGSLMGTFKLKDSFRIVVQLTVR

SEQ ID NO: 118329 - protein, 1162 aa, Glycine max
  Coding DNA Sequence Number=SeqID_1551
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=98%, HitCoverage=95%, E-value=0.0, Identity=40%"; Hit description =Putative SCARECROW gene regulator
  Pfam annotation: Domain name=GRAS; Domain location=243-549; Score =406.9; E_value=2.9e-119; Accession=PF03514.5; Description=GRAS family transcription factor
  Pfam annotation: Domain name=GRAS; Domain location=859-1161; Score =334.2; E_value=2.2e-97; Accession=PF03514.5; Description=GRAS family transcription factor
  Pfam module annotation: Pfam domain module=GRAS::GRAS; Domain location=243-549::859-1161
MNATNDEESCLDKSVLSYIKQMLMEDDTEERYSMFHDSLALQHTERSFLEAINHNYPSPSYSSSTHYHLDNYPSVDSPEPCLSACSADNITFSASSSCASNNTTSSSEFPLRSLYPLLPDTTDEFVFHSNSTQSTINTPFGFFDNPLAEIFERRVDLGTLFLPANTPFSSSFTKVPHVVIKTEAEEGDHFLTGRKQREREEYEAADGRSRKQSAAHMDESELSELFDKVVLGTDLRKRVPPNTTHKTTILTNMLYGGDVWENDDQVVDLRTLLMLCAQAIASDNPSSAKQLVKQIMQHSSPTCNETQRLAHYFGNALEARLDGTGYKVCSALSSKRTSAKDMIKAYHVYASVCPFEKLAIIFANNSIWNPSVDAKAIHIIDFGIRYGFKWPALISRLSRRSGGPPKLRITGIDVPQPGLRPQERVLETGRRLANFCKRFNVPFEFNAIAQRWDTIRVEDLKIEPNEFVAVNCLFQFEHLLDETVVLNNSRDAVLRLIKNANPDIFVHGIVNGSYDVPFFVSRFREALFHYTALFDMLDTNVARQDPMRLMFEKELFGREIVNIIACEGFERVERPQTYKQWQLRNMRNGFRLLPLDHRIIGKLKDRLRDDAHNNNFLLEVDGDWVLQVSSINISKEDESDVSAVLGYIKQMLMEDNTEENYSMFHDSLALQDTQRSFYEVITHNHNYPSSSTHHHVHNYLSVESPDQSLSCTSSSAESQWRNLDHIPDSFVFHSNSTTNMNTGFGFFNDSLQAGFLDSTFLQKFQRGVDQGTQFLPKHTPFIIAPSFTKAPHLVIKTEAEEGDHFRTVSGGRKIREREENEADERSRKQSAPYMDDSEQSELFDKVLIGTGLGKGVPPNTTHETILTNMFGGDVRKSDGEVVDLRTLLMLCAQAVASASSPSFAKQLVKQIKQNSSPIGDETQMLAHYFGNALEARLDGTGYQVYSVLSSKRTFVKDMIKAYHVYASVCPFEKIAVMFANNYIRNLTEEAETIHIIEFGIRYGFKGPGLVGHLSRRAGGPPKLRITGIDLPQPGLRPRQRVLETGRRLANYCKRFNVPFEFNAMAQRWDTIKVDDLKIQRNEFVAVNCMFQFEHLLDETVVLNNPRDAVLRLIKNANPDIFVHGIVNGSYDVPFFVSWFREALFHYTALFDMLDTNVARKIP

SEQ ID NO: 118330 - protein, 125 aa, Glycine max
  Coding DNA Sequence Number=SeqID_1552
MPIKLSHTSATLSYDFESNAALTEEKSITLLFDQIPIPYSRKTIEIQINKKATQQLFYATKHGTSVAIPQFDAKSKKPASAPPAKKQDIVYVNDVVLTCVYDSEKKLCALFHGSSPMRPSAGLPL

SEQ ID NO: 118331 - protein, 449 aa, Glycine max
  Coding DNA Sequence Number=SeqID_1553
  Homolog annotation: Hit_ID=Q75I82; Match level="QueryCoverage=86%, HitCoverage=86%, E-value=9e-83, Identity=47%"; Hit description =Expressed protein
  Pfam annotation: Domain name=Pinin_SDK_memA; Domain location=160-319; Score=11.2; E_value=5.1e-06; Accession=PF04696.3; Description =pininSDKmemA protein conserved reg
MGSTAVEKTEEELRNEIDELLRQQREITERLRDPRGLRRGSLAGPALPSNGARQRPFIRPVTGDRNDSEDQPPAKRRLSSAVVKVDDGELPEDAGAGQDGKTKDSANEAVNGTAAVVQNDSNPFNSHQTVWSKRDNNQRTSKASDIPTTEHVPRVLPKNEDPSLVNRNKRMLGQLLGTLEKFRKEDKQLSGTEAYMRRSSSLQRAEQRAREESERLRKEEREQIAEKRRRDLTMTQRSILILINNYILFPPYSYQTLRARVAAKTEEKKLELLFLQWTEHHKRLSNFIRTKAEPPIYYLPNKPLDEDPTLLEKSKEEAFLEWKNARREEVSEYQKQIGEQYLANVEKELERWQNARNARKVNNDQNLQETMDKELDTHRLEHGPKKRKIPDENNNDDDDDVEDINVGEDDMMDDELDDDSSRRIDETTKTEAGSASSDPAADADNAGGK

SEQ ID NO: 118332 - protein, 205 aa, Glycine max
  Coding DNA Sequence Number=SeqID_1554
  Gene Ontology: Biological process=steroid metabolic process
  Homolog annotation: Hit_ID=Q10NC7; Match level="QueryCoverage=25%, HitCoverage=11%, E-value=9e-14, Identity=65%"; Hit description =Oxysterol-binding protein, expressed
MAGKENFFSMYLFLVLSSQHHTGKTYWKGFHQGFAFQGNVQQFYTSRMMLGHEGVEVINPEGSKEDAEEETQRGRWKPERHGLYLCTLHINEPGSLLTLSLERLMRWLTMVELHFLQNSCTPQLVAAMDMSHVIFKIGYKGVVDRIQGHRIDFSEIGALVIECKALLSSFPNFSVKFVRRQSNITAHFNARAVINYASTYLAVCV

SEQ ID NO: 118333 - protein, 249 aa, Glycine max
  Coding DNA Sequence Number=SeqID_1555
  Subcellular localization annotation: CTP_CleavageSite=64; ConfidenceScore=5.14e-01
MVPISRTWMFDVCFAHILNWKQLILPSTPSGLSYGSPSSSGLGLLFVVNSIIFMALGFVIGYPVASASGDIVVLDEKTVELQRTITGGEAEVAEFGDRMRHAARALIVGKVVATLEESIDGVRESRNSEVVVVGEGNEVAREVRSQLTVFNFVGELELKADLHEIKVLQGLWRNDLAALKGSCPNCGEEVFAFVRTDKANNSPHRADCHVCECLLEFRTEVEQSALRLGRQWVYGRIYLVRRSRRQREP

SEQ ID NO: 118334 - protein, 261 aa, Glycine max
  Coding DNA Sequence Number=SeqID_1556
MGNKIGRAIKSRRGSNLGESDVHVHGFGSVVDSAIRTASNAGTDVYSFSETVDNPMRSSGAPNNLHVHVSDFGSVVDSAIRTASNAGTAVYSFSETVDNPMRSSGAPNNLHVHVSDFGSVVDSAIRTASNAGTAVYSFAEAVDNPMRSSGAPNNRHVHVHGFDWVVDNAMRSSGIDESVHGFASAVDNGIMSSNLEVSASALVDVHNLSPNGSGWQKGDFLGNGSFGTVYEGFTESVYYYHTIPSYTFKLNSASVFSYLPI

SEQ ID NO: 118335 - protein, 73 aa, Glycine max
  Coding DNA Sequence Number=SeqID_1557
MDAEFLKRCLPRSLLEWDNVVAWFCSLYNKPDNYLKGMVNRCMFFLTSALKGFNDKHGSKSKANAKWIPVKSK

SEQ ID NO: 118336 - protein, 2065 aa, Glycine max
  Coding DNA Sequence Number=SeqID_1558
  Gene Ontology: Mol. function=oxidoreductase activity; Biological process=electron transport
  Homolog annotation: Hit_ID=Q1RYZ2; Match level="QueryCoverage=59%, HitCoverage=79%, E-value=0.0, Identity=79%"; Hit description=NAD -binding site; Serine/threonine dehydratase, pyridoxal-phosphate- binding site; ...
  Homolog annotation: Hit description=AMP-dependent synthetase and ligase
  Pfam annotation: Domain name=AMP-binding; Domain location=261-718; Score=241.3; E_value=2.1e-69; Accession=PF00501.18; Description=AMP -binding enzyme
  Pfam annotation: Domain name=Hexapep; Domain location=1112-1129; Score=3.0; E_value=62; Accession=PF00132.14; Description=Bacterial transferase hexapeptide (three rep
  Pfam annotation: Domain name=Hexapep; Domain location=1141-1158; Score=12.4; E_value=1.6; Accession=PF00132.14; Description=Bacterial transferase hexapeptide (three rep
  Pfam annotation: Domain name=Hexapep; Domain location=1401-1418; Score=9.0; E_value=12; Accession=PF00132.14; Description=Bacterial transferase hexapeptide (three rep
  Pfam annotation: Domain name=Hexapep; Domain location=2029-2046; Score=10.0; E_value=8.6; Accession=PF00132.14; Description=Bacterial transferase hexapeptide (three rep
  Pfam annotation: Domain name=PP-binding; Domain location=860-926; Score=32.7; E_value=1.3e-06; Accession=PF00550.15; Description =Phosphopantetheine attachment site
  Pfam module annotation: Pfam domain module=AMP-binding::Hexapep::Hexap ep::Hexapep::Hexapep::PP-binding; Domain location=261-718::1112 -1129::1141-1158::1401-1418::2029-2046::860-926
MDASELEKDLFSKVETNDYYTTVLKIKGLERMPVGFYYFSEYMEDPSTIGNPVAMQKFYADSNIFLFWSYGNSADIKGPTVTELAIKSIESMGGEVQNIILQRRFKYFPHVSSQDMRNGFYEKLESELQGSRNTYYVGGLMAFELTERNSSYAMALICKNFANSSDLPVFPYTKILHTLSSHVFQIELHLLEECLWQSLFPLQTDIQKKEPKELVELPGVQFPNLPALNSYLKHWGTHPITQNRTLYTWLNEGGTVVGKRTYGEQHLNASCIAHKLLTSQKPVIKPGDRVLLVYVPGLDFVDAFFGCLRAKVLPVPVLPPDPMQRGGQALLKIENIAKSCGIVAILSTASYHTAVRAGLVKSLISLTGKNGKYTAQWPKLPWLHTDTWVNNSRNSAVEDVDDQCEPQPGDVCFLQFTSGSTGDAKGVMITHGGLVHNVKLMRSRYKSTSRTVLVSWLPQYHDMGLIGGLFTALVSGGSAVLFSPLTFIKKPLLWLETISKYQATHSAGPNFAFELVVRRLESEKDKLQSLDLSSMIFLMVAAEPVRMKTLKRFLDLTTPFGLSQKVMAPGYGLAENCVFVSCAFGEGCPILVDWQGRVCCGYIHPGDSDVDIIIVDPESGEELEEDGREGEIWISSPSAGIGYWGKEELSQKTFRNKLQNHPGRNYTRTGDLGRIIDGKLFITGRIKDLIIVAGRNIYSADVEKTVESSSEFLRPGCCAVIGVPEEILSAKGISLPDGSDQVGLVVVAEVRDGKTVSKDVIEHIQTRVVEEHGVSVASVKLIKPRTISKTTSGKIKRFECLKQFSDETLNLVPQPILTKKSLLRSFTTGTCREGRTPRAHLVRSSSPLPIPRISNKEIVEHLKRIISDQSGIPVNNISVTDNMSTYGIDSIGVVKATQKLTDFLGVPVAAIDVFTASCIQELANFSENLLLKSQPQLMSNSPHAPEAEIDFTEVVVDVSKSRQWGIRLLQLLALVYISIMLVTPAYLSITAFQSFIPNASESVYGMPWSSYLISLTLAPLSWILCIVSTCLCISFFGNSFLRPNYALTPEISIYSMDFVKWWALYKTQEISSKVLATHLRGTVFLKYWFEMLGARIGSLVLLDTVDITDPSLVSIGDEVAIAEGVLVQSHEVKNGILSFLPIRIGKNSSIGPYSIIQKGSIIKEGSEVQPLQKVEGGQHVLKPAKHNNVKENALLLVSTSKIQSNAMYHFLGIYLTGFLSSLASAIAYILYIRLFQIPASFQHFSFLCVCGAFHWIPFTVVAYATMFSDVPSNPIAFTISFTSAYLLHGLILTSLTCALTRLLKFNQNQTHFKTWLRHQLTISCHHRFAKLLSGTEAFCLYLRLLGAKIGKHCSIRAINPVSNPELMSIGDGVHLGDFSKIITGFHYSNGYACGKVEVQDNSVVGSQSLILPGSVVEKNVILGALSVAPMNSILHEGSVYIGSQTRVATRNSSYHLDERIEEMDMEYKKVVANMAANLAVTTINVKARYFHRIGVSGKGHLKIYDKLDGNIPLHKIFYPGKSYPIMLRHSNSLSADDDARIDARGAALRILSDESPDSNNLQHASLIDLTLKTGNAFYARTLADFATWLVCGLPAREELVKRTPHVRDAVWNSLRHANSYAELHYYSNICRLMRFTDGQEMYVKFKLRPIDTSISEDTGKVVPTGILPPETGAIPRDEKDTRPLLFLAQDFQRRVNSPGGVCYVFQLQLRAVPEDEAARDIALDCTKPWDENEFPYIDVGEVNINENLSTEESDRLEFNPYLKSHELDVIPATSNTQSASIDHGRSLIYEICQHVRNRQPLPESWRNLVEQSNVKVDLSCCPVAAALPKKETTKKVTTTLTLTRTWYQTFSALFTQPLLQTVLPYTVMGLAVFAPLNFLVNLKNVEKLQVQWFFPLFWVVSGVMAALACVVTKWVLVGRKKEGETVPLWSKRVIMDSTWQAIRTLVGDYFMDMASGSFLFVMWMKLMGADIDMDGGGAYVDSTGAMLNPEMVTIERGGCVGREALLFGHIYEGDEGGMVKFGGIKIGEDGFVGSRAVVMPGVHVENEANLSALSLAMKGETVRSR

SEQ ID NO: 118337 - protein, 206 aa, Glycine max
  Coding DNA Sequence Number=SeqID_1559
  Gene Ontology: Mol. function=transferase activity, transferring glycosyl groups; Biological process=response to oxidative stress
  Homolog annotation: Hit_ID=Q9LXU2; Match level="QueryCoverage=99%, HitCoverage=29%, E-value=9e-76, Identity=76%"; Hit description =Anthranilate phosphoribosyltransferase-like protein
  Pfam annotation: Domain name=PRT_C; Domain location=82-201; Score =166.1; E_value=8.8e-47; Accession=PF08372.1; Description=Plant phosphoribosyltransferase C-terminal
MRLSRAEPPLRKEVVEYMLDVDSHMWSMRRSKANFFRITKVLGGLLAFGRWFDQICNWKNPLTSILIHILFIILVLYPELILPTIFLYLFLVGIWNFRWRPRHPPHMDTRLSHADAAHPDELDEEFDTFPTSRSSDMVRMRYDRLRSIAGKVQTVVGDLATQGESSSLCHSLPSCVPSNWLLFAKAPQIPPETSFSPIQLLQEVAS

SEQ ID NO: 118338 - protein, 89 aa, Glycine max
  Coding DNA Sequence Number=SeqID_1560
  Homolog annotation: Hit_ID=Q5ZDM9; Match level="QueryCoverage=40%, HitCoverage=10%, E-value=9e-09, Identity=66%"; Hit description =Putative membrane protein
MVRTIIYIHCDDEDDNVGHHEGGDQPWEPALEEAEVAIVHGRGTRRRRRVPPPPSGVDGGGVAARMNLHLDGGRRWVPPHDSSRPFGKD

SEQ ID NO: 118339 - protein, 609 aa, Glycine max
  Coding DNA Sequence Number=SeqID_1561
  Homolog annotation: Hit_ID=Q2QWE9; Match level="QueryCoverage=67%, HitCoverage=69%, E-value=3e-94, Identity=42%"; Hit description =Expressed protein
  Pfam annotation: Domain name=XS; Domain location=288-405; Score=-3.8; E_value=1.1e-05; Accession=PF03468.5; Description=XS domain
  Pfam annotation: Domain name=zf-XS; Domain location=218-256; Score =22.2; E_value=0.00031; Accession=PF03470.5; Description=XS zinc finger domain
  Pfam module annotation: Pfam domain module=XS::zf-XS; Domain location= 288-405::218-256
  Subcellular localization annotation: CTP_CleavageSite=79; ConfidenceScore=5.52e-01
MADDGADPFPVLTSVYRVSGSKNSQLGWNVANSQQTVDSSVNNSRQLQSISDGSAPRPWFSQNFRPNAWEVPGVIQKLRPAKRGNDGLALTGSGILNDKLPPESVISPTSETERGTGLNSSVGVVTTTSKDCENVECKDKDKRIPEPQCENNNDQIVDNGSDIVFDSDDDCFLDDIDSDTGERSHEQCKKSKWLRNFFDKLNALTNEEISSLDRQWHCPACQGGSGAIDWYKGLHPLLDHSRTIQTKRARLHRMFAETLEEECFRRRAPLTTVSDVHDIWEGLDKKVKDHEIVWPPMVIIMNTRYEQDESNKWNGMGNQGLLDCFCDYAALKARHSYGPQGHRGMSALIFEESTAGYLEAVRLHKHFKEQGRDREAWDCYRNPFLPGGKRQLYGYLASKEDLDIFNKHSRGKTKLKFEMRSYQEMVESKIKHINDDSRKLDYYKSMVAKEQIKSQVGADSLLRLSEKLSLTTEENRVDQQNKEMDALEKNFQSQILDIQQAIAAKEDKFVKLQQAMQEKVKESCGESSEKEDKVENISCFLKPQDKEMKQFEAEREKIIKIHEEKRLALKKKHWQEQVELEKELENERTQLMDKYTCNQTQEENCYVDH

SEQ ID NO: 118340 - protein, 239 aa, Glycine max
  Coding DNA Sequence Number=SeqID_1562
  Gene Ontology: Mol. function=serine-type endopeptidase activity; Cellular component=integral to membrane
  Homolog annotation: Hit_ID=Q3C2H8; Match level="QueryCoverage=85%, HitCoverage=63%, E-value=9e-55, Identity=50%"; Hit description =Rhomboid family protein AtRBL1
  Pfam annotation: Domain name=Rhomboid; Domain location=9-164; Score =164.3; E_value=3.2e-46; Accession=PF01694.12; Description=Rhomboid family
MGALEVGKVIHGHQVWRLFSCIWLHGGVVHVLANMLSLVFIGIRLEQEFGFGMVLVIILALSIRIGFLYVISGFGGSLLSALFIQEGISVGASGALFGLLGGMLSELLINWTIYANKFAALLTLIVIVVINLAIGVLPHVDNFAHIGGFVSGFFLGFIFLIRPQFKWVSSRHRNSHSTAAAPSVKYKHKPYQYALWVISFILLIAGIVPPYPCITRFKVIYNSSHDTSCIKLCYLNHNS

SEQ ID NO: 118341 - protein, 255 aa, Glycine max
  Coding DNA Sequence Number=SeqID_1563
  Gene Ontology: Mol. function=ferric iron binding; Biological process =aromatic compound metabolic process
  Homolog annotation: Hit_ID=Q6KAC4; Match level="QueryCoverage=89%, HitCoverage=36%, E-value=2e-51, Identity=44%"; Hit description =Putative X1
  Pfam annotation: Domain name=XH; Domain location=119-254; Score =235.0; E_value=1.6e-67; Accession=PF03469.5; Description=XH domain
MAIMEQNKADEKKEKEKMHKKILELQNELDAKQKLELEIQQLKGNLQVRNQIGEDDEEEKNKLDAIKTELEDKEEELEDLEALQQALVVKERKTNDELQDARKELIRWLRKTNSSRAFIGVKRMGELDEKPFLSAAKRKYSGDEVNLKAVELCSQYEAYLRDPTWFPFKVLIDKEGKAKEVLDEEDEKLRTLKDEFGDDVFQAVVTALKELNEYNPSGRYPLPELWHSKEGRKALLKEGCSFIIRQWKALKQRKK

SEQ ID NO: 118342 - protein, 42 aa, Glycine max
  Coding DNA Sequence Number=SeqID_1564
MDVLCLVGTSVKPTKHRGRICQDSYHRTFLAMVVGKESVDCC

SEQ ID NO: 118343 - protein, 478 aa, Glycine max
  Coding DNA Sequence Number=SeqID_1565
  Homolog annotation: Hit_ID=Q9LTJ0; Match level="QueryCoverage=15%, HitCoverage=13%, E-value=9e-18, Identity=58%"; Hit description =Transcription regulator-like
  Pfam annotation: Domain name=XS; Domain location=410-478; Score=48.2; E_value=2.7e-11; Accession=PF03468.5; Description=XS domain
  Pfam annotation: Domain name=zf-XS; Domain location=286-326; Score =15.2; E_value=0.0025; Accession=PF03470.5; Description=XS zinc finger domain
  Pfam module annotation: Pfam domain module=XS::zf-XS; Domain location= 410-478::286-326
MAWGMMATTRLMYLHLSVQFTIHVNMMTSPGAVKLYLGDLLVMDPNPETASLHMQGLIDVRTRHHHRVAILPAQDVDVFKSVWETRIPLNVSAFVPREESMEHLMFSCTFSSTSGISIMLGWGYILPNKNAPKATFVWDLMKEVGGEMDGGMVHSGVVSMVTENFCFLRMETLMVNRFVGGSMKIQVAVHGYSDIKTEAAAEPCTTRLPFVLCDGRKLHVNTGSIVHGNRTNSIFMSSNIIKNSVSMSGRRERVRESDFEYYERVYYEDLKSGYYKLKISKSSYKCPFCQDKREYSLNELSKHAVRFERDSRSMKIKDLAKHSALQLYIKKYLDVYDKVGSVVHDKVESVIHDKAGSVVHDRPGKVVLDRSGKVVNDGSGNVYSDRFGKVVNDRPRNVVIANDRSEKVGKDQLFVWPWVGIVANIATEFKNGMRIGDSGSKLRDEFTLKGFHPLKVQPLWNRYGHSGFAIVDSPKTGM

SEQ ID NO: 118344 - protein, 129 aa, Glycine max
  Coding DNA Sequence Number=SeqID_1566
  Gene Ontology: Mol. function=sequence-specific DNA binding; Cellular component=intracellular; Biological process=DNA mediated transformation
  Homolog annotation: Hit_ID=UPI00005FA32E; Match level="QueryCoverage =82%, HitCoverage=29%, E-value=1e-23, Identity=50%"; Hit description =COG0758: Predicted Rossmann fold nucleotide-binding protein involved in DNA uptake
MERSERIIRLTYVWGLSGERAPARAGRHAAAAVSRPLSTPAGKNAALAATGATSSDCLHRCTLSRPFAGNQPLSGCPLYSGRPLCTRDTATGGGRQSSLFAVWQRMGQLVYPAAGAKRFDHHQRAGARY

SEQ ID NO: 118345 - protein, 317 aa, Glycine max
  Coding DNA Sequence Number=SeqID_1567
  Gene Ontology: Mol. function=hydroxymethyl-, formyl- and related transferase activity; Biological process=biosynthetic process
  Homolog annotation: Hit_ID=Q8ZJ79; Match level="QueryCoverage=42%, HitCoverage=79%, E-value=3e-61, Identity=85%"; Hit description =Peptide deformylase
  Pfam annotation: Domain name=Formyl_trans_N; Domain location=127-286; Score=103.3; E_value=7.1e-28; Accession=PF00551.9; Description=Formyl transferase
  Pfam annotation: Domain name=Pep_deformylase; Domain location=3-149; Score=242.6; E_value=8.2e-70; Accession=PF01327.11; Description =Polypeptide deformylase
  Pfam module annotation: Pfam domain module=Formyl_trans_N::Pep _deformylase; Domain location=127-286::3-149
MSVLQVLHFPDDRLRKIAAPVAAVNADVQRIVDDMFETMYAEEGIGLAATQVDIHQRIIVIDVSESREERLVLINPELLEKSGETGIEEGCLSIPEQRAFVPRAERVKVRALDRDGNSFELETDGLLAICIQHEIDHLDARHLDALLASEHQVVGVFTQPDRPAGRGNKLTPGPVKVLAQAHDIPVFQPKSLKPEENQQLVAGLQADVMVVVAYGLILPQAVLTMPRLGCINVHGSLLPRWRDGRGVWIPGDMLHKITCPINADDTSASLYDKLAQLGPQGMLTTLSLLAAGSAQPEVQDETLVTYAEKLSKRRGSS

SEQ ID NO: 118346 - protein, 622 aa, Glycine max
  Coding DNA Sequence Number=SeqID_1568
  Gene Ontology: Biological process=lipid metabolic process
  Homolog annotation: Hit_ID=Q2R2X0; Match level="QueryCoverage=72%, HitCoverage=94%, E-value=1e-101, Identity=49%"; Hit description =Patatin, putative, expressed
  Pfam annotation: Domain name=PAP_fibrillin; Domain location=16-173; Score=131.7; E_value=2e-36; Accession=PF04755.3; Description=PAP _fibrillin
  Pfam annotation: Domain name=Patatin; Domain location=300-537; Score=- 3.9; E_value=2.2e-05; Accession=PF01734.12; Description=Patatin-like phospholipase
  Pfam module annotation: Pfam domain module=PAP_fibrillin::Patatin; Domain location=16-173::300-537
MVSFFPGFLTKGSDVQKLKVELYEAIAPLDRGAEATPEDQQRVDQIARKLEAVNPVKEPLKSGLLNGKWELFYTTSQSILQTQRPKLLRPNGKIYQAINVDTLRAQNIETWPFYNQATANLVPLNSKRVAVKFDFFKIASLIPIKSPGSGRGQLEITYLDEDLRSGMGPCICSSHAQRLPYAANLNPNSSILRRRAQFISFASNSSPPQDEEATAKKSFAVATGELFLGLATRLIKSRNKGSSSLAEDSGSVGMFENNSEERIGAVVEDEIDPDVVWEQRVKDVEAERNRYSRLVTSPGFSFSAAGLLFPYHLGVAQFLIQNGYIKETTPLAGSSAGAIVCAVIASGASMEEALNATKILAEDCRNRGTAFRLGPYTDLSLDTCIMCFSSLRTTQHLSCTVRYPPLYEIVCLRCLVSSSSCSRSLGNNFCCLGLKAVLRDILDKFLPDDVHIRSNGRVRVLLCLNYVPSVAVAVTQLLWRPRGLLVDQFDSKEDLINAVFTSSFIPGYLAPRPATMFRNRLCIDGGLTLFMPPTSAAQTVRVCAFPASRLGLQGIGISPDCNPENVCSPRQLFNWALEPAEDAILDRFFELGYLDASVWAKENPVEVIVQDDSPAFGSSSAT

SEQ ID NO: 118347 - protein, 354 aa, Glycine max
  Coding DNA Sequence Number=SeqID_1569
  Gene Ontology: Mol. function=metal ion binding
  Homolog annotation: Hit_ID=Q67UA8; Match level="QueryCoverage=67%, HitCoverage=46%, E-value=2e-44, Identity=44%"; Hit description =Hydroxyproline-rich glycoprotein-like protein
MNASINPVSLSVLKSSLIELFLKQINLTLTSSIFGNASIFEILKFPGGLTVIPVQSAYIWQMPEILFNFTLNNSISEVLESFDDFKDELKFGLHLNSDENVYVQITNANGSTITPPVVVQASVMAGFGSLLPQRLKQLAQTITGSAGKNLGLDNSVFGRVKEVRLSSFLKNTLHASSPSPSPAPAPSPQLIDHSEPSTSPHHANPYSPISPAASEQPPCFECEVSSPAPSMVPAHPPDPCPYSDFLHHPIPSPKSYSKPSFPPDYSPAAAPTSNSASHTSEEASDLSRVAEVSHGSKLPQGEETSNKLVSQLLAPSSLFLGDILCMTEWFLNPGLGSFDSDTLDGFRVGYHDPD

SEQ ID NO: 118348 - protein, 2762 aa, Glycine max
  Coding DNA Sequence Number=SeqID_1570
  Gene Ontology: Mol. function=hydrolase activity; Cellular component =nucleus; Biological process=chromosome segregation
  Homolog annotation: Hit_ID=Q5IBC5; Match level="QueryCoverage=66%, HitCoverage=97%, E-value=0.0, Identity=37%"; Hit description=Separase
  Pfam annotation: Domain name=DUF593; Domain location=2086-2167; Score= -31.7; E_value=0.081; Accession=PF04576.6; Description=Protein of unknown function, DUF593
  Pfam annotation: Domain name=Ndc80_HEC; Domain location=1866-2066; Score=-16.1; E_value=3.2e-05; Accession=PF03801.4; Description =HECNdc80p family
  Pfam annotation: Domain name=Peptidase_C50; Domain location=1340 -1787; Score=427.7; E_value=1.5e-125; Accession=PF03568.7; Description=Peptidase family C50
  Pfam module annotation: Pfam domain module=DUF593::Ndc80 _HEC::Peptidase_C50; Domain location=2086-2167::1866-2066::1340-1787
  Subcellular localization annotation: CTP_CleavageSite=74; ConfidenceScore=5.10e-01
MASPSESSLISKLQSSDSPGIHALVSDYLRPLSDLKPTKKSNPDQTLIRSLAKRFLSFLNASLSILPKRLPEVSKSNNAVSLLELLRVYRLCLDCLDAVASQLASKPFSVEFQRLRLIHCLESCGLFDEAQLEGLGVLEKLPPAKRKGKLLPEIDKGSGEGKELCSLVVDIVVSLLRCAAAGLAKEDAHFRKVLQLVEEVNPWLRTPFPDRDLVTLFWCTTLTEYVKSPIKDQVYKIALRVCSSLFALRDNNSLYIMDILDSIVRECKVEEGNTGTDFVELVYYCANKCQTANASFCSTFAAYLNKIAEHFKQVMTPINSILRLYAAGLLLVSCNLRSRTGDLASSGSAKFECLLGTLLENEKILQNSPPLLGSLHICSKSNCMSSSVEDQCFAGHPCALSGFDGEASMTYLSGYLEALKYLCQPLAKSINSERKELVTKVDDASAMTMMSTVQDAFHILCHLILSSTSSMPKNNGDGFDEKSKTVLNLVVAAFTLSIRTNLKVQESKQLINQIIASKWIEAEGLKYIIACLYNIAVVLYRNRLLKKASKVLNLCCKASWLCIKYHSANLSEGALKEFVMEACTRSALLLDIIHDVNNLKINKKMIDILKNWFTANDLFEGLPAPIPVVKQWVKIECKRATQVDERIDSLTLYSLLSSSLELSKRNIAMILEQKAQTLVRKGKAIRVRGIGGLRDCIQCLSEAITIMQIFEDVKAALDLWLSISHLNRFEEGDSSALSDNIMILLYNVVDLLQLKGFMELFNDAYQLLIKMFKRKNVPIEKWLPLMWESRSLSHALCVSPVNEEFIMNSLDEFSELSNIDFWIRYLQGNQSSLIGFQQNFSFLFASSHRNSCSHGSSFQTDITIDEVQKAALDLISNVPVPSHSTFLAGCLFYDLCPRLVANGQLIEALSSAKEAHRLHAKLFQRKFTHNVQQQNEEKNVMVDSSKNLMDGVENIGLNLSVAREVLLFDSISWDLKDSYLSAWKVMQCYLESTLQLGIIHEMIGDGAEAETYLKWGKAISSEKELLSAEQILKESNTPFCCSKCKLKLEVTLYEYLGDLCQSKFDTCDGVMSEETAKNWYTSALDKLNLSEWKNPLSCPEDGSDGTATDIKCPAGKTCTCFIMNEVGESVKKSMKAGRETEIGAKQNRKTKNAAKVLPKEPNLVVENKSRLTRSRYRSSQNQYTSIHGKLEVHESLEGNHVSDSSDMLSQNGSVLSNIGCTFASREIPGDVFTIERAEIVHDICWYSLKNYHSKFARNIFCNLSFIKFEDLASWLMVAFVLSREVPVIFQKGSYVTGSSSIKECTSDLLRLVPDTTVDLAEYVKKFLAGLPSTTIISISLLGRDYTSLLQELLSYPTCVQAWMLVSRLSFKNEPVVMLLPLDSILQASCEGDLSTGSGTSPKCEEHSEKWHCPWGFTVVDDVAPTFKTILEENYLSTKSPLEDTTQNRMLWWKRRKNLDHCLDKLLRNLEESWFGSWKCLLLGEWLNCKNFDLVLKNLVNDLRSKCKLDVNEGLLKIILGGSKYVCDGKTLVSQLCSKKDCYIAKVGYCDEARRGILNSANGIGVSSEVAFELLSEALNVLEVDDSVNREPIILVLDYEVQMLPWENLPILRNQEVYRMPSVSCISAVLHKGSNHKEQVGRNLGPFPLIDPLDAFYLLNPDGDLGGTQIEFENYFRDQNLENNHAFFSPLVTSQGKAGLRPTIKELASALESHDLFIYFGHGSGGQYIPRHEIQKLDKCAATLLMGCSSGSLTLPGQYAPQGIPLSYLLAGSPAIVGNLWEVTDKDIDRFGKAMLDAWLKERSDMPTECLQCNLLSEEFEAMNLKGCKGRAKRKAPRKKLLELAESESPKNCGHRRKIGAFMGQAREVCTLPFLTVGITTVPRKGKTTLVMKTDSFIPPAPPTPLDFHHRQYSSRDSDVSSRPSSVGIGRRPTLDLYNEPSYKQTVVSTINSFLSSHNFPITFKTTLPSAKDIHETLKFLLSLLDFPFSKLEEDLPPLLKRLNYPFKLNKSILRSPAAPHQWPTFLALIHWLVQIAKFHLHLSSSPKQHNSLYQYTVNSYMHFIHNEDDAVEDLDRSIKDKLHHEKAAAEERLQATRRSAAELEAELERLRSAPSLKEALEKEKAMLEDDVKKFHKMIEELSLRIEQAERVLAEKEKQVEAKQAENEKICEENEELKRRVEAQSFNARDVERMKRELQAVERDTAEAELARNALEEQAWDLDTTLSHKIKDLEALGMECNQALKRLKIGNGIQYLLNAKGTTPAEIMGIDHKLVLKPALRSFSDEIKKSSMEKLEESISYQQKSGENAVRLEGKRNQLAAVQSRIDEMGIGKRNNVACEDFCFTFLSAAYRFIYQMEAQLNRIKKETHEYTSRASAEAKKMLEDVQLADHEIDIMEREAAEVLKEVIKQSEEEIQMHARELFQLVDSVSKFKEHVGSKISEIGRDLSETAAAVSDTYRGACEPLLKDTVVEEGAGGSDETLTSIRINEYNFVHPSSSALPPPSSHPPPSVPPPADHSAHDVVGGGSEAGLQCVHDVEGRGERGGGSSESSFGFEPESISGIVDFDDFGLSDFHRFFYTRITVLARNLGSGKCGIIWNRGKWREGIWNPKAVFVAFGTKGDVYPLLQSAIAAAFACDQKQCDVMLITHSAHVKKKVAIAHRQECYALIERIFGDGPSLDGDLVIEEIFMMVQEGWSLAESFCVRCIVAAPYVVPYRYTEPVWHTGHLQMAIITNGGGQNAKMSMEQGLWETLESKRKLSRRKL

SEQ ID NO: 118349 - protein, 263 aa, Glycine max
  Coding DNA Sequence Number=SeqID_1571
  Gene Ontology: Mol. function=carboxypeptidase activity
  Homolog annotation: Hit_ID=Q1SU32; Match level="QueryCoverage=99%, HitCoverage=69%, E-value=8e-85, Identity=56%"; Hit description=HSP20- like chaperone
IRYPDSFRVVKGAVLIDDPSTSCIKEKDLNRFRSLTGVRTFKLNISECQCFQLDRRSSKEADGSCMNKMPETFPNGGCQSEKFQQERKRKYTDDTSLMLEFPDVLPTEHNAKVEPSRKKCKSDGPTFMPLLPIPDVDDCNRDSSLILTGAARRGPFGPSVGVVDIGISKVAYLFRISLPGVKKDCTGQFSCDIESDGRVQIRGVLTGGSTITKQSRVFKMKIRQLCSPGPFTLSFSLPGPVDPRLFAPNFRPDGIFEGVIIKQ

SEQ ID NO: 118350 - protein, 102 aa, Glycine max
  Coding DNA Sequence Number=SeqID_1572
MTFESGTKSIDVQNTLRNGILRDHWNVEDRMNVYDRHMELITMPNSRNLSGAENHASNSSMYFVRQGFIQRLLICQTDMSPTYEISNLIIEHVDQLVQIVSI

SEQ ID NO: 118351 - protein, 856 aa, Glycine max
  Coding DNA Sequence Number=SeqID_1573
  Gene Ontology: Mol. function=protein-tyrosine kinase activity; Cellular component=integral to membrane; Biological process=protein amino acid phosphorylation
  Homolog annotation: Hit_ID=Q1SSI2; Match level="QueryCoverage=75%, HitCoverage=92%, E-value=1e-131, Identity=39%"; Hit description =Tyrosine protein kinase, active site
  Pfam annotation: Domain name=LRR_1; Domain location=119-141; Score =18.1; E_value=0.032; Accession=PF00560.23; Description=Leucine Rich Repeat
  Pfam annotation: Domain name=LRR_1; Domain location=143-165; Score =17.2; E_value=0.06; Accession=PF00560.23; Description=Leucine Rich Repeat
  Pfam annotation: Domain name=LRR_1; Domain location=167-189; Score =15.3; E_value=0.22; Accession=PF00560.23; Description=Leucine Rich Repeat
  Pfam annotation: Domain name=LRR_1; Domain location=191-213; Score =16.4; E_value=0.1; Accession=PF00560.23; Description=Leucine Rich Repeat
  Pfam annotation: Domain name=LRR_1; Domain location=215-237; Score =10.5; E_value=3.1; Accession=PF00560.23; Description=Leucine Rich Repeat
  Pfam annotation: Domain name=LRR_1; Domain location=239-262; Score =11.9; E_value=1.7; Accession=PF00560.23; Description=Leucine Rich Repeat
  Pfam annotation: Domain name=LRR_1; Domain location=282-301; Score =14.3; E_value=0.45; Accession=PF00560.23; Description=Leucine Rich Repeat
  Pfam annotation: Domain name=LRR_1; Domain location=303-324; Score =3.5; E_value=64; Accession=PF00560.23; Description=Leucine Rich Repeat
  Pfam annotation: Domain name=LRR_1; Domain location=71-93; Score =10.0; E_value=3.9; Accession=PF00560.23; Description=Leucine Rich Repeat
  Pfam annotation: Domain name=LRR_1; Domain location=95-117; Score =14.0; E_value=0.56; Accession=PF00560.23; Description=Leucine Rich Repeat
  Pfam annotation: Domain name=Pkinase; Domain location=416-646; Score =58.0; E_value=3.1e-14; Accession=PF00069.15; Description=Protein kinase domain
  Pfam annotation: Domain name=Pkinase_Tyr; Domain location=416-646; Score=7.5; E_value=6.2e-13; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=119-141::143-165::167-189::191-213::215-237::239 -262::282-301::...
  Pfam module annotation: Domain location=303-324::71-93::95-117::416 -646::416-646
MAASNSSSTNEEQEALLQSKWGGQNISNYCKWNGIVCNEAQSVTEISTTKYFYIPPTEAHIQNFNVTAFPNLIHLDLSRLGLKGKIPTEISFLKKLIYLDLSSSCLQGELPSSLSSLTQLETLNISNNFLTGVIPPTLGQLKNLTLLSLDSNQFEGHIPEELGNLRGLKQLTLSNNSLNGSIPSTLEHLIHLKVLDLSYNKIFGVIPEGISALTQLTNVQLSWNQISGFIPSGIGRIPGLGILDISNNQLEGPIPYGVLNHCSYVQLSNNSLNGSIPPQIGNISYLDLSYNDLTGNIPEGLHSVPYLNLSYNSFNDSDNSFCGFPKDSLIGNKDFQYSCSSQSSGADISLVMIIVFSTFNGMVVSIVLVCWGIHAFCPPHNEFGSEERRKNGDMLSIWNYDGKIAFEDIIKATEDFDIRYCIGTGAYGTVYKAQLPSNRIVALKKLHKAESENPSFYKSFCNETKILTETRHPQELNWSKRINIVKGVAYGLAHMHHDCTPPIVHRDISSNNILLNSELQAFVSDFGTARLLDCHSSNQTLPAGTYGYVAPELAYTLTVTTKCDVYSFGVVVLETMMGRHPAELISSLSEPSIQNKMLKDILDLRIPLPFFRKDMQEIVLIVTLALACLSPHPKSRPSMQEIASTMMAEDLGVEAKEAAVREVAKLLPLPELLQSISSIKADYISRQQANDAQLSTMVAEQDIGNRDLSETSTDALSLFCLDFLELALDIELTEAPNLISSCALSKILLQVEQSQAGLKSLSFSERTINQLRENFVSIEKYDVEGMMSISDEAAEARDSLSDDKEIVNTYERLTALDGKRRFALAAAGSHKEEVGRLRFVSSLVHCHIHWLGEQES

SEQ ID NO: 118352 - protein, 642 aa, Glycine max
  Coding DNA Sequence Number=SeqID_1574
  Gene Ontology: Mol. function=transferase activity; Cellular component= nucleus; Biological process=mRNA editing
  Homolog annotation: Hit_ID=Q8LIP4; Match level="QueryCoverage=87%, HitCoverage=92%, E-value=1e-101, Identity=37%"; Hit description =Selenium-binding protein-like protein
  Pfam annotation: Domain name=PPR; Domain location=173-207; Score =39.7; E_value=1e-08; Accession=PF01535.11; Description=PPR repeat
  Pfam annotation: Domain name=PPR; Domain location=236-270; Score =42.9; E_value=1.1e-09; Accession=PF01535.11; Description=PPR repeat
  Pfam annotation: Domain name=PPR; Domain location=298-332; Score =30.5; E_value=6.1e-06; Accession=PF01535.11; Description=PPR repeat
  Pfam annotation: Domain name=PPR; Domain location=334-368; Score =11.7; E_value=0.3; Accession=PF01535.11; Description=PPR repeat
  Pfam annotation: Domain name=PPR; Domain location=400-434; Score =29.8; E_value=9.3e-06; Accession=PF01535.11; Description=PPR repeat
  Pfam annotation: Domain name=PPR; Domain location=435-469; Score=4.9; E_value=2; Accession=PF01535.11; Description=PPR repeat
  Pfam annotation: Domain name=PPR; Domain location=471-505; Score =16.5; E_value=0.083; Accession=PF01535.11; Description=PPR repeat
  Pfam annotation: Domain name=PPR; Domain location=537-571; Score =11.4; E_value=0.34; Accession=PF01535.11; Description=PPR repeat
  Pfam annotation: Domain name=PPR; Domain location=89-123; Score=23.0; E_value=0.0011; Accession=PF01535.11; Description=PPR repeat
  Pfam module annotation: Pfam domain module=PPR::PPR::PPR::PPR::PPR::PP R::PPR::PPR::PPR; Domain location=173-207::236-270::298-332::334 -368::400-434::435-469::471-505::537-571::89-123
  Subcellular localization annotation: CTP_CleavageSite=37; ConfidenceScore=5.19e-01
MLVCATSCSSHQPWASPIPTLTTLPKCTTAEHVNQLHARMITTGFLKNPSLTAKLVLSCISSPREPLVEFARYVFFKHHAFRDFRDDPFLWNALLRSHSHGCDPRGALVLLCLMIENGVRVDGYSFSLVLKACARVGLVREGMQNCLIGLFVRCGCVELARQLFDRMADRDVVSYNSMIDGYVKCGAVERARELFDSMEERNLITWNSMIGGYVRWEEGVEFAWSLFVKMPEKDLVSWNTMIDGCVKNGRMEDARVLFDEMPERDSVSWVTMIDGYVKLGDVLAARRLFDEMPSRDVISCNSMMAGYVQNGCCIEALKIFYDMKRATNVVPDDTTLLIVITAFAQLGHVEDGVVIHHYLMDKGYSLNGKLGVALIDMYSKCGSIDNAISVFENVEQKCVDHWNAMIGGLAIHGMGLMAFDFLMEMGRLSVIPDDITFIGVLSACRHAGMLKEGLICFELMQKVYNLEPKVQHYGCMVDMLSRAGHIEEAKKLIEEMPVEPNDVIWKTLLSACQNYENFSIGEPIAQQLTQLYSCSPSSYVLLSNIYASLGMWDNVKRVRTEMKERQLKKIPGCSWIELGGIVHQFSVQDRTHPQVSKHVVLMQQFSKTKVCSDMAYASKIVMVLLIWQKQQAEALALAEALY

SEQ ID NO: 118353 - protein, 106 aa, Glycine max
  Coding DNA Sequence Number=SeqID_1575
  Gene Ontology: Mol. function=identical protein binding; Cellular component=cell wall; Biological process=negative regulation of enzyme activity
  Homolog annotation: Hit_ID=Q2HV71; Match level="QueryCoverage=96%, HitCoverage=13%, E-value=1e-38, Identity=76%"; Hit description =Protease-associated PA; Proteinase inhibitor I9, subtilisin propeptide
  Subcellular localization annotation: CTP_CleavageSite=8; ConfidenceScore=5.01e-01
MAPSSNVLAAYVPTEVVATIGNNVMLSSGYNLLSGTSMACPHASGVAALLKAAHTKWSAAAIRSALVTTASPLDNTQNPIRDYGYPSQYASPLAIGAGSEVEPVTC

SEQ ID NO: 118354 - protein, 341 aa, Glycine max
  Coding DNA Sequence Number=SeqID_1576
  Gene Ontology: Mol. function=cytochrome-c oxidase activity; Cellular component=membrane; Biological process=electron transport
  Homolog annotation: Hit_ID=Q33B99; Match level="QueryCoverage=87%, HitCoverage=37%, E-value=6e-25, Identity=28%"; Hit description =Expressed protein
  Pfam annotation: Domain name=DUF639; Domain location=1-341; Score= -5.1; E_value=2e-14; Accession=PF04842.3; Description=Plant protein of unknown function (DUF639)
MHAHCLIVLECSQNFKTFSGMTTFVLNCKRPVLKWENNMAWPGKLTLTDKAIYFEAVGILGKKRAMRLDLIHDGLQVEKAKVGPFGSALFDSAVSVSSGSELNRWVLEFIDLGGEMRRDVWHAFISEVIALHRFIREYGPDDSDESLFKVYGARKGKDRATTTAINGIARLQALQHLRKLLDDPTKLVQFSYLQNAPHGDIVLQTLAVNYWGGPLVSGFINTRNQPEIRPSDEISDSRSHVFDIDGSVYLQKWMKSPSWGSSTSTNFWKNTSVKGLILSKNLVVADLSLTERTAKTCKQKYHVVEKTQATIDAATLQGIPSNIDLFKVGMLNLLITFDKFK

SEQ ID NO: 118355 - protein, 79 aa, Glycine max
  Coding DNA Sequence Number=SeqID_1577
MELIENMAASDHAILRDRMHIPTKRNDTSKEVNYMANQNRQGFHLGGFARYQQGGNFSHNHGQGWRSVETLASVPNRSK

SEQ ID NO: 118356 - protein, 440 aa, Glycine max
  Coding DNA Sequence Number=SeqID_1578
  Gene Ontology: Cellular component=chloroplast inner membrane
  Homolog annotation: Hit_ID=Q2QTT0; Match level="QueryCoverage=94%, HitCoverage=96%, E-value=1e-127, Identity=56%"; Hit description =Expressed protein
MKGGQYGAFGAVTLEKSKLDLSQKQTSFSPELDIGGGGGDIGKKINHGGGDGGDDDGDDDDYFDDFDDGDEGDEGGLFRRRILFEELFDRKFVDAVLNEWQKTMMDLPAGLRQAYEMGLVSSAQMVKFLAINARPTTSRFISRTLPQALSRSFIGRLLADPAFLYRFLLEEAATVGCSLWWEIKNRKDRIKQEWDLALMNVMTAAACNALVVWSLAPCRSYGNTFRFDLQNTLQKLPNNIFEKSYPLREFDMQKRIQCFLFKAAELCMVGLSAGAVQGALSNSLASKKEGRLSVTVPSVSSNALGYGAFLGIYANLRYQLLCGFDRAMMTHFDVIGVALFFSTTFRILNVQLGETSKRAWLGVEADPLAQSDDLLKVYNRTSENVEKSSSKWFISKNAVVSGLGLLGIKQRNTDGSGAESSAPKTRRKRIVRKKVAAGSA

SEQ ID NO: 118357 - protein, 141 aa, Glycine max
  Coding DNA Sequence Number=SeqID_1579
MMITKGDDKGDDKKLKDQSKNNQVNQRSIKEQLKYILCGTSRGYIYLGLTENKRGYISCGSVLVEGTSTRVSKRTREGPQVAWGLEGTSLMEHSNPMTPKAYTPKSPSGPLPLDSGPTPKIILHADTTHELYNTHDLTLMF

SEQ ID NO: 118358 - protein, 381 aa, Glycine max
  Coding DNA Sequence Number=SeqID_1580
  Gene Ontology: Mol. function=zinc ion binding
  Homolog annotation: Hit_ID=Q1S5W7; Match level="QueryCoverage=74%, HitCoverage=90%, E-value=4e-96, Identity=62%"; Hit description=Zinc finger, RING-type; Thioredoxin-related; RINGv
  Pfam annotation: Domain name=DUF1407; Domain location=222-295; Score=- 6.6; E_value=0.059; Accession=PF07191.2; Description=Protein of unknown function (DUF1407)
  Pfam annotation: Domain name=zf-C3HC4; Domain location=225-265; Score= 46.0; E_value=1.3e-10; Accession=PF00097.15; Description=Zinc finger, C3HC4 type (RING finger)
  Pfam module annotation: Pfam domain module=DUF1407::zf-C3HC4; Domain location=222-295::225-265
MGRDGRVKATLQVNGGVSFDVGGDFESVEVVGGIRSHADTENTASVTERGKHGNGRTVRLPFTNNDGSTCPYCFHQLRYELDISRPRLLMNVPNNLEPSQATQLMHNLALILDPPLRRQNNNHLNTTPHWETENEDGLNPQAWITLRFPRPTRPPRPISPPQNLVPQTNDTDHDTLFENTILDDFIDGVIQNNNRPGPPPATSSAIAALPMVKLTQTHLASDPNCPICKDEFELDMEARELPCKHFYHSDCIIPWLRMHNTCPVCRYELQGVSTSGNANYYRLQNDENDMRFGFEDAASSLVWVWNQLTSFRPIRSVLDWTRSYFNFQEDHVRGRRVASLKADKGVMNQQVALGGEHCKRWTATHFKNTDGIDTEVLIGYF

SEQ ID NO: 118359 - protein, 83 aa, Glycine max
  Coding DNA Sequence Number=SeqID_1581
MASLQKNAHIEVINLIDYSREYANTYKTLAARRISVHFLPLNGSLPDILELEIPAFPKRPPSPPPLKKEKLVEHEEVKSPVDS

SEQ ID NO: 118360 - protein, 69 aa, Glycine max
  Coding DNA Sequence Number=SeqID_1582
  Gene Ontology: Cellular component=integral to membrane; Biological process=transport
  Homolog annotation: Hit_ID=Q67UZ5; Match level="QueryCoverage=75%, HitCoverage=23%, E-value=1e-09, Identity=54%"; Hit description =Putative transmembrane trafficking protein
MDMNVLNLKRDPRRQERKRNLDGNGGVVGMIIPSVDDSVIAQNDDVVVDFFGNALGAERWYGDPESPRG

SEQ ID NO: 118361 - protein, 419 aa, Glycine max
  Coding DNA Sequence Number=SeqID_1583
  Homolog annotation: Hit_ID=Q67UA7; Match level="QueryCoverage=99%, HitCoverage=97%, E-value=1e-136, Identity=56%"; Hit description=F -box protein-like
MDPLPDAILQYILSRINNARDVAACNCVSKRWKDSMAYIRTLYFPRNSFDNPSLRESPDDIVKRMVSMVVRLEELVVYGPFSPSGLASWLSLVGMSLSQLELRMDNLADNQASHESPSKLDCIGAARNLESLKLWGVLMMHSPKWDVFQNLRTLEIVGARLEEPVLTVVFQSCPYLRRLKLLGCEGVGSISIDLPYLEQCKLDFYGLGNCSLTLSSPKIESLEVQGCSWIRVPETQHLRNLSISNSAGRVYMVDFGNLPALEFLTMRGVQWCWDAICKMLKMASEVKHIYMKVEFTGDYEALQPFPEIDFVDFFNNHPKLRKFDIHGAMFAALCQRNSLKHVDPGFLIPCLEEVVITVRSPLNAEQKMSTLESLLKYGKNLRTMVIKILQMKSSHSSADDFFDEICRLRYMNHGIVRIE

SEQ ID NO: 118362 - protein, 135 aa, Glycine max
  Coding DNA Sequence Number=SeqID_1584
MGSKFPMTQLGISPRYVIYPHSAYNYKYSRRIFSEQKFPFKFVAQSLGDKWKLNDISTSSIQERWNVLMSRTQNFWNEVTFPLAKPGQTRKPDPENDCGFQVMEDILMIEKTIDRRTPCGVLSLAAVICIEQFSR

SEQ ID NO: 118363 - protein, 68 aa, Glycine max
  Coding DNA Sequence Number=SeqID_1585
MGKEMQQLICAFVLITLSFMMFSAEARNLHAFQQQAMEEPSAAGEQFPHLGLLHQLTPTAAATTTAGR

SEQ ID NO: 118364 - protein, 133 aa, Glycine max
  Coding DNA Sequence Number=SeqID_1586
  Gene Ontology: Mol. function=protein binding; Cellular component =integral to membrane; Biological process=transport
  Homolog annotation: Hit_ID=Q69TX8; Match level="QueryCoverage=98%, HitCoverage=62%, E-value=1e-48, Identity=69%"; Hit description =Putative transmembrane protein Tmp21
MENISIGNFAFTTRESGNYLACFWVGHSERAGGDVSVNLDWKTGIAAKDWDSVAKKEKIEGVELQLRKLEGSVEAVHENLIYLRGREAVVRNVSESTNARVVWSSFMSLGVCIAVSVLQLWHLKRYFHKKKLI

SEQ ID NO: 118365 - protein, 273 aa, Glycine max
  Coding DNA Sequence Number=SeqID_1587
  Gene Ontology: Mol. function=structural molecule activity; Cellular component=chloroplast thylakoid membrane
  Homolog annotation: Hit_ID=Q1SU33; Match level="QueryCoverage=99%, HitCoverage=99%, E-value=3e-78, Identity=62%"; Hit description=PAP fibrillin
  Pfam annotation: Domain name=PAP_fibrillin; Domain location=75-263; Score=124.3; E_value=3.3e-34; Accession=PF04755.3; Description=PAP _fibrillin
  Subcellular localization annotation: CTP_CleavageSite=10; ConfidenceScore=5.03e-01
MALSSPFLISAVNATCSVPHFHFHFHAQPLSLSSSHFPINIRPSTHHHVHVSHNHKWRAKVSFFTSFLKKGKDAKIIKEEMLEAIAPLDRGADATPQDQQTIDQIARELEAVTPIKEPLKTNLLDGKWELIYTTSQSILQTKLINHPRTKICLVRYYDLMHLMFASMLQQRPKLLRSVANYQAINVDTLRAQNMESWPFFNQVTADLTPLNPRKVAVKFDTFKIGGIIPIKAPGRARGELEITYLDEELRVSRGDKGNLFILKMVDPSYRVPE

SEQ ID NO: 118366 - protein, 126 aa, Glycine max
  Coding DNA Sequence Number=SeqID_1588
MDLQHQAPPPLVVLEAREFAMSYQLVGMMNGLTGKKMQKIFEALVPESVYNNARNLVEYCCFRFLSRDGSDIHPSLQDPAFQRLIFITMLAWENPYTNDLSSNAEKASLQVHFFPLVSVLHLPFKH

SEQ ID NO: 118367 - protein, 108 aa, Glycine max
  Coding DNA Sequence Number=SeqID_1589
  Subcellular localization annotation: CTP_CleavageSite=90; ConfidenceScore=5.17e-01
MGSEGYEQVVGADRVFFHCSIVTFASSCDKRWSTQWRKSRSISPRGHRSPSTTPRRGRSRSPSAKRYRRHRSRSSSLSPTRKSSSPSLVSVEHKSATEKQKKEEEKKR

SEQ ID NO: 118368 - protein, 183 aa, Glycine max
  Coding DNA Sequence Number=SeqID_1590
  Homolog annotation: Hit_ID=Q33A42; Match level="QueryCoverage=52%, HitCoverage=37%, E-value=8e-16, Identity=49%"; Hit description =Expressed protein
MTSFKTAACYLNFFFTGLSEERRQLEAELKLIEEETAKRVEEAIRKRVEESLKSEEVQVEIERRLEEGRKRLNDEVAAQLEKEKEAALIEAKQKEEQARKEKEDLERMLEENRRKVEEAQRREALEQQRREEERYKELEEMQRQKEEAMRKKKQEEEQERLNQIKLLGKNKSRPKLSFAFGSK

SEQ ID NO: 118369 - protein, 602 aa, Glycine max
  Coding DNA Sequence Number=SeqID_1591
  Gene Ontology: Mol. function=nucleic acid binding; Cellular component= spliceosome; Biological process=nuclear mRNA splicing, via spliceosome
  Homolog annotation: Hit_ID=Q7XIR8; Match level="QueryCoverage=94%, HitCoverage=46%, E-value=1e-150, Identity=52%"; Hit description =Putative DEAH-box RNA helicase
MEKDGTGAGVIDIDKTTTTLEQEKPTSGGLYVPGKDRVVYVPQERKSRLGLDALASAKRSQHDVGFKVPKERTISIAASAEDEDKSESSVSEESGHDGIVNRRRHTNRRYRDTTNETSHAESSVTEDHYGDTNRTPLTEHKGSDVPASPSRYDREDHRSERRHHRDDSRSGSGRVRQWDYYESRGSYSERDSHSRYDREYGKKRNRYEGSRRTPGRSDWDDGRWEWGDTPRRDSVSSSRRHQPSPSPMFVGASPDARLVSPWLGGHTPHSSFTSSSPWDHVSPSPVPIRASGSSTKSSVSKHNGRSHQLSFSSETSNRYEDEVADKSDLGEEHKYEITESMRLEMEYDADRAWYDREEGSTFDGDNSSLFLGDEASFQKKEAELAKRLVRRDGTKMSLAQSKKLSQLTADNAQWEDRQLLRSGAVRGTEVQTEFDDEEEHKVILLVHDTKPPFLDGRVVFTKQAEPIMPLKDPTSDMAIISRKGSTLVREIHEKQSMNKSRQRFWELAGSKLGDILGVEKTAEQIDADTAEVGEDGEIDFKEEAKFSQHMKKGEAVSDFAKSKTLAEQRQYLPIFSVREELLQGSVWSKCKEHMGIQSLELK

SEQ ID NO: 118370 - protein, 76 aa, Glycine max
  Coding DNA Sequence Number=SeqID_1592
MVRSPQEQVQEMAQGSRGESSSSPYAARKAHQIVKYLKLKRMNSSIELREPVLDRIKFRNKALLKETLIIDDLEQN

SEQ ID NO: 118371 - protein, 112 aa, Glycine max
  Coding DNA Sequence Number=SeqID_1593
MSLSSVIRKSISPFTSLTTLLPMMNSGAYANIIVNLNAREEKVVENMDFQEEVCEASDVPVQYRLENSVWWNDRACSAHSFIEFKPHPNYSNKYSRNFWTPNRNLNIKVSHN

SEQ ID NO: 118372 - protein, 472 aa, Glycine max
  Coding DNA Sequence Number=SeqID_1594
  Gene Ontology: Mol. function=1-phosphatidylinositol-4-phosphate 5 -kinase activity; Biological process=phosphatidylinositol metabolic process
  Homolog annotation: Hit_ID=Q8RY89; Match level="QueryCoverage=98%, HitCoverage=60%, E-value=1e-150, Identity=56%"; Hit description =Phosphatidylinositol-4-phosphate 5-kinase 8 (EC 2.7.1.68) (AtPIP5K8) ...
  Homolog annotation: Hit description=(1-phosphatidylinositol-4 -phosphate kinase 8) (PtdIns(4)P-5-kinase 8)
  Pfam annotation: Domain name=MORN; Domain location=110-132; Score =31.9; E_value=2.3e-06; Accession=PF02493.10; Description=MORN repeat
  Pfam annotation: Domain name=MORN; Domain location=133-155; Score =30.9; E_value=4.6e-06; Accession=PF02493.10; Description=MORN repeat
  Pfam annotation: Domain name=MORN; Domain location=156-178; Score =29.0; E_value=1.7e-05; Accession=PF02493.10; Description=MORN repeat
  Pfam annotation: Domain name=MORN; Domain location=179-200; Score =27.5; E_value=4.8e-05; Accession=PF02493.10; Description=MORN repeat
  Pfam annotation: Domain name=MORN; Domain location=18-40; Score=18.0; E_value=0.023; Accession=PF02493.10; Description=MORN repeat
  Pfam annotation: Domain name=MORN; Domain location=41-63; Score=20.2; E_value=0.0075; Accession=PF02493.10; Description=MORN repeat
  Pfam annotation: Domain name=MORN; Domain location=64-86; Score=24.8; E_value=0.0003; Accession=PF02493.10; Description=MORN repeat
  Pfam annotation: Domain name=MORN; Domain location=87-109; Score =23.7; E_value=0.00067; Accession=PF02493.10; Description=MORN repeat
  Pfam module annotation: Pfam domain module=MORN::MORN::MORN::MORN::MOR N::MORN::MORN::MORN; Domain location=110-132::133-155::156-178::179 -200::18-40::41-63::64-86::87-109
MEDSGRFDEKSFSNGDVYIGMIKGIVPHDKGKYTWSDGTVYEGDWEGEKMTGKGLIVWSSGAQYEGEISGGYLHGYGTLTTSAGCIYRGGWRMNAQHGIGRKQYSNSDVFEGLWKEGVPEGSGRYTWNNGNMYVGNWKNGKIYGRGVMKWVNGDTFDGLWLNGLMHGTGVYRFGDGGLYIGTWNKGLKDGKGVFYPAGSKHPSLKKLHSPRDSDHNGFLLNVEKQEAPKARVKRSLSENMPVISRFKSFRQISHRTSSLKINLIRSDSAQDCVCHDSSLTLSNALDGDQSEASGESTLVYEREYVQGVLIMERICECSESSREKKQQNKFSVKQVKKSSCLDIFEGRRSYYLKLNLQLGIRYTVGKITPVPAREVRSSDFGDRARIRMYFPRAGSKLTPPHSSINFYWKDYCPMVFRNLREMFKLDAAEYMMSICGDSGLRDLSSPGKSGSIFYLSKDDRFVIKTVNKSELK

SEQ ID NO: 118373 - protein, 432 aa, Glycine max
  Coding DNA Sequence Number=SeqID_1595
  Homolog annotation: Hit_ID=Q7XAE6; Match level="QueryCoverage=81%, HitCoverage=51%, E-value=1e-114, Identity=60%"; Hit description=S3 self-incompatibility locus-linked pollen 3.15 protein
MDPEQTFIRVQERFSQMLTPKVRVALEYLYLFIAITLFCILVVMHANYVQQPGCSSELSGVVTSEAQLIQIKITSAGLWSHNDSESNRIDPPETEIVKDKMEISDVSGDKLPFLASKLWWNWIGSGARRGKLVFKFWKTDTEFLEHQAETSTSNQNTRPVGEDAVIKIDKEDPPKSFTLSAKETLKAAIIHFGKKWYRRISFIWRHTMQIIGSFQKLWNIAGVHLNLDIPKWMHILRLDRLNTNAVQWLNKKGKLFEPTYLYTMEKGYFLLPESAKSHHNIRTVNVSISAWHSCFGNRWQQLLINRFVGYDTILINSLLSSPGQGYLYNYQTKEFYNLSYAQEVPEGPARFGGLRPGFDQSMPQNGPGVADPQDRSENNRDRVANPAQIPGQADIQQAERDVREQGQVFNETPGAGAGAGDESRENQDNIDR

SEQ ID NO: 118374 - protein, 1045 aa, Glycine max
  Coding DNA Sequence Number=SeqID_1596
  Gene Ontology: Mol. function=protein transporter activity; Cellular component=nuclear pore; Biological process=protein import into nucleus, docking
  Homolog annotation: Hit_ID=Q10NR5; Match level="QueryCoverage=31%, HitCoverage=99%, E-value=1e-132, Identity=73%"; Hit description=HEAT repeat family protein, expressed
  Pfam annotation: Domain name=HEAT; Domain location=113-149; Score =14.7; E_value=0.35; Accession=PF02985.12; Description=HEAT repeat
  Pfam annotation: Domain name=HEAT; Domain location=154-191; Score =25.5; E_value=0.00019; Accession=PF02985.12; Description=HEAT repeat
  Pfam annotation: Domain name=HEAT; Domain location=201-237; Score =4.0; E_value=14; Accession=PF02985.12; Description=HEAT repeat
  Pfam annotation: Domain name=HEAT; Domain location=332-368; Score =10.8; E_value=2.1; Accession=PF02985.12; Description=HEAT repeat
  Pfam annotation: Domain name=HEAT; Domain location=373-409; Score =30.8; E_value=4.7e-06; Accession=PF02985.12; Description=HEAT repeat
  Pfam annotation: Domain name=HEAT; Domain location=414-450; Score =26.8; E_value=7.8e-05; Accession=PF02985.12; Description=HEAT repeat
  Pfam annotation: Domain name=HEAT; Domain location=455-491; Score =13.7; E_value=0.66; Accession=PF02985.12; Description=HEAT repeat
  Pfam annotation: Domain name=HEAT; Domain location=500-535; Score =10.3; E_value=2.4; Accession=PF02985.12; Description=HEAT repeat
  Pfam annotation: Domain name=HEAT; Domain location=661-697; Score =0.8; E_value=34; Accession=PF02985.12; Description=HEAT repeat
  Pfam annotation: Domain name=HEAT; Domain location=712-749; Score =15.6; E_value=0.18; Accession=PF02985.12; Description=HEAT repeat
  Pfam annotation: Domain name=HEAT; Domain location=73-110; Score=1.9; E_value=25; Accession=PF02985.12; Description=HEAT repeat
  Pfam annotation: Domain name=HEAT; Domain location=857-893; Score =21.3; E_value=0.0036; Accession=PF02985.12; Description=HEAT repeat
  Pfam annotation: Domain name=HEAT; Domain location=898-936; Score =3.7; E_value=15; Accession=PF02985.12; Description=HEAT repeat
  Pfam annotation: Domain name=HEAT; Domain location=981-1019; Score =0.9; E_value=33; Accession=PF02985.12; Description=HEAT repeat
  Pfam annotation: Domain name=IBN_N; Domain location=23-89; Score =70.8; E_value=4.4e-18; Accession=PF03810.9; Description=Importin -beta N-terminal domain
  Pfam module annotation: Pfam domain module=HEAT::HEAT::HEAT::HEAT::HEA T::HEAT::HEAT::HEAT::HEAT::HEAT::HEAT::HEAT::HEAT::HEAT::IBN_N; Domain location=113-149::154-191::201-237::332-368::373-409::414 -450::455-491::...
  Pfam module annotation: Domain location=500-535::661-697::712-749::73- 110::857-893::898-936::981-1019::23-89
MAQSLELLLIQFLMPDNDARRQAEDQIKRLAKDPQVVPALVQHMRTAKTPNVRQLAAVLLRKKITGHWAKLSPQLKQLVKQSLIETITMEHSPPVRKASANVVSIVAKYAVPSGEWPDLLPFLFQCSQSSQDDHREVALILFSSLTETIGNAFRPYFANLQALLLKCLQDETSNRVRVAALKAVGSFLEFTHDEDEVIKFREFIPSILNVSRQCLASGEEDVAILAFEIFDELIESPAPLLGDSVKSIVQFSLEVCSSQNLESNTRHQAIQIISWLAKYKSSTLKKHKLIIPILQVLCPLLAESTNETEDDDLAPDRAAAEVIDTMALNIPKHVFQPVFEFASVSCQNANPKFREASVTALGVISEGCLELMKSKLEPVLHIVLGALRDPEQMVRGAASFALGQFAEHLQPEIVSHYESVLPCILNALEDVSDEVKEKSYYALAAFCENMGEDILPFLDPLMGRLLTALQNSSRVLQETCMSAIGSIASAAEQAFIPYAERVLELMKSFMVLTNDEDLRSRARATELVGIVAMSVGIARMEPIFPPYIEAAISGFGLEFSELREYTHGFFSNVAEILDASFAKLKFGIGKQYLPRVVPLAFSSCNLDDGSAVDIDECDDEIANGFGGVSSDDEAHDEPRVRNISIRTGVLDEKAAATQALGLYLDETLRILVKHSSYFHEDVRLQAIISLKHTLTAANAIFQSQNEGAAKAKELLDTVMNIYIKTMVEDDDKEVVAQACTSVADIIRDYGYATLEPYLSQLVDATSLLLREQSACQQIESDSEIDDVDSAHDEVLMDAVSDLLPAFAKSMGAQFAPIFAQLFEPLMKFAKSSRPPQDRTMVVACLAEVAQNMGSPIASYVDRVMPLVLKELASSEATNRRNAAFCVGELCKNGHEQALKYYDNILRGLHPLFGESEPDDAVRDNAAGAVARMIMVHPESIPLNQVLPVFLRVLPLKEDHEESMAVYSCVFSLVFSSNPQILSLVPELVNLFAQVVVSPVETPEVKAVVGRAFSHLISLYGQQMQPLLSNLPPAHANALSAFAQRS

SEQ ID NO: 118375 - protein, 54 aa, Glycine max
  Coding DNA Sequence Number=SeqID_1597
  Pfam annotation: Domain name=GATA; Domain location=1-25; Score=17.2; E_value=0.0023; Accession=PF00320.17; Description=GATA zinc finger
MWRKGPLGPKTLCNACGLQYLKMVKGTGSGLPAAVSDEGDASVPAETVERDSNL

SEQ ID NO: 118376 - protein, 438 aa, Glycine max
  Coding DNA Sequence Number=SeqID_1598
  Gene Ontology: Mol. function=acyltransferase activity; Cellular component=integral to membrane; Biological process=biosynthetic process
  Homolog annotation: Hit_ID=Q9C992; Match level="QueryCoverage=87%, HitCoverage=83%, E-value=1e-137, Identity=62%"; Hit description=3 -ketoacyl-CoA synthase 7
  Pfam annotation: Domain name=ACP_syn_III_C; Domain location=345-431; Score=5.7; E_value=3.6e-06; Accession=PF08541.1; Description=3 -Oxoacyl-[acyl-carrier-protein (ACP)
  Pfam annotation: Domain name=Chal_sti_synt_C; Domain location=289 -433; Score=9.5; E_value=0.00028; Accession=PF02797.6; Description =Chalcone and stilbene synthases, C-te
  Pfam annotation: Domain name=FAE1_CUT1_RppA; Domain location=44-332; Score=553.4; E_value=2.4e-163; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=345-431::289-433::44-332
MVQFKLMTMEALLSKYFPFYNLSEGSISATESLAVIASILILLCFCFRSSSIYLLDYVCYMPPDNLRLPYSHIVEHFELCNFDPELIGFELKVLERSGIGVEACVPESVHELPPDDSMKRAQAEVESVLFRIVKDLLSKHKVHPKSIDILVSNCSLFCPTPSITSMIINKFGFRSNVKSVNLSGMGCSAGLLSINLAKDLLRVHKNSLALVLSMEAVAPNGYRGNTKSKLIANVLFRMGGAAILLSNKKQHKPVAKYKLEHLVRTHMGSNDKAYQSVYQEPDEDEIVGVSLSRSLLSVAASALRTNITDLGPLVLPYSEQLRYGWSVISRKMWARGNKEMYVPNFRKAFEHFCIHAGGKSVVDAIEESLKLHKKDGEASRMALYRFGNTSSSSVWYELCYLEAKGRVKKGDRVWQIAFGSGFKCNSAVWKCLSDIDPN

SEQ ID NO: 118377 - protein, 736 aa, Glycine max
  Coding DNA Sequence Number=SeqID_1599
  Gene Ontology: Mol. function=nucleoside-triphosphatase activity; Cellular component=membrane; Biological process=protein transport
  Homolog annotation: Hit_ID=Q5JMS6; Match level="QueryCoverage=31%, HitCoverage=85%, E-value=1e-86, Identity=62%"; Hit description =Membrane protein-like
  Pfam annotation: Domain name=AAA; Domain location=465-650; Score =134.8; E_value=2.4e-37; Accession=PF00004.19; Description=ATPase family associated with various cellular activities (AAA)
  Pfam annotation: Domain name=AAA_5; Domain location=503-637; Score= -22.3; E_value=0.089; Accession=PF07728.4; Description=ATPase family associated with various
  Pfam module annotation: Pfam domain module=AAA::AAA_5; Domain location=465-650::503-637
MRKRSIYAWLVALVCFLLLMIVTPAIPQSQEYHDFADHRTFLGIPNALNVISNFPFLVIGLVGLVLCHHGNYFRLSLQGELWGWTCFYVGVAAVAVGSSYYHLKPDDARLVWDRLPMTVAFTSIMAIFIIERIDERKGTVSIIPLVLAVQFVPCIVIPLMAILLPPMYTHSTYWLWAAGSYLLAKVLEATDDVIYEWAQHIVSGHTLKHLVAAMVPVFLTFMLAKRSVEPERILVRVYEEKKITEPKGLGRWEEVTVEALNSTAKLNHARTPKHCKNDDDDDEGKAQSASRKRRKKIDRSEETLQRMEALHVRRKVQGSSSSSSASECDDEDEEGTVSTSEDTIYGEKVEPEFDLMKTTLRKSYTPKKVATEEKNVELEVGNSSKDTLVNEEMGNSSKGTSTLVNEEWKEVKGSCWGSVSNGKDGPRFKDLGGMKEVLEEPKNEVIVPLFHPQLPRQLGVRPMAGILLHGPPGCGKTKLAHAIANETGLPFYHISDPLDTKSGFLLYGPPGCGKTLIAKAVVNEAGANFIHIKIDTLTTKRGKEGGWVIERLLNQLLVGLDGAEERRDVFVVGATNRPEVMDRAVLLRPGRFGKLLYVPLPSPDERVLILKALARKEAVDASVDLSDIAKMEACENLSGADLAALYYNYKGWTIEKVVVSLREILILWTIQMNEAAMAALVENLDSIETTCDTLTIKSPIKRHHFEVALSIVSPSVSDRIWLILLYLFHMKYDALW

SEQ ID NO: 118378 - protein, 788 aa, Glycine max
  Coding DNA Sequence Number=SeqID_1600
  Homolog annotation: Hit_ID=UPI0000162CAC; Match level="QueryCoverage =17%, HitCoverage=12%, E-value=5e-10, Identity=35%"; Hit description =GTP binding
MGKDLVSSDQTTVQIQDNNPGCMWGMLQILDYHRWRVKKVFPHKRRKHATYKRKPILYDQHEDQQHGVTEAESLLVGQHSEKLHAAGRSSPKNRKKEPCTEKKVNNENSKGGRTMDYSRKNQASNEYALHLEKDGKTTEDDLNHKPMETNKHNRNISNKFEKHTDVFELLRVEKDLLLKFLRDTDFGGKKVQQASHINARLTKSGSFPLASTSQMRNISSRSLKHKQNEIWALPKGEKLHAGTQESNMSVSSSVKDNSYENPMPLASDLGVDSTMKQKAFFSLRPSQGSNHKGWNQAVLHHFKVIKQKIKHALVEFRKSGCQATSAEAIHHRDSPEYSMNKNEEEISQSLEDGVVQQFKRSKSSNETRASDYDSNKHDARLMRRTSSLNESLDRYTQLFEKSFSEDTKWQSSKSKSLKLTNEDKIHKNGHTPRFSRSNLSMPNLETLGFILQDALFDTNDIGNKVEAYNRVHRKSVSLPLKIDRSLDHFKEAEIVETVEGSERDVNPNLLSDKIMEKIDEEVTCDQKEDMNEPAVGDGSFPEEKEEMSNMTTYLRKEVMATLETSFEDTKTSHEVNFPSLNICAMNNNRGTKLNSLRSTLDELETDLSYSSDRNASVTAEDTDNTSDFKYVKNILEFSGYLRNEHTQMPYTVDQPLKPSIFKDLDATLRHEIEPSEEETINHQLLFNLVNEVLLEIYGRSPTYFPRPFSFNPRLHSMPKGNYLLNEVWNSVNSYLNLKPELDQTLDDVVGRDLAKGKGWMILQEEEEYVALELEEMIMDELLDEFIFS

SEQ ID NO: 118379 - protein, 381 aa, Glycine max
  Coding DNA Sequence Number=SeqID_1601
  Gene Ontology: Mol. function=heat shock protein binding; Biological process=protein folding
  Homolog annotation: Hit_ID=O04087; Match level="QueryCoverage=68%, HitCoverage=55%, E-value=6e-71, Identity=51%"; Hit description=DnaJ isolog; 47062-48761
  Pfam annotation: Domain name=DnaJ_C; Domain location=254-374; Score =43.8; E_value=4.9e-10; Accession=PF01556.9; Description=DnaJ C terminal region
MGDHPRSQPLDLHHLFKIKNKSLKDVSKAYKSLVSKRHHHDKKNPEEPITPPRFEENDNKRVDEDIWSPKFLSRAASRRSKTPTLKSRPMSRHGSRRCTTPTSLSRSSSSSGRRSATEIAASSLKRIMSRRGSPASLSSKLNISEPKLTNHVASPTKDADACLKTTRKPEYIPAVSLSSNLSCRLTTPIIFSQTTARRKPPEVERKLHCTLENLCFGCIKKIKVTRDVIKYPGVIIQEEEILKIEVKPGWRKGTKITFEGVGDEKPGYLPSDIVFLIDEKKHPLFRREGNDLEICVEIPLVDALTGCFISIPLLGGENMGLSFENNVIYPGYEKVIKGQGMPNPKNNGIRGDLHVKFFIEFPTELSEEQRKEAASILQDCC

SEQ ID NO: 118380 - protein, 186 aa, Glycine max
  Coding DNA Sequence Number=SeqID_1602
  Homolog annotation: Hit_ID=Q10HT0; Match level="QueryCoverage=74%, HitCoverage=27%, E-value=2e-07, Identity=25%"; Hit description=Nuf2 family protein, expressed
MDFTETEFTTELGKIELGLGELVLTVNSAKSIEKDLKALKAKLSDEEILEKSLEAKLVEKQSKVEQMEESRKQLEKESNIMWEEATKYLSSTKSDVESKRSATETRQKNVEAVLSEVAFLKVDAISSKIISVKEAGAVKVALLVRKCEELVEAFHNYANPIARVIESEQRRLGATKGGGFGISDPV

SEQ ID NO: 118381 - protein, 282 aa, Glycine max
  Coding DNA Sequence Number=SeqID_1603
  Homolog annotation: Hit_ID=Q10HT0; Match level="QueryCoverage=98%, HitCoverage=52%, E-value=3e-22, Identity=27%"; Hit description=Nuf2 family protein, expressed
  Pfam annotation: Domain name=Nuf2; Domain location=3-177; Score= -23.6; E_value=0.0083; Accession=PF03800.4; Description=Nuf2 family
MAESNYEYPRLRRPEIVTILAQLQIANVTEQDFTNPNPDFISDLYTRVLIHLDILLESLSLSIFFSFRTFFDSTFLAQILILFIFRREDNEQLEFHALEHLENPDFHLDSVRAVKLYNQINEVLTTLECPRKFTLADLLMPDPHRTDLFLGSLLNFCLDRDARMNSVSEIVEEVNALEAQRTELEENRILQLKAEISECNEAKEREMPLVEEVEAKVKELKQTIAVLNSNQSSLRSTLRKLKEKTGETDEKISNAEFTLVQNVQENANLRSKISQSPDKVQA

SEQ ID NO: 118382 - protein, 195 aa, Glycine max
  Coding DNA Sequence Number=SeqID_1604
  Gene Ontology: Mol. function=protein serine/threonine kinase activity; Biological process=protein amino acid phosphorylation
  Homolog annotation: Hit_ID=O04086; Match level="QueryCoverage=89%, HitCoverage=27%, E-value=2e-43, Identity=48%"; Hit description =Ser/Thr protein kinase isolog; 46094-44217
  Subcellular localization annotation: CTP_CleavageSite=20; ConfidenceScore=5.61e-01
MNYVQTVPWNSSSCQNFQPLASQYQTRTSPCCQTLLSLFGITLAQNLKKNSLFQLPNLPTSISCLQHFQSNLTFLSLPNNLVSSCFDPFQFVITPNICAHIQNIEDWHTRLGPTAQLNNACGPDLADPNQCRKCVAEGDKVQQRFLSIDGNDSHSLDCFYFTKLYLAGVVNELGPASIGTKLQPKAEAKCSVNLV

SEQ ID NO: 118383 - protein, 337 aa, Glycine max
  Coding DNA Sequence Number=SeqID_1605
  Gene Ontology: Mol. function=protein binding; Cellular component =clathrin vesicle coat; Biological process=Golgi to endosome transport
  Homolog annotation: Hit_ID=Q9LW61; Match level="QueryCoverage=50%, HitCoverage=60%, E-value=5e-32, Identity=40%"; Hit description =Arabidopsis thaliana genomic DNA, chromosome 3, P1 clone: MLM24
  Pfam annotation: Domain name=ENTH; Domain location=43-167; Score =156.9; E_value=5.4e-44; Accession=PF01417.11; Description=ENTH domain
  Subcellular localization annotation: CTP_CleavageSite=51; ConfidenceScore=5.09e-01
MSLMLNKNNSSKMSIPLFHEFKKQASFFLKEKFKTARLALTDVTPTELMTEEATKGNSWAPDPPTLRSISRAAFELDDYLRIVEILHKRLLKFDNKNWRASYNSLIVLEYLLTHGPESVAEEFQSDKDVIGEMKCFQHIDDSGFNWGLAVGKKSEQILKLLEEGTLLKKERNHARRLSRGIQGFGSFGQHSTQAQGVLQEKSLPTTFDRRNSDFNNHENQENQSFGSNHCLDTAAVKSASPSSQGGIFKSLDDSAETESHLDDQGNIQMHQKSETSSEENMTPSKEEFHLWNLKGESNPLLDGSQENDSRLGMFIAEDDHPFDSTEMPATSSLLSST

SEQ ID NO: 118384 - protein, 757 aa, Glycine max
  Coding DNA Sequence Number=SeqID_1606
  Gene Ontology: Mol. function=protein serine/threonine kinase activity; Cellular component=ubiquitin ligase complex; Biological process=protein amino acid phosphorylation
  Homolog annotation: Hit_ID=Q2HTK4; Match level="QueryCoverage=93%, HitCoverage=95%, E-value=1e-123, Identity=41%"; Hit description =Protein kinase; U box
  Pfam annotation: Domain name=Pkinase; Domain location=413-705; Score =70.0; E_value=7.5e-18; Accession=PF00069.15; Description=Protein kinase domain
  Pfam annotation: Domain name=Pkinase_Tyr; Domain location=413-676; Score=25.7; E_value=4.8e-14; Accession=PF07714.7; Description =Protein tyrosine kinase
  Pfam annotation: Domain name=U-box; Domain location=686-757; Score =64.1; E_value=4.5e-16; Accession=PF04564.6; Description=U-box domain
  Pfam module annotation: Pfam domain module=Pkinase::Pkinase_Tyr::U -box; Domain location=413-705::413-676::686-757
  Subcellular localization annotation: CTP_CleavageSite=43; ConfidenceScore=5.25e-01
MELLKPLHPHHAPILRIPFHAVPSSSSSQSQSQVPLPMISKVHVAVGKSLDKVVPLLRWTLNHFRNAEIVIVHAYQPSLTIPTLLGKLPASQASPAVVSAFRKVEREQIMKLLDKYLSICRAARVKAAIIVTEADQVQKGIVDLVIKHNIEKLVIGAVPENCMKVKRNSSKANYTAKNAPPFCEVWFIYKGKHIWTREASETPCSSSSCTQPEIATTESLRCRSFQYEVMEERINKQLIETKREAEAVTDEAFTELLKCEKLEVEAMEAIRKVNLFESAHVREVKLRKEADDALRDTVQEQQKLLNESEEIAGELQMTMRNIALLDSRAQEANRRRDEAADELSLIQESISTLWQERQQIRRQKTEALRWLERWRSRGQVGAAHCNGVIGFAEELPELAEFSLSDLQNATCNFSNSFKIEQGGYSCIYKGEMLGRTVAIKKFHQHNMQGPLEFRQEVQVLGSLQHPHLITLLGVCPEAWSIVYEYLPNGTLQDYLFRKSNNSPLTWNTRARMIAEIASALCFLHSFKPETIIHGDLKPETVLLDSSLGCKMCGFGLCRLVSEESLLRPSFRLSTEPKGAFTYTDPEFQRTGILTTKSDIYSFGLIILQLLTGRTPVGLAVLVRNAVSCGKLSSILDSSAGEWPSAVAMQLVELGLQCCQQYHRDRPELTPTLVRELEQLHASEERPVPSFFSCPILQEIMHDPQVAADGFTYEGDAIREWLENGHDTSPMTNLKLSHLFLTPNYALRLAIQDWLCKS

SEQ ID NO: 118385 - protein, 120 aa, Glycine max
  Coding DNA Sequence Number=SeqID_1607
MDVDGAKGGSDDENEVLGTGVQDAEIEMMDNQVIHWQIVTRLKNFSPFLIVMMKETIFIPPPMSTAFRPPPLRPPTPIRIIMLDGVSHNKNQSNYMRFIPMNFIPNVQPPRFKELKYRID

SEQ ID NO: 118386 - protein, 51 aa, Glycine max
  Coding DNA Sequence Number=SeqID_1608
MPMHCRTTSNSGGQLDQMMFFIWSWLKAYRKDFAVLFQQWHMDPALGLLHG

SEQ ID NO: 118387 - protein, 68 aa, Glycine max
  Coding DNA Sequence Number=SeqID_1609
MVTFCGCNPSMFQNMFGMRNQTENYISDEQSRRIKVKNKYHRKLFLCFGNLGFIDNEDGIPKDKCGIN

SEQ ID NO: 118388 - protein, 200 aa, Glycine max
  Coding DNA Sequence Number=SeqID_1610
VSVDKVIEGDAKVPFPTSEIQYESDTSPKKLPETNERGTNDFDHDPLHQLIKSLYFMYDTPVELKWDGSKFELSNVDASFFLTFSDVNEIVAGYKCLNISILQLWMFINFYVYFIKADFWMSGAQLWVMLPCMDSLSHNRYTMQRINVLNVSITYKHDSRNRNERGHWQLVVLCPATNVVAWFCSLRKKPDTHIKTAINK

SEQ ID NO: 118389 - protein, 82 aa, Glycine max
  Coding DNA Sequence Number=SeqID_1611
  Homolog annotation: Hit_ID=Q1SRJ5; Match level="QueryCoverage=100%, HitCoverage=7%, E-value=7e-11, Identity=42%"; Hit description =Probable helicase [imported]-Arabidopsis thaliana-related
MHWECKNFPTCFWGRYLSNDSSSTHILLKIESDVGENRRIPAIKILLNFILISKRSCDTVRIFVDVFEQIFNGCTLITPFHV

SEQ ID NO: 118390 - protein, 82 aa, Glycine max
  Coding DNA Sequence Number=SeqID_1612
IMVRIRYLSRALGRVIRRVLGKEPKEVVVNDVVTDAEGFPDRPHDTSVLIGYVHHVVMIVWNEEERPELKSSSHGRFCREVA

SEQ ID NO: 118391 - protein, 83 aa, Glycine max
  Coding DNA Sequence Number=SeqID_1613
MANNHNIVVEIDATRENWKICVRVVRLWVRIECTLFREYVDKLNPSLLLEKVNGLICFGSVGYVILGSDLIYLDNMRLKETMV

SEQ ID NO: 118392 - protein, 102 aa, Glycine max
  Coding DNA Sequence Number=SeqID_1614
SACTTGLSTPGGLVDNDRRREALRVRFTADVEANASEVGGGGGKRKRGTSNNLKVVHSGTKEFKIASNMRDLFLGFSEHQQRLRKKLALEEGKIFAANEQLS

SEQ ID NO: 118393 - protein, 423 aa, Glycine max
  Coding DNA Sequence Number=SeqID_1615
  Gene Ontology: Mol. function=nucleic acid binding; Cellular component= membrane of vacuole with cell cycle-correlated morphology; Biological process=mitochondrion organization and biogenesis
  Homolog annotation: Hit_ID=Q1RSX3; Match level="QueryCoverage=99%, HitCoverage=100%, E-value=1e-175, Identity=74%"; Hit description=CBS
  Pfam annotation: Domain name=CBS; Domain location=210-325; Score =31.8; E_value=2.4e-06; Accession=PF00571.18; Description=CBS domain
  Pfam annotation: Domain name=DUF21; Domain location=14-191; Score =180.6; E_value=3.9e-51; Accession=PF01595.10; Description=Domain of unknown function DUF21
  Pfam module annotation: Pfam domain module=CBS::DUF21; Domain location=210-325::14-191
MAVEYQCCETQFFIRLLIILLLVLFAGLMSGLTLGLMSLSLVDLEVLAKSGTPQGRKHAAKILPVVRNQHLLLCTLLICNAAAMEALPIFLDGLVVAWGAVLISVTLILLFGEIIPQSICSRYGLAIGATVAPFVRVLVWICFPVAYPISKLLDYLLGHRHEALFRRAELKTLVNLHGNEAGKGGELTHDETTIIAGALELSEKTASDAMTPITEIFSVDINAKLDRDLMSLILEKGHSRVPVYYEQPTNIFGLVLAKNLLTIDPEEEIPVKSVTIRRIPRVPETLPLYDILNEFQKGHSHMAVVVRHFEKTRQQSSNNNADVRDVKVDIDGEKTPQGNILKTKRSLQKWKSFPNSNNSNRGGSRSRKWSKNMYSYILEIDGNSLPSLPEKEEAVGIITMKDVIEELLQEEIFDETDHHFEDS

SEQ ID NO: 118394 - protein, 134 aa, Glycine max
  Coding DNA Sequence Number=SeqID_1616
  Gene Ontology: Cellular component=integral to membrane
  Homolog annotation: Hit_ID=Q1RSX3; Match level="QueryCoverage=83%, HitCoverage=26%, E-value=7e-39, Identity=72%"; Hit description=CBS
  Pfam annotation: Domain name=DUF21; Domain location=14-133; Score =9.0; E_value=1e-06; Accession=PF01595.10; Description=Domain of unknown function DUF21
MGVEYTCCDMEFYKRILIIVLLVMFAGLMSGLTLGLMSLSIVDLEVLAKSGTPQDRNNAAKILPVVRNQHLLLCTLLICNAIAMEALPIFLDSLVVAWGAILISVTLILLFGEEYLGIKLFSFVKEYSLTSAYF

SEQ ID NO: 118395 - protein, 75 aa, Glycine max
  Coding DNA Sequence Number=SeqID_1617
MQQKVPIFFAERELKCAVVVEVAAAGSDVEVSLRSVTVAPLVAIPVREREREREVVEFSFGWRSRQRILSLVGFL

SEQ ID NO: 118396 - protein, 335 aa, Glycine max
  Coding DNA Sequence Number=SeqID_1618
  Gene Ontology: Cellular component=nucleus; Biological process =regulation of progression through cell cycle
  Homolog annotation: Hit_ID=O04389; Match level="QueryCoverage=70%, HitCoverage=47%, E-value=1e-18, Identity=30%"; Hit description=B -type cyclin
MPSDWKVFTIVLRGEEADVSEGANETARDNVDEGTIEDEKGFEEGLWAGPGPFGGGGEGKSGGVGRKVCEERRKIDEKEKRRENLESRERKAVDTEVGQGCRQVFGDIGNLEVPRITEGKLISRPIKRNFNAKLLANEENLANVLEVEANKQGATQGKKNLIVPALDNAAIVHQEHGAEDSTHKPNPEPVDMVNFEAEDSANFVCERGSRERSRRNVKTLTSEIIAQSKKACVVLNDTKEEPVDMDADDPNEVVVAEYLEDIYRFFNLTEVPAILKSYSFHIYVFILLLLQLMMQQETDYQASDYMKKQHGINDKMRSIIVDWLVENPHEISINA

SEQ ID NO: 118397 - protein, 169 aa, Glycine max
  Coding DNA Sequence Number=SeqID_1619
  Gene Ontology: Cellular component=nucleus; Biological process =regulation of progression through cell cycle
  Homolog annotation: Hit_ID=Q2PHL0; Match level="QueryCoverage=72%, HitCoverage=27%, E-value=1e-26, Identity=48%"; Hit description =Cyclin B1-1
  Pfam annotation: Domain name=Cyclin_C; Domain location=16-145; Score =102.0; E_value=1.8e-27; Accession=PF02984.9; Description=Cyclin, C -terminal domain
MEKAILERLEWKLTVPTPYVFLVRFTRTFALSPDQQMKNMAFFLAELGRVHYGTANLFLPSMTAAAAVYAAQCTLNRKPLWNDEILKNMAGYTAPQIRDCAKLPMKLHPSVPESQVIAVHRKFCTVCRVQRRCCFSIITEGYIKLENYLVFQHKLSCADPYGNIPDEIR

SEQ ID NO: 118398 - protein, 245 aa, Glycine max
  Coding DNA Sequence Number=SeqID_1620
  Gene Ontology: Cellular component=integral to membrane; Biological process=mitochondrion organization and biogenesis
  Homolog annotation: Hit_ID=Q1RSX3; Match level="QueryCoverage=99%, HitCoverage=57%, E-value=1e-92, Identity=70%"; Hit description=CBS
  Pfam annotation: Domain name=CBS; Domain location=30-146; Score=25.6; E_value=0.00018; Accession=PF00571.18; Description=CBS domain
AGKGGELTHHETTIIAGALELAEKTAGDAMTPITEAFCIDINSKLDMYLMNLILENGHSRVPVFYDQPTNIIGLILIKNLLTIDPEDEAPVKCVTIRRIPRVPETMPLYDILNEFQKGHSHMAIVVKHCDKTGYQSSNNNAYDSARDVKVDIDGEKPPREKNLKTKMSCHKRKSFPNANNLNKGSPQSRKWSKNMYSDILEIDGNSIPKLPEKEAAVGIITMEDVIEELLQGEIFDETDHDFEVS

SEQ ID NO: 118399 - protein, 291 aa, Glycine max
  Coding DNA Sequence Number=SeqID_1621
MAATATNNPQITREEIQTAIAKAVELRALHAALTQGSSPGTNNARFPSPSPASHFSAQDYPVFTPSYEDEAHQNSTRSRTISESCDENGVEGGENSMTPSDYKEKSNSRKGLPFGFGNLDSHMCPADDDTKSVTGSCANHITVLQTSPAATANDYFKSRRTNSLGDSKQPLSSCNRCNPAVITSEYENTRNNKSSNIVVPLTDSHASFQTQPRSKGLISWLFPRLKKKHNKNVSSPSRTESEEVSQVLKDMGIVSVEALKRELMDANESRDAALVEVSEMRSSLGELKQKL

SEQ ID NO: 118400 - protein, 229 aa, Glycine max
  Coding DNA Sequence Number=SeqID_1622
  Gene Ontology: Mol. function=DNA binding; Cellular component =chromosome; Biological process=chromosome organization and biogenesis (sensu Eukaryota)
  Homolog annotation: Hit_ID=UPI00005A5838; Match level="QueryCoverage =67%, HitCoverage=100%, E-value=4e-68, Identity=87%"; Hit description= PREDICTED: similar to histone 1, H2ai (predicted)
  Pfam annotation: Domain name=CBFD_NFYB_HMF; Domain location=157-222; Score=5.3; E_value=0.05; Accession=PF00808.13; Description=Histone -like transcription factor (CBFNF-Y) and archaeal histone
  Pfam annotation: Domain name=Histone; Domain location=151-225; Score =145.3; E_value=1.7e-40; Accession=PF00125.14; Description=Core histone H2AH2BH3H4
  Pfam module annotation: Pfam domain module=CBFD_NFYB_HMF::Histone; Domain location=157-222::151-225
MGVPTATDRDPWLERRKHLNRRLRSSSTVLVFVFPHLLNHIHQIENISKFALHLFSQYIYPRNPNQFGIAKSFLQFNHHCTTQFPSSFSIKRAMARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 118401 - protein, 110 aa, Glycine max
  Coding DNA Sequence Number=SeqID_1623
  Homolog annotation: Hit_ID=Q6AU54; Match level="QueryCoverage=59%, HitCoverage=11%, E-value=2e-20, Identity=68%"; Hit description =Expressed protein
MSAGRPNKTLRREVVMAETRCLAIIDEEEIEVDDDIYENIEAPKFVDLTAPDSRRPDDDRHWFCFRVGCDQKHEQELDSEAIYKNFVLRVMAARSPNVRLRKALNRREAR

SEQ ID NO: 118402 - protein, 417 aa, Glycine max
  Coding DNA Sequence Number=SeqID_1624
  Gene Ontology: Mol. function=oxidoreductase activity; Cellular component=integral to membrane; Biological process=electron transport
  Homolog annotation: Hit_ID=Q1T3E8; Match level="QueryCoverage=100%, HitCoverage=75%, E-value=1e-170, Identity=75%"; Hit description =Helix-turn-helix, AraC type; NAD-binding site; Fumarate lyase
  Pfam annotation: Domain name=DAO; Domain location=62-386; Score= -53.4; E_value=0.021; Accession=PF01266.14; Description=FAD dependent oxidoreductase
  Pfam annotation: Domain name=FAD_binding_3; Domain location=60-404; Score=-96.1; E_value=4.1e-05; Accession=PF01494.9; Description=FAD binding domain
  Pfam annotation: Domain name=SE; Domain location=230-417; Score =324.4; E_value=2e-94; Accession=PF08491.1; Description=Squalene epoxidase
  Pfam module annotation: Pfam domain module=DAO::FAD_binding_3::SE; Domain location=62-386::60-404::230-417
MGYEYILGGIIASSLVLVFVIYGSVSKRKAKSSVHAESNGGSIIRTSPENGNHHQEISETTDVIIVGAGVAGAALAYTLGKIYAKLMLRINDVGLWFLLQEGRRVHVIERDLTEPDRIVGELLQPGGYLKLIELGLQDCVGEIDAQPVFGYALYKDGKNTKLSYPLENFASDVSGRSFHNGRFIQRMREKASSLPNVKLEQGTVTFLLEEDRIIKGVNFKTKSGQELTAKAPLTIVCDGCFSNLRRSLCNPKVDVPSHFVGLVLENCNLPYANHGHVILGDPSPILFYPISSTEIRCLVDVPGHKLPSLGNGDMARYLKTVVAPQVPPELRDSFIAAVEKGNIRSMPNRSMPASPYPTPGALLMGDAFNMRHPLTGGGMTVALSDIVLLRNLLRPLHDLHDANALCKYLESFYTLRK

SEQ ID NO: 118403 - protein, 266 aa, Glycine max
  Coding DNA Sequence Number=SeqID_1625
MNKLELNGVKKNGEGGSNSLAVATWKKQLRGREVKSRVFDSLYSINRKEPETNTKTSLMEKKVKKCMQKRQVAVPHETDTSDMEIDEKSRCGSLEGCHESGTSGSGGELSLGDEKSHESTRGESSVPVLSEASRGDITWLSSLNNEKNETTERSEKEETKNSVSDKGKVSETKKRRAEENSLASDDKENERQLTENDDKENVSAPHENIEMSTNDDVQKKRAILGSKHEDLRKTQKKFTSPSTTPQVLKYRKLKPTSLKPFKLRID

SEQ ID NO: 118404 - protein, 71 aa, Glycine max
  Coding DNA Sequence Number=SeqID_1626
MALRQIMTLLGPRRLFLEEMIEGIQSFDANVVCLGFGLEEQTWDLAGHMWWWVIVKNVSYFKIRKICDNGI

SEQ ID NO: 118405 - protein, 62 aa, Glycine max
  Coding DNA Sequence Number=SeqID_1627
MVLFCTGLASSNDDLGPVGYASLTGDLPRVRPEACRAAAFQRCSWLRQFEWREACNRSRKLE

SEQ ID NO: 118406 - protein, 104 aa, Glycine max
  Coding DNA Sequence Number=SeqID_1628
  Homolog annotation: Hit_ID=Q53N84; Match level="QueryCoverage=51%, HitCoverage=37%, E-value=2e-10, Identity=59%"; Hit description =Expressed protein
MWQTKNLTQNICLTPGVGFGPGIPGFQVGFGFGAGCGVGFGFGYGVGKGIAQDENKRYSNVGNPFRGSRSIISEDDITALVDDLVINTKKFIKATSKEIDKWRR

SEQ ID NO: 118407 - protein, 494 aa, Glycine max
  Coding DNA Sequence Number=SeqID_1629
  Gene Ontology: Mol. function=translation initiation factor activity; Cellular component=chloroplast; Biological process=translational initiation
  Homolog annotation: Hit_ID=Q9XIR4; Match level="QueryCoverage=77%, HitCoverage=88%, E-value=1e-147, Identity=63%"; Hit description=APO protein 1, chloroplast precursor
  Pfam annotation: Domain name=DUF794; Domain location=104-494; Score =769.5; E_value=2e-228; Accession=PF05634.2; Description=Arabidopsis thaliana protein of unknown function (DUF794)
  Subcellular localization annotation: CTP_CleavageSite=48; ConfidenceScore=5.29e-01
MGLPLLSSALWDPSHNCVSSSVEFIRPLLSASKSYSLGLKLSVAIPVRMSQYTCCTVSTFKGVPGIKRLAPLMVHFNSTQSSLHMIIEFVISSNFQFNCQQFCKGRSKLPGVLVCASRRPKGTVWRRKTLPQNEDLPPILPKNKKKPYPIPFKEIKQAGREDRKLAHMGIEKPLEPPKNGLLVPDLVPVAYEVFDAWKLLIEGLAQLLHVIPAHGCSECSEVHVAQTGHHIRDCSGTNGRQRRSSHAWVKGSVNDILVPIESYHLFDPFGRRIKHDTRFEYDRIPAVVELCIQAGVDIPEYPSRRRTNPIRMLGRRVIDRGGNLEEPKPWRFADPSSLNDFDTYRASERFPRPSLSDLPKIAQETMSAYETVKKGVKKLMRKYTVKACGYCTEVHVGPWGHNAKLCGAFKHQWRDGKHGWQDATVDEVFPPNYVWHVRDPRGPPLASALRRYYGKAPAVVEVCMQAGAQIPEEYKPMMRLDIIIPDTEEARMIA

SEQ ID NO: 118408 - protein, 120 aa, Glycine max
  Coding DNA Sequence Number=SeqID_1630
  Gene Ontology: Mol. function=protein serine/threonine kinase activity; Cellular component=integral to membrane; Biological process=protein amino acid phosphorylation
  Homolog annotation: Hit_ID=Q19AV8; Match level="QueryCoverage=87%, HitCoverage=10%, E-value=2e-22, Identity=50%"; Hit description =Clavata-like receptor
MTSRASTIYEYAYTCRVTEKNDVYSFGAVLMELVTGKRPMEPEFGENHDIVHWVCNNIRSREDALELVDPTIAKHFKEDAMKVLKIATLCMHWENSSFKTLNENVGRGRSIYHNQNDCDH

SEQ ID NO: 118409 - protein, 70 aa, Glycine max
  Coding DNA Sequence Number=SeqID_1631
MEPWDHKHRVVGHLDPTESTSRGAGACFSEKGVATAIGELPASCNSHWRVAQEEIAITNGDLLAINTSAH

SEQ ID NO: 118410 - protein, 197 aa, Glycine max
  Coding DNA Sequence Number=SeqID_1632
  Gene Ontology: Mol. function=nucleoside-triphosphatase activity; Cellular component=mitochondrial inner membrane; Biological process =protein transport
  Homolog annotation: Hit_ID=Q1T499; Match level="QueryCoverage=99%, HitCoverage=26%, E-value=9e-70, Identity=73%"; Hit description=ClpX, ATPase regulatory subunit
VESADLIAYGLIPEFIGRFPILVSLSALTEDQLMMVLTEPKNALGKQYKKLFSMNNVKLHFTEKALRLIAKKAMAKNTGARGLRALLENILTEAMFELSSSITNYHSSLRFCTNIYDAYLHQIPDIKTGSDRVDAVVIDEESVGSLTAPGCGGKILRGDGALEQYLAKMKDSAVNVDVGESDLQEGDLELSSRAMSL

SEQ ID NO: 118411 - protein, 160 aa, Glycine max
  Coding DNA Sequence Number=SeqID_1633
  Homolog annotation: Hit_ID=Q1T4A0; Match level="QueryCoverage=36%, HitCoverage=49%, E-value=2e-22, Identity=82%"; Hit description=Cupin, RmlC-type
  Pfam annotation: Domain name=Cupin_3; Domain location=52-127; Score =75.4; E_value=1.8e-19; Accession=PF05899.3; Description=Protein of unknown function (DUF861)
MKPSVLRLSLLVFVPLLLSLFYVALMPKKETSMKTYEVFGVKIEKNPSQSKLTDLGVSTWPMWEGGPTKIPWSFKEEETMYLLEGKVRVTVEGSVESFEIGGGDLVVFPKGMNITWEVIEAASVDRYLEIEADDLAVFPRGTIMTWEIIEAGNNRCNMEN

SEQ ID NO: 118412 - protein, 126 aa, Glycine max
  Coding DNA Sequence Number=SeqID_1634
MAICRAIGNRQSNWRVPTAEGACHGSEGQSASRQSRPNRQWQWRFALGMDRQPCWRVAPKYASSIIKAQSESAPATLPSWLSPRVHQLASFVPLLPLILPLLCFHCCAIFFISFSVRFCYFGLVRM

SEQ ID NO: 118413 - protein, 165 aa, Glycine max
  Coding DNA Sequence Number=SeqID_1635
MKDKGEDFESYKGENFEFYEGIKARTLSPIKDKVRTLSPIKDQVRTLSPIKERTLSPAKSKGSIVAQSMKFRDMPEVKKSKGSIVAQSVKFCDMPKSKGSIVAQSVKFRNIPEAKEGMIMGVQIAIRPTWAFQEVPPEGTAVPSGGSNLARLGELGGKLLPYFHL

SEQ ID NO: 118414 - protein, 194 aa, Glycine max
  Coding DNA Sequence Number=SeqID_1636
  Homolog annotation: Hit_ID=Q47522; Match level="QueryCoverage=26%, HitCoverage=64%, E-value=7e-24, Identity=100%"; Hit description=LacZ protein
  Subcellular localization annotation: CTP_CleavageSite=88; ConfidenceScore=5.61e-01
MCVMPKSASSTTLVNVYSGVPSARISTGSESDPISTVCSPRTRSCHETSVGNGASPREGSVFFSSSRQYGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 118415 - protein, 272 aa, Glycine max
  Coding DNA Sequence Number=SeqID_1637
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=Q8YH36; Match level="QueryCoverage=37%, HitCoverage=22%, E-value=9e-30, Identity=62%"; Hit description =Glutamyl-tRNA synthetase 2
  Pfam annotation: Domain name=tRNA-synt_1c; Domain location=42-242; Score=-111.4; E_value=5.5e-07; Accession=PF00749.11; Description =tRNA synthetases class I (E and Q), catalytic domain
VLQWLLFLSAVPPVQLLTGWCVTAKAPPDISAGKCSGHAARRVPFAIQAAQLLGRAIGAGLFAITPAGERGMCCKAIKLGNARVFPEFDPYWRLLLKNTDPSRGLAPLPTLVSWHDLVRGEQTVDIGSLSDPVLIRADGTPLYTFTSVVDDADFGITHIVRGEDHVTNSAVQIQLFEALGATAPKFAHHSLLVGAESSLSIPSTSRGGPVPAFVPFSEVGKPVVPAALMNRPTRGERRFAYWALAECILAYYVGTDEGVSEVLHVAGEKRLH

SEQ ID NO: 118416 - protein, 122 aa, Glycine max
  Coding DNA Sequence Number=SeqID_1638
MLRDFIINYERFDILRDSFGHQSKKLSSFDFAQSFYSEFQGSRYTKLSSSITSYSIYYGIHSDIRVKSYYRLIVLRASVINNEDLSILRDSFRHLSKKLLSFDFAKSFYSEFRASRYITGHS

SEQ ID NO: 118417 - protein, 94 aa, Glycine max
  Coding DNA Sequence Number=SeqID_1639
AKGHFGAVVAHPGKLKLSAEAMSSPRQAGFFTMKLYGGPGELEASLGELGSKKTKEKTLLPHFLVFFAFLIKILNDHLFRTITGVQHRKLTSKD

SEQ ID NO: 118418 - protein, 540 aa, Glycine max
  Coding DNA Sequence Number=SeqID_1640
  Gene Ontology: Mol. function=oxidoreductase activity; Cellular component=intracellular; Biological process=lignin catabolic process
  Homolog annotation: Hit_ID=Q9SR40; Match level="QueryCoverage=99%, HitCoverage=94%, E-value=0.0, Identity=61%"; Hit description =Putative laccase
  Pfam annotation: Domain name=Cu-oxidase; Domain location=127-278; Score=177.8; E_value=2.6e-50; Accession=PF00394.12; Description =Multicopper oxidase
  Pfam annotation: Domain name=Cu-oxidase_2; Domain location=384-526; Score=176.7; E_value=5.6e-50; Accession=PF07731.4; Description =Multicopper oxidase
  Pfam annotation: Domain name=Cu-oxidase_3; Domain location=1-116; Score=219.5; E_value=7.4e-63; Accession=PF07732.5; Description =Multicopper oxidase
  Pfam module annotation: Pfam domain module=Cu-oxidase::Cu-oxidase _2::Cu-oxidase_3; Domain location=127-278::384-526::1-116
VENITVQRLCRQQVITAVNGTLPGPTINAREGDTVVVHVFNKSPYNLTIHWHGIFQFLTPWSDGPEFATQCPIASGSSYTYRFNLTGQEGTLWWHAHSSFLRATVYGALLIRPRLGHSYPFPKVYQEIPILVGEWWNANVVEVEQNATETQQPPIESDAYTINGLPSDLYNCSQDGTYQVKVKQGKTYLLRIINSALNNQHFFEVANHTLTVVAIDATYTNHYDTKVVVLAPGQTVDVLLRTNQSVGSYYMAFTPYHSAPLVQINANMTRGVIIYEGATSAKPIMPDLPAQTDTPTAHKFYTNITGLAGGPHWVPVPRQVDEHMFITFGLSFDICRSDTGVCPGPVPLFSANMNNESFVLPHGKGVSMLEAFFRNDVTGVYTRDFPDQPAVVFDFTNPNITSSPDTPREFLIAPKSTKVKTLKFNSTVQIVLQNTAIIAAENHPIHLHGFNFHVLAQGFGNYNATRDEPKFNFVNPQIRNTIAVPVGGWSVIRFQANNPGVWLMHCHLETHLPWGLSTAFEVENGPSIRVPPPPADLPKC

SEQ ID NO: 118419 - protein, 136 aa, Glycine max
  Coding DNA Sequence Number=SeqID_1641
  Subcellular localization annotation: CTP_CleavageSite=40; ConfidenceScore=5.23e-01
MTLNLVLRMTMVANNILSLYHLSSPSNAPNHNVFTFCLPSCNLDTNSNLFLQQLAVELEGIVAGEVIATEDDVEDTEFLGDGGDPAKEDAGDDLKFMFMVLDKYVLDEGFEGDDVNVLCVGREAVVRGVGFGRGRG

SEQ ID NO: 118420 - protein, 485 aa, Glycine max
  Coding DNA Sequence Number=SeqID_1642
  Gene Ontology: Mol. function=nucleoside-triphosphatase activity; Cellular component=intracellular; Biological process=protein transport
  Homolog annotation: Hit_ID=Q1T499; Match level="QueryCoverage=99%, HitCoverage=63%, E-value=1e-141, Identity=60%"; Hit description=ClpX, ATPase regulatory subunit
  Pfam annotation: Domain name=AAA; Domain location=253-455; Score= -0.1; E_value=0.00022; Accession=PF00004.19; Description=ATPase family associated with various cellular activities (AAA)
  Pfam annotation: Domain name=AAA_2; Domain location=249-452; Score =117.6; E_value=3.5e-32; Accession=PF07724.4; Description=ATPase family associated with various
  Pfam module annotation: Pfam domain module=AAA::AAA_2; Domain location=253-455::249-452
GGGEKEKGYQSVNLCPSCKTAYYFRPYDTTPLQGTFVEIGRVTSTKNNGVNDLSGKGHSPRRITHGKGGGKEGGSSTSKGEEFWGRSNNNASKWLEVSLWETLMTYNRGAGRGNGSNGEPPESWPLAPDGSNGNGNGLAVHTPPGPPFPPGINVIRATGPRNGGSGGGGGGKGEKTAWGGSNLGKDFPSPKEICKGLDKFVIGQQRAKKVLSVAVYNHYKRIYHATLQKGSAADSGVSEVLDDDDNVELEKSNVLLMGPTGSGKTLLAKTLARFVNVPFVVTDATTLTQAIGSLVLRQSFVVIDLNKVSTLQAGYVGEDVESILYKLLTAADFNVAAAQQGIIYIDEVDKITKKSKSLNISRDVSGEGVQQALLKMLEGTGLVRADMIPWSTIFFSITINYVFTISSSQIVNVPEKGARKHPRGDNIQMDTKNILFICGGAFIDLEKTISERRQDSSIGFGAPVRANMRAGGITDSAVTSSLLES

SEQ ID NO: 118421 - protein, 178 aa, Glycine max
  Coding DNA Sequence Number=SeqID_1643
  Gene Ontology: Mol. function=transporter activity; Cellular component= integral to membrane; Biological process=transport
  Homolog annotation: Hit_ID=Q1SYG1; Match level="QueryCoverage=99%, HitCoverage=35%, E-value=9e-64, Identity=66%"; Hit description=Major facilitator superfamily MFS_1
MVGSHLGWRYAFWVESLLMIPFAISGLFMKPLQLRGLVPADSKKALTPETVASGVQVMEASNGRDESLSLKAELRDKSSNDHSKSKSATQIFEQFLRFLNDMKELWLDKVYVVNVLGYIAYNFVIGAYSYWGPKAGYNTYHMTEADLIFGGITIVCGIAGILAGGFVLDYMSNTLSNA

SEQ ID NO: 118422 - protein, 456 aa, Glycine max
  Coding DNA Sequence Number=SeqID_1644
  Gene Ontology: Mol. function=RNA-directed DNA polymerase activity; Cellular component=integral to membrane; Biological process=RNA -dependent DNA replication
  Homolog annotation: Hit_ID=Q1RXD8; Match level="QueryCoverage=95%, HitCoverage=57%, E-value=3e-43, Identity=28%"; Hit description=RNA -directed DNA polymerase
MQLGKVKLSPLLFNIAAEGLNGLMTNAIERRLYRGFLSGTNKVEISLLQYTDDTIFFGKATMENVRAIKAILRAFELASGLKINFAKSSCGAFGVSDQWISDAANYLHCSLMIPKKVVDKLVRLQRNFLWSGASEQNKISWIGWETRRLNEAPRAINESIWWRDLKILSQHPQQGQLLNGSILWKVGCGDKFKFWENNWKRGDNQLLEKYPRLYTISAQQNQLIQHMGVYKDTGWEWDLKWRRPLFDSEIDLAGVWEADPSGQYSVKSAYSVLRQHVSGEAHDEEFKELWKLKVLSKVAVFAWRLLKDRLPTRDNLRRKQIELQDYLCPFCRIMEESIDHLFFHCSKVLPIWRESLSWVNLVGVFPHHLRQHFIQHMYQTYEGMTATRWKWWWLALTWTIWKHKNNIVFSNNTFNANKMMDEAVFLLWTWLKYLEKDFTTHYNQWSSNLRYGFRRS

SEQ ID NO: 118423 - protein, 779 aa, Glycine max
  Coding DNA Sequence Number=SeqID_1645
  Gene Ontology: Mol. function=heat shock protein binding; Cellular component=integral to membrane; Biological process=protein folding
  Homolog annotation: Hit_ID=Q1T494; Match level="QueryCoverage=94%, HitCoverage=92%, E-value=0.0, Identity=59%"; Hit description =Aminotransferase, class-II; Heat shock protein DnaJ
  Pfam annotation: Domain name=DnaJ; Domain location=66-127; Score =107.7; E_value=3.5e-29; Accession=PF00226.21; Description=DnaJ domain
MECNKDEATRAKEISERKFAAKDTLGAKKFALKALNLFPDLEGISQMVATLDVYIAAANKTNGEADWYGVLGVDPLADDDTVRKQYRKLALQLHPDKNKSIGADGAFKLISEAWSLLSDKAKRGAYDKRSGRERKVSTKFGGSSSQKGTNGGFNFTKTAPSRATPQKNTAKDHTSSSTYKSKSNTFWTVCRRCKMQYEYLRVYLNLKLLCPNCHEAFVAVETAPPPASGIRPATQWSFPHKQNSSRQSNKSKSNAGKNNMAAPNVGGGSCSKTDSYEKANFQWAPFSKASGVSNVAQAASVVQQVYDKVKRDREEAQAASKREEALKRKQHATKKGYYNPAKRRRGGGMEDASASNHGKKTNLSRSKQGNFEYNSVNGINKTGHVGDISPVQLKNLLMEKARKEISNKLRQVQSNAVDKTAMKENGNDFQEVSEKGEKCSRNSEMCAQDNIEKSEDRKSGSRAIKPFAGTTIAKVSRKFLETTPVDVLDPDFHDFCKDRTEGSFGENQVWAVYDNDDGMPRFYAMIHRIISLNPFKMQISWLNPNTNSELDPLNWVASGFSKICGDFRTSRPEICGSTNFFSHKVRWRTGADGAICIYPRKGDVWAIYRNWSPDWNELTADEVIHKFDVVEVLEDFTVGHGIDVIPLVKVAGFRTVFHHHLDPKEIRIIPREEMFRFSHQIPSYVLTGQEAPEAPKGCRVLDPAATPFELLQVIEVVKKGDGADNEDSDVKKTSDDMKKDNNDQMIDAMGKHGEEKEAKDEEMQEVETSDSMKKPIMRK

SEQ ID NO: 118424 - protein, 125 aa, Glycine max
  Coding DNA Sequence Number=SeqID_1646
MATIPPRKPSLGWRVKKGVAETKRVVGVTDFGGKMVEGEERRRVEKMGLDLEEEIGVEMEVVLRILKPMAMVFVFTNHGSGSADRGVVVRMDGSGGCNGGGGSVASGSCSGGGNRKRESSCTVWG

SEQ ID NO: 118425 - protein, 282 aa, Glycine max
  Coding DNA Sequence Number=SeqID_1647
  Gene Ontology: Mol. function=hydrolase activity; Cellular component =cytoplasm; Biological process=translation
  Homolog annotation: Hit_ID=Q4FCX5; Match level="QueryCoverage=99%, HitCoverage=46%, E-value=1e-121, Identity=76%"; Hit description=N -acylethanolamine amidohydrolase
  Pfam annotation: Domain name=Amidase; Domain location=3-255; Score= -124.4; E_value=1.1e-05; Accession=PF01425.11; Description=Amidase
MEGSLCDSGTVEIIGPIASTVEDVLLVYSAMLGASPANRISLKPSPPCLPSLSSNDNSNALGSLRIGKYTPWFNDVHSTEISDKCDEALNLLSKAHGCEMIEIVIPELLEMRTAHVVSIGSECLCSLNPDCEDGKGVNLTYDTRTSLALFRSFTAADYVAAQCIRRRSMYYHLEIFKKVDVIVTPTTGMTAPIIPPSALKSGETDMQTTANLMQFVVPANLLGFPAISVPVGYDKVGLPIGLQIMGRPWAEATVLRVAAEVEKLCGEWKKKPASYYDVLKAK

SEQ ID NO: 118426 - protein, 101 aa, Glycine max
  Coding DNA Sequence Number=SeqID_1648
MKADNNSTTDQSMSKFFLLANNATFHEAELPPLLSNVREIMVVKMHTTTAMRGLNGDEKEQQGQELEDAEPSRNAESNKEEDRRPKREINKPYYLKDFVSK

SEQ ID NO: 118427 - protein, 87 aa, Glycine max
  Coding DNA Sequence Number=SeqID_1649
MASMMDAMLGMKQLMESNVATAVAISSTAEADPTLSTVVHHPIPNMVGRERSTPGHISNPIRGTTEVLTPTVYHPITHHQPYMKTWV

SEQ ID NO: 118428 - protein, 418 aa, Glycine max
  Coding DNA Sequence Number=SeqID_1650
  Gene Ontology: Mol. function=nucleic acid binding; Cellular component= membrane; Biological process=electron transport
  Homolog annotation: Hit_ID=Q2HTY4; Match level="QueryCoverage=99%, HitCoverage=80%, E-value=1e-152, Identity=61%"; Hit description=FAD linked oxidase, N-terminal
  Pfam annotation: Domain name=FAD_binding_4; Domain location=4-143; Score=109.6; E_value=9.3e-30; Accession=PF01565.13; Description=FAD binding domain
TSKPLAIITARSENHVHATVKCAKSNGIQVRIRSGGHDYEGLSYVSDVSYVVLDMFPLHKIDLDMESGTAWVQAGATLGELYYQIANKSNVLAFPAGVCSSLGTGGHFSGGGYGNLMRKYGLSVDNIIDAILVDANGILLDRKLMGEDLFWAIRGGGGASFGVIVAWKIKLVPVPPQVTVFRVKKSIKEDATDVAYQWQLVAPNLDKDLFIRVQPDVVNGTVIVSFIGQFLGPIERLLRLVNESFPELGLKQSDCTEMPWINSTLFWYDLPIGTPIEALLPTNQEPPSIYTKGKSDYVKKPIPKEALKSIWDLMIKYNNIWMQWNPYGGRMAEISPKATPFPHRAGNLFLIQYSVFWTEDGAEANNRYLNYSRSFYEFMTPYVSSFPREAFLNYRDIDIGAKNPSTSNNLVDSLKYAS

SEQ ID NO: 118429 - protein, 57 aa, Glycine max
  Coding DNA Sequence Number=SeqID_1651
  Gene Ontology: Mol. function=hydrolase activity; Cellular component =mitochondrion
  Homolog annotation: Hit_ID=Q2R391; Match level="QueryCoverage=84%, HitCoverage=19%, E-value=1e-12, Identity=62%"; Hit description=Nudix hydrolase 13, mitochondrial, putative, expressed
MVDINFQEIPLGRWEFRSKSSNDSCSQEGWCRGYMFALEVTEELETWPEQKDHNRQW

SEQ ID NO: 118430 - protein, 81 aa, Glycine max
  Coding DNA Sequence Number=SeqID_1652
MKEVGELARGRMRVSQGCRSTSRIWEVENEGLGMGNLAVSLKDDVLELHPRRPINRKEKSNCFSIMRLWCTIWNHDVAAEM

SEQ ID NO: 118431 - protein, 100 aa, Glycine max
  Coding DNA Sequence Number=SeqID_1653
MPKIGTIPHEQQAPSRVQTQLNSTLVKEASEEREAAQEYSCPRITPRVKKEGVLVEMSEIKYGYPYPAQGTYQGPPPVAAPPQYYAAPPPRREPGFLEGW

SEQ ID NO: 118432 - protein, 102 aa, Glycine max
  Coding DNA Sequence Number=SeqID_1654
  Homolog annotation: Hit_ID=Q8S403; Match level="QueryCoverage=61%, HitCoverage=8%, E-value=4e-19, Identity=73%"; Hit description =Putative phosphate transporter 1
MAIVGTLLHNTHHETIVRRKTTEESEEVYETELAQLFSEEDEVQVFFAKLDGELNKINQFYKKQETEFIERGEMLSKQLNILLDLKQILSDRHKKKSVAKAF

SEQ ID NO: 118433 - protein, 416 aa, Glycine max
  Coding DNA Sequence Number=SeqID_1655
  Gene Ontology: Mol. function=oxidoreductase activity; Cellular component=membrane; Biological process=electron transport
  Homolog annotation: Hit_ID=Q2HTZ1; Match level="QueryCoverage=99%, HitCoverage=79%, E-value=1e-167, Identity=69%"; Hit description=FAD linked oxidase, N-terminal; TonB box, N-terminal
  Pfam annotation: Domain name=BBE; Domain location=354-412; Score =105.1; E_value=2.1e-28; Accession=PF08031.2; Description=Berberine and berberine like
  Pfam annotation: Domain name=FAD_binding_4; Domain location=1-100; Score=3.8; E_value=0.0014; Accession=PF01565.13; Description=FAD binding domain
  Pfam module annotation: Pfam domain module=BBE::FAD_binding_4; Domain location=354-412::1-100
MEFRLGSEVVAMTVKAFLDVDIESGTAWAESGATLGDVYYHISEKSGVHGFPAGVCPTVGAGGHFSGGGYGNLMRKYGLSVDNIIDAKLVDVNGNILDRKSMGEDLFWAIRGGGGGSFGVILSWKIKLVYVTPKVTVFKVMRNLEDGAKGLVYKWQLIATKLHDDLFIRVMHDVVDGTQKAKNKTIKVTFIGLFLGKSDQMLSLVNESFPELGLKQSDCIEMPWINSTLYWFNYPIGTPIKALLDVPKEPLSYSFKTMSDYVKRPIRKSALKSMWKLMIKSESVRMEWNPYGGKMHEISPSETPFPHRAGNLFLIEYLTTWGQDGVDAANRYLNISRSFYEFMTPYVSHSPREAFLNYRDLDIGSNFPSNATNMNIAQSYGSKYFKGNFKRLVRVKSKVDPENFFRHEQSIPPLSH

SEQ ID NO: 118434 - protein, 102 aa, Glycine max
  Coding DNA Sequence Number=SeqID_1656
MEIFIQSIDPVAWNAIVKGPFIPTKEVNGQREAHGCVFQGRKTCGVATNVYLRKNVRKTKSGSMSFKNKRFKSCVFYARGRSTKAGLLLLRILNCDEELRPM

SEQ ID NO: 118435 - protein, 134 aa, Glycine max
  Coding DNA Sequence Number=SeqID_1657
  Gene Ontology: Mol. function=DNA binding; Cellular component =mitochondrion; Biological process=DNA integration
  Homolog annotation: Hit_ID=Q1SA33; Match level="QueryCoverage=98%, HitCoverage=17%, E-value=1e-29, Identity=40%"; Hit description =Integrase, catalytic region
MGELKFFVRLQIKQTPNGVYIHHTKYVKELLKKFNMNDAKEMKTLMHLTTYLGLDEESTKEDGTQYRAMIGSLLYLTSSRLDIMFSVCLFVRKSASGSYHFISGNLVTWICKKQGSTTLSTTEAEYMLATSCCA

SEQ ID NO: 118436 - protein, 174 aa, Glycine max
  Coding DNA Sequence Number=SeqID_1658
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-25, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TTRPRLRGLHVLTIRGLHVLTFRGLHILTFRGLHVLTMRGLHVLTIRGLHVLTFRGLHVLTFRGLHILAIRGLHVLTFRGLHVLTFRGLHVLTFRGLQVLNFRGLHVLALRGLYVLAIRGLHVLTIRGLHALAFRGQHVLPFRGLHALAFRGLHALTIIGLHVLPFRGLHALTF

SEQ ID NO: 118437 - protein, 220 aa, Glycine max
  Coding DNA Sequence Number=SeqID_1659
  Gene Ontology: Mol. function=electron carrier activity; Cellular component=integral to membrane; Biological process=cytochrome complex assembly
  Homolog annotation: Hit_ID=Q13LA1; Match level="QueryCoverage=83%, HitCoverage=29%, E-value=5e-54, Identity=60%"; Hit description =Putative transmembrane protein
MAPPTAGGCRSVLPLLPEPDDAAVAACLPRGRADPAQPLHPAGAAVRVRACRPPVPAQHAAVAAGHGTDLHRGRQPRRRGQPMGGAGQPGWTLDRPAADGVVRSRPAVATTGRPSAGTVPAGGRTAERARRCGRCRRAWRRVDLAADRHRHWPAVGTVRRTDPRSGADRRRPARCQRRHQHPAAGVCAGRDHRAGTGGVGGRSCVPCAAGAAWPRRRTTQ

SEQ ID NO: 118438 - protein, 111 aa, Glycine max
  Coding DNA Sequence Number=SeqID_1660
  Homolog annotation: Hit_ID=Q1SEN8; Match level="QueryCoverage=49%, HitCoverage=4%, E-value=6e-19, Identity=78%"; Hit description=Cyclic peptide transporter
VACWVSTEERQAARIRGLYLRAILWQDISFFDKETNTGEVVGRMSGDTLLIQEALGEKRNGERERERRRHFKEKMSLEEAHHHRRPWIRAWRKKEMNEGRGREEHEILCSK

SEQ ID NO: 118439 - protein, 68 aa, Glycine max
  Coding DNA Sequence Number=SeqID_1661
MRILRSIKPSTQVKATQSHAREQRPILEYNSIHPELTHLLLKFTHNFDSIRGTQAQGRSDRFSIRALT

SEQ ID NO: 118440 - protein, 314 aa, Glycine max
  Coding DNA Sequence Number=SeqID_1662
  Gene Ontology: Mol. function=kinase activity; Cellular component =intracellular; Biological process=regulation of transcription, DNA -dependent
  Homolog annotation: Hit_ID=Q1SFT4; Match level="QueryCoverage=87%, HitCoverage=52%, E-value=2e-95, Identity=64%"; Hit description =Bromodomain
  Pfam annotation: Domain name=Bromodomain; Domain location=148-237; Score=106.9; E_value=5.9e-29; Accession=PF00439.15; Description =Bromodomain
  Subcellular localization annotation: CTP_CleavageSite=86; ConfidenceScore=5.41e-01
MASAVLANRNEPNWQRHRGGGAGFMGKTPFSNPNSKLANSKRTQSASDDASSINRRSNDALTHSQYVTFNIASCTKKELNDFKNLLVSELEQIRKLRNQIESSEFQPGQSLNGHPKKPSSKKVSGNKRPWPSNSAKDLKRSHSEAGNLMKCCSQVLQKLMKHKHGWVFNAPVDIVGLKLHDYCDIIKQPMDLGTVKSNLSKNVYATPADFASDVRLTFNNALAYNPKGHDVYTMAEQLLARFEELYRPVHEKFEGSISHDRESEEELQASSWSHVEPERVKKKEKPPPPPPAKLQQEPPVPPASSSNPPLLQSP

SEQ ID NO: 118441 - protein, 64 aa, Glycine max
  Coding DNA Sequence Number=SeqID_1663
MSNYKTNFSWVENHLASLLYRIEYNLENITSKAVKEEMLQNDILLQTEVYAQLFMDQGTVESLS

SEQ ID NO: 118442 - protein, 154 aa, Glycine max
  Coding DNA Sequence Number=SeqID_1664
MWVGQSIGDEICPWVLREAFSAIDAFLIYDPTDGVDYSTVPKPDRGSGTEGDDFVMLPRVFVRAEGWRRPLFGFGFGFEGLTGGWAHVDDVDGGQTKVSSVWARKTRVDVKGSIVKEQCSLREDWFFFFSFFHSLCFHLIIISSVLALLNDEFS

SEQ ID NO: 118443 - protein, 62 aa, Glycine max
  Coding DNA Sequence Number=SeqID_1665
VEGSLRFEKCGRCCRAAQGYQIRGKGTRGERVFTVAKECLLTVEEEGKKSVPVRIFVSIQVF

SEQ ID NO: 118444 - protein, 202 aa, Glycine max
  Coding DNA Sequence Number=SeqID_1666
  Homolog annotation: Hit_ID=Q1SFT6; Match level="QueryCoverage=70%, HitCoverage=26%, E-value=5e-38, Identity=62%"; Hit description =Bromodomain
MSLEEKHKLGLGLQSLPPEKMEQVVQIIRRRNGHLKQDGDEIELDIEAVDTETLWELDRLVTNYKKMVSKIKRQALMGNTNNNNNDAQSNKGNGELPASEKVDGAPVEVKKAKKVEAGEEDIDIGDEMPTSMFPPVEIEKDKDVAGGRGSSSSSSSGSSSSDSSSSSVEAISVRKNLSLIAIADSDSGSSSGSDSEADNGLS

SEQ ID NO: 118445 - protein, 261 aa, Glycine max
  Coding DNA Sequence Number=SeqID_1667
  Gene Ontology: Mol. function=DNA-directed DNA polymerase activity; Biological process=transcription
  Homolog annotation: Hit_ID=Q9FGF4; Match level="QueryCoverage=85%, HitCoverage=17%, E-value=3e-62, Identity=58%"; Hit description =Arabidopsis thaliana genomic DNA, chromosome 5, BAC clone:T12B11
MKFLAVQGLFTASLGSEVTSFELQEKFRWPKSPTSNALCKMCIDQLQLLLANAQKGEGSCPLANSVEPNDLGSYFMKFFGTLCNIPSVSLFRSLDDVDQKAVKKLQAMETRLSREERSRDCSTDANRLHALRYLLIQLLLQVLLHPGEFSEAASELVICCKKAFSTSDLPESSGEDDVEVDDAPELMDVLVDTLLSLLPQSSAPMRSSIEQDWSDFTYSIKNEKDELPGFNGWYEHAIQKWMQPVTYLAMSDNRGDVEVLC

SEQ ID NO: 118446 - protein, 255 aa, Glycine max
  Coding DNA Sequence Number=SeqID_1668
  Gene Ontology: Mol. function=nucleotide binding; Biological process =translation
MENGVGEEMDGETSARVPLRERRVYPAHPSGLVRKRAYIFDCMGNFYHKDWDLADLFLKEEKESGVGEGRGNEFSWYHVELPKGNQKLSQSAQDLIGVFCPPLKLQDILSLVSNGPFCAHVDGALVFRVNSPGPPSSDFTFRIAARVTEHSVITVSLGRVPRLGFSRVGESLLSEIPSVESFSPLRGQQQERTVIKEHVLEFLLTMNHSEEADNPVPRSVSNLVVHIIDTHVDQIQDLVTKLEMELDSVELDLDN

SEQ ID NO: 118447 - protein, 680 aa, Glycine max
  Coding DNA Sequence Number=SeqID_1669
  Gene Ontology: Mol. function=DNA-directed DNA polymerase activity; Biological process=transcription
  Homolog annotation: Hit_ID=Q9FGF4; Match level="QueryCoverage=93%, HitCoverage=45%, E-value=1e-133, Identity=42%"; Hit description =Arabidopsis thaliana genomic DNA, chromosome 5, BAC clone:T12B11
MGSSSKKRSSATEEQTLAAADAPKPLIKKPKNTTTDDDSQQQQQPSVKPMERKKKRKALDKERRRTTSQPEPEHAASEPKPAPPSTDSPSSSGGVMPEFHIGVFKDLAAASESAREAAAKQMVTELKAVQNAYDSREEKESGEGGLKLEAEKDDGLDNCASSVRYAVRRLIRGVSSSRECARQGFALGLTVLAGTVHNIKVDSFLKLVVNLLEVTSSMKGQEAKDCLLGRLFAYGALARSGRLTQEWNMEKSTPYIREFISVLISLANKKRYLQEPAVSIILDLVEKIVYSHCLYPGTSSCENDWIASTFSMSDPCMHMSMCIDPHRHLQTTTCIIESVYAMSGSLSHRLPVEALVNHVLEAPGLQEWFEAAIEVGNPDALLLALKVREKISIDSSVFGKLLPNPFSSSQLFSADHLSSLSNCLKESTFCQPRVHSVWPVLINILLPNTILQLEDAASASNSLKKHKKSRKSSSSDEEIAKNLQNFCEIIIEGSLLISSHDRKHLAFDVLFLLLQKLPASLVPVVLSNKVVQCLVDVLSTKNTWLFKVAQHFLKQLSDWVGDDDVRRVSVIVAIQKHSNGKFDRITRTKHVKDFMSQFKTEPGCMLFIQNLMNLFVDEGNALEEPSDQSQTTDENSEIGSIEDKDSPRTNGNSDFLKSWVIESLPSILKFLKLDHEEKFR

SEQ ID NO: 118448 - protein, 187 aa, Glycine max
  Coding DNA Sequence Number=SeqID_1670
  Gene Ontology: Mol. function=nucleotide binding; Biological process =translation
MRTVTMTGMTVIAHGEQVYLRVKEKCSSKRWFASDDLNSLEELIGRLRRLKENVGFIVNRVTAIQAGLDSWQSEQINRKLYYLSFLSIIFLPLSIITGVFGMNVGGVPWTGQNAPELKDGFRNVILLCVAMLFLVLLCFIFPALYTRIAASWRNKRAMGRSWSLNRKSLLRRSLRIGEQERGGYLRI

SEQ ID NO: 118449 - protein, 186 aa, Glycine max
  Coding DNA Sequence Number=SeqID_1671
LQTRYRSANENTIALWAKNAGIGNIREENYCDPADSLADTLPVQGLHFTFLPLPLPLYNVNEPLPAKVAQLTTIWKEFAAKKIVIRDLRLVALPSQLLLAGIPDTPAIAMRQSFCDKVLDSDWKNELLMRHGNSPLPAPFWHSTLLRYSAEFLPAVLRQFFYEHRSINFGAVAGELMLAKTNYNWT

SEQ ID NO: 118450 - protein, 58 aa, Glycine max
  Coding DNA Sequence Number=SeqID_1672
MRGVYGGFWSIFVAREEEMDEDQWMYDSMMSQEVEMNVKNAQDAGIKVDCFDAFNTSE

SEQ ID NO: 118451 - protein, 75 aa, Glycine max
  Coding DNA Sequence Number=SeqID_1673
MIFEGETAADDECCKLLEDAAGEQKQKADVTRDVLTSWRRLVDLQLEEFPLCLITLIMEVADPTCLTAHTCSGSV

SEQ ID NO: 118452 - protein, 221 aa, Glycine max
  Coding DNA Sequence Number=SeqID_1674
  Gene Ontology: Mol. function=motor activity; Cellular component =membrane; Biological process=ciliary or flagellar motility
  Homolog annotation: Hit_ID=Q7CIY9; Match level="QueryCoverage=94%, HitCoverage=70%, E-value=1e-103, Identity=93%"; Hit description =Proton conductor component of motor
MDLMALLFRLLAKSRQQGMLSLEFDIDNPQESEIFSNYPRILADNTLVEFITDYLRLMVSGNMNAFEIEALMDEEIETYEQESEVPAGSLAMVGDSLPAFGIVAAVMGVVHALASADRPAAELGALIANAMVGTFLGILLAYGFISPLATLLRQKSAENVKMMQCIKVTLLSSLNGYAPQIAVEFGRKTLYTTERPSFVELEEHVRRVKAPAQQATEEEEA

SEQ ID NO: 118453 - protein, 544 aa, Glycine max
  Coding DNA Sequence Number=SeqID_1675
  Gene Ontology: Mol. function=oligopeptide transporter activity; Cellular component=integral to membrane; Biological process =oligopeptide transport
  Homolog annotation: Hit_ID=Q1T3R4; Match level="QueryCoverage=93%, HitCoverage=72%, E-value=0.0, Identity=79%"; Hit description =Peptidase aspartic, active site; Oligopeptide transporter OPT superfamily
  Pfam annotation: Domain name=OPT; Domain location=4-508; Score=471.5; E_value=1e-138; Accession=PF03169.6; Description=OPT oligopeptide transporter protein
MWKRLTHYVGDLVGMATVDLKKQQHVTHDEFYLSKQALHEKDDHRLSRAKFFFIALSVTAQQIGSGMRGLGVGALTLDWAAVASFLFSPLISPFFAIVNVFVGYALIVYVVIPVSYWGLNVYNANRFPIFSSHLFTAQGQKYNIPKIVDNHFELNVAEYEKQGRIHLSVFFALTYGFGFATIASTLTHVVCFYGREIMERYRASSKGKEDIHTKLMRRYKDIPSWWFHSLLLVTLLVSLALCIFLKDQVQMPWWGLLFAGVLAFGFTLPISIITATTNQTPGLNIITEYVFGLIYPGRPIANVCFKTYGYISMAQAVSFLSDFKLGHYMKIPPRSMFLVQFIGTMLAGTINIGVAWWLLNSIKNICHDDLLPEGSPWTCPGDRVFFDASVIWGLVGPKRIFGSQGNYSAMNWFFLGGAVGPIIVWLLHKAFPKQSWIPLINLPVLLGATGMMPPATPLNYNAWIFVGTIFNFFIFRYRKKWWQRYNYVLSAALDSGVAFMTVLLYFALGLENKSLNWWGNDGEHCPLAVCPTAKGVIVDGCPAN

SEQ ID NO: 118454 - protein, 490 aa, Glycine max
  Coding DNA Sequence Number=SeqID_1676
  Gene Ontology: Mol. function=binding; Cellular component=thylakoid; Biological process=photosynthesis
  Homolog annotation: Hit_ID=Q1T1X0; Match level="QueryCoverage=73%, HitCoverage=62%, E-value=1e-106, Identity=54%"; Hit description=IMP dehydrogenase/GMP reductase
  Pfam annotation: Domain name=TPR_1; Domain location=211-245; Score =3.8; E_value=1.9; Accession=PF00515.18; Description=Tetratricopeptide repeat
  Pfam annotation: Domain name=TPR_1; Domain location=25-58; Score =34.0; E_value=5.2e-07; Accession=PF00515.18; Description =Tetratricopeptide repeat
  Pfam annotation: Domain name=TPR_1; Domain location=258-291; Score =13.3; E_value=0.14; Accession=PF00515.18; Description=Tetratricopepti de repeat
  Pfam annotation: Domain name=TPR_1; Domain location=292-325; Score =31.3; E_value=3.4e-06; Accession=PF00515.18; Description =Tetratricopeptide repeat
  Pfam annotation: Domain name=TPR_1; Domain location=326-359; Score =21.1; E_value=0.004; Accession=PF00515.18; Description =Tetratricopeptide repeat
  Pfam annotation: Domain name=TPR_1; Domain location=59-92; Score =20.5; E_value=0.006; Accession=PF00515.18; Description =Tetratricopeptide repeat
  Pfam annotation: Domain name=TPR_1; Domain location=93-126; Score =3.9; E_value=1.8; Accession=PF00515.18; Description=Tetratricopeptide repeat
  Pfam annotation: Domain name=TPR_2; Domain location=211-245; Score =5.0; E_value=8.6; Accession=PF07719.7; Description=Tetratricopeptide repeat
  Pfam annotation: Domain name=TPR_2; Domain location=25-58; Score =30.3; E_value=7e-06; Accession=PF07719.7; Description=Tetratricopepti de repeat
  Pfam annotation: Domain name=TPR_2; Domain location=258-291; Score =14.3; E_value=0.44; Accession=PF07719.7; Description=Tetratricopeptid e repeat
  Pfam annotation: Domain name=TPR_2; Domain location=292-325; Score =19.9; E_value=0.0091; Accession=PF07719.7; Description =Tetratricopeptide repeat
  Pfam annotation: Domain name=TPR_2; Domain location=326-359; Score =19.7; E_value=0.01; Accession=PF07719.7; Description=Tetratricopeptid e repeat
  Pfam annotation: Domain name=TPR_2; Domain location=59-92; Score =23.5; E_value=0.00076; Accession=PF07719.7; Description =Tetratricopeptide repeat
  Pfam annotation: Domain name=TPR_4; Domain location=168-193; Score =0.7; E_value=31; Accession=PF07721.5; Description=Tetratricopeptide repeat
  Pfam annotation: Domain name=TPR_4; Domain location=25-50; Score =10.4; E_value=2.2; Accession=PF07721.5; Description=Tetratricopeptide repeat
  Pfam annotation: Domain name=TPR_4; Domain location=93-118; Score =7.5; E_value=4.8; Accession=PF07721.5; Description=Tetratricopeptide repeat
  Pfam annotation: Domain name=Thioredoxin; Domain location=410-488; Score=-0.2; E_value=0.00017; Accession=PF00085.10; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_4::TPR_4::TPR_4::Thioredoxin; Domain location=211-245::25 -58::258-291::292-325::...
  Pfam module annotation: Domain location=326-359::59-92::93-126::211 -245::25-58::258-291::292-325::326-359::59-92::168-193::25-50::93 -118::410-488
MGNIMRKNSDELGQFRSLRNSRVDPEVLKSMGNEAYKQGRFEEALALYDRAIAVDSKKATYHCNKSAALISLGRFLQAIVECEEAIRLEPSYGRAHTRLATIYFRLGEAEKALNCNETSPCVDSVLAFQAQALQNHLSKCTEARKVKDWKVILKESQAAISLGADSAPLVYCLHTEALLKLLRHQEAHATYEKMPKFDLDYSNKLFGPVRSAYLLMIGTHIYLATGRFEDAVIASQQASKLDPSSFEVNAVVRRARAVASARMSGNLLFKASKFTEAYAVYNEGLEHDPFNSVLLCNRAACRSKLGQFEKAIEDCNVALIVQPSYSKARLRRADCNAKLERWEAAIQDYEMLLREKPGDEEVARALFETQLQLKTLRGEDIKDLKFGSNLFFISSNDRFRHYVTSPGMSVVLFCNKATHKQVLLVLEQTCKRFPSVNFLKVEIEDHPYLAKSEGVNCIPAFKIYKNGSRVKEIPGSNHDLLEKLVKLYSN

SEQ ID NO: 118455 - protein, 613 aa, Glycine max
  Coding DNA Sequence Number=SeqID_1677
  Gene Ontology: Mol. function=protein binding; Cellular component =nucleus; Biological process=rRNA processing
  Homolog annotation: Hit_ID=Q1T3P7; Match level="QueryCoverage=90%, HitCoverage=100%, E-value=0.0, Identity=76%"; Hit description =Inorganic pyrophosphatase; WD40-like
  Pfam annotation: Domain name=WD40; Domain location=301-339; Score =13.9; E_value=0.57; Accession=PF00400.22; Description=WD domain, G -beta repeat
  Pfam annotation: Domain name=WD40; Domain location=346-383; Score =0.4; E_value=33; Accession=PF00400.22; Description=WD domain, G-beta repeat
  Pfam annotation: Domain name=WD40; Domain location=432-469; Score =25.7; E_value=0.00016; Accession=PF00400.22; Description=WD domain, G-beta repeat
  Pfam annotation: Domain name=WD40; Domain location=475-512; Score =13.1; E_value=1; Accession=PF00400.22; Description=WD domain, G-beta repeat
  Pfam annotation: Domain name=WD40; Domain location=568-606; Score =5.3; E_value=8.7; Accession=PF00400.22; Description=WD domain, G -beta repeat
  Pfam module annotation: Pfam domain module=WD40::WD40::WD40::WD40::WD4 0; Domain location=301-339::346-383::432-469::475-512::568-606
  Subcellular localization annotation: CTP_CleavageSite=65; ConfidenceScore=5.13e-01
MDRGSGESGPGNSGHGPAQEQKPNPFAKTLGAVFLSELKPKTVKRLRRHLATTVSFNSELMSLISQNARSKNEVNKNKREVEDDVENNDTLEVKKKKKDHEREQSTVEQVKEMKKLENFLFGSLYSPLVFGKDDDEVEPRKAAEKVSDLFFTDRSADSVLTVYQEEDADLSEGSHDDDDRPLQRKPVWMDDEEENATVNIAKVNRLRKLRKVEDEDLISGLEYVSRLRAQHVKLNPGTEWARVDSRIDRSSDDESTDDENEAVVSQGYGDMDVDDVLRTNEDLVVKSGSKLLPGHLEYSRLVNANIQDPANGPINSVQFHPNAQLFLAAGLDRKLRFFQIDGKRNTTIQSVFLEDCPIRKASFLPDGSQVIVSGRRKFFYSFDLVKARVDKIGPLVGREEKSLEVFEVSPDSQMIAFTGNEGYILLVSTKTKQLVGTLKMNGTIRSLAYTENGQKLLSSGGDGQVYHWDLRTMTCLHKGVDEGCINGTTLCTSPSGTYFAAGSDSGIVNIYNREEFLGGKRKPIRTIENLTTKVDFMRFNHDSQILAICSGMKKSSLKLIHIPSYSVFSNWPPSNTSLHYPRCIDFSPGGGFMVVGNASGKVLLYKLHHYQHA

SEQ ID NO: 118456 - protein, 499 aa, Glycine max
  Coding DNA Sequence Number=SeqID_1678
  Gene Ontology: Mol. function=oxidoreductase activity, acting on the CH-OH group of donors, NAD or NADP as acceptor; Cellular component =cytoplasm; Biological process=lignin biosynthetic process
  Homolog annotation: Hit_ID=Q1T3P8; Match level="QueryCoverage=71%, HitCoverage=100%, E-value=1e-180, Identity=85%"; Hit description =Alcohol dehydrogenase superfamily, zinc-containing; D-isomer specific 2-hydroxyacid ...
  Homolog annotation: Hit description=dehydrogenase, NAD-binding
  Pfam annotation: Domain name=ADH_N; Domain location=176-292; Score =114.1; E_value=4.1e-31; Accession=PF08240.2; Description=Alcohol dehydrogenase GroES-like domain
  Pfam annotation: Domain name=ADH_zinc_N; Domain location=323-457; Score=101.7; E_value=2.2e-27; Accession=PF00107.16; Description=Zinc- binding dehydrogenase
  Pfam module annotation: Pfam domain module=ADH_N::ADH_zinc_N; Domain location=176-292::323-457
MDDDFEKGHEVLGSATSKFAVREAWTRESQQGVKEYATQVKIIRQLRHKNLIASGRKPIYLNAKEGQVTIVEWVWELYELGEILKVADPKLCGAFDEEQMERLLLISVIVNSASVSFAPSTCNHEIIMSSAALMIDDFGRKIMSSKGVGEDCLGWAARDASGVLSPYKFSRRTPGNEDVLIKITHCGVCFADVVWTRNKHGDSKYPVVPGHEIAGIVTKVGSNVHRFKVGDHVGVGTYVNSCRDCEHCNDREEVHCTKGSVFTFNGVDFDGTITKGGYSSYIVVHERYCFTIPKSYALASAAPLLCAGITVYSPMVRHKMNQPGKSLGVIGLGGLGHMAVKFGKAFGLSVTVFSTSISKKEEALSLLGADKFVVSSNQEEMTALAKSLDFIIDTASGDHPFDPYMSLLKTYGVFVLVGFPSQVKFSPASLNIGSKTVAGSVTGGTKDIQEMIDFCAANEIHPNIEVIPIEYANEALERLINRDVKYRFVIDIENSLKEK

SEQ ID NO: 118457 - protein, 666 aa, Glycine max
  Coding DNA Sequence Number=SeqID_1679
  Gene Ontology: Mol. function=protein serine/threonine kinase activity; Cellular component=cell surface; Biological process =protein amino acid phosphorylation
  Homolog annotation: Hit_ID=Q1SFV7; Match level="QueryCoverage=97%, HitCoverage=98%, E-value=0.0, Identity=55%"; Hit description=Protein kinase; Concanavalin A-like lectin/glucanase
  Pfam annotation: Domain name=Lectin_legB; Domain location=33-263; Score=177.6; E_value=3e-50; Accession=PF00139.10; Description=Legume lectin domain
  Pfam annotation: Domain name=Pkinase; Domain location=342-596; Score =141.6; E_value=2.1e-39; Accession=PF00069.15; Description=Protein kinase domain
  Pfam annotation: Domain name=Pkinase_Tyr; Domain location=342-596; Score=94.0; E_value=4.5e-25; Accession=PF07714.7; Description =Protein tyrosine kinase
  Pfam module annotation: Pfam domain module=Lectin_legB::Pkinase::Pkina se_Tyr; Domain location=33-263::342-596::342-596
MATYQYCICKCSHLLPYLGITIAILSFLIPHAAPLDFSFQQFLNKESTLNFEGDVSYDNGLLQLTQLKKDSVGRVTYYKPLHLWVKDSRKLTDFTSNFSFIINQPNKTHIGDGITFFLASPKFPLPVPPDGSGIGLVSGQQMADPNYINEHPFVAVEFDTFWNHFDPQYDHVGINIKTIKSPFTTEWFSINDGRVHDAQISYNSSTCNLSIIFTGYEDNVTVKQHYSQVIDLREVLPDWVEFGFSSATGLLSEIHTLCSWSFSANLDLKVHKDESKTRMVIGLSIGGGVLVVGIGLAWLLKLKMKTRGKEDDLDLIMDSDFERGTGPKRFSYNELVRTTNNFANELKLGEGGFGGVYKGFIRELGVEEYASEVKIISKLRHRNLVQLLGWCHKKNDLLLIYELMPNGSLDSHLFGGKSLLTWAARYNIAGGLASALLYLHEEWEQCVLHRDLKSSNVMLDSNFNAKLGDFGLARLVDHGKGSQTTVLAGTMGYMAPESATRGKASRESDVYSFGVVVLEIACGRKPIELRASEEQIVMVEWVWELYGMGNLLEAADSRLCGDFDEQAMERLMIVGLWCAHPDYSARPTIREAMHVLNFEAHLPSLPSKMPKATYIVPSITASASSNPPSSSADAFGPNKTELLSSGSYTGSPESKTSAALLHSIEY

SEQ ID NO: 118458 - protein, 417 aa, Glycine max
  Coding DNA Sequence Number=SeqID_1680
  Gene Ontology: Mol. function=protein serine/threonine kinase activity; Cellular component=cell surface; Biological process =protein amino acid phosphorylation
  Homolog annotation: Hit_ID=Q1SFV2; Match level="QueryCoverage=98%, HitCoverage=99%, E-value=1e-103, Identity=58%"; Hit description =Protein kinase; Concanavalin A-like lectin/glucanase
  Pfam annotation: Domain name=Pkinase; Domain location=161-379; Score =47.3; E_value=2.2e-11; Accession=PF00069.15; Description=Protein kinase domain
  Pfam annotation: Domain name=Pkinase_Tyr; Domain location=161-379; Score=-39.6; E_value=4.9e-10; Accession=PF07714.7; Description =Protein tyrosine kinase
  Pfam module annotation: Pfam domain module=Pkinase::Pkinase_Tyr; Domain location=161-379::161-379
MAPCHVGLRATNHLFCYARGISFLLMITFVNPLSFHYQGFEYDDARIEGDATLAHSEIQLTSATKYQSNAYSVGRVTSFNDENVSNQIPPMAASPVPNPSPTATANISPKQEANKGLLKGIEIGIGIAASFLILGMDDEFQKGIGPKRFCYKELVSATNNFAEAQKIRQCGFGGVYRGYLKDLNSNVAIKRISRESKQGIKEYANEIKIISQLRHRNLVQLIGWCHMKKDLLIYEFMQNGSLDSHLYRGKSILTWQMRDIKSSNAMLDSSFNAKLGDFGLAGLVDHDKGPQTTVLAGTMGYIAPEYCTTGKARKESDIIQFWGCFVGLYRLGKLLKVVDSKLGGAFDEEQMGHLVIAGLWCVNPDYTSRPSVRQVIQVLKFETPLPVLPQKMPDPFCRSPTMSTIFASVSSPSLALC

SEQ ID NO: 118459 - protein, 101 aa, Glycine max
  Coding DNA Sequence Number=SeqID_1681
MALEGRALAWFQWGIEQELFMCIFLNLLNEEIRVEVTLYEPRSLRIDKEGVDGREESSGGKDWVSGGAILKIVIEVTLAQEQSRLRLKQKVNEWRLKRVEI

SEQ ID NO: 118460 - protein, 339 aa, Glycine max
  Coding DNA Sequence Number=SeqID_1682
  Pfam annotation: Domain name=DUF593; Domain location=109-202; Score =73.6; E_value=6.3e-19; Accession=PF04576.6; Description=Protein of unknown function, DUF593
  Subcellular localization annotation: CTP_CleavageSite=42; ConfidenceScore=5.07e-01
MQTLGLLVAPVLGFYQRFLRFSLRFLLLMFMDFPSTFKFITQASELGCGFLLLGYFSRLFNLLGLLLIFFFCLRFLRSPLLLSNHEKSSSSRDENSKEEESLEDEVFDVMSLRKMVKEERQRYNAACAEIEQEQGAAASAAEEAMAMILRLQSEKSAVEIQAKQFRRVVEQKQEYDLEVIESLRWTVVQVESQKNLLERQLGVLRERLRQFVNDQEIQQLQEEQELQGTASDDDDDGDEDSSGFLNFSIEYDDVDASSSSNHSPTHTPQHFYTICVNMRVSVVMVGNRFKVGSGIWHLMNEKATWYWSLNQSDGPVGACRVMWEALIGEEPFFSTLLLL

SEQ ID NO: 118461 - protein, 450 aa, Glycine max
  Coding DNA Sequence Number=SeqID_1683
  Gene Ontology: Mol. function=methylmalonate-semialdehyde dehydrogenase (acylating) activity; Cellular component =mitochondrion; Biological process=valine metabolic process
  Homolog annotation: Hit_ID=Q2HV89; Match level="QueryCoverage=90%, HitCoverage=86%, E-value=0.0, Identity=75%"; Hit description =Aldehyde dehydrogenase
  Pfam annotation: Domain name=Aldedh; Domain location=30-430; Score =398.2; E_value=1.2e-116; Accession=PF00171.12; Description=Aldehyde dehydrogenase family
MANSHLSTPSELFSRQHKPPRVPNLIGGSFLDSKSLTFIDVINPATQEVVSQVPCTTDEEFKAAVSAAKKAFPSWRKTPITKRQRVMLKFQELIRRDMDKLALNVTTEQGKTLKDAQGDVFRGLEVVEHACGMATLQMGEYVSDVSSGIDTYSIREPLGVCAGICPFNFPAMIPLWMFPVAVTCGNTFILKPSEKVPGASVMLAELAMEAGLPEGVLNIVHGTHDIVNAICDDDDIKAISFVGSNVAGMHIYARAAAKGKRVQANMGAKNHAVVMPDASVDATVNALVAAGFGAAGQRESKLVEHAKALKVNVGTEPDADLGPVISKQVPGYESGNFIGPTILSDVTANMECYKEEIFGPVLLLTEADNLEEAINIINENKYGNGASIFTTSGVAARKFQTEIEAGQEVHALSAECHAKRAYEGPKPTSAAINRESVQGTEHTPPQNPLS

SEQ ID NO: 118462 - protein, 311 aa, Glycine max
  Coding DNA Sequence Number=SeqID_1684
  Gene Ontology: Mol. function=transferase activity, transferring glycosyl groups; Cellular component=cytoplasm; Biological process =metabolic process
  Homolog annotation: Hit_ID=Q9ZWS2; Match level="QueryCoverage=99%, HitCoverage=67%, E-value=1e-136, Identity=78%"; Hit description =Flavonoid 3-O-galactosyl transferase
  Pfam annotation: Domain name=UDPGT; Domain location=1-311; Score= -117.5; E_value=0.00011; Accession=PF00201.9; Description=UDP -glucoronosyl and UDP-glucosyl transferase
SAHFHTDLIRQKCANNSDTNTPLDFIPGLSKMRVEDLPEDVINSGSEEETLFSKTLASLGSVLPQAEEVVVNFFVELDPTSLVHDMRSKLKCFLYVGFLTLSLPLPPLPPSDTDATGCLSWLDHKKKKNGGSVAYVSFGTVVTPPPHEIVAVAEALEASGFPFLWSLKEHLKDLLPRGFLERTSENGKVVAWAPQTEVLGHGSVGVFVTHCGCNSVFENMCNGVPMVCRPFFGDHGLTGRMVEDVWEIGVRVEGGVFTKDGLVKCLRLVLVEEKGKRMKENALKVKKTVLDAAGPQGKAAQDFKTLVEVVT

SEQ ID NO: 118463 - protein, 175 aa, Glycine max
  Coding DNA Sequence Number=SeqID_1685
  Gene Ontology: Mol. function=hydrolase activity, hydrolyzing O -glycosyl compounds; Biological process=carbohydrate metabolic process
  Homolog annotation: Hit_ID=Q1T2S0; Match level="QueryCoverage=47%, HitCoverage=25%, E-value=5e-27, Identity=52%"; Hit description =Glycoside hydrolase, family 1
MVVLSPKIEQDLANYAEVCFREFGDRLKHWITLNEPVLYNSGGYEMLQASQKGQIGVTLNSAWVVPLVQSKEDREAAYRGLAFMYDCVVKWRPWRRHGGFLWRIFEKTPPNSGGVAGLGWRCHGGRHSHGGRGGYGGVTEMAVFFLLFVRGRSWADPTQLYPVIHSTKRPSHVAL

SEQ ID NO: 118464 - protein, 574 aa, Glycine max
  Coding DNA Sequence Number=SeqID_1686
  Gene Ontology: Mol. function=binding; Cellular component =intracellular; Biological process=protein amino acid phosphorylation
  Homolog annotation: Hit_ID=Q1T3P3; Match level="QueryCoverage=99%, HitCoverage=97%, E-value=0.0, Identity=71%"; Hit description =Tetratricopeptide-like helical
  Pfam annotation: Domain name=PPR; Domain location=193-227; Score =42.1; E_value=1.9e-09; Accession=PF01535.11; Description=PPR repeat
  Pfam annotation: Domain name=PPR; Domain location=295-329; Score =36.2; E_value=1.2e-07; Accession=PF01535.11; Description=PPR repeat
  Pfam annotation: Domain name=PPR; Domain location=330-364; Score=2.3; E_value=4; Accession=PF01535.11; Description=PPR repeat
  Pfam annotation: Domain name=PPR; Domain location=396-430; Score =48.4; E_value=2.3e-11; Accession=PF01535.11; Description=PPR repeat
  Pfam annotation: Domain name=PPR; Domain location=431-465; Score=6.6; E_value=1.2; Accession=PF01535.11; Description=PPR repeat
  Pfam annotation: Domain name=PPR; Domain location=467-501; Score=5.2; E_value=1.8; Accession=PF01535.11; Description=PPR repeat
  Pfam annotation: Domain name=PPR; Domain location=91-125; Score=32.6; E_value=1.3e-06; Accession=PF01535.11; Description=PPR repeat
  Pfam module annotation: Pfam domain module=PPR::PPR::PPR::PPR::PPR::PP R::PPR; Domain location=193-227::295-329::330-364::396-430::431 -465::467-501::91-125
  Subcellular localization annotation: CTP_CleavageSite=32; ConfidenceScore=5.64e-01
MAFFTRRLLTTVAPTCSSPSNQIKSFLSKVIKASSSAQCHTFGTQLHCLALKTGSHSETVVSNSIITMYFKFSDVGSARQVFDTMPHRDPITWNSLINGYLHNGYLEEALEALNDVYLLGLVPKPELLASVVSMCGRRMGSKIGRQIHALVVVNERIGQSMFLSTALVDFYFRCGDSLMALRVFDGMEVKNVVSWTTMISGCIAHQDYDEAFACFRAMQAEGVCPNRVTSIALLSACAEPGFVKHGKEIHGYAFRHGFESCPSFSSALVNMYCQCGEPMHLAELIFEGSSFRDVVLWSSIIGSFSRRGDSFKALKLFNKMRTEEIEPNYVTLLAVISACTNLSSLKHGCGLHGYIFKFGFCFSISVGNALINMYAKCGCLNGSRKMFLEMPNRDNVTWSSLISAYGLHGCGEQALQIFYEMNERGVKPDAITFLAVLSACNHAGLVAEGQRIFKQVRADCEIPLTIEHYACLVDLLGRSGKLEYALEIRRTMPMKPSARIWSSLVSACKLHGRLDIAEMLAPQLIRSEPNNAGNYTLLNTIYAEHGHWLDTEQVREAMKLQKLKKCYGFSRIEA

SEQ ID NO: 118465 - protein, 163 aa, Glycine max
  Coding DNA Sequence Number=SeqID_1687
  Gene Ontology: Mol. function=transferase activity; Cellular component= membrane
  Homolog annotation: Hit_ID=Q6ZIF8; Match level="QueryCoverage=50%, HitCoverage=20%, E-value=8e-28, Identity=69%"; Hit description =Putative pectin-glucuronyltransferase
MPVSRENSFWAVRNRARSSCRYAVAVLSDTRVCIAGYVLVLFIIYTKQHSDLPSYSDSDAHRRTLPFSSGVFHSPEEAFRFDYEKMEEEFKIFVYPDGDPETYFHTPRKLTGKYASEGYFFKNIRESRFFTDDPRRAHLFFLPISCHKMRGRVCPPLRDYALL

SEQ ID NO: 118466 - protein, 135 aa, Glycine max
  Coding DNA Sequence Number=SeqID_1688
  Gene Ontology: Mol. function=transferase activity; Cellular component= membrane
  Homolog annotation: Hit_ID=Q6ZIF8; Match level="QueryCoverage=97%, HitCoverage=32%, E-value=1e-38, Identity=56%"; Hit description =Putative pectin-glucuronyltransferase
  Pfam annotation: Domain name=Exostosin; Domain location=2-126; Score=- 109.7; E_value=0.051; Accession=PF03016.6; Description=Exostosin family
MNMQGLTIERMIDEVEKYVEHLKLKYPYWNRTLGADHFFVTCHDIGVKATKGVPHLTKNSIRVACSSSYDDDDYVPHKDVTLPQVQLPFFHPPGENDIKNRNTFAFWAGRSDSRLKDDLMAMWDNDTELDIQNKS

SEQ ID NO: 118467 - protein, 502 aa, Glycine max
  Coding DNA Sequence Number=SeqID_1689
  Gene Ontology: Mol. function=RNA binding
  Homolog annotation: Hit_ID=Q2HVA1; Match level="QueryCoverage=99%, HitCoverage=69%, E-value=1e-141, Identity=49%"; Hit description=KH, type 1
  Pfam annotation: Domain name=KH_1; Domain location=146-201; Score =39.9; E_value=8.6e-09; Accession=PF00013.19; Description=KH domain
  Pfam annotation: Domain name=KH_1; Domain location=358-426; Score =42.7; E_value=1.2e-09; Accession=PF00013.19; Description=KH domain
  Pfam annotation: Domain name=KH_1; Domain location=450-502; Score =40.4; E_value=6.1e-09; Accession=PF00013.19; Description=KH domain
  Pfam annotation: Domain name=KH_1; Domain location=46-106; Score =41.9; E_value=2.2e-09; Accession=PF00013.19; Description=KH domain
  Pfam annotation: Domain name=KH_2; Domain location=146-189; Score =6.1; E_value=0.022; Accession=PF07650.7; Description=KH domain
  Pfam annotation: Domain name=KH_2; Domain location=46-96; Score=6.9; E_value=0.018; Accession=PF07650.7; Description=KH domain
  Pfam module annotation: Pfam domain module=KH_1::KH_1::KH_1::KH_1::KH_ 2::KH_2; Domain location=146-201::358-426::450-502::46-106::146 -189::46-96
  Subcellular localization annotation: CTP_CleavageSite=52; ConfidenceScore=5.68e-01
MGSNFLSPPAKRSAPDPYPFHPNGPSKRSRQSKPPPPLSVPPGHVAFRLLCNASRIGGVIGKSGSVIKTLQQSTGAKIRIEDAPQELPDRIILVIADAALSGKILLRNEEVIEVSKAQEALLKVFDRILEVAAETVGHDVGDRVMSCRLVADAAQAGSVIGKGGKVVERIKKETGCKIRVLTDDLPLCASASDEIIEVFLLPALLRFSICHSTFRILLRDVRCQKTYLDILEVEKIEGRVSSVKKALVAVSQRLQDCHPVDRTKMMGSKPYEIVQYEALDALPRATSTAAPRVTLTAAPRGTLTAVQHETVDHLLLRSSALSTLSSSSNSYATRIHSLPTEVNRVSSLEPKALKQEVTFRILCSNDRVGGVIGKGGNIVRALQSETGATISIGPAVAECEDRLITIAASENPESRYSPAQKAAVLVFSRSIEVGFEKGLDSGLNKGSIVTVRLVVPSSQVGCLIGKGGVIVSEMRKATGANIRIIGTDQVPKCASDNDQVVQ

SEQ ID NO: 118468 - protein, 71 aa, Glycine max
  Coding DNA Sequence Number=SeqID_1690
MFVLIGALKGFDDTPQSKLKVVARWIVVKCNRKNGNIECRHYVMHWMSTIILGSFKNNWETTIGTTKNEGT

SEQ ID NO: 118469 - protein, 259 aa, Glycine max
  Coding DNA Sequence Number=SeqID_1691
  Gene Ontology: Mol. function=transcription factor activity; Cellular component=intracellular; Biological process=regulation of transcription, DNA-dependent
  Homolog annotation: Hit_ID=Q0T1X0; Match level="QueryCoverage=96%, HitCoverage=64%, E-value=1e-79, Identity=64%"; Hit description =Putative NAGC-like transcriptional regulator
  Pfam annotation: Domain name=ROK; Domain location=36-211; Score=44.7; E_value=3.1e-10; Accession=PF00480.10; Description=ROK family
MQHSSATLSTRGNSNGSFQLPAEGAWTLCLCVKPTSIELQLADAQLVAQGDYQQISINAQTPEQLLAEIETVWRATCKRWPKRQINLALAVHGQVDPVTGVSQHMPQAAWRSPLQLKFLLEEKLAVDVRVDNDCVMLALAEKWLNRNALAEFCVINVDYGIGSSFVINGEIFRGNLYGSGQIGHTIIDPRGERCNCGRQGCLETVASLSTLKRLAHQRAPQLCSPPAVSCWPPGSRRAVDRRVGAAQRGSHRHESVQFP

SEQ ID NO: 118470 - protein, 138 aa, Glycine max
  Coding DNA Sequence Number=SeqID_1692
  Subcellular localization annotation: CTP_CleavageSite=47; ConfidenceScore=5.07e-01
MEVELSVPCYAKPKGHFGKAELSAPCCAKPKPFSVLKIMASKKRKSSASSSTQARYDRSRFHSQEAWERYTDIIVPRKLLPERNVVVYYTEFDDFKEELERRKWDEELTNFDEGSIDVAIVKEFYANLYDPEDNSLKQ

SEQ ID NO: 118471 - protein, 651 aa, Glycine max
  Coding DNA Sequence Number=SeqID_1693
  Gene Ontology: Mol. function=cysteine-type peptidase activity; Biological process=proteolysis
  Homolog annotation: Hit_ID=Q2HVA8; Match level="QueryCoverage=29%, HitCoverage=96%, E-value=2e-63, Identity=66%"; Hit description =Peptidase C48, SUMO/Sentrin/Ubl1
  Pfam annotation: Domain name=Peptidase_C48; Domain location=96-336; Score=124.6; E_value=2.7e-34; Accession=PF02902.9; Description=Ulp1 protease family, C-terminal catalytic domain
MGEGCCTQSYPCICKEAVSGFEPMTNKSPRHNFTAAPGLALFLRLHFIPPCSIDEENNGNISALGKDCFFSQKHYFPNFDEAFDEVIYPMGEPDAVSISMRDIELLQPQTFINDTIIDFYIKYLKSKLPTDEQNRFHFFNSFFFRKLADLDKDSSSACDGRAAFQRVRKWTRKVNLFEKDYIFIPVNYSIWILLPLKNYMCLDDSLHWSLIAICHPGEVTCFKEINESSKVACILHMDSLRGSHKGLKNVFQSYLCEEWKERHSNVVDDVSSKFLHLRFISLELPQQENLYDCGLFLLHYVERFLEEAPMNFNPFMITKSSNFLSSNWFPPPEASLKRSHIQNLIYDIFENNSLHAPPTDCLDKGHPSEDPSIIVNPKVEEDSLRGCYPALWHGKNPSNSSTELETTDIQYPTASHIRVPICLTGSGLVSKDLQAAVVTSHSDCLQMPACHQRGFLSPLEEIEESGEETALSLERENSQVGILAYDFPSTYVSNDHRASETFQDGFSVNFVEAVESHSHSRTSNTATHEDQPLEKIEESSIPDKIVLEYLSTSGSGDDVKDYIVPDSPDANDVDVSVKSRSSVRNNMNSAAHQIFDLTHNASVEDNTLVSKEEPLAFDSDERDAKRPKLMNAGGPSRRFTRSMIKRTCNVV

SEQ ID NO: 118472 - protein, 150 aa, Glycine max
  Coding DNA Sequence Number=SeqID_1694
  Gene Ontology: Mol. function=RNA-directed DNA polymerase activity; Biological process=RNA-dependent DNA replication
  Homolog annotation: Hit_ID=Q1SSM4; Match level="QueryCoverage=50%, HitCoverage=51%, E-value=3e-10, Identity=35%"; Hit description =Rhodopsin-like GPCR superfamily
MGKKGRNGWFQHNIGREVGLGSEVSFWHSKWLGEESLCCKFNRVYLNSEQKDNSVLEVGYWHDVLAWKRAWFQWETPIVQQLWNIIENFLPKKTPKIDGFRIKWEQKLCGQGGLQCPSKGGIFGNWENFLIYLEITYSFQDQRVYMENSS

SEQ ID NO: 118473 - protein, 475 aa, Glycine max
  Coding DNA Sequence Number=SeqID_1695
  Gene Ontology: Mol. function=transferase activity; Cellular component= membrane
  Homolog annotation: Hit_ID=Q6Z527; Match level="QueryCoverage=80%, HitCoverage=69%, E-value=1e-135, Identity=59%"; Hit description =Exostosin family-like protein
  Pfam annotation: Domain name=Exostosin; Domain location=99-426; Score= 379.8; E_value=4.2e-111; Accession=PF03016.6; Description=Exostosin family
MSDKNMVPSRFIFCVIVIAVFLLVLSSFFLIHLSNHSFIPRSVSELVLVNNTSLDFKPNFKREQVQPQSCQFSNSSHKPSSPRQQRKIPCDPTNALLRVFMYDLPPEFHFGLLDWKGNVNQTWPNVNNPKHIPPYPGGLNLQHSVEYWLTLDLLSSNIAENFRPCTAIRVQNSRQADVVFVPFFSSLSYNRHSKIHGKEKVSVNRMLQQRLVQLLMEREEWKRSGGRDHVIVAHHPNSILRARRKLGSAMLVLADFGRYPSQLANIKKDIIAPYRHLVSTVPRAESASYEERSTLLYFQGAIYRKDGGAIRQKLYYLLKDEKDVHFAFGSIRKNGINQASQGMALSKFCLNVAGDTPSSNRLFDAIVSHCVPVIISDEIELPFEDVLDYSEFGLFVHASDAVRKGYLLNLLRSIKPEKWTQMWERLKDITQHFEYQYPSQPGDAVNMIWEEVAHKISSLQFNLHRKNQIPETLAS

SEQ ID NO: 118474 - protein, 66 aa, Glycine max
  Coding DNA Sequence Number=SeqID_1696
  Gene Ontology: Mol. function=sequence-specific DNA binding; Cellular component=nucleus; Biological process=regulation of transcription, DNA-dependent
  Homolog annotation: Hit_ID=Q9AT62; Match level="QueryCoverage=91%, HitCoverage=26%, E-value=1e-19, Identity=77%"; Hit description=MADS box transcription factor
  Pfam annotation: Domain name=SRF-TF; Domain location=9-59; Score =93.1; E_value=8.5e-25; Accession=PF00319.9; Description=SRF-type transcription factor (DNA-binding and dimerisation domain)
MVRRKIPIKKIDNVTARQVTFSKRKSGLFKKARELSLLCDSEIALIVFSPGGKLFDYASSSENVTQ

SEQ ID NO: 118475 - protein, 136 aa, Glycine max
  Coding DNA Sequence Number=SeqID_1697
  Pfam annotation: Domain name=K-box; Domain location=30-130; Score= -11.9; E_value=0.0043; Accession=PF01486.8; Description=K-box region
MSSMQQTLERRNQHSGIQGLDNPSIGQQPSASLITSGTMKKLGSDSFGMLPLRKEIEDKTNELSQLNEEELQGLKIKELQKLEDILQRRWTTISKTKDEKVIQEINHLKTKLFVGNLGEEVNWNLQKVAKKTLEGV

SEQ ID NO: 118476 - protein, 368 aa, Glycine max
  Coding DNA Sequence Number=SeqID_1698
  Gene Ontology: Mol. function=hydrolase activity, acting on ester bonds; Cellular component=cellulose and pectin-containing cell wall; Biological process=lipid metabolic process
  Homolog annotation: Hit_ID=Q9CA68; Match level="QueryCoverage=91%, HitCoverage=91%, E-value=1e-147, Identity=73%"; Hit description =Putative lipase/acylhydrolase; 46085-44470
  Pfam annotation: Domain name=Lipase_GDSL; Domain location=29-340; Score=161.2; E_value=2.7e-45; Accession=PF00657.12; Description=GDSL- like LipaseAcylhydrolase
MNFNLALVIIVSTILGIGLEGCDSKVVQFIFGDSLSDVGNNMHLSRSLAQASLPWYGIDMGNGLPNGRFTNGRTVADIIGDNMGLPRPPAFLDPSVNEEVILENGVNYASGGGGILNETGAYFIQRFSLDKQIELFQGTQKLIRGKIGKRAAYKFFKEASYVVALGSNDFINNYLMPVYTDSWTYNDETFMDYLIGTLERQLKLLHSLGARQLVVFGLGPMGCIPLQRVLTTTGNCREKANKLALTFNKASSKLVDDLAKDFPDSSYKFGDAYDVVYDVISSPNKYGFQNADSPCCSFWNIRPALTCVPASSLCKDRSKYVFWDEYHPTDSANELIANELIKKFGLSNTNQGSVPSPAPAVAPSPDDQ

SEQ ID NO: 118477 - protein, 107 aa, Glycine max
  Coding DNA Sequence Number=SeqID_1699
MANDRDVGKLNEKILGFPRVLFVPISFHSKPSSQPFKVSGLRSKDLALRWDEGLLPFVRSFRVLKAEAVEDLQSKVKLAPSPSMTFDPNQSNKRTVRKGPDPIHNRS

SEQ ID NO: 118478 - protein, 277 aa, Glycine max
  Coding DNA Sequence Number=SeqID_1700
  Gene Ontology: Biological process=regulation of transcription
  Homolog annotation: Hit_ID=Q6Z2T5; Match level="QueryCoverage=76%, HitCoverage=87%, E-value=5e-31, Identity=38%"; Hit description=RWP -RK domain-containing protein-like
  Pfam annotation: Domain name=RWP-RK; Domain location=143-194; Score =58.6; E_value=2e-14; Accession=PF02042.6; Description=RWP-RK domain
MESQSLMGWSSFYEIDEKPFPFTCQFSYSGNSEVYPSLDWPYGFPIQDYYLDAVPLMDYYPSDPLYETLTLATTEPTQSVQDYDFYDIKKGLSGWNEVDAVFDSQKVFLFGNNEESGGIEKQMMEEDGKVNNQGREERINNSSCRTLSRKTISQYFYMPISQAATELNVGITLLKKRCREVGIRRWPHRKLMSLQTLINNVQELGKEEGGESEEKLRSAIEILEREKKVLEEMPDTELEDTTKRLRQACFKANYKKRKLTVTGRRKEPRSSSSSSLH

SEQ ID NO: 118479 - protein, 392 aa, Glycine max
  Coding DNA Sequence Number=SeqID_1701
  Gene Ontology: Mol. function=diacylglycerol kinase activity; Cellular component=intracellular; Biological process=protein kinase C activation
  Homolog annotation: Hit_ID=Q6YWL6; Match level="QueryCoverage=86%, HitCoverage=66%, E-value=9e-79, Identity=42%"; Hit description =Pentatricopeptide (PPR) repeat-containing protein-like
  Pfam annotation: Domain name=PPR; Domain location=131-165; Score =47.1; E_value=5.8e-11; Accession=PF01535.11; Description=PPR repeat
  Pfam annotation: Domain name=PPR; Domain location=54-88; Score=26.3; E_value=0.00011; Accession=PF01535.11; Description=PPR repeat
  Pfam module annotation: Pfam domain module=PPR::PPR; Domain location =131-165::54-88
MVSYYNTMIRACSMSDSPQKVLYKVIRFLYLLGGVQRGGDACKVFDEMPPRDTVAWNVMISCCIRNNRTRDALSLFDVLQNSSYKCEPDDVTCLLLLQACAHLYALEFGERIHGYMMEHEVFKGTGNKNVVSWSAMISGLAMNGYGREAIESFEEMLRIGIRPDDQTLTGDVIGSGIRGPVPPESRISKRKREEEGLRMSFFDRMSREFGVTPNVHHYGQTPQRGGPCLVLAEFMAMLHLVNDWGHWEKVAEVRKLMKNKSIQTTPGCSTIELKGVVHEFVVDDVSHTRNHEIYETLDEINHQLRIAGYVVELSSELHKMDDKEKGYVLSHHSEKLAIAFGVLATPPGTTLRVANNLRICVDCFNFLKHFSGVYNGDGAARVATIGRNIMSW

SEQ ID NO: 118480 - protein, 200 aa, Glycine max
  Coding DNA Sequence Number=SeqID_1702
  Gene Ontology: Mol. function=sequence-specific DNA binding; Cellular component=nucleus; Biological process=regulation of transcription, DNA-dependent
  Homolog annotation: Hit_ID=Q2R053; Match level="QueryCoverage=96%, HitCoverage=50%, E-value=2e-11, Identity=29%"; Hit description=SRF -type transcription factor family protein
MEDSLRESINRVSLQKENLGKHQLISLECANQEGMTLPLMMTSLQESQPLSWLLNNDNHQLMLPNEPKFLSFSDNTNRDVECSTDISLPNYFGHIGSNKLEVGSSPQVTTMGQGGGTMNELNGTTYLNVQHCDQFAYPPPPDIEEVKHFPSMDNKSNIVDYQVNNNFDLPRSLFENGHQFWNSASGSCGIAMYNENDYHR

SEQ ID NO: 118481 - protein, 287 aa, Glycine max
  Coding DNA Sequence Number=SeqID_1703
  Gene Ontology: Cellular component=extracellular region; Biological process=cellulose and pectin-containing cell wall organization and biogenesis
  Homolog annotation: Hit_ID=Q6T5H5; Match level="QueryCoverage=77%, HitCoverage=89%, E-value=1e-109, Identity=80%"; Hit description =Alpha-expansin 3
  Pfam annotation: Domain name=DPBB_1; Domain location=99-184; Score =172.8; E_value=8.7e-49; Accession=PF03330.8; Description=Rare lipoprotein A (RlpA)-like double
  Pfam annotation: Domain name=Pollen_allerg_1; Domain location=195 -272; Score=183.5; E_value=5.1e-52; Accession=PF01357.11; Description= Pollen allergen
  Pfam module annotation: Pfam domain module=DPBB_1::Pollen_allerg_1; Domain location=99-184::195-272
  Subcellular localization annotation: CTP_CleavageSite=55; ConfidenceScore=5.24e-01
HFVPDCQTCSQLAASIYSLPMPSAFNFLTTSLLPFLPLYRGNMVFLGVLLVGFLLGAYGDSDGWMDAHATFYGGGDASGTMGGACGYGNLYSQGYGTNTAALSTALFNNGLSCGACFEIKCVNDQRWCLPDTVVVTATNFCPPNNALPNDAGGWCNPPLQHFDLSQPVFQQIAQYRAGIVPVAYKRVPCQKRGGIRFTINGHSYFNLVLITNVGGAGDVQAVSIKGSRTNWQPMSRNWGQNWQSNTYLNGQSLSFKVTTSEGRTLVSNNVAPDSWSFGQTFTGKQFN

SEQ ID NO: 118482 - protein, 543 aa, Glycine max
  Coding DNA Sequence Number=SeqID_1704
  Gene Ontology: Mol. function=zinc ion binding; Cellular component =nucleus; Biological process=regulation of transcription
  Homolog annotation: Hit_ID=Q0GLD2; Match level="QueryCoverage=54%, HitCoverage=97%, E-value=1e-156, Identity=89%"; Hit description=Dof20
  Pfam annotation: Domain name=zf-Dof; Domain location=187-249; Score =141.1; E_value=3.1e-39; Accession=PF02701.6; Description=Dof domain, zinc finger
QKKKKRKENLTEATRTCGLESKPRSDVAPDSALNGSKSYSSCSTDTSHQKPNTSNEEVTAISQVSIPRRKIKMHEIRDPAIRLFGQKIPFPEDVDKEEESAEDREQEMEEHEDEGDKDTRVENVTKEELEADPPLDAEETKISGTSPEAIVNPKTPSIEEETAKSKGGKSEKEQGDAANSQEKTLKKPDKVLPCPRCKSMDTKFCYYNNYNVNQPRYFCKACQRYWTAGGTMRNVPVGAGRRKNKNSTSHYRHITISEALQAARIDAQNGTHLPTLKGNGRVLSFGLDAHAPICDSMASLMNLGEKKALNGTRNGFHHGFEDQRLPVPCKSGENGDDSSTTSSITISSPKGENNKSTFQQQPLPQNHGFLPQVPCIPGVPWPYTWNSPVPPPALCPSGFPLPFYPATFWNCGMPGNWNVPWFSSSSPASNLKSPSSSPNSPTLGKHSRDSDMIKQDSLHKEEASTPRNGSVLVPKTLRIDDPSEAAKSSIWATLGIKNESVSGGAMFKAFQSKKGEKNHVEASPMLMANPAALSRSLNFHENS

SEQ ID NO: 118483 - protein, 88 aa, Glycine max
  Coding DNA Sequence Number=SeqID_1705
  Gene Ontology: Mol. function=sequence-specific DNA binding; Cellular component=nucleus; Biological process=regulation of transcription, DNA-dependent
  Homolog annotation: Hit_ID=Q1SG97; Match level="QueryCoverage=76%, HitCoverage=31%, E-value=7e-17, Identity=69%"; Hit description =Transcription factor, MADS-box
  Pfam annotation: Domain name=SRF-TF; Domain location=9-59; Score =102.5; E_value=1.3e-27; Accession=PF00319.9; Description=SRF-type transcription factor (DNA-binding and dimerisation domain)
MTRKKIPIKKIDNINARQVTFSKRRKGLFKKAQELSTLCDAEIALIVFSATGKLFEYASSRKYQGFKIQYAIATLTATSKFLEQYCLQ

SEQ ID NO: 118484 - protein, 227 aa, Glycine max
  Coding DNA Sequence Number=SeqID_1706
  Gene Ontology: Mol. function=metal ion binding; Cellular component =integral to membrane; Biological process=ubiquitin cycle
  Homolog annotation: Hit_ID=Q8LBA0; Match level="QueryCoverage=57%, HitCoverage=62%, E-value=3e-32, Identity=57%"; Hit description=RING -H2 finger protein ATL1Q
MVGMLEMARGYVEGEKLGDDEVLLREAVEKYLGVNLKEVRFMVGVVVVVYKGREFEGCRLFAWPVATIVVLHRVCTGALTGAIAGALAAKATKSGLLRGVSLGAIAGSILSVEVLEASRAYWCMEQTGSRSASSMADFIEELVRGRLVEESLTPAILTAYNLQVGIANTGYVETHDVHGLVAPRGLSGDSLKRLPHHMISKAENTCCAICLQGKLQEAYLAVTIHFT

SEQ ID NO: 118485 - protein, 59 aa, Glycine max
  Coding DNA Sequence Number=SeqID_1707
METEKITEQRTKEATKKPIILIKERVKEHLVSKSEGKSESFFIRTSAVTGNYRLHNLDM

SEQ ID NO: 118486 - protein, 410 aa, Glycine max
  Coding DNA Sequence Number=SeqID_1708
  Gene Ontology: Mol. function=transferase activity, transferring glycosyl groups; Cellular component=integral to membrane; Biological process=cell wall biogenesis
  Homolog annotation: Hit_ID=Q9M5Q1; Match level="QueryCoverage=83%, HitCoverage=64%, E-value=1e-168, Identity=77%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=1-395; Score =624.2; E_value=1.1e-184; Accession=PF03254.4; Description=Xyloglucan fucosyltransferase
MPPCTNPHHSHPSCKSHKLYKIWSMKPLVDFVNETSDSVELQQDKLLGGLLADGFDDEETCLSSGLGNRILTLASAFLYALLTNRVLVVDPGTDMVDLFCEPFPDSSWFLPSDFPLNVQFNNFSQNSDQCYGKMLKNKAVTDSTVASFVYLHIARDYDDHDKLFFCDEEQRFLRNMPWLMMKTDNYFVPSVLLMPSFEQELNDLFPNKETVFHFLGRYLLHPTNNVWGLVVRYYQAYLAKADERVGIQIRVFDTKPGPFQHEDATNSSGIPKSKAVLMTSLNSGYFEKVRDIYWEFPTVTGEAVGVYQPSHEGYQQTQKQMHNQKAWAEMYLLSLTDVLATSSWSTFGYVAHGLGGLKLRILYKPENRTVPDPPCPCAMSMEPCFHAPPFFNCKAKRGTYTGELVPCEAL

SEQ ID NO: 118487 - protein, 189 aa, Glycine max
  Coding DNA Sequence Number=SeqID_1709
  Gene Ontology: Mol. function=3'-5'-exoribonuclease activity; Cellular component=exosome (RNase complex); Biological process=RNA processing
  Homolog annotation: Hit_ID=Q9SP08; Match level="QueryCoverage=98%, HitCoverage=82%, E-value=1e-79, Identity=78%"; Hit description =Exonuclease RRP41
  Pfam annotation: Domain name=RNase_PH; Domain location=1-96; Score =83.9; E_value=5.1e-22; Accession=PF01138.11; Description=3' exoribonuclease family, domain 1
  Pfam annotation: Domain name=RNase_PH_C; Domain location=99-164; Score=41.9; E_value=2.2e-09; Accession=PF03725.5; Description=3' exoribonuclease family, domain 2
  Pfam module annotation: Pfam domain module=RNase_PH::RNase_PH_C; Domain location=1-96::99-164
MGNTKVIAAVYGPREVRCEYSMANFSTGDRMRKPKGDRRSTEISLVIRQTMEACILTHLLPRSQIDIYVQVLQADGGTRSACINAATLALADAGIPMRDLVTSCSAGYLNSTPLLDLNYVEDSAGGPDVTLGILPKLDKVTLLQMDSKLPIDILENVMQLAIEGCKAIANYIREVLLENTKQLEYRRGV

SEQ ID NO: 118488 - protein, 430 aa, Glycine max
  Coding DNA Sequence Number=SeqID_1710
  Gene Ontology: Mol. function=metal ion binding; Cellular component =intracellular; Biological process=protein kinase C activation
  Homolog annotation: Hit_ID=Q1SNX8; Match level="QueryCoverage=99%, HitCoverage=78%, E-value=4e-78, Identity=36%"; Hit description =Pentatricopeptide repeat
  Pfam annotation: Domain name=PPR; Domain location=197-231; Score =45.4; E_value=2e-10; Accession=PF01535.11; Description=PPR repeat
  Pfam annotation: Domain name=PPR; Domain location=237-271; Score=1.3; E_value=5.2; Accession=PF01535.11; Description=PPR repeat
  Pfam annotation: Domain name=PPR; Domain location=273-307; Score =11.6; E_value=0.31; Accession=PF01535.11; Description=PPR repeat
  Pfam annotation: Domain name=PPR; Domain location=42-75; Score=9.6; E_ value=0.54; Accession=PF01535.11; Description=PPR repeat
  Pfam annotation: Domain name=PPR; Domain location=7-41; Score=20.6; E_ value=0.0057; Accession=PF01535.11; Description=PPR repeat
  Pfam annotation: Domain name=PPR; Domain location=91-125; Score=39.8; E_value=9.2e-09; Accession=PF01535.11; Description=PPR repeat
  Pfam module annotation: Pfam domain module=PPR::PPR::PPR::PPR::PPR::PP R; Domain location=197-231::237-271::273-307::42-75::7-41::91-125
MDNPTTTVWNHVIRGYARSHTPWKAVECYTHMVSSKAEPDGFTHSSLLSACARGGLVKEGEQVHATVLVKGCADFDGARRVFDVMPCRNVVSWTTMVAGCARNGKSRQALLLFGEMRRACVELDQVALVAALSACAELGDLKLGRWIHWYVQQRFVARNWQQPSVRLNNALIHMYASCGILHEAYQVFVKMPRKSTVSWTSMIMAFAKQGLGKEALDLFKTMLSDGVKVDGVRPDEITFIGVLCACSHAGFVDEGHQIFASMKHTWGISPSIEHYGCMVDLLSRAGLLDEARGLIETMPLNPNDAIWGALLGGCRIHRNSELASQVENKLVPELNGDQAAGYLVLLSNIYAFGQRWQDVITVRQKMIEMGVKKPPGRSWIQINGVVHNFIAGDMTHKHSSFIYETLRDVTKQANLEGYDREIIVFLDVEV

SEQ ID NO: 118489 - protein, 163 aa, Glycine max
  Coding DNA Sequence Number=SeqID_1711
  Homolog annotation: Hit_ID=Q10EV2; Match level="QueryCoverage=70%, HitCoverage=65%, E-value=1e-13, Identity=36%"; Hit description =Expressed protein
  Pfam annotation: Domain name=DUF538; Domain location=8-148; Score =141.5; E_value=2.3e-39; Accession=PF04398.3; Description=Protein of unknown function, DUF538
MSMRHRSLLAIFLAFVGVFPFSVAASYSSIHELLRSHGLPAGLFPESVKSYNLDQSGRLEVNLDGPCMTKYETRVLFETVVRANLSFGQLKGLEGLSQEELFLWLPVKDIIVNDPSSGLILIDIGLAHKQLSLSLFEDPPVCRSQGLSLNIAGRKSIGFQDQR

SEQ ID NO: 118490 - protein, 145 aa, Glycine max
  Coding DNA Sequence Number=SeqID_1712
  Gene Ontology: Mol. function=transcription regulator activity; Cellular component=nucleus; Biological process=regulation of transcription
  Homolog annotation: Hit_ID=Q9ZVX2; Match level="QueryCoverage=96%, HitCoverage=35%, E-value=8e-10, Identity=27%"; Hit description=BHLH transcription factor
MNRGTIIVDAITYIEKLQHEVQRLSQELHQLEATSEKTAEAKVDEIDAVEDMKHWGIQAEVRVAQIDENKLWVKIIIEKKRGRFSKLMEALNNFGIELIDTNFTTTKGAFLITSCIQVKDGERLEIHQSKSLLQEIINDISSKSE

SEQ ID NO: 118491 - protein, 65 aa, Glycine max
  Coding DNA Sequence Number=SeqID_1713
MAGTVMVEKICTHGASKVEIARKQGLWATVIEVVGGDDGCSTMAGKGGAVVGWVRVRWGRGEWVR

SEQ ID NO: 118492 - protein, 302 aa, Glycine max
  Coding DNA Sequence Number=SeqID_1714
  Gene Ontology: Mol. function=protein serine/threonine kinase activity
  Homolog annotation: Hit_ID=Q1T6P2; Match level="QueryCoverage=48%, HitCoverage=37%, E-value=3e-11, Identity=31%"; Hit description =Stress protein DDR48 , related
MAYTGYDYNQPYYGYDSSLYYASNYPAENCQTISYSATMYSDPKSVLYDPNYGMSQLVISYSKVKFNVPEFDDYDPTPYGGGYDIDQTYGKALPPSDKICYPRSESSPITEPPFSESIVPLPTIEEGIEEKAITPQNGAIVQTKTEEKPQSQDSGKDQPKEVEDNNFNTESEGSHQEDDNYSESGIVSGFIEGYKEHEKQVVPVVPQYPSGYGLEAMDICESLFGYWPCLERMKKRECCCEEVSYRGNNCQENMWQGTAGYLFGSPNPYGGSGYGGDVVYGYQRHYPMQVQHRQIDYTDGSW

SEQ ID NO: 118493 - protein, 93 aa, Glycine max
  Coding DNA Sequence Number=SeqID_1715
MPGNLMLVGLPPQHVVHVADKGKEKVHRGGSVTHPSKMRLLEEPKLSDPMSNEAEDTTIGTLQIMEDYIFRGLRDGDTDTNDIDPGPFGYISR

SEQ ID NO: 118494 - protein, 77 aa, Glycine max
  Coding DNA Sequence Number=SeqID_1716
MEEKFLDDMITKKGRKKNMREKVRILAIAEEGLKWCGRVKEGSETNLDIMKAGSESGTEADGVCDQSTLEEQEECWQ

SEQ ID NO: 118495 - protein, 497 aa, Glycine max
  Coding DNA Sequence Number=SeqID_1717
  Gene Ontology: Mol. function=heat shock protein binding; Cellular component=integral to membrane; Biological process=protein folding
  Homolog annotation: Hit_ID=Q1SGA1; Match level="QueryCoverage=97%, HitCoverage=98%, E-value=4e-63, Identity=54%"; Hit description=Heat shock protein DnaJ, N-terminal
  Pfam annotation: Domain name=DnaJ; Domain location=73-135; Score =36.5; E_value=9.2e-08; Accession=PF00226.21; Description=DnaJ domain
MDGHGGGGGGSRGEAELWLYTANKVLSARDLHGARSFAIRARDSDPRYEPTELLLAVIDTLMAGEARINDQLDWYAILQVLRYTQNIDYIAAQYRRLATQLDPHHNPFAFAAHAFTLVHDAWTVLSNPTKKTFYDNQLRLLTQPPPPQPPPPPPAPPAPVAFFPIQPPQPNLNPNPIPNLVPPRESPRPRPRVEVEPPPPAPPPSSQLDNATELTRASEAESEGASFWTACPYCYVMYEYPKVYEDCTLRCQNCRRGFHAMVVRSPPKDGTFGSFCSWGFFPVGFSGDFKDINGSSSKWNPFSPLFPCALKGAEQNSRYQKGPWVFYDDDASAEFVEAGSDTTEDDSDDDDWRGGNQKGTTRRRKRRKRRSNAGGDVRRVPTIERPRRRVQNSDGNDSVGNGEAVDGGALAVPVAPESSKKAVALGGSRRRSERNLGKLDLNVEFSNEVEEPVHGAGEGNGNAEDNIEGIGFFEGLDEFLSSLPILNVVADDKVKGH

SEQ ID NO: 118496 - protein, 229 aa, Glycine max
  Coding DNA Sequence Number=SeqID_1718
  Gene Ontology: Mol. function=oxidoreductase activity; Biological process=fatty acid metabolic process
  Homolog annotation: Hit_ID=Q1XLJ0; Match level="QueryCoverage=99%, HitCoverage=28%, E-value=5e-75, Identity=63%"; Hit description=Enoyl- CoA hydratase/isomerase:3-hydroxyacyl-CoA dehydrogenase-like:3- hydroxyacyl-CoA ...
  Homolog annotation: Hit description=dehydrogenase, NAD-binding:NAD -dependent glycerol-3- phosphate dehydrogenase-like
MMRVRYSSIPVVVAPHGMTLGGGCEMTMHADRVVAAAETYIGLVETGVGVIPGGGGTKELTLRTSREFHTDDVKNNRLREAFMNIAMGKVATSAYEAYDMGILEKGKDIVSVSKNRQIAEAKKIAKLLAEQGYTQPIEQSVKVLGKDALGMFYVGTDQMLTGNFISEHDKKIADKLANVMVGGNLSEPTVVTEQYLLNLERETFLQLCGERKTLERIQYMLQNGKPLRN

SEQ ID NO: 118497 - protein, 196 aa, Glycine max
  Coding DNA Sequence Number=SeqID_1719
  Gene Ontology: Mol. function=protein binding; Cellular component =outer membrane-bounded periplasmic space; Biological process=cell wall organization and biogenesis
  Homolog annotation: Hit_ID=UPI00005F9D0A; Match level="QueryCoverage =98%, HitCoverage=78%, E-value=6e-73, Identity=65%"; Hit description =COG3121: P pilus assembly protein, chaperone PapD
  Pfam annotation: Domain name=Pili_assembly_C; Domain location=96-180; Score=40.7; E_value=4.9e-09; Accession=PF02753.7; Description=Gram -negative pili assembly chaperone
  Pfam annotation: Domain name=Pili_assembly_N; Domain location=1-92; Score=78.3; E_value=2.4e-20; Accession=PF00345.11; Description=Gram -negative pili assembly chaperone
  Pfam module annotation: Pfam domain module=Pili_assembly_C::Pili _assembly_N; Domain location=96-180::1-92
LPYLAQGWLEDEQGNKIQSPLTVLPPVQRIEPGKPSQVKIQALPAAKQLPQDRETLYYFNLREIPPKSNKPNSLQIALQTRIKLFYRPAAIAPERNAAPWQEQLTLTRQGDKYIVNNPTPYYVTLIDAASRKGAAGAQNFEPFMVPPKGSAPLSVNAATLGGNPVLTYINDYGGRPQLAFNCQADKCSVVPEKKSS

SEQ ID NO: 118498 - protein, 91 aa, Glycine max
  Coding DNA Sequence Number=SeqID_1720
MIITQALCNKYTKTQSYMQSGIMSVKNLVKCLEVHDKTDHTLGDQSGSHYFARMLQPCGISTDLKEHSNRMYLLPRPRLQIVRQGLSLLIQ

SEQ ID NO: 118499 - protein, 162 aa, Glycine max
  Coding DNA Sequence Number=SeqID_1721
MDHFKCLKESMTMLTKLSYPVNGESDLRTNPSKEGENDEDMTKSKGKDPLEGLGGPMTRARARKAKEALQQVLSILFEYKPKFQGEKSKVLSQPTLLRASEARLTGASSKGGKCAESPPTFICGKRRKTKGTGHEDIPDSGVVFTFEDGISTSHVCPKGQHP

SEQ ID NO: 118500 - protein, 202 aa, Glycine max
  Coding DNA Sequence Number=SeqID_1722
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=97%, HitCoverage=35%, E-value=1e-103, Identity=80%"; Hit description=DNA -directed RNA polymerase beta' chain
  Pfam annotation: Domain name=RNA_pol_Rpb1_2; Domain location=4-132; Score=176.4; E_value=7.1e-50; Accession=PF00623.11; Description=RNA polymerase Rpb1, domain 2
MRDGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRAYQQKRINFDSPLWLRWRLDQRIISSREVPIEVHYDL

SEQ ID NO: 118501 - protein, 194 aa, Glycine max
  Coding DNA Sequence Number=SeqID_1723
MVDYEYLKIVVGGGVSSGNNSISVDPDDTDATTFEPENRTVGIEEFSYDPNSDTFITPNNYEPTYQPPSPNQPSPPSHPPLDSEVPIEKQNCHKRRRSEYGGSSSVVGINNQGNVLENLSVGIGTIAVNFEKISDMMEKREKDRDRDRELEGIIWDVIKEIPNLDDITRFKTAELLNTKAKKDFFLKMSPEERS

SEQ ID NO: 118502 - protein, 77 aa, Glycine max
  Coding DNA Sequence Number=SeqID_1724
MAAMAWEVKREVHLGGSRRFTATIMTRMKKMQKLKKMQKNEEAQRFEEEETYGAGEREVRYPRNVGFFSPCILGHLD

SEQ ID NO: 118503 - protein, 101 aa, Glycine max
  Coding DNA Sequence Number=SeqID_1725
  Homolog annotation: Hit_ID=UPI0000612705; Match level="QueryCoverage =72%, HitCoverage=27%, E-value=9e-07, Identity=28%"; Hit description =UPI0000612705 related cluster
LSVRGLHALTFRGLQVLSCRGPHALTSRGQHVLAFIGLHALAFRGLHVLTFKGLHILTFKGLNVFTFKGQNVLAFRGLHICTFRELKISVRKTLSGPEEVQ

SEQ ID NO: 118504 - protein, 51 aa, Glycine max
  Coding DNA Sequence Number=SeqID_1726
IKRLRVSYCRGFLNTREGLSLCSSDFVKGVLQREWKISSGLLEDWTGSDRT

SEQ ID NO: 118505 - protein, 43 aa, Glycine max
  Coding DNA Sequence Number=SeqID_1727
MRKLIKERMENKVVNFVGLNKVKRWLDKNIEMAITQATGLQMR

SEQ ID NO: 118506 - protein, 129 aa, Glycine max
  Coding DNA Sequence Number=SeqID_1728
  Pfam annotation: Domain name=zf-CCHC; Domain location=104-121; Score =13.2; E_value=0.0066; Accession=PF00098.13; Description=Zinc knuckle
MDEYFRVSNCKNAKDMWDTLQEHEMELMRLNHHEENDKKKKGIPLKASSSTQEGSDKEDLNEIDEDDDLSYFVKRFNKFLRVRGNQRRSNFKSKKRAEDSSSTPKCYECNQPEHLRVDYTIFKKRIEKS

SEQ ID NO: 118507 - protein, 244 aa, Glycine max
  Coding DNA Sequence Number=SeqID_1729
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=2e-31, Identity=34%"; Hit description= UPI00006A17C9 related cluster
YPGLQRTTLLANRGLHALTLRGLCVLTFKGLHVLTFRGLHALAIRGLRVLTFRGLHALAIRGLHVLTFRGLHALAIRGLHVLTFVGLHALTFRGLHVLANRGLHALTLRGLHVLANVGLHALTFRGLHVLANRGATCPRLRGLHALTLRGLHVLALRGLHVLTIIGLHALTFRGLHVLTFEGLHALTFRGLHVLTNRGLHALTSRGLHILALRALHALTFRGLRVLIFSVLHIRTLREFKVLCP

SEQ ID NO: 118508 - protein, 142 aa, Glycine max
  Coding DNA Sequence Number=SeqID_1730
MVKPLSETTKTIKVFPPGLMTQTPAQILEYAKSHYFHFLLETMRFKYTPVQILVPEIPFGVQYSILIALKPLMTYNILTNPYQDEYLLWTMLEWLSPLAWWHMKLKQILDIERQRGISEDHIRKLVSIVIIHSPYFMEQRQL

SEQ ID NO: 118509 - protein, 265 aa, Glycine max
  Coding DNA Sequence Number=SeqID_1731
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-27, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLQVLTIRGLHVLTLIGLHALTLRGLHVLALRGLPVLAFRGLHILPFRGLHAFAFRGLYILAIRGPYVLTFRGLHVLAFRGLLVFTIIGLHTLAFRGLHVLTFRGLHALVIRGLHVLPFVGLHAFTFRGLHVLALRGLPVLAFRGLPVLAFRGLHILALRGLHALAFRGLHALAVKGLYVLTFRGLFVLTFRGLYILTFRGLRILTFKALYVLTFSGLHVLAIRGLHVLAFRGIHVLPFRKLHTFTFVRLHILTVRELHSLAFKR

SEQ ID NO: 118510 - protein, 249 aa, Glycine max
  Coding DNA Sequence Number=SeqID_1732
MASKKHKSIGSRPTTQYDTRRFHSLDAWNQYTDNVLGRNILPEKKVELYHTKLDDFKTELKRRNFHKRLTNLVDGSKDLALVKEFYANLYSSEGPSPKQAIVRGHLVKIDVDSLNTFLETPVVLAEGETLPIYSRYCSLPTDYREIEATLCIPGRRFILNTEGHPGRILRKDLTTLAQVWSALSYSNMPPTSHTSDLTVDRARLIFGLVSRMDMNKGALISGQMTSIAQSNTSRLGFPTLITALCRARG

SEQ ID NO: 118511 - protein, 190 aa, Glycine max
  Coding DNA Sequence Number=SeqID_1733
MRSFNGDFHHEDAAEDKGEKELHHQESALDNKLKEEASMEEKNEKERGGHEIEGEKEGEKLNFEDCIISNSLVVISHGGFASVDLVKYSMTTSRYLTAPGAFSNGPGPRGAQTVKIVKRKAWHVCKLLASSAPPIHFETSEIVNESLCDVIILEQHHFLGLGDIVRDFKDDPCPTSFYVGNIVNVKGLPV

SEQ ID NO: 118512 - protein, 49 aa, Glycine max
  Coding DNA Sequence Number=SeqID_1734
MGFPLPTVIYLAENLSGFSIRHLLSLEEIPLSFASEERMRILFIGQGSK

SEQ ID NO: 118513 - protein, 92 aa, Glycine max
  Coding DNA Sequence Number=SeqID_1735
  Subcellular localization annotation: CTP_CleavageSite=82; ConfidenceScore=5.40e-01
FKGVFTKYKAKTRKRTSSYWAIRTGVWTSRSRGSKSSGLSIISEQIFTKPVRLRARWITVLRSSYVHGRKSFLQNPYTLKVSSAERNEYTRR

SEQ ID NO: 118514 - protein, 48 aa, Glycine max
  Coding DNA Sequence Number=SeqID_1736
MVHDIFVKVKLEVTGTLTVLNVFGSRRSSDKWVYDPNMGWLMVPNTCN

SEQ ID NO: 118515 - protein, 275 aa, Glycine max
  Coding DNA Sequence Number=SeqID_1737
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=2e-31, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPKSCEFGMIGPLDESISCLLIRLDPWVLVRIAIRGLHVVAFKGLYALASRGLHVLSFRGLHVLAFKGLHALTLRGLHFLTFRGLHVLASRGLHILAFKGSCTFAFGGLHILASRGLHVLAFRGLHVLVFRGPHALAFRGLHVLAFKGSCTFAFRGLHVLAFKGSCTLTFRGLHVLAFRGPHALTFRGLHVLTFRGLRVLAFKESYTFGFRGLHVPLFKGLHSLALRGQHALTFRGLHVLAIIGIHSLAFKKATRPETSEGCTPPPLEGYASSLS

SEQ ID NO: 118516 - protein, 89 aa, Glycine max
  Coding DNA Sequence Number=SeqID_1738
MEVNEGSYLDVTTYPTTGVWAKSQRCVFQKGKSAGVTTNIYSRKTLEKPKRGMQILNTRVREMFTHGEDISIPRACHKGRQPLIECAKT

SEQ ID NO: 118517 - protein, 35 aa, Glycine max
  Coding DNA Sequence Number=SeqID_1739
MYKTLPQNRFLQDENFRCLLRCLVPPAEEEDPVQK

SEQ ID NO: 118518 - protein, 165 aa, Glycine max
  Coding DNA Sequence Number=SeqID_1740
  Gene Ontology: Mol. function=potassium ion transporter activity; Cellular component=integral to membrane; Biological process =potassium ion transport
  Homolog annotation: Hit_ID=Q9M7J9; Match level="QueryCoverage=100%, HitCoverage=21%, E-value=2e-55, Identity=67%"; Hit description =Potassium transporter 8
  Pfam annotation: Domain name=K_trans; Domain location=23-165; Score= -510.1; E_value=0.01; Accession=PF02705.7; Description=K+ potassium transporter
MDLERAIVQNSDKRKESWKTVLTLAYQSLGVVYGEISTSPLYVYRNTFAEDIGHSETNEEIYGVLSLVFWTLTLVPLVKYVFIVLKADDNGEGGTFALYSLLCRHARVGLLPNCQLADEELSEYRRNDCGVAPERSLAFRLRSLLERYKVLQRILLVLALLGTCM

SEQ ID NO: 118519 - protein, 288 aa, Glycine max
  Coding DNA Sequence Number=SeqID_1741
AEFDIPEASDVREKKKILQIVRERWRQFKSDLTSKWAFAADKDNVDDTVCKKYGISKEKWVQFCQSRRDPSWEDVRKKAQAIQKQNTAPHVLSCGGYEYLEKKSMVEKTKEKLEETAQSRSTEVVIDPLSPIKRHVKWKMARTKKTGKMTFEVAKEIVEKVVKHLGHVRIAGVGVTIKQYFGPAPRTSRTSSSTAPEELEQLTQQIRDQLEESITEKGLALPPEPEVGPSAACVSTKESCVDPSGNDPDTGDSDKCGLYIEENPPCLVALGKVYEGLTTIHNILLLQD

SEQ ID NO: 118520 - protein, 276 aa, Glycine max
  Coding DNA Sequence Number=SeqID_1742
  Homolog annotation: Hit_ID=Q9AVH2; Match level="QueryCoverage=60%, HitCoverage=71%, E-value=5e-63, Identity=62%"; Hit description =Putative senescence-associated protein
LGKPLVEILPPGQLRGFCPLLAWLGSAVLGEGRIKATRAESQWIVAARPLCHLQYPVAYLSRLQRILPAARWELRFKASRRANPPHEGHQRHVPFGGAEAPYCWSAKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADL

SEQ ID NO: 118521 - protein, 42 aa, Glycine max
  Coding DNA Sequence Number=SeqID_1743
MGHTDLIQLPFHSILRDVLDTPQELIEYFLDTKAQETVVPTF

SEQ ID NO: 118522 - protein, 189 aa, Glycine max
  Coding DNA Sequence Number=SeqID_1744
MTVEMEVAVMVVMETMKAVVVEADVVEVCGYTHNNVYLPSSYSSSSSSGDENSYEFKSSTYSPSYTFTWSSFTFNDNKRLWLLSVCCVLPLPLPRGLSDLLATVGVQVRWVAPNHGWVCLNFDGATRSSQNMTGLLLARSKSFGVASGFNCLLMQQDGVCFVKSRSYFSLTGKSRLCTSSWKEIDAMML

SEQ ID NO: 118523 - protein, 208 aa, Glycine max
  Coding DNA Sequence Number=SeqID_1745
  Gene Ontology: Mol. function=calcium ion binding; Biological process =protein amino acid phosphorylation
  Homolog annotation: Hit_ID=Q2PP75; Match level="QueryCoverage=54%, HitCoverage=41%, E-value=4e-25, Identity=51%"; Hit description =Lectin-like protein
  Pfam annotation: Domain name=Lectin_legB; Domain location=27-205; Score=22.5; E_value=6.1e-12; Accession=PF00139.10; Description =Legume lectin domain
  Subcellular localization annotation: CTP_CleavageSite=20; ConfidenceScore=5.11e-01
MAKTQNSFHILMVSLCFVLLINNVKSDSLSLRFPNFAPRQNSNIGFLGDERPLDGAIQLRRRDNNGPYLMALPIFAYPVLPRNHFQRIQKPNRGYSFGNEWDPKPVPVALHIGIDINTLESVETVGWPINYVPHGSVGQASIRYYADVKELSVVVGYFNTQPATIVRVLQSIDLRAVLPESVRIGFSGATGDKVETHDILSWSFNSRI

SEQ ID NO: 118524 - protein, 447 aa, Glycine max
  Coding DNA Sequence Number=SeqID_1746
  Homolog annotation: Hit_ID=Q1T493; Match level="QueryCoverage=68%, HitCoverage=63%, E-value=2e-36, Identity=29%"; Hit description =Nucleic acid-binding, OB-fold, subgroup
  Pfam annotation: Domain name=DUF223; Domain location=40-135; Score= -5.8; E_value=0.01; Accession=PF02721.5; Description=Domain of unknown function DUF223
  Pfam annotation: Domain name=Rep_fac-A_C; Domain location=261-356; Score=-62.8; E_value=0.027; Accession=PF08646.1; Description =Replication factor-A C terminal domain
  Pfam module annotation: Pfam domain module=DUF223::Rep_fac-A_C; Domain location=40-135::261-356
MARIPDKINSIDGSKEALKLVVRITDLWFVGTPNKSKQAKMVIVDFEGDQIHVVCKADQLKCWKANLKENSTYVMHNFKVVKNDGQFRVCEHEYKLVFIGVTVVKEADLHQLPFKEFRFVEFGNVVGGNFVAGLLVGALSACLIKKYQGCFKMKDLSGEVLSCTLWENYCMQFLAYLNECGNDGSIVIILTHARIKDAQGSYPALVSNSFKTSKLLINEHVLEIQEFRERLLDLGVEVSPVLAPGDQGSSQLSWDVVCVMVGTISKIVMDSHSWCYPACIQCHRKTDIETGPFTCECGKDNDQPVLRYRVEVMDGDVDLNASPQALDRLLGYVFAFKVRIQSKFRNVVVLRYSNELDLINVVLDMLADTEACSKIDASNVDCNNATHPECQSLSVIADHDPIAGFPLTLKKRLSSDEVDDELGSSQISPAQLSFNKLTRHFDKSEFS

SEQ ID NO: 118525 - protein, 195 aa, Glycine max
  Coding DNA Sequence Number=SeqID_1747
  Gene Ontology: Mol. function=oxidoreductase activity; Cellular component=mitochondrion; Biological process=fatty acid biosynthetic process
  Homolog annotation: Hit_ID=Q1SQN2; Match level="QueryCoverage=56%, HitCoverage=35%, E-value=5e-41, Identity=68%"; Hit description =Alcohol dehydrogenase superfamily, zinc-containing
  Pfam annotation: Domain name=ADH_zinc_N; Domain location=3-128; Score= -1.9; E_value=0.01; Accession=PF00107.16; Description=Zinc-binding dehydrogenase
MSTGDVIVQNGATNMVGQSGVDEVKERLKNLGADEVFTESELEVKNVKSLLGGTPEPVLGFNCVGGNAASLVLKFFRQGGTMATYGGMSKKPVTVSTSTFIFKGTALVRTWKWFNVGGFNFQVKKLLRMFWGRVQRPGIEPIIYRDLFLFRTLASFLNGINIQKLGCNAELIVDEFGEKLLEELDYTLQSKKPLR

SEQ ID NO: 118526 - protein, 281 aa, Glycine max
  Coding DNA Sequence Number=SeqID_1748
  Gene Ontology: Mol. function=sugar binding; Cellular component =membrane; Biological process=protein amino acid phosphorylation
  Homolog annotation: Hit_ID=Q2PP74; Match level="QueryCoverage=80%, HitCoverage=78%, E-value=1e-58, Identity=50%"; Hit description =Lectin-like protein
  Pfam annotation: Domain name=Lectin_legB; Domain location=30-278; Score=258.6; E_value=1.3e-74; Accession=PF00139.10; Description =Legume lectin domain
  Subcellular localization annotation: CTP_CleavageSite=22; ConfidenceScore=5.36e-01
MAKSKTQTPFPTLLVFLCYVLLLNNVKKSNSLSFNFSNFVSGPNFDIGFLGDARPLDGAIQLTRRDNNGPYGTANIRQHSVGRAVYIPPVRLWDKTTGKLADFETDFSFVVDYYSAGSQIHADGLSFFIIPFGADPRIPKNSSGGYLGLFSPETAFNAYKNQIVAVEFDSFRNEWDPEPVPVAPHIGIDINSLESVETTDWPINSVPQGAVGKAIISYDSNAKKLYVAVGYDTQPPTIVALSQTIDLRVVLPEWVRIGFSGATGDMVETHDILSWSFTSHI

SEQ ID NO: 118527 - protein, 256 aa, Glycine max
  Coding DNA Sequence Number=SeqID_1749
  Gene Ontology: Mol. function=calcium ion binding; Cellular component =membrane; Biological process=protein amino acid phosphorylation
  Homolog annotation: Hit_ID=Q2PP76; Match level="QueryCoverage=98%, HitCoverage=97%, E-value=4e-48, Identity=45%"; Hit description =Lectin-like protein
  Pfam annotation: Domain name=Lectin_legB; Domain location=24-252; Score=245.3; E_value=1.2e-70; Accession=PF00139.10; Description =Legume lectin domain
MVLSNSKPFFLLLVQFLMLHRNWDDTSFNFPNFSGPYPNTVLTFQGDARIIRGVIDPTNFVKNAEIVPSAGRATYALPVRLWDSKSGKVASFTTTFSFKISNGPNTGDGIAFFLAPFGSNMPRDSAGGYLGLFSRDTALRNTNKNHIVAVEFDMHQNEWDPAATPHIGIDVNSISSVATVRWEIEELGVPTVSATVSYDSKTQIFGMALNDGTVVAYEIDLRTVLPEFVSVGFSGATGVLIEDHEILSWTFSSSFD

SEQ ID NO: 118528 - protein, 277 aa, Glycine max
  Coding DNA Sequence Number=SeqID_1750
  Gene Ontology: Mol. function=calcium ion binding; Cellular component =membrane; Biological process=protein amino acid phosphorylation
  Homolog annotation: Hit_ID=Q2PP78; Match level="QueryCoverage=98%, HitCoverage=96%, E-value=3e-67, Identity=50%"; Hit description =Lectin-like protein
  Pfam annotation: Domain name=Lectin_legB; Domain location=27-274; Score=257.1; E_value=3.7e-74; Accession=PF00139.10; Description =Legume lectin domain
MAKTQTPFPALMICLFFVLLLNNVKSDSISFSFSNFEPGQNFDIGFLGDARPVDGAIQLTRRDNNGPYGTPNIRQHSVGRAVYIPPVRLWDKTTGKLADFETDFSFVVDFAASQIHADGLSFFIIPFDADPRIPKNSSGGYLGLFSPETAFNAYKNQIVAVEFDSFGNEWDPKPVPVAPHIGIDVNSLESVETIDWPINSLPLGSVGKASISYDSNAKQLSVTVGYDSNHPPIFVGLKQIIDLRGVLPEWVRIGFSGATGEKVETHDILSWSFTSRI

SEQ ID NO: 118529 - protein, 139 aa, Glycine max
  Coding DNA Sequence Number=SeqID_1751
MKDHTNLDHKFVGSTAKKVQLIILYPINSTNHTKLPIELDGTTSKQELYGRGEPAKEEVTMTSLQRNNEALREETSVLIKIQIEKEVVIEVMVVELCLRQRSIDLEDVVLIHQAIFLELEPKVFLLTALPLLLNTRHKG

SEQ ID NO: 118530 - protein, 85 aa, Glycine max
  Coding DNA Sequence Number=SeqID_1752
MVEPPSNSQHKRGLFYFSDPWWFIFPLHTRAPPRLPSHIANIRHLHVVLLWVVTVGKRRAKIFSDWKDAFMITVREKIRVGWEST

SEQ ID NO: 118531 - protein, 264 aa, Glycine max
  Coding DNA Sequence Number=SeqID_1753
  Gene Ontology: Mol. function=calcium ion binding; Cellular component =cellular_component; Biological process=protein amino acid phosphorylation
  Homolog annotation: Hit_ID=Q2PP76; Match level="QueryCoverage=95%, HitCoverage=97%, E-value=6e-80, Identity=59%"; Hit description =Lectin-like protein
  Pfam annotation: Domain name=Lectin_leg-like; Domain location=28-264; Score=-103.6; E_value=0.019; Accession=PF03388.4; Description=Legume -like lectin family
  Pfam annotation: Domain name=Lectin_legB; Domain location=32-260; Score=267.0; E_value=3.9e-77; Accession=PF00139.10; Description =Legume lectin domain
  Pfam module annotation: Pfam domain module=Lectin_leg-like::Lectin _legB; Domain location=28-264::32-260
MAIIKNTRAQSKTPISILMLIISFLGLVHNVKSVSFSFPSFGSYTNDITLQGEAYVNSEGAIKLTPLSPNNVGRASYAAPLHLWDAKTGKLAGFNTTFSFVVAPSGPGLFGDGIAFFLAPFTSNLPNNSSGGFLGLFSPNSALNVYKNQIVAVEFDSFSGNPWDPPSAHVGIDVNSIASVTTRKWETGNSFEVAYATVNYEPIGKSLNVLVTYPGSSLNTTSLSFVIDLRTVLPEWIRVGFSGATGQLVETHKIYSWTFASSFY

SEQ ID NO: 118532 - protein, 50 aa, Glycine max
  Coding DNA Sequence Number=SeqID_1754
MHHWQRWCWNDNDNVLNPGPTQLVRPIRPRSRGDNGIGGGGGSAVVRRQR

SEQ ID NO: 118533 - protein, 69 aa, Glycine max
  Coding DNA Sequence Number=SeqID_1755
MGGNEEALVGGSGIVDRWWRQHGAVACGGDMVRLPRINVGGNSTHFPSLEDAPVSLASPSRQRVGCDSW

SEQ ID NO: 118534 - protein, 188 aa, Glycine max
  Coding DNA Sequence Number=SeqID_1756
  Gene Ontology: Mol. function=monooxygenase activity; Cellular component=membrane; Biological process=electron transport
  Homolog annotation: Hit_ID=Q1RV12; Match level="QueryCoverage=54%, HitCoverage=21%, E-value=1e-43, Identity=84%"; Hit description=E -class P450, group I
MEIIDNILLLLFAAHDTSRSVLSLVMKYLGQLPQVFEHVLKEQLEISQGKEAGQLLQLEDVQKMKYSWNVASEVMRLSLPVSGAYREAKEDFTYADYNIPKGWNCKTSACMLKGENLDVAALKLARSLNAIVLTLGGNLDAAALKLARNLSAAPIGSLDIIITFALAKPSLSQLLRFLQEPITAPPCC

SEQ ID NO: 118535 - protein, 266 aa, Glycine max
  Coding DNA Sequence Number=SeqID_1757
  Gene Ontology: Mol. function=protein serine/threonine kinase activity; Biological process=protein amino acid phosphorylation
  Homolog annotation: Hit_ID=Q1S9T6; Match level="QueryCoverage=91%, HitCoverage=51%, E-value=3e-21, Identity=40%"; Hit description =Protein kinase; Concanavalin A-like lectin/glucanase
  Pfam annotation: Domain name=Lectin_legB; Domain location=7-213; Score=-102.8; E_value=0.002; Accession=PF00139.10; Description =Legume lectin domain
MLKCENIGFHQNRCYNKYYTRYCFKVGLANYTKRVLLWSPCTLQLSDFTTKFSFTTNTLANSLFFADTITFFLAPIGFKISSYSLSVGFLGLFNITTVVSPNNDIVPVGFDSNVNAHCEIESLKTWDSGGSERNQQSLVKIILTVVGGILILELVIATTSVIVWRRWNKTIIKPHLRSYNNSLINDVEIGRGAAATPRMFSYKELVVATNNFSMENKLGDRGFGAIYKGLIVDSDLEIPVKEISRSSRQGKKEYATEINILNQHRH

SEQ ID NO: 118536 - protein, 96 aa, Glycine max
  Coding DNA Sequence Number=SeqID_1758
MMSTSAIKILVMIAVTMVIEMVVISIVIVIVVKAIDAMMTVIGGGASSGGNDIDGDNQCWRGDGSSSNVDDGDGDSDVGDWKDIGDGDECSIDLWR

SEQ ID NO: 118537 - protein, 168 aa, Glycine max
  Coding DNA Sequence Number=SeqID_1759
  Gene Ontology: Mol. function=protein binding; Cellular component =endoplasmic reticulum; Biological process=ER to Golgi vesicle -mediated transport
  Homolog annotation: Hit_ID=Q013E9; Match level="QueryCoverage=88%, HitCoverage=91%, E-value=6e-33, Identity=46%"; Hit description=[U] KOG3315 Transport protein particle
  Pfam annotation: Domain name=TRAPP_Bet3; Domain location=29-159; Score=179.7; E_value=7.1e-51; Accession=PF04051.6; Description =Transport protein particle (TRAPP) component, Bet3
MIGVGKIKQYSNVLDKPLTKGKQEVSLSAFAFLFSELVQYNQTQVDNIGELERRLEDAGYAVGARVLELLCHRDKVADSLEKGTEHEDEYMISEKELLVNKFISIPKDMGTFNCGAFVAGIVRGVLDGAGFPAVVTAHFVPMEGQQRPRTTILIKFAEEVLRREARLG

SEQ ID NO: 118538 - protein, 98 aa, Glycine max
  Coding DNA Sequence Number=SeqID_1760
MYPLEHKNDSSTYPPKHDDHNPTYPPEHDDDSPTYPLKHDDDNPVYSPNMRMISCKALTKVCIPCLHAIFSSYAFEEVDVDPQIASYFAYPPEISPIP

SEQ ID NO: 118539 - protein, 151 aa, Glycine max
  Coding DNA Sequence Number=SeqID_1761
  Gene Ontology: Mol. function=protein binding; Biological process =jasmonic acid mediated signaling pathway
  Homolog annotation: Hit_ID=Q45FY8; Match level="QueryCoverage=88%, HitCoverage=26%, E-value=8e-63, Identity=96%"; Hit description =Coronatine-insensitive 1
MSKISLPVSSKKEVEMMSLRVLFLEESSILEKDGEWLHELALNNTVLETLNFYLTDIAVVKIEDLELLAKNCPNLVSVKLTDCEILDLVNFFKHASALEEFCGGTYNEEPERYSAISLPANRTKKIGSPLCNARHGGSLYVNPKVSKSGSP

SEQ ID NO: 118540 - protein, 127 aa, Glycine max
  Coding DNA Sequence Number=SeqID_1762
  Subcellular localization annotation: CTP_CleavageSite=37; ConfidenceScore=5.18e-01
GRLALWSLGRMLLNSNVIHIQVRVVKLVCMIRTRLFAAARVKSCTGMHSRCVIASLSGCARTVGRPPISGGGPGTDKRKLLARLKGALSKRGKTRGVATNEGISTSHVDKSGALAPTYPPSKRKSDL

SEQ ID NO: 118541 - protein, 84 aa, Glycine max
  Coding DNA Sequence Number=SeqID_1763
  Homolog annotation: Hit_ID=Q1SQL2; Match level="QueryCoverage=47%, HitCoverage=30%, E-value=9e-09, Identity=65%"; Hit description=4Fe -4S ferredoxin, iron-sulfur binding
  Pfam annotation: Domain name=DUF1677; Domain location=46-84; Score= -32.7; E_value=0.0021; Accession=PF07911.4; Description=Protein of unknown function (DUF1677)
  Pfam annotation: Domain name=E7; Domain location=13-82; Score=-29.1; E_value=0.022; Accession=PF00527.9; Description=E7 protein, Early protein
  Pfam module annotation: Pfam domain module=DUF1677::E7; Domain location=46-84::13-82
MAPNQHFTNGFQSTTTVSDITLIERNKEVALEETHDDEYLPIVSEVENAKCECCGMCEECTREYIRRVRDMFSGRLICGLCAEA

SEQ ID NO: 118542 - protein, 62 aa, Glycine max
  Coding DNA Sequence Number=SeqID_1764
MGLGAGLAVGAVAGALGGLALEEGLNYEEDKIAERVENDVTAANVAAARDNYSDYRFDLVLD

SEQ ID NO: 118543 - protein, 171 aa, Glycine max
  Coding DNA Sequence Number=SeqID_1765
  Gene Ontology: Mol. function=aminoacyl-tRNA hydrolase activity; Cellular component=mitochondrion; Biological process=cell redox homeostasis
  Homolog annotation: Hit_ID=Q9Y3E5; Match level="QueryCoverage=83%, HitCoverage=82%, E-value=5e-27, Identity=38%"; Hit description =Peptidyl-tRNA hydrolase 2, mitochondrial precursor
  Pfam annotation: Domain name=PTH2; Domain location=66-157; Score =161.4; E_value=2.3e-45; Accession=PF01981.7; Description=Peptidyl -tRNA hydrolase PTH2
MPILLYMLFVYLSIIGIVCNLPGRNHLSKKICSSARPQQQQISVSSNADQELKMKYYRQVLVVRQDLKMKSGKIASQCAHAATGMYAELMQSDRYLLRRWEQCGQPKIVVTCRNQQEMNKLAEAAESIGLPTFVVADAGRTQVSAGSKTVLAVGPGPKSSVDSVTGRLPLL

SEQ ID NO: 118544 - protein, 97 aa, Glycine max
  Coding DNA Sequence Number=SeqID_1766
  Subcellular localization annotation: CTP_CleavageSite=67; ConfidenceScore=5.82e-01
MASRYRSVSQPAFSLIKSTITKPASKPVPSSFLLKTRSPVTARQVRFGGGWVVSSVACSLCFPFTRRCHQRASHLVWALIPVGRGRCLRYSPNMLKH

SEQ ID NO: 118545 - protein, 76 aa, Glycine max
  Coding DNA Sequence Number=SeqID_1767
MSNGVMVSLHGVPFRIDKNGRVGLTRSKLIHRVKNIFVTIVYRVILGKGVCLVVATDLIDRKCSWRYDLSPGCASL

SEQ ID NO: 118546 - protein, 60 aa, Glycine max
  Coding DNA Sequence Number=SeqID_1768
MNSRNQSRYLGMDASGDGVTTDRSLPLLCAKQAENAAQGIPVSFGFTVFYYHCLFLVINA

SEQ ID NO: 118547 - protein, 146 aa, Glycine max
  Coding DNA Sequence Number=SeqID_1769
MVGIRDYNLSSKGISDKPSQSSYDNMIDVPCLFTGGSLSGWPCPHPLRLRPHLRRGWDPGPTGVECTDRNSHLATPDPYGWWSQPASAPDHTSSIKRKKITQIPGENHDCGYGQVPGAKKDVLYLTMLMRSYVVSWTARPRFLMIA

SEQ ID NO: 118548 - protein, 207 aa, Glycine max
  Coding DNA Sequence Number=SeqID_1770
MAPKKFPTKRSRKDTTGEGSSAAPQADTNFDRHRFQSAEHQHHFETIKGWSFLKERQEIARKHWAPLVTPMAKFDPDIVMEFYANAWPTKEGRASSVSIARGGDRSLALMRRLLPNYYAYWARFCPDCRRETGADHAHQHDHPYTNMDDVSVAPTRYPIDQEKSNRALGFPTLITGLCQFYGVPITPNKVIQPPITRAFIEKYCTLK

SEQ ID NO: 118549 - protein, 145 aa, Glycine max
  Coding DNA Sequence Number=SeqID_1771
  Homolog annotation: Hit_ID=Q1PEY6; Match level="QueryCoverage=47%, HitCoverage=41%, E-value=2e-11, Identity=46%"; Hit description =Allergen-like
METRRIMCYNFLVASILLLSCLVCVKSRPLFLFDASTQQAFFKQSSTLDDDQTTRIQDVSKHVFDTTQGNEGKRILKAKANEYKEALRGLSRLGSTPPRCEHKCGGCIPCNPIQIPTNNDLLGAQYANYEPEGWKCKCGNSYYNP

SEQ ID NO: 118550 - protein, 100 aa, Glycine max
  Coding DNA Sequence Number=SeqID_1772
  Gene Ontology: Mol. function=RNA-directed DNA polymerase activity; Cellular component=signal recognition particle, endoplasmic reticulum targeting; Biological process=RNA-dependent DNA replication
MRGTGFGSILRRINSLLRGNPSLVPNGMDLFSSWRGSITMPIGWTSQKNGANIKEEEPKYLRSNPLQGGKDDTILPRKGPVTRAMSKRLQEDWLELLKKP

SEQ ID NO: 118551 - protein, 165 aa, Glycine max
  Coding DNA Sequence Number=SeqID_1773
  Homolog annotation: Hit_ID=Q2HUH8; Match level="QueryCoverage=83%, HitCoverage=47%, E-value=3e-12, Identity=28%"; Hit description =Histidine triad (HIT) protein; Homeodomain-like
MFGGVSMMSNGGDCLDQQVQTLVGFVAESQVPSFCSQVNLQNVPINEDISLSGCVDSKQRFSMDEDKLLMNAWLNVSKDPIVGVDQKGWLLKSESSEDDVINDALAIFIRDQGEAFKYEYACREARNQAKWLAVYGEGSSKRTKKSALRAYTSSSQSDITTNSEI

SEQ ID NO: 118552 - protein, 498 aa, Glycine max
  Coding DNA Sequence Number=SeqID_1774
  Gene Ontology: Mol. function=nucleic acid binding; Cellular component= nuclear pore; Biological process=DNA integration
  Homolog annotation: Hit_ID=Q1SRN1; Match level="QueryCoverage=86%, HitCoverage=30%, E-value=1e-69, Identity=35%"; Hit description =Integrase, catalytic region
  Pfam annotation: Domain name=zf-CCHC; Domain location=233-250; Score =6.5; E_value=0.083; Accession=PF00098.13; Description=Zinc knuckle
MKAKIPNGIPFTNYLPKWQIEHVIKSHKLQRFVVNPSIRQRYLTDEDRVANKVNLAYEAWEVQDQTLLTWLQSTLSKSVLSRVIGSLHSYQVWDKIHEYFHMQTKARAHQLHTDLRSTTLDGKTMREFLSQIKNIVHELASVGNPVPHDEHVDAILEGLPQDYAPVISVIESKFETPPVSEVEALLFAHELEPTDFVNTHLPPLSITLKGRGNNSGRRGGGHGRGRGGCFANFQCQICLKYGHTANICFYRADSNYHPHESLVLYDPHTLQSVQINPSQPTNRTSNTWVNPNLPNSRQDINVTSATPSAMLANVSSTGAAHFAWIPDSGASLHVTGEPQNIHQLGHFEGPDQIFIGNSQGLHINGSGSSSFLSPINSHVCFRLNDLLHVPSITKNLLSESKFAKDNSIFFEFHPHHCLVKSQETHETLLQGVVGVDGLYSFPNLKLQESSMLLSSAATPSSNSVALSSSSRVVFNSGDESHTNSLHLVLKLYTLLHWN

SEQ ID NO: 118553 - protein, 95 aa, Glycine max
  Coding DNA Sequence Number=SeqID_1775
HCFHRNHFSFRLKEEKVQEADVLLSEVYALSEWHPLSEACSSLSVLGNLRRRLVRDVLAQYAASSPSESFISSRPQRVQLAKAKFTYSRLASQSC

SEQ ID NO: 118554 - protein, 289 aa, Glycine max
  Coding DNA Sequence Number=SeqID_1776
  Gene Ontology: Mol. function=integrase activity; Cellular component =cytoplasm; Biological process=DNA integration
  Homolog annotation: Hit_ID=Q019M1; Match level="QueryCoverage=91%, HitCoverage=71%, E-value=3e-30, Identity=32%"; Hit description=[S] KOG2972 Uncharacterized conserved protein
  Pfam annotation: Domain name=DUF28; Domain location=53-289; Score =276.3; E_value=5.8e-80; Accession=PF01709.11; Description=Domain of unknown function DUF28
  Subcellular localization annotation: CTP_CleavageSite=49; ConfidenceScore=5.45e-01
MRALLLLQLQALTSRVSLSSSTFVRGKSLWFDANRDNSQVRRIWSSTPVCMGRRSSKIAGRKGAQDAKKAKLYSRIGKEVVSAVKRGGPNVTSNSVLAAVLEKAKELDVPKDIVERNMKRASEKGQEAYIEKVYEVYGYGGVSMVVEVSTDKIHRSVAKIREVIKDYGGKMADSGSVTFKFKRVRVVNIKATNADKDQLLAIALDAGAEDVIDPPTYEDDTEEDRSDKNYSSILSKLREEGIDFEPDNGSELLPNTPVEVDDEAMDLNKELMSKLLELDDVDAVYTDQK

SEQ ID NO: 118555 - protein, 474 aa, Glycine max
  Coding DNA Sequence Number=SeqID_1777
  Homolog annotation: Hit_ID=Q7XDI4; Match level="QueryCoverage=89%, HitCoverage=43%, E-value=4e-77, Identity=38%"; Hit description =Expressed protein
  Pfam annotation: Domain name=DUF810; Domain location=47-473; Score =165.1; E_value=1.8e-46; Accession=PF05664.2; Description=Protein of unknown function (DUF810)
MAHLFRDLSLGHSKRDSTPPPPIMPPKPSAVIAADDLPSPLGQLAASLSDSDLALTAYEIFVAACRTSSGKPLSSAANHSSTNSPSQNSPNSPALQRSITSTAASKVKKAFGLKSPGSASRKSPGSGSGQGKPKRPLTVGELMRNQMRVSEAMDSRVRRALLRISAGQVGRRIESVVVPLELLQQLKASDFTDHQEYDDWQKRTLKVLEAGLILHPHMPLDKSNSAAQRLRQIVHAALDKPIETGKNTESMQVLRSAVMSLANRSYEGSYADSCHWADGIPLNLRLYEMLLQSCFDANDESSIIEEFDELMEQIKKTWAILGLNQTLHNLCFTWVLFHRFVVTGQLDLDLLSAADGQLTEVAKDAKTTKDAEYSKVLSSTLTSILGWAEKRLLAYHETFDRGNVETMQGIVSLGVAAAKILVEDISNEYRRRRRNEVNVARERIETYIRSSLRTAFAQASSFCLPLAFPFSKRC

SEQ ID NO: 118556 - protein, 573 aa, Glycine max
  Coding DNA Sequence Number=SeqID_1778
  Gene Ontology: Mol. function=oxidoreductase activity, acting on single donors with incorporation of molecular oxygen, incorporation of two atoms of oxygen; Cellular component=chloroplast; Biological process=DNA integration
  Homolog annotation: Hit_ID=Q6Q623; Match level="QueryCoverage=99%, HitCoverage=100%, E-value=0.0, Identity=82%"; Hit description =Dioxygenase RAMOSUS1
  Pfam annotation: Domain name=RPE65; Domain location=60-572; Score =61.1; E_value=9e-20; Accession=PF03055.6; Description=Retinal pigment epithelial membrane protein
MAFTFSPSIRNSISWPTMLVPDMPDINISLRNKGIYKGKRNINLRDLTKANVASPSLPLIAPPTPEERPGITHDCHHHHHVAWTSIPQERWEGELQVQGQIPLWLEGTYLRNGPGMWHIGDYNFRHLFDGYATLVRLGFRNGRLVAGHRQIESEAYRAAKKNKKICYREFSEVPKAANFLAYVGELASLFSGASLTDNANTGVVKLGDGRVVCLTETQKGSIVIDPETLETVGKFEYSDSLGGLIHSAHPIVTDEEFLTLLPDLVRAGYLVVRMEPGTNERRVIGRVNCRGGPAPGWVHSFPVTQHYVVVPEMPLRYCAQNLLKAEPTPLYKFEWHPESRAFMHVMCKTSGKIVASVEVPLFVTFHFINAYEEQDEDGRVTAIIADCCEHNSDTTILDRLRLQNLRSFNGEDVLPDARVGRFRIPLDGSPYGTLDAALEPNEHGRGMDMCSINPNYLGKKYRYAYACGAQRPCNFPNTLTKLDFELKKAKNWHEEGAVPSEPFFVARPGATEEDDAYSLFFPRMAGVVISIVSEKNGEGFALVLDGSTFEEIARAKFPYGLPYGLHGCWVPKE

SEQ ID NO: 118557 - protein, 263 aa, Glycine max
  Coding DNA Sequence Number=SeqID_1779
MAKKVPGTSKHPTQVAQSDPKHACGQEPAGRKIGRRTPGAPAKNKKDKGSYDESLHLVKFHATSSNSNDPFHSGGGVANPEGFGVYGIQWKVDILQNDHQCVHMKVGWKNQPAWFLSADLGQSLEISILFSNTMIKVVVPAIPLGGVLKTSFQEMISETELIDAGFQGPTYTWKRGNSLKRLDRVLINLAWRIRAKWLSFGDHNTRYFDGETAVRRKSTYEAMQDLNGNWITDGEALERSKDLLSTLQPQLPDVDAPIDANAF

SEQ ID NO: 118558 - protein, 103 aa, Glycine max
  Coding DNA Sequence Number=SeqID_1780
MENGSDPNYKDHNVAAAIVVLQTWCDGSRSDIDLMKEVVYTWWKGKIERQKRKLNKKRRCRKSLSLAANDDTYVALNNSHVEAALGKSMAVPSGSNRLRDLWD

SEQ ID NO: 118559 - protein, 136 aa, Glycine max
  Coding DNA Sequence Number=SeqID_1781
  Gene Ontology: Mol. function=nucleic acid binding; Biological process= DNA integration
  Homolog annotation: Hit_ID=Q1S7C5; Match level="QueryCoverage=91%, HitCoverage=14%, E-value=2e-14, Identity=31%"; Hit description =Integrase, catalytic region
MASTPSNLVSQSFPNSIAEKLDDSNYLHWRQHVELVIKSHKLQCFVVNPATPPRYLTEDDRIADRVNLDYEAWEVQDQALLVWFQSTLHEYFSLHTKSRYVDKHAGVGVPVRHKEYVDALLEGLLSDYVPVISVIE

SEQ ID NO: 118560 - protein, 1399 aa, Glycine max
  Coding DNA Sequence Number=SeqID_1782
  Gene Ontology: Mol. function=nucleic acid binding; Cellular component= intracellular; Biological process=DNA integration
  Homolog annotation: Hit_ID=Q1SRN1; Match level="QueryCoverage=97%, HitCoverage=98%, E-value=0.0, Identity=54%"; Hit description =Integrase, catalytic region
  Pfam annotation: Domain name=rve; Domain location=550-711; Score =170.8; E_value=3.3e-48; Accession=PF00665.16; Description=Integrase core domain
  Pfam module annotation: Pfam domain module=RVT_2::rve; Domain location=893-1149::550-711
MASPFRNDGAFPSSHVKLSHLISIKLDDKNFKQWKQKIDGVVRGHKLQRFVTVPVIPHRSPSTSDPNLSEVNDAYLDWEQQDALICTWLLSTISDSLLPKLVDCTHAWQVWTEVHRYFATLLTTKARQLRSELRRLSKGTLTIESFMERVREINESLISIGDPVPLRNLIEIVLDALPEKYDPIVAAVNSKEDLSSLDELESCLLAHESRLEKHRKAILTEPVSVNLTQAQPSDSSSPMELSSPATELFPTGTSHVTAHAENNNYNFRGGRSGRGGGRFGRGGGRFAAPRPSPPQAFMGSSDPTFSNQWWYPDSGASHHVTPDSSNVSDAHSVTGSEQVFMGNGQGLSINSIGSMNFTSPNFPHKPLTLHSLLLVPHITKNLISDSSEVLLRGVVEADGLYKFQSPSSQVSKFKSLSSLNSSVALGSNNCNPSTSCNTLLHSNAQSDCITDCTPSVSMNTSNVSCVNSPLVHATTFNNSQSPQHSIVPNIIPTSKYALWHTRLGHPHYQALAEVLKTCNIPIPPKSLAEFCTACCLGKSHRLPTSLSTIVYAQPFELVVCDLWGPAPIQSLGGYTYFLTCIDACSRFVWVFPLRLKSDTLTQFVQFKTMVELQFNCKIKVVQSDGGGEFRPFTRYLNNLGITHRFTCPHTHHQNGIVERKHRHIVETGLALLAHSNLPLKMWDHAFVTAAYLINRMPSMSLANQSPYFKLLHKIPDYSHLRVLGCACFPFLRPYNAHKLDYRSQECIFLGYSTIHKVSSVPATPITSVSLSSPMSAPINTANSPIITPSNDASPASENSSLHSPITPSSLTPITSDIAEASTISPSSIPATSSPLSPVPTPQQPSIHPHNTHPMQTRAKSGITKPKIHPTLLLTHMEPTSVGQALSSPHWFQAMKDEYHALLKNQTWTLVSPFVSRKPIGCKWVFRVKENPNGSINKYKARLVAKGFHQQAGTDFTETFSPVVKPVTVRTVLTLAVTHKWPIQQIDVNNAFLNGTLEEEVFMLQPPGFEAADKTLVCKLNKAIYGLKQAPRAWFDKLKGSLLHHGFLASKCDPSLFLLHTASLTIMVLVYVDDIIITGNSASFITALIKNPNTDFSLKQLGKLDYFLGIEVTHLPNGSLLLSQAKYLTDLLAKINMLNANGMPTPMVSTSKLSKIGSPAVSDPTQFRSVVGALQYATLTRPEISFSVNKVCQFLSNPLEEHWKAVKRILRYLSGTLHHGLLIQPASPHQPLSLLGFCDADWASDPDDKRSTSGACVFLGPNLISWWSKKQRLVARSSAEAEYRSMAQLAAEILWVQSLLQELKCRLLTPTILCDNLSTVTLAHNPVLHNRTKHMELDIFFVREKVLSKNLIVKHVPAQDQWADLLTKPLSAVKFLPLHDKLRVINKLNLLDAPSVSKGE

SEQ ID NO: 118561 - protein, 72 aa, Glycine max
  Coding DNA Sequence Number=SeqID_1783
MPINNPPYEPYGLMIRRRRIVAREVEEEGKKKTTNAWEVEEEEEPQPRRRRRMVIGTPEEEQANQRKMKKWP

SEQ ID NO: 118562 - protein, 70 aa, Glycine max
  Coding DNA Sequence Number=SeqID_1784
  Gene Ontology: Mol. function=ATP-dependent helicase activity; Cellular component=cellulose and pectin-containing cell wall; Biological process=translation
  Homolog annotation: Hit_ID=Q8VWS9; Match level="QueryCoverage=83%, HitCoverage=35%, E-value=8e-24, Identity=86%"; Hit description =Putative DEAD/DEAH box helicase
MAGIAPEGSQFDARQYDTKMNELLTSDGQDFFTSYDEVYDSFDAMGLQENLLRGIYAYGRFNFLYVLLLF

SEQ ID NO: 118563 - protein, 146 aa, Glycine max
  Coding DNA Sequence Number=SeqID_1785
  Gene Ontology: Mol. function=nucleic acid binding; Biological process= DNA integration
  Homolog annotation: Hit_ID=Q1RWP6; Match level="QueryCoverage=84%, HitCoverage=9%, E-value=1e-20, Identity=44%"; Hit description=Zinc finger, CCHC-type; Polynucleotidyl transferase, Ribonuclease H fold
MSLREWLSSITKGNSSVSTYLHSIRNIVDELALIGHPIDNLEMVIRALNDLGPTFEEFTASIRTRDSPIAFNELYDKLVDFEMFLQCEEHISTPVPITAYLTQCHYNHNARGHYQTSCNNNYHGYAPTLSNTNKATNQQSYHFSIL

SEQ ID NO: 118564 - protein, 146 aa, Glycine max
  Coding DNA Sequence Number=SeqID_1786
  Homolog annotation: Hit_ID=Q1SQL2; Match level="QueryCoverage=72%, HitCoverage=81%, E-value=3e-15, Identity=38%"; Hit description=4Fe -4S ferredoxin, iron-sulfur binding
  Pfam annotation: Domain name=DUF1677; Domain location=38-146; Score =145.2; E_value=1.7e-40; Accession=PF07911.4; Description=Protein of unknown function (DUF1677)
MEQNQQKLRNAVSDVSKEIGRYYNELELEKKLGAIEEVEQAECQCCGMKEDCTTVYITEVQECYCGKWVCGLCSEVVKERVGRSPKVAMQDALNSHRDFCQEYNATTRLNPQLSLTLSMREIAKRSLENRKSVLSITKLSRAISYP

SEQ ID NO: 118565 - protein, 168 aa, Glycine max
  Coding DNA Sequence Number=SeqID_1787
  Homolog annotation: Hit_ID=Q8H6Q7; Match level="QueryCoverage=95%, HitCoverage=15%, E-value=4e-43, Identity=51%"; Hit description=CTV.22
MSASPLDSTAQTGQSSGGDWQEQVYQHIKSMKESYLPELNEMYQKIATQLQQHNSLPTQPKLDQLEKMNVFKMLERIIAFLQVSKSNISPNFKEKLGSYENHIINFINRKRHKKAMPPMQSRQLPLPHIDWQEEVYQKIKSMKENYLPELNEMYQKSASKLQRVCLVR

SEQ ID NO: 118566 - protein, 125 aa, Glycine max
  Coding DNA Sequence Number=SeqID_1788
MDHLTREDDAFNASLVEENCYEMEKMIVELNVELVETSGGTVSDCINESPQTSTLQTTSSPPNLSDAKSELKSEAHCDLTRGPECLKSSFYTQLQLLQCQQDRAFRCCQLTNKTDNDAIGFKDWN

SEQ ID NO: 118567 - protein, 32 aa, Glycine max
  Coding DNA Sequence Number=SeqID_1789
KPHFPVPGGSAIDGGGRMNSARQSIYESPDKI

SEQ ID NO: 118568 - protein, 249 aa, Glycine max
  Coding DNA Sequence Number=SeqID_1790
MARRDKLWSFCTLLSSRGGGPDDMRRQNLVIPHPFAIQTQSCPMARRDKLWSFCTLLSSRGGGPDDMRRQNLVIPHPFAIQTQSCLMARRDKLWLFCTLLSSRGGGPDDMRRQNLVIPHPFAIQTQSCPMARRDKLWPFCTLLSSRGGGPDDMRRQNLVIPHPFVIQTQSCPIARRDKLWSFCTLLSSRGGGPDDMRRQNLVIPHPFAIQTQSCPMARRDKLWSFCTLLSSRGGGPDDTRRFTSSSVLT

SEQ ID NO: 118569 - protein, 191 aa, Glycine max
  Coding DNA Sequence Number=SeqID_1791
  Gene Ontology: Mol. function=oxidoreductase activity; Cellular component=vacuole; Biological process=hydrogen peroxide catabolic process
  Homolog annotation: Hit_ID=Q39034; Match level="QueryCoverage=90%, HitCoverage=52%, E-value=1e-58, Identity=66%"; Hit description =Peroxidase 59 precursor
  Pfam annotation: Domain name=peroxidase; Domain location=41-191; Score=191.1; E_value=2.6e-54; Accession=PF00141.13; Description =Peroxidase
MNRSSNANFWLVNFFILSVGVRSQLTPDFYKTTCPDLYRIVRREVQKALKYEMRMGASLLRLHFHDCFVNGCDGSILLDGDQDSEKFATPNLNSARGFEVIDTIKSSVERACSGAVSCADILAIAARDSVLLSGGPFWYVQLGRRDGLISNGTLANLAIPSPFDTLDTIISKFNDVGLDLKDVVTLSGTMK

SEQ ID NO: 118570 - protein, 193 aa, Glycine max
  Coding DNA Sequence Number=SeqID_1792
  Gene Ontology: Mol. function=nucleic acid binding; Cellular component= mitochondrion; Biological process=DNA integration
MTDAKPIGTPMSTTCSLGTNDDIPSCDSSFFCSLIRSLHYLSITRSDVAFAVNKLSQYMQAPLSIHMQALKRILRYLKHIIFHGIHLVATRNLDLIAFCNADWGGDNVDWKSTSAYIVYLGPNAFHGHAKNSPQLRDLPLRPNIAQSEPPRLNSYGFNNFSWSLGSKYLNRQTSSQITLVLRISVQTQCSIHK

SEQ ID NO: 118571 - protein, 207 aa, Glycine max
  Coding DNA Sequence Number=SeqID_1793
MKMFVDPKNANTATLAKVAETLQYMVSPQGRNTWTIDDFVPYGAKIMILSEEQERITEPVSHGPASERQFPAQEFHILQSSVETQGIGRRREVVEAEEYFQQMVAMECITRHQHFLSILHRCISIPSKQHDAPIVTPNAPLGLQWNVPGAIPDMGDLLGVDLRHQFFVEADQVEAGRHRGRRNPNRQAQRWDRLCGASSRHHRHHNE

SEQ ID NO: 118572 - protein, 35 aa, Glycine max
  Coding DNA Sequence Number=SeqID_1794
MKCREWCIYRREEQSMDLEFSHKGGENIPNPLLFG

SEQ ID NO: 118573 - protein, 69 aa, Glycine max
  Coding DNA Sequence Number=SeqID_1795
MQTASLIGTFAVAMTHGEDATATGGFLGVASPIGDFTMQGGVASQSSKLQARVQACQPFQAFQLAGAGV

SEQ ID NO: 118574 - protein, 131 aa, Glycine max
  Coding DNA Sequence Number=SeqID_1796
MEEDAGERSSNTSSSREKEEDANEGGRRRRKASRERRKEALGELSSPRLAGYFTPKLFGSPGDLEASLGELGSRKPPEMTLLPLPFEHAQGMPEYARALAIKLADQAVIVPSNLIKVMPAQRACIFHASIG

SEQ ID NO: 118575 - protein, 113 aa, Glycine max
  Coding DNA Sequence Number=SeqID_1797
  Homolog annotation: Hit_ID=Q1S1D0; Match level="QueryCoverage=67%, HitCoverage=44%, E-value=2e-07, Identity=43%"; Hit description =Pectinesterase inhibitor
HGHRVLLGDDGCDLIGKVCNEIPKLVLELATHKAIEGQNLIKGLVKTKYVPAIAECADNYKSVADAYRRDLSLLKHDQRLANYNVATASDGSNSCEKVLAAGVALAPTYPQVR

SEQ ID NO: 118576 - protein, 157 aa, Glycine max
  Coding DNA Sequence Number=SeqID_1798
  Gene Ontology: Mol. function=RNA-directed DNA polymerase activity; Cellular component=extracellular region; Biological process=RNA -dependent DNA replication
MVLGRKKSEILRGQKGSLMASRKNIDELLCNEEIYWAQCSTTNWLEDGNKNTKYFHQKASQRNKVNTIKKIRDDEGLDFIDNHVGGRINDEMLRLLGKSFIGEKVEEAFFQMHPTKALGPDGTPAYFYQQLWDLVRPYVKQIVLEVLNNGRDPSFLS

SEQ ID NO: 118577 - protein, 150 aa, Glycine max
  Coding DNA Sequence Number=SeqID_1799
  Gene Ontology: Mol. function=RNA-directed DNA polymerase activity; Cellular component=chromatin; Biological process=chromatin assembly or disassembly
  Subcellular localization annotation: CTP_CleavageSite=34; ConfidenceScore=5.04e-01
MVHGGMHIHAKPSWGKFSVWPGWFYYTSKNSGTKASPFEVTFGKKSPIISYIINSFNIVTVDDLLVNKDTMIIVLRRKLTKAQERKSQLLLHPYTNLAKHFHGPFQILDKIGKDTIPAIMLPKIVVENQPMITPLAILNTVGITLLLHHV

SEQ ID NO: 118578 - protein, 313 aa, Glycine max
  Coding DNA Sequence Number=SeqID_1800
  Gene Ontology: Mol. function=sequence-specific DNA binding; Cellular component=nucleus; Biological process=regulation of transcription, DNA-dependent
  Homolog annotation: Hit_ID=Q1S5S6; Match level="QueryCoverage=99%, HitCoverage=100%, E-value=1e-76, Identity=51%"; Hit description=Zinc finger, GATA-type
  Pfam annotation: Domain name=GATA; Domain location=204-239; Score =65.4; E_value=1.9e-16; Accession=PF00320.17; Description=GATA zinc finger
MEAQEFFQNTFCPQFPSGTNITPSNANPSAATADHFLVEDFFDFSNDDNDATAVTDATFDSLPTDVDSPNVTPLDSTTKNSNLPSSSSADAHFSGDLSVPYDDLAELEWLSKFAEESFSSEDLQKLQLISGVRAQNDAASSETRDPNPGASGHVGPHATGHSRLVVLSPNTTSSSSNSDAGKKPATPRRREAAFAEGGSEGRKCLHCATDKTPQWRTGPMGPKTLCNACGVRYKSGRLVPEYRPAASPTFVLTKHSNSHRKVLELRRQKEMVKVQQHQFLQLHQQNMMFDVPSSNGEDYLIHQHVGPDYTHLI

SEQ ID NO: 118579 - protein, 338 aa, Glycine max
  Coding DNA Sequence Number=SeqID_1801
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q9AXK9; Match level="QueryCoverage=80%, HitCoverage=51%, E-value=1e-115, Identity=73%"; Hit description =Lycopene epsilon-cyclase
  Pfam annotation: Domain name=DAO; Domain location=112-312; Score= -28.8; E_value=0.00043; Accession=PF01266.14; Description=FAD dependent oxidoreductase
  Pfam annotation: Domain name=Lycopene_cycl; Domain location=112-338; Score=169.6; E_value=7.9e-48; Accession=PF05834.3; Description =Lycopene cyclase protein
  Pfam module annotation: Pfam domain module=DAO::Lycopene_cycl; Domain location=112-312::112-338
  Subcellular localization annotation: CTP_CleavageSite=53; ConfidenceScore=5.56e-01
MECVAARNLAAMAFCVSPLSSRLRLRRKKLWRRRTASSSSSCGGRGVRCLKVEAKAGSESCVATKEDFADEEDYVKAGGSELVFVQMQQNKAMEMQSKLADKLPPIGDDILDLVVIGCGPAGLALAAESAKLGLKVGLIGPDLPFTNNYGVWEDEFKDLGLEGCIEHVWKDTIVYLDNKDPIFIGRSYGRVSRHLLHEELLRRCVESGVSYLSSRVESVIETSNGHSHVVCEYDVVVPSRLVTVASGAASGKLLQYEVGGPKVSVQTAYGVEVEVENNPYDPNLMVFMDYRDYMKQNVQCPEANYPTFLYAMPMSHTKVFFEVCSIFVNNNNNNALSH

SEQ ID NO: 118580 - protein, 126 aa, Glycine max
  Coding DNA Sequence Number=SeqID_1802
  Gene Ontology: Mol. function=RNA-directed DNA polymerase activity; Biological process=RNA-dependent DNA replication
MEKNIYRLAKCRETGTRDLNKVKCIKNGEVNFLVTEEDIRKNGRVNSMCYEHVKRTNNDTAVKRDNIHSDIWKDLREKGISWLTKLFNGIMRSKRMSDGWRRRTLIPIYKNTRDTQSCANYNGLSS

SEQ ID NO: 118581 - protein, 150 aa, Glycine max
  Coding DNA Sequence Number=SeqID_1803
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=66%, HitCoverage=18%, E-value=5e-45, Identity=96%"; Hit description=NADH -plastoquinone oxidoreductase subunit 2
  Pfam annotation: Domain name=Oxidored_q1; Domain location=3-148; Score=-98.7; E_value=0.011; Accession=PF00361.10; Description=NADH -Ubiquinoneplastoquinone (comple
MFLSTIWIYQERCTANEATTKYLLMGGASSSILVHGFSWLYGSSGGEIELQEIVNGLINTQMYNSPGILIALLFITVGIGFKLSPAPSHQWTPDVYEGVRDYEYNRSIRQQKDHPKMIISWLLRTNQIRWVLFLILNVFDLGSVGTSHRD

SEQ ID NO: 118582 - protein, 506 aa, Glycine max
  Coding DNA Sequence Number=SeqID_1804
  Gene Ontology: Mol. function=protein serine/threonine kinase activity; Cellular component=phragmoplast; Biological process =protein amino acid phosphorylation
  Homolog annotation: Hit_ID=Q5SNF8; Match level="QueryCoverage=85%, HitCoverage=76%, E-value=0.0, Identity=73%"; Hit description =Putative serine/threonine kinase 38
  Pfam annotation: Domain name=Pkinase; Domain location=111-434; Score =252.7; E_value=7.6e-73; Accession=PF00069.15; Description=Protein kinase domain
  Pfam annotation: Domain name=Pkinase_Tyr; Domain location=111-412; Score=5.4; E_value=8.4e-13; Accession=PF07714.7; Description=Protein tyrosine kinase
  Pfam module annotation: Pfam domain module=Pkinase::Pkinase_Tyr; Domain location=111-434::111-412
MENQKAGESVHVREEEDDVAVEEEEEQQGDVDVGSSMTLERVAAAKKFIENHYRSQRKHIQERKERRLMLEKKLASSQVPEDEQINLLKDLELKETEYMRLKRHKICVDDFDLLTIIGRGAFGEVRLCREKKSGNIYAMKKLKKSEMLSRGQVEHVRAERNVLAEVACDFIVKLYYSFQDAEHLYLIMEYLPGGDIMTLLMREETLTETVARFYIAESVIAIESIHKHNYIHRDIKPDNLLLDQYGHMKLSDFGLCKPLDCSSLSSISENEILDDENLNDTMDVDGALPNGRNGRRWKSPLEQLQHWQINRRKLVISVCPCSEVVFDDFLAFSTVGTPDYIAPEVLLKKGYGVECDWWSLGAIMYEMLVGYPPFYSDDPVSTCRKIVHWKNHLKFPEEVRLTPEAKDLICRLLSGVPHRLGTRGAEEIKAHPWFKDVMWDRLYEMEAAFKPQVNGELDTQNFMKFDECAMSIPVVCFVSMTSMNLLHPFSLFLTREVGAIEVVVGL

SEQ ID NO: 118583 - protein, 208 aa, Glycine max
  Coding DNA Sequence Number=SeqID_1805
  Gene Ontology: Mol. function=RNA-directed DNA polymerase activity; Cellular component=chromatin; Biological process=chromatin assembly or disassembly
MVKRLTPEEPTFRREHGMCFTCDERYLRGHYGASKASLLVAEDEDSNSLNTDPVDPTLDLKPTPNPDPKFTPDSDPKPTSNPDPIHSAQISLTFFSGDLAPRNLRPADLISGNRVVILVDGRSTHTFFQPQLSISLSLPNRTAPTPLREMFLPHEHFVELQGVIGKHIAADKVQEVQAEAVTGKHIAAGNKVQEVQTETNKNNQIAEF

SEQ ID NO: 118584 - protein, 131 aa, Glycine max
  Coding DNA Sequence Number=SeqID_1806
MATATLSPTDVDKFSHLKSVVVALSQIQKEKGDMNFKFEKGFSSTGEVNVATTGSTADDVVMKGGVMSFARHMEAALLTNWTSLYLIGKHIAADKVQEVQAEAVAGKHIAAGNKVQEVQIETNKNNQIAEF

SEQ ID NO: 118585 - protein, 179 aa, Glycine max
  Coding DNA Sequence Number=SeqID_1807
MALNSLVQSLGVGGYGDLWVVMEEGLMRYCGCGNMHWLPLCGTTCKVMVDEVCTTQWQNMKINNEGNILDLYWSSFANCGYSPHPLRSPLVAVQCGPRDGSNEGLSSSKDSPSSAMSRKALEAHLWPDEIFMQLKKRPRSRLKVSSSGDSRLMGSEARGFGSVGNNDKEEVVAEGEGDD

SEQ ID NO: 118586 - protein, 522 aa, Glycine max
  Coding DNA Sequence Number=SeqID_1808
  Gene Ontology: Mol. function=protein serine/threonine phosphatase activity; Cellular component=protein serine/threonine phosphatase complex; Biological process=protein amino acid dephosphorylation
  Homolog annotation: Hit_ID=P49597; Match level="QueryCoverage=61%, HitCoverage=70%, E-value=1e-99, Identity=59%"; Hit description =Protein phosphatase 2C ABI1
  Pfam annotation: Domain name=PP2C; Domain location=221-505; Score =284.0; E_value=2.9e-82; Accession=PF00481.12; Description=Protein phosphatase 2C
MEEITSTVAVPFTLENLIQKEPAVTTHMEITGLKLRANTSPPLILNPSIEIEKHTDIGPQPQIKASSEGTENLVGAGLVSEMVSQGDNNGLYSESLKQARKENESLQAKDFQCGGKIGPCREESSVLRTNCERNSPITIKVGDNIIDGKSGSTKPPRAREHESDNGSGPDESNKKTFAVPCAMPEKPTCLELSGGTSTNCTTPLWGCSSVCGRREEMEDAIAVKPHLFQVTSRMVRDDHVSENTKYSPTHFFGVYDGHGGIQVANYCREHLHSVLVDEIEAAESSFDGKNGRDGNWEDQWKKAFSNCFHKVDDEVGGVGEGSGASVEPLASETVGSTAVVAILTQTHIIVANCGDSRAVLCRGKQALPLSDDHKPNRDDEWERIEAAGGRVIQWNGYRVLGVLAVSRSIGDRYLKPWVIPEPEVKCVQRDKSDECLILASDGLWDVMTNEEACEIARKRILLWHKKNGNNSVSSEQGQEGVDPAAQYAAEYLSRLALQRGTKDNISVIVIDLKPQRKIKKKE

SEQ ID NO: 118587 - protein, 78 aa, Glycine max
  Coding DNA Sequence Number=SeqID_1809
  Gene Ontology: Mol. function=protein serine/threonine kinase activity; Biological process=protein amino acid phosphorylation
  Homolog annotation: Hit_ID=Q5JCL0; Match level="QueryCoverage=58%, HitCoverage=12%, E-value=2e-14, Identity=76%"; Hit description =Mitogen-activated protein kinase kinase MAPKK2
MPPPIRPQDDQLSLADIDTIEVIGKGNGVIVQWVQHKWTNQFFALKVFDPITLLDIGFDGCLLKGTCDAILLVGETLT

SEQ ID NO: 118588 - protein, 168 aa, Glycine max
  Coding DNA Sequence Number=SeqID_1810
  Gene Ontology: Mol. function=protein binding; Cellular component =paraspeckles; Biological process=mRNA processing
  Homolog annotation: Hit_ID=Q9SZQ4; Match level="QueryCoverage=85%, HitCoverage=73%, E-value=2e-43, Identity=60%"; Hit description=MRNA cleavage factor subunit-like protein
  Pfam annotation: Domain name=NUDIX; Domain location=37-164; Score =0.8; E_value=0.082; Accession=PF00293.18; Description=NUDIX domain
MGEEEEEEVSVTALHHPNSGNDDQSLEFDIYPLSSYYFGSKDAVPSKDLTLVDRVLRMKSKNSIYKLPGGRLRPGESDTDGLKRKLARKLSVNEDGDGSEWEVGECLGMWWRPDFETLMYPFIPPNVKKPKECTKVFLVKLPESRKFIVPKNMRVLAVPLCQVHENHK

SEQ ID NO: 118589 - protein, 51 aa, Glycine max
  Coding DNA Sequence Number=SeqID_1811
MKFLSDRIPKRVVENAVVVECGALVFGVIKRVNQPHLIIDQPKMGCPTCPT

SEQ ID NO: 118590 - protein, 62 aa, Glycine max
  Coding DNA Sequence Number=SeqID_1812
PRLFRFFRRFPQINVGGDSARIPFVEHASRESRVALPPKGRLRHSRSTSLEPKSQLIINLDP

SEQ ID NO: 118591 - protein, 235 aa, Glycine max
  Coding DNA Sequence Number=SeqID_1813
  Homolog annotation: Hit_ID=UPI0000D9B3B9; Match level="QueryCoverage =96%, HitCoverage=75%, E-value=5e-08, Identity=24%"; Hit description =PREDICTED: similar to splicing factor 3a, subunit 2
  Subcellular localization annotation: CTP_CleavageSite=45; ConfidenceScore=5.50e-01
MNLLPSAVHASSTQESGAPRIYCLALFANSPFSTFLRSPMNLLPSAVHASSTHESGAPRIYCLALFANSPFSSFFAAPQIYCLALFANSTFPTFIRSPMNLLPSAVHESSTHEPGAQRIYYLALFANSPFSTFIWSPMNILPSAVHASSTHESGAPRIYCLALFANSPFSTFFGAPRIYCLALFANSPFSTFIRSHVNLLPSAAHASSTHESGAPQIYCLALFANSPFSTLIRSP

SEQ ID NO: 118592 - protein, 89 aa, Glycine max
  Coding DNA Sequence Number=SeqID_1814
  Gene Ontology: Mol. function=nucleic acid binding; Biological process= DNA integration
  Homolog annotation: Hit_ID=Q1SDG1; Match level="QueryCoverage=97%, HitCoverage=10%, E-value=1e-13, Identity=49%"; Hit description =Integrase, catalytic region; Zinc finger, CCHC-type
MKKAYITWDDNDMESSEDSKNEEINLCLMAKSYESDEEVSLRKEWYIDSGCSKHMTGDASKFTYISPKKSGHVLSTTYLVLVNYVTKAI

SEQ ID NO: 118593 - protein, 57 aa, Glycine max
  Coding DNA Sequence Number=SeqID_1815
MLVKKFMDLTGGSTILDRIATPKRLCGITNVATVELIVPTWWWRHRKTLKAFLVLRR

SEQ ID NO: 118594 - protein, 127 aa, Glycine max
  Coding DNA Sequence Number=SeqID_1816
MVQPEPSVGLKGKPHQYVPTFMSSCISTNKGLGPLDLSHVLAFILTFTSCPHPTNGENTIEAFHRALGGRTFGYQQKGNGDNVACPIISEHNLGLRPSPTTPQFNESKHKFSPNCLTELVNYVQFKG

SEQ ID NO: 118595 - protein, 210 aa, Glycine max
  Coding DNA Sequence Number=SeqID_1817
MERQLETKHSYKKTFHYDTSRGKGKSKKEGSSSPKKQGSNSTSGRVSHFNKMDDDSKHTIIAKDSVIAKQQKFSKTNLKVVKVTLEQSPKEAPQVDLDTINKRKQKRLAKAIANEDQAVALVAPTPKKSKESPTNPRITEFISVETVERETISVQASTWTKYDYEHTPSEAFKALPTDAIVHLPFPQWTHPIQPNVIKMPPHWLAPGTKQ

SEQ ID NO: 118596 - protein, 201 aa, Glycine max
  Coding DNA Sequence Number=SeqID_1818
MYVRDQATAYPPDLHISRATDIKTVVDKVCPHLPIWDADLLEPDLEKAFTCGYDGRDNVEHHDIIQVLHLVRKYYFNDACICFSKDAYNNTFIQRLLQLRTIQYQDVASVQDEASTKVMDDTIVCRVIIDLTNTSVMDGTPKASNSTIADEGEPNILIIYSTSIGPAPFELCTTCYCYQRSSARHDRAINEIICRTIKSRK

SEQ ID NO: 118597 - protein, 74 aa, Glycine max
  Coding DNA Sequence Number=SeqID_1819
  Homolog annotation: Hit_ID=Q2PMM5; Match level="QueryCoverage=45%, HitCoverage=1%, E-value=1e-09, Identity=88%"; Hit description =Protein ycf2
MEYDSLSRCLGGEMVDTRDSKSRAKERGGDLSIEKIHRPETKRKKGRSVWEVRSSLDISSSVKNCRCENTETKG

SEQ ID NO: 118598 - protein, 87 aa, Glycine max
  Coding DNA Sequence Number=SeqID_1820
MGSSRLSFILVLVLVTFSSMIIDSRVAEARTLPKSALLPSKVDIPTVVPLPLVAPLPNLPVTLPPVPELPAVPKVPIPEGGSGSVGV

SEQ ID NO: 118599 - protein, 241 aa, Glycine max
  Coding DNA Sequence Number=SeqID_1821
  Gene Ontology: Mol. function=nucleic acid binding; Cellular component= intracellular; Biological process=DNA integration
  Homolog annotation: Hit_ID=Q1T693; Match level="QueryCoverage=96%, HitCoverage=20%, E-value=2e-85, Identity=63%"; Hit description =Integrase, catalytic region; Zinc finger, CCHC-type; Peptidase aspartic, catalytic
MEEEEISEPLAFEEALSDENWRKAMDDEIHALEKNDTWELTNLSADKRPIGVKCKYKTKYNPNREINRFKTRFVAKGYKQNPSIDYFEIYQMDVKSAFLNEILEEEAYVEQLVGYVVRGKEDKVYRLKKNLYGLKQVLRVWSTCYTSKFVDPGDILIVCLYVDDLISTGNNLRIIAKFKEAMISYFEMTNLGLMSYFLGIEVIQQDDGIYISQKKYVDNILKKFKTNFHISSREVDANKGK

SEQ ID NO: 118600 - protein, 239 aa, Glycine max
  Coding DNA Sequence Number=SeqID_1822
  Gene Ontology: Mol. function=carbonate dehydratase activity; Cellular component=chloroplast; Biological process=carbon utilization
  Homolog annotation: Hit_ID=Q69MC9; Match level="QueryCoverage=53%, HitCoverage=44%, E-value=4e-40, Identity=61%"; Hit description =Putative carbonic anhydrase
  Pfam annotation: Domain name=Pro_CA; Domain location=90-231; Score =111.1; E_value=3.3e-30; Accession=PF00484.9; Description=Carbonic anhydrase
  Subcellular localization annotation: CTP_CleavageSite=54; ConfidenceScore=5.50e-01
MAVPAPFSLSSDPFASKSATSTILGPAVLKIGNFEQTHFGLFTALRRNQGFTLKASMGPAGFTEKLNNNRLKTLADAEDGKNIEQFENLAKVQTPKFMVIACADSRVCPSNVLGFQPGEAFMIRNVANLVPTFESGPSETNAALEFAVNSLLVENILVIGHSCCGGIRALMGMQDDDVERSWVIVGKNARKKAKAAASNFSFDEQCKHCEKGKGVGVGRVGASILTEVILKTYLQFLLM

SEQ ID NO: 118601 - protein, 117 aa, Glycine max
  Coding DNA Sequence Number=SeqID_1823
  Gene Ontology: Mol. function=RNA-directed DNA polymerase activity; Biological process=RNA-dependent DNA replication
  Pfam annotation: Domain name=AT_hook; Domain location=33-45; Score =14.9; E_value=0.061; Accession=PF02178.9; Description=AT hook motif
MVKNRLRWFGHVERRPVDSVVRRVDQMERRQTIRGRGRPKKTIREVIKKDLEINGLDRSMGFGITSGGGNSSLENLALLTVEMLIVVGFLPLQTLSDPSLLKKLEKVRSGTHHLSNL

SEQ ID NO: 118602 - protein, 70 aa, Glycine max
  Coding DNA Sequence Number=SeqID_1824
FYDDALRYLCAEIADGKLVDMKGKVENCEILRVRETKFGVSVNWGLKTCGKAWAEQMRKMSDQSESKSHF

SEQ ID NO: 118603 - protein, 199 aa, Glycine max
  Coding DNA Sequence Number=SeqID_1825
  Gene Ontology: Mol. function=peptidyl-prolyl cis-trans isomerase activity; Biological process=protein folding
  Homolog annotation: Hit_ID=Q38931; Match level="QueryCoverage=97%, HitCoverage=58%, E-value=6e-31, Identity=33%"; Hit description=70 kDa peptidyl-prolyl isomerase
  Pfam annotation: Domain name=FKBP_C; Domain location=116-198; Score =23.4; E_value=2.6e-05; Accession=PF00254.18; Description=FKBP-type peptidyl-prolyl cis-trans i
MVSWSTIRDLTRHGGIKKKIIREGEGWATPREADEVLVKYEARLENGMLVSKSDQGVEFNVSDDGLGQNSNKITELDGVLPADSNLTCIKLELVSLKIVTDVTGDKKILKKIKKAGEGFDHPNEGSQVKVIYLCKGEDGTVIESKGSEEEPFELTTQEEPVPEGLERAIMTTKKGEQALVTVDAEYLSDYNNSRGNTNQ

SEQ ID NO: 118604 - protein, 699 aa, Glycine max
  Coding DNA Sequence Number=SeqID_1826
  Gene Ontology: Mol. function=signal transducer activity; Cellular component=membrane; Biological process=response to light stimulus
  Homolog annotation: Hit_ID=Q1SGA7; Match level="QueryCoverage=96%, HitCoverage=100%, E-value=0.0, Identity=79%"; Hit description =BTB/POZ; NPH3
  Pfam annotation: Domain name=BTB; Domain location=68-171; Score= -14.0; E_value=0.076; Accession=PF00651.21; Description=BTBPOZ domain
  Pfam annotation: Domain name=NPH3; Domain location=254-544; Score =487.4; E_value=1.6e-143; Accession=PF03000.5; Description=NPH3 family
  Pfam module annotation: Pfam domain module=BTB::NPH3; Domain location= 68-171::254-544
MPISAQPLKALSQEKSRVLHSVNLVFSMWESESESASAHKYGGGLLTSSNHGVKTEGFVQRGHSWYVATDIPSDFLVQIGEANFHLHKYPLVSRSGKLSRVIYESHDPDLNKIVIDDIPGGAEAFELAAKFCYGIAVDLTAGNISGLRCAAEYLEMTEDLEEGNLIFKAEAFLSYVVLSSWRDSIVVLKSCEKLSPWAENLQIVRRCSESIAWKACANPKGIRWSYTGRTAKISSPKWNDMKDSSPSRNQQVPPDWWFEDASILRIDHFVRVITAIKVKGMRFELVGASIMHYATKWLPGLISDTAIPGDEASNCSMSNSSSSGGSSWKGGLHMVVTGTKDDTSSLQAKEQRMIIESLVSIIPPQKDSVSCSFLLRLLRMAIMLKVAPALVTELEKRVGMQFEQATLADLLIPSYNKGETMYDVDLVQRLLEHFIIQEHTESSSPSRQSFSDKQHMGMGCILNAKARVARLVDSYLTEVSRDRNLSLTKFQVLAEALPESARTCDDGLYRAIDSYLKAHPTLSEHERKRLCRVMDCQKLSIDACLHAAQNERLPLRVVVQVLFAEQVKISNALASSSVKDVESESHAMVTNRKTLLEGTPQSFQEGWTAAKKDINTLKFELESVKAKYMELQNDMASLQKQFDKMLKQKHTSAWSSGWKKLSKLGRTTHLVENQDDSPEIQDSLEQNRKTTRRWRNSIS

SEQ ID NO: 118605 - protein, 195 aa, Glycine max
  Coding DNA Sequence Number=SeqID_1827
MEVERMRQLMLMWCRIRSNRVALVGGNHTAASTMKNKHLHDGRTIAALNPESFLVIRIPDALVLRILSRSLFVAMVLAALPFLGTVLKGFYFSSSFVPNVETAAASGSLDVGLLNSILHDFAHEGLLRENDKALVLNSPLPNVFREKIDVVMDSDWESKSLFADVSYDFVFTSGDIDAEFIDRILKIDGIVALPL

SEQ ID NO: 118606 - protein, 408 aa, Glycine max
  Coding DNA Sequence Number=SeqID_1828
  Gene Ontology: Mol. function=transcription regulator activity; Cellular component=nucleus; Biological process=unidimensional cell growth
  Homolog annotation: Hit_ID=Q9FMF4; Match level="QueryCoverage=57%, HitCoverage=61%, E-value=2e-22, Identity=39%"; Hit description =Arabidopsis thaliana genomic DNA, chromosome 5, P1 clone:MSJ1
MVCQAASQTRFRALKHESGIKGEPAIIVRVIACFQPLHDCQLKFVVFYFCHLFPREAASHSRSHIKALDHRSWPYPQHVAWPSPYLNCSCTSAEPSSQVHSAYMNPSTCIFPAVSVFPGFTAPALPNWKTEQTNEVHGFHQYPHSEPYLKETHTGGAMQNANHASFQKKLLIFDHSGSKTRMLYSPVFSLVQSPTVTATKFAQVYHVNMEAQATNMGQKHLPIYTSPEETGKDHIDNEESEMHEDTEEINALLYSDDDDDDEVTSTGHSPLVTKRTYVMQEQFAGMKKEVAGSDWPNKRQKLIDSGYNTLPPLMDSASSERLNEMCEYASDAESKYSSSGGVYAARQTKEDNPTPADIQLKKDKIRELLRVLENFIPGAKGKHPLLVIDGTIEYLKSLASQAGTLKYH

SEQ ID NO: 118607 - protein, 111 aa, Glycine max
  Coding DNA Sequence Number=SeqID_1829
  Homolog annotation: Hit_ID=P51850; Match level="QueryCoverage=39%, HitCoverage=7%, E-value=4e-14, Identity=81%"; Hit description =Pyruvate decarboxylase isozyme 1
MENLVAAIIIGIGSPNNANDWKILTVSTRNGVQNTKTTNVEGSHDIKDAARQGHHKKLRTPLPRGSSLCEGMGEGCCTQSYPCICKEAVSGFEPMTNKSSRHNFTAVPRAP

SEQ ID NO: 118608 - protein, 71 aa, Glycine max
  Coding DNA Sequence Number=SeqID_1830
MFPQKICISPHSVVPLLLALTKIVTRCNEISHAVVSATTVTAEWRRCEVRQRLGKLIREWCDSDGARYMTA

SEQ ID NO: 118609 - protein, 205 aa, Glycine max
  Coding DNA Sequence Number=SeqID_1831
  Gene Ontology: Mol. function=thiamin pyrophosphate binding; Cellular component=cytosol
  Homolog annotation: Hit_ID=Q1I1D9; Match level="QueryCoverage=98%, HitCoverage=47%, E-value=2e-41, Identity=67%"; Hit description =Pyruvate decarboxylase
MEMVDASGYPFAMLASAKGMVEEHHPNFIGTYWGPASTPFCAEIVESSDAYLFAGPISNDIISLGNSLPLKKESSIVVLPDRVMIGNGPTIGYECQMQYGSIGWSVGATLGYAQAAPHKRVIASRNLGRKCGLSNTYQTTVQEVSTMLRCGQNGIVFLINNGGYTTEVEIHDGLYNVIKNWDYAGLVERIDNGEGKCWTAKVRQS

SEQ ID NO: 118610 - protein, 535 aa, Glycine max
  Coding DNA Sequence Number=SeqID_1832
MGHLLEEGKVVDVFIPKRRSKSVQQFGFVCFMEVENEGKLEHERRLLLCPSNKSPKPGVEEKNGQRQGSGVEGRVVIRIRSTNEEWLKRPVRDNLTLIPKNGEEDVHAIMENKDWLGFLAFVSTTGTFINMAEKISSLEKVDYARIVVKEAPTVEGGTCYYNKDKDGDNSAPSFDGTDEANKISNTKNKIGAVFKGSKEEFVEELLTYNVRGLWGRAKWKEIREVIAREELDMICIQSQRWKLILIKYVVLYGGILDISVYVMATKMAKCYPTLQDLQLLDQGIGFWEFEKAKYEAIDVHGWGAFVFKLHERKELIEKFWRTTRIQESIMCQKSRIKWLKEGDVNTKVRRVWCDDPSIVKKKIKEFFHSKFKEDKEMQVLLDDSNASFLTLIPKKENPQGLGEYRPISLIGCLYKILAKSLANRIKKVLGGIIDDKAKEYFGWGVVLLWQIDTMDVELPTNILHIRACEREVEAKRMLSGMEIGNGNLKISLLQFIDDTIFFFKDEVRDTIIAKAILRCFEMAFGHKVNFYKSSL

SEQ ID NO: 118611 - protein, 115 aa, Glycine max
  Coding DNA Sequence Number=SeqID_1833
  Subcellular localization annotation: CTP_CleavageSite=32; ConfidenceScore=5.16e-01
MAHRSLFLSLRRFSSCRNSGLACVLNRTRFVSSGAVSSDLVEESVEGDDDLRSRIFRLRLPKRSATNVLQKWVLQGNPITLSQLRDISKELRRSQRYKHALEVSPFPLEYNNTGL

SEQ ID NO: 118612 - protein, 110 aa, Glycine max
  Coding DNA Sequence Number=SeqID_1834
MTGVMVLNRGQQPKLGPHQSHFFAVARNVKVFWLTETATAILNHDRSLWGFGNSDVLKKASLWWRDLAKRGQCRLGSCVVCPQGIRQNLELGHGLMRKGKEENSLIMNGR

SEQ ID NO: 118613 - protein, 501 aa, Glycine max
  Coding DNA Sequence Number=SeqID_1835
  Gene Ontology: Mol. function=phosphotransferase activity, alcohol group as acceptor; Biological process=protein modification process
  Homolog annotation: Hit_ID=Q9SI52; Match level="QueryCoverage=76%, HitCoverage=59%, E-value=2e-94, Identity=47%"; Hit description =Expressed protein
  Pfam annotation: Domain name=PI3_PI4_kinase; Domain location=120-374; Score=228.1; E_value=2e-65; Accession=PF00454.17; Description =Phosphatidylinositol 3- and 4-kinase
MVVSIDQHHGFKPFSRTQRCKLQSYGHLDPNIIELSQTGGALSSSSNSFGLAFQAENIHRSFSTPCLPLTTMLGGEDFTSSSHPRVEIVGGSEAPPVHALVVEVAIAMASGVHPIPLPSGLGGAYVFPNQNGNNIAVAKPVDEEPLALNNPKGLGGQMLGQPGLKKSIRIGETGIRELAAYLLDHGGLAGVPPTALVKFSHAAFFGATATISHMPKIASLQRFVGHDFDAGELGPSFFQVSSVHQIGILDIRIMNLDRNAGNMLVMKHDHNNSGYVDGVADLVPIDHGFCLPEWLDDPYFEWLHWPQASIPFSDYVLEYISKLDPFRDAEILRTNLPSLRESSIRVLIACTIFLKQAAAAGLCLAQIGQMMTREFCDGEESPSELENICLKVKTTSVPRGSDDNVNNRKDETEECDEVGGIISLADLNQGEWEAFLEGFSELLHGFFEGDVVDEGDIVVVEGVEVTEVVIGRGVDDVVEIVKGVVLLVDEEEFDGGVAMGA

SEQ ID NO: 118614 - protein, 75 aa, Glycine max
  Coding DNA Sequence Number=SeqID_1836
MSLGGFQNILSERWEMVAREVSFWKAKWLGEENLSTKHNCAFLNSEQKFNSIAEMGAWRGEEWHWELLWRMPWFQ

SEQ ID NO: 118615 - protein, 382 aa, Glycine max
  Coding DNA Sequence Number=SeqID_1837
  Gene Ontology: Mol. function=transferase activity, transferring glycosyl groups; Biological process=carbohydrate metabolic process
  Homolog annotation: Hit_ID=Q6R608; Match level="QueryCoverage=81%, HitCoverage=33%, E-value=1e-145, Identity=76%"; Hit description=4 -alpha-glucanotransferase
  Pfam annotation: Domain name=Glyco_hydro_77; Domain location=14-382; Score=52.2; E_value=4.5e-13; Accession=PF02446.8; Description=4 -alpha-glucanotransferase
MQHADAVRTGTLETSLSSPSSSLFLEVLTLKVQQQAAARNTGKKAKRKNEKLKISLSVFALHPLYLRVQALSKNIPEEIKKEIEKAKQQLDGKDVDYEATMATKLSIAKKVFAQEKDLILNSSSFKEFFSENEGWLKPYAAFCFLRDFFETSDRTQWGCFAHYSEDKLEKLVSKDSLHYEIICFHYYVQYHLHLQLSEAAEYARKKGVILKGDLPIGVDRNSVDTWVYPNLFRMNTSTGAPPDYFDKNGQNWGFPTYNWEEMSKDNYGWWRARLTQMAKYFTAYRIDHILGFFRIWELPDHAATGLVGKFRPSIPLSQEELEREGIWDFNRLSYPYIKRELLQEKFGDAWTFVATTFLKEIDKNFYEHTFSFSHKGSREQLF

SEQ ID NO: 118616 - protein, 240 aa, Glycine max
  Coding DNA Sequence Number=SeqID_1838
MEVGVAEVEPFCGVKVEEEGVVELLAAAEVLLADSRNGGKQPQWKLDPSRLWAAARLWTAAVWVRTAEVAEAARLAEVAWSWMSIKFGQGGPRWQTKTQGGVVVVVGGSGGWSCSCGGQPWKLRTTSSVGGGRQPWKLHMVSGSHGRRPREVNESTKCYVQRLVAELRGSAPPETKRKKEKIGWFQGCQCLPRKREKGKLCYFIHILQVPLQRIYIATNGTRPRHPLTVLRKSTQKQKYH

SEQ ID NO: 118617 - protein, 205 aa, Glycine max
  Coding DNA Sequence Number=SeqID_1839
  Homolog annotation: Hit_ID=Q2HUT4; Match level="QueryCoverage=65%, HitCoverage=23%, E-value=5e-24, Identity=47%"; Hit description =Putative RING zinc finger protein-related
  Subcellular localization annotation: CTP_CleavageSite=64; ConfidenceScore=5.85e-01
MNQYLSQLATPSPTHAPTPTPTPTPTPRKGVTPPKVGSPAASKSAPAPGKSSQSEPPNCHFRKRSTHNSGKHAHPPMPAVAPIINPHHPVPVASPKLQVEPPTHVSHSVPALSPLPNVAFAHAEPPPKNEPAPERSQTHSHGPPLSSCFACRLTSKQDNCLVLSAAGCLRTVKWASLMLIVLVLHVKFPKWQALITHIAAVCDVR

SEQ ID NO: 118618 - protein, 107 aa, Glycine max
  Coding DNA Sequence Number=SeqID_1840
MASLQLVAPPDPIPMVEQFNEWVAWPRTQPPLHREDEDPATQVPYQSEDESSESSTPKPLIKKRRVVVTQEATTTSENSLEATPELPTPVADTTSPQQTTDNRPFHA

SEQ ID NO: 118619 - protein, 83 aa, Glycine max
  Coding DNA Sequence Number=SeqID_1841
MTKARQKGVRKEGSTKFFFISPPIYRKMGEMLATQLAQASKVTSSRRMLLEESSGGPNWVWLLFAPPFLLNTPPAFFLVILFP

SEQ ID NO: 118620 - protein, 65 aa, Glycine max
  Coding DNA Sequence Number=SeqID_1842
  Homolog annotation: Hit_ID=Q1SGR1; Match level="QueryCoverage=71%, HitCoverage=5%, E-value=2e-17, Identity=91%"; Hit description =Kinesin, motor region; Prefoldin
MENGTPGKQYTIKHDANGNTQVSDLTVVDVHSAKEVAFLLNQPANSRCNKLLHLLAIYEGDAMLS

SEQ ID NO: 118621 - protein, 562 aa, Glycine max
  Coding DNA Sequence Number=SeqID_1843
  Gene Ontology: Mol. function=transporter activity; Cellular component= membrane; Biological process=sodium ion transport
  Homolog annotation: Hit_ID=Q8L7Z8; Match level="QueryCoverage=83%, HitCoverage=80%, E-value=0.0, Identity=74%"; Hit description =Glutamate/malate translocator
  Pfam annotation: Domain name=CitMHS; Domain location=126-494; Score= -102.3; E_value=0.002; Accession=PF03600.6; Description=Citrate transporter
  Pfam annotation: Domain name=DctM; Domain location=129-550; Score= -242.1; E_value=0.064; Accession=PF06808.2; Description=DctM-like transporters
  Pfam annotation: Domain name=Na_sulph_symp; Domain location=92-562; Score=596.9; E_value=1.8e-176; Accession=PF00939.9; Description =Sodium:sulfate symporter transmembrane region
  Pfam module annotation: Pfam domain module=CitMHS::DctM::Na_sulph _symp; Domain location=126-494::129-550::92-562
  Subcellular localization annotation: CTP_CleavageSite=69; ConfidenceScore=5.80e-01
MESFALSASTSFSRFSQLHHRPRPVISRSQSLRSPITISQRFSFPSKPSSTFNFNFKFNRFSKPHYPIQASPSSSSSPPPPPPPPPPPPLQGAKPIPFIISISIGLIVRFFVPKPVEVTPEAWQLLSIFLSTIAGLVLSPLPVGAWAFLGLTASVVTKTLTFTAAFSAFTNEVIWLIVISFFFARGFVKTGLGDRIATYFVKWMGKSTLGLSYGLTFSEVLIAPAMPSTTARAGGVFLPIIKSLSLSAGSEPASPTSKKLGAYLIQNQFQSAGNSSALFLTAAAQNLLCLKLAEELGVIVPNPWVTWFKAASLPAVVCLLLTPLILYKLYPPEIKDTPEAPALAAKKLESMGPVTKNEWIMVGTMLLAVSLWIFGDTIGIASAVAAMIGLSILLLLGVLDWNDCLNEKSAWDTLAWFAILVGMASQLTNLGIVNWMSDYVAHNLRSFSLSWPASLAVLQAAYFFIHYLFASQTGHVGALYSAFLAMHRAAGVPGVLAALALGYNTNLFGAITHYSSGQAAVYYGAGYVDLPDIFKMGFIMAFINAIIWGGVGSVWWKFLGLY

SEQ ID NO: 118622 - protein, 111 aa, Glycine max
  Coding DNA Sequence Number=SeqID_1844
MVFLCVLLCCTVVGCTYQDTSMLKLVVQRERSNSLNGHVLSSTRSFQKTIKRHLFVFYLSPSFSRMLSPEVHIDDPLTIMVALMLPMTKGLTLRLVAPPLLLTSLTTSVPT

SEQ ID NO: 118623 - protein, 44 aa, Glycine max
  Coding DNA Sequence Number=SeqID_1845
MESMTTEKTYIDVDGQDRNAKVLFDEEKVQFVSIFYEIQCLLYC

SEQ ID NO: 118624 - protein, 103 aa, Glycine max
  Coding DNA Sequence Number=SeqID_1846
  Subcellular localization annotation: CTP_CleavageSite=66; ConfidenceScore=5.10e-01
MLQPYGISIGLKEHSNPVTPKAYTPKSPSGPLPPDSAYNTNNVTSRVNHTLIHNQNSFTISHLIKSQSTITCFTYLTIQHMFYFTLLLNLNNNIIISRHHIIP

SEQ ID NO: 118625 - protein, 176 aa, Glycine max
  Coding DNA Sequence Number=SeqID_1847
MAPLAKWRWDLFNENKGSLRCRILLFSWEGGVGGGIFVGEGSGSPGSRYETFGYQQHQILNDIWSLKVPPKILMFLWRVMKNALQTGVDLKKRVWLESTQQIFCQRVMVSGSALANRIWRILWCSITWVIWNWRNNAVFRGDRGYSWKVVGFSPCLCTREPHFICSILVYTGTCIR

SEQ ID NO: 118626 - protein, 241 aa, Glycine max
  Coding DNA Sequence Number=SeqID_1848
MVRWMAMENLMLEDAGTLCSDRIDVTLGHKMSSFDQEDMAYFISFPGLFIARPWIGIVRIMAKFDSNLSKWHKPRRLESRKNQLRKLRLTKGKDFNPYALFQSSMLSQFDHDMLSEAGPCAFMHSITCFHARNWGIADFWVNEFEKVDVKSKKAQTKLAKAEQALVEATRVNVRLLQSVKESQKSLESTGTKLKKVETREEALKSKLATVESLAKALQGEIEHLNKEFSLFKVNVEKAEEC

SEQ ID NO: 118627 - protein, 98 aa, Glycine max
  Coding DNA Sequence Number=SeqID_1849
MELTSVLVPEIGTGGGQRRPPSGGEELLVRYHSRRVRILTLCEDLRAEGQSQVDKGLPKGNGRVQRFPRARQRLSLECKGRRELDCKTHPSSREESRP

SEQ ID NO: 118628 - protein, 128 aa, Glycine max
  Coding DNA Sequence Number=SeqID_1850
  Gene Ontology: Mol. function=calcium ion binding; Cellular component =flagellin-based flagellum; Biological process=ciliary or flagellar motility
  Homolog annotation: Hit_ID=O82659; Match level="QueryCoverage=90%, HitCoverage=68%, E-value=5e-47, Identity=83%"; Hit description =Centrin
  Pfam annotation: Domain name=efhand; Domain location=29-57; Score =40.7; E_value=5.1e-09; Accession=PF00036.22; Description=EF hand
  Pfam annotation: Domain name=efhand; Domain location=65-93; Score =36.1; E_value=1.2e-07; Accession=PF00036.22; Description=EF hand
  Pfam module annotation: Pfam domain module=efhand::efhand; Domain location=29-57::65-93
MSSLYRGESRRYNNKPRGRHNLTTQKKQEIKEAFELFDTDGSGTIDAKELNVAMRALGFEMTEEQINQMIADVDKDGSGAIDYEEFEYMMTAKIGERDTKEELMKAFHIIDHDKNVKFFTAIYIIYTS

SEQ ID NO: 118629 - protein, 198 aa, Glycine max
  Coding DNA Sequence Number=SeqID_1851
  Gene Ontology: Mol. function=nucleic acid binding; Cellular component= nucleus; Biological process=mRNA polyadenylation
  Homolog annotation: Hit_ID=Q9FJN9; Match level="QueryCoverage=92%, HitCoverage=87%, E-value=5e-53, Identity=62%"; Hit description =Poly(A)-binding protein II-like
  Pfam annotation: Domain name=RRM_1; Domain location=59-130; Score =55.4; E_value=1.9e-13; Accession=PF00076.12; Description=RNA recognition motif. (a.k.a. RRM, R
MENDDVDMHAADTSEELDDMKKRLKEMEDEAAALREMQAKVEKEMGSAQGCKRRNKQSLVVPSKKVDYSCTPEEVQQHFQSCGTVNRVTIRTDKFGQPKGYAYVEFLEVEAVQEALLLNESELHGRQLKVTAKRTNIPGMKQYRPRRTINPYMGGFRGRTPYAPPFIYSPYGYGFQGSEWQCATAPTIESPILVGWTE

SEQ ID NO: 118630 - protein, 367 aa, Glycine max
  Coding DNA Sequence Number=SeqID_1852
  Gene Ontology: Mol. function=transferase activity; Biological process= response to oxidative stress
  Homolog annotation: Hit_ID=Q9SS68; Match level="QueryCoverage=99%, HitCoverage=39%, E-value=3e-55, Identity=72%"; Hit description =Putative phosphoribosylanthranilate transferase
  Pfam annotation: Domain name=C2; Domain location=9-94; Score=90.7; E _value=4.4e-24; Accession=PF00168.20; Description=C2 domain
MAEGAGRKLMVEVCNAKNLMPKDGQGTASAYAIVDFDGQRRRTKTKSRDLNPQWEEKLEFIVHDKDSMPSETLEVNIYNDKRTGKRSTFLGKVKISESTFVKSGSEAIVYYPLEKRSVFSQIKGELGLKVWYVEDDPPETENAGEEKAESAPAAEEKPPEKEKKEDENKPKEESKEEKPKEEATAEAAAPPPPEVENPPIAQTEKPKPPKEKHGEVQKRADLNVSDHELRSLRGDRSCSAYDLVDRMPFLYVRVVKAKRPKPETGSTVYSKLVIGTHSVKTRSESEGKDWDQVFAFDKEGLNSTLFEVSVWSEEVKEGDEKSESSLGTVSFDLQEVPKRVPPDSPLAPQWYTLESETSPGNDVMLAV

SEQ ID NO: 118631 - protein, 392 aa, Glycine max
  Coding DNA Sequence Number=SeqID_1853
  Gene Ontology: Mol. function=methyltransferase activity; Cellular component=nucleus; Biological process=DNA methylation
  Homolog annotation: Hit_ID=Q8LER4; Match level="QueryCoverage=96%, HitCoverage=95%, E-value=1e-136, Identity=65%"; Hit description=DNA methyltransferase PMT1-like protein
  Pfam annotation: Domain name=DNA_methylase; Domain location=12-390; Score=24.2; E_value=9.7e-14; Accession=PF00145.8; Description=C-5 cytosine-specific DNA methylase
MAKESSESRGCWRVLEFYSGIGGMRYSLMKAQVNAQVVQAFEINDTANDVYQHNFGHRPYQGNIQCLTAADLDKYGADAWLLSPPCQPYTRQGLQKDTGDARAFSFLQILELMPFLLRPPSMLFVENVVGFETSDTHAKLIEILEKTNFITQEFILTPLQFGIPYSRPRYFCLAKRKLSSFVNECLNSQLIQSPPPLFEHFDTAADEDDSSKEDRQNLLQSCQPIENFLELKNPSSDIAVESVALRTDLSNDAPRTLGKNNGHDEYESLDQYFVHPSLIERWGSAMGILALSLDVVYPDSKRCCCFTKSYYRYVKGTGSLLATVQPVKRDKTSLKEQCLRYFTPREVANLHSFPEGFVFPEHISLRQRYALLGNSLSIAVVAPLLQYLFTQP

SEQ ID NO: 118632 - protein, 159 aa, Glycine max
  Coding DNA Sequence Number=SeqID_1854
MAVSASSIVAVAIGSPPQLKRANLQAKPPTGEIPLGLVEVLVVPPVWLALESSWSSGMPQKYLLGSNNSFGHDENWEVEPGRVGLGYLGDLRGYHVAQVHVHLHNNAINEVGLIHVEIRGVGGKSKAELSLYDLVVRIGVKKLGVFRVALSLKKDYRCL

SEQ ID NO: 118633 - protein, 47 aa, Glycine max
  Coding DNA Sequence Number=SeqID_1855
MGNTWSYGIDFNSMEGLILHCFGDEERKSLCTQYEKPVSGPGRLVYL

SEQ ID NO: 118634 - protein, 82 aa, Glycine max
  Coding DNA Sequence Number=SeqID_1856
MQLGSLGQWHCHFFGKKKVQPKCLDDNYLNQFNVLLSSFVPYSKLHKVVWMVAVEGGQNSLQDGGKTKSGLHYFEDLFSVNY

SEQ ID NO: 118635 - protein, 63 aa, Glycine max
  Coding DNA Sequence Number=SeqID_1857
MHIDHVIKSEHFQGLIDPSFRRIPTELQLQACVNPNLDTEDGTKTSSTTTPIRGRLKSLYKDN

SEQ ID NO: 118636 - protein, 201 aa, Glycine max
  Coding DNA Sequence Number=SeqID_1858
  Homolog annotation: Hit_ID=Q2QQC6; Match level="QueryCoverage=72%, HitCoverage=60%, E-value=1e-09, Identity=31%"; Hit description =Expressed protein
MFFSSLLFTSLALLLSTFLLFMWKHKAEGIGFSFEEKKTPHHGRESVVAIAPTPMHKNVETIVTQAKGSEEEEQEVLCLSTSEDYEEVDHTLSDECSDGTISDEDSLIEIALPSGHFVGHNRHHHHNQNKEESNSKYNNNHNCCSLQQKKRELSSAHEALFNQQSLMEFLAEFNEMNEEDNLIEIDIAMGSIKCSRFEIEA

SEQ ID NO: 118637 - protein, 121 aa, Glycine max
  Coding DNA Sequence Number=SeqID_1859
MVVFLNNPVAVVVVEVKVEAEVEALSNESLLFWCGEALNIKEIEAYVARGVVVHDDACLLESESIRGTAIEEITTRGVSIEVEGEKEELKQRGRGVRRKNRSNGVEGESESERESERENEK

SEQ ID NO: 118638 - protein, 181 aa, Glycine max
  Coding DNA Sequence Number=SeqID_1860
  Gene Ontology: Mol. function=carboxylic ester hydrolase activity; Cellular component=mitochondrion; Biological process=lipid metabolic process
  Homolog annotation: Hit_ID=Q6TGC0; Match level="QueryCoverage=75%, HitCoverage=34%, E-value=6e-43, Identity=55%"; Hit description =Triacylglycerol/steryl ester lipase-like protein
  Pfam annotation: Domain name=Abhydro_lipase; Domain location=33-104; Score=81.2; E_value=3.2e-21; Accession=PF04083.6; Description=ab -hydrolase associated lipase region
MADALIRLFSVVLLCITAAQGKEQLHSNSEWPKSFSVIRDTDGICKVAETQGYTCEEHKATTEDGYILSLQRLPAGQSGKKAHKPPVLLQHGLFCDAIVWVVNPPDESLGFILADNGYDVWLANVRGTKYSRGHISLHPNDMAYWDWSWDELARYDLPAFVQYVYNQTGQRMHYAGHSLVL

SEQ ID NO: 118639 - protein, 234 aa, Glycine max
  Coding DNA Sequence Number=SeqID_1861
MGKSKGGRTNLPTLHFVAMRRSYYVRTKALRQALGGVLGRALGRQDLENVNNVAYEPHEEPYAQITEDVGGDSQGFSAVALVHMYDNLNVVSKHTTKHLVGYITLLRIYEHFPTIANIISNEDCHERKPHACHWKSRKALPMTSYRKRLNRLTSDAVSWIPDGDHRAFKEFELSIHPLPTALSLSIEEIDNRWLQFSQYLASVGEFCSFPSQCATSYMEWFYRISQPFMSLPQL

SEQ ID NO: 118640 - protein, 207 aa, Glycine max
  Coding DNA Sequence Number=SeqID_1862
  Gene Ontology: Mol. function=transcription regulator activity; Cellular component=nucleus; Biological process=regulation of transcription
  Pfam annotation: Domain name=HLH; Domain location=42-85; Score=16.8; E_value=0.0023; Accession=PF00010.16; Description=Helix-loop-helix DNA-binding domain
MEYEDEDWLCVTMDEFSLATENGFSRQMMSRKRNYDDDTREYKSKNLETERRRREKLSSRLLMLRSMMNKATIVEDAITYIEKLQDKVQNLSQELHQMEATSVETAETKIVEIDAVEDMKNWGIQEEVRVAQINENKLWVKIIIEKKRGRFNRLMQALNNFGIELIDTNLTTTKGSFLITSCIKCKNGERFEIHQAKNLLQDVINHI

SEQ ID NO: 118641 - protein, 93 aa, Glycine max
  Coding DNA Sequence Number=SeqID_1863
TSFRYRKDRNGQWLKKDALPPQVEHTPSPPPQRDDSALMTEVLSELRGLRTYVGERFDSLDNLFAGMDIRLTQIEDVGYIRQSFDLPPPPPPS

SEQ ID NO: 118642 - protein, 97 aa, Glycine max
  Coding DNA Sequence Number=SeqID_1864
MNQLKRLSITSEMLRFSNHASYPRLDHPTRSVHSTPMAYTSYDVCSWPKASTKDPGRSMHSAPHKHTQHPTYERGQKLVSKTLEEKSACNRDRQISS

SEQ ID NO: 118643 - protein, 105 aa, Glycine max
  Coding DNA Sequence Number=SeqID_1865
  Gene Ontology: Mol. function=protein binding
  Homolog annotation: Hit_ID=Q60DC3; Match level="QueryCoverage=74%, HitCoverage=29%, E-value=3e-09, Identity=43%"; Hit description =Leucine rich repeat containing protein
  Pfam annotation: Domain name=LRRNT_2; Domain location=26-64; Score =33.9; E_value=5.8e-07; Accession=PF08263.3; Description=Leucine rich repeat N-terminal domain
MPFTFVKFPFHILLFLVLSLPSPVISQDQQTTLLGIKRQFGDPPALRSWKSSSPPCAWPEIRCSGGFVTELHLAGKNISAVQLPAAICDLAHLAHLNLSDNNIAG

SEQ ID NO: 118644 - protein, 123 aa, Glycine max
  Coding DNA Sequence Number=SeqID_1866
  Gene Ontology: Cellular component=integral to membrane
  Homolog annotation: Hit_ID=Q5Z9R9; Match level="QueryCoverage=70%, HitCoverage=17%, E-value=7e-14, Identity=42%"; Hit description =Putative amino acid transporter
MVWRLQSSFFLLHSATIELQEAKDSIDEEDPRPTNSTWATSAMPFFNEMFTLLGAIGFWQIITMYFPMEMYIAIKKITKGAMRWHGLKTLNLVFMLLSVVIAIVVIHGMNQALRKYKPCKYKG

SEQ ID NO: 118645 - protein, 227 aa, Glycine max
  Coding DNA Sequence Number=SeqID_1867
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=7e-22, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSRTTRPRLQRTTRPPIRGLHVLTFIGLLALTFRGLHVLPFRGLHVLAIRGLHVLTFIGLHAPTSRGLHILAIRELNAFTFRGLHIFTSRGLHILTIKGLHTLTFRGLHVLTFRGLHALAFRGLQSSPQEGYTSSPSEGYGPLPSEDYTSSPIEGCTPSPLEDYTSSPSEGFMPSPLEDYTSSPSEGCTPSPSEGFTPSPLEDYTPSPSEGCMPSPSEGSRSAP

SEQ ID NO: 118646 - protein, 836 aa, Glycine max
  Coding DNA Sequence Number=SeqID_1868
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=94%, HitCoverage=88%, E-value=0.0, Identity=41%"; Hit description=Protein kinase
  Pfam annotation: Domain name=LRR_1; Domain location=117-139; Score =13.8; E_value=0.64; Accession=PF00560.23; Description=Leucine Rich Repeat
  Pfam annotation: Domain name=LRR_1; Domain location=141-163; Score =4.0; E_value=50; Accession=PF00560.23; Description=Leucine Rich Repeat
  Pfam annotation: Domain name=LRR_1; Domain location=165-184; Score =5.2; E_value=31; Accession=PF00560.23; Description=Leucine Rich Repeat
  Pfam annotation: Domain name=LRR_1; Domain location=19-41; Score=5.6; E_value=26; Accession=PF00560.23; Description=Leucine Rich Repeat
  Pfam annotation: Domain name=LRR_1; Domain location=213-235; Score =14.3; E_value=0.44; Accession=PF00560.23; Description=Leucine Rich Repeat
  Pfam annotation: Domain name=LRR_1; Domain location=237-256; Score =13.1; E_value=0.99; Accession=PF00560.23; Description=Leucine Rich Repeat
  Pfam annotation: Domain name=LRR_1; Domain location=259-278; Score =4.4; E_value=43; Accession=PF00560.23; Description=Leucine Rich Repeat
  Pfam annotation: Domain name=LRR_1; Domain location=280-302; Score =12.2; E_value=1.5; Accession=PF00560.23; Description=Leucine Rich Repeat
  Pfam annotation: Domain name=LRR_1; Domain location=304-326; Score =4.7; E_value=38; Accession=PF00560.23; Description=Leucine Rich Repeat
  Pfam annotation: Domain name=LRR_1; Domain location=328-350; Score =12.7; E_value=1.2; Accession=PF00560.23; Description=Leucine Rich Repeat
  Pfam annotation: Domain name=LRR_1; Domain location=352-374; Score =15.9; E_value=0.15; Accession=PF00560.23; Description=Leucine Rich Repeat
  Pfam annotation: Domain name=LRR_1; Domain location=375-397; Score =17.4; E_value=0.05; Accession=PF00560.23; Description=Leucine Rich Repeat
  Pfam annotation: Domain name=LRR_1; Domain location=43-65; Score =17.6; E_value=0.047; Accession=PF00560.23; Description=Leucine Rich Repeat
  Pfam annotation: Domain name=LRR_1; Domain location=67-88; Score =15.5; E_value=0.2; Accession=PF00560.23; Description=Leucine Rich Repeat
  Pfam annotation: Domain name=LRR_1; Domain location=93-114; Score =10.3; E_value=3.4; Accession=PF00560.23; Description=Leucine Rich Repeat
  Pfam annotation: Domain name=Pkinase; Domain location=497-783; Score =143.5; E_value=5.7e-40; Accession=PF00069.15; Description=Protein kinase domain
  Pfam annotation: Domain name=Pkinase_Tyr; Domain location=497-783; Score=81.5; E_value=2.6e-21; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::Pkinase::Pkinase_Tyr; Domain location=117-139::141 -163::165-184::19-41::...
  Pfam module annotation: Domain location=213-235::237-256::259 -278::280-302::304-326::328-350::352-374::375-397::43-65::67-88::93 -114::497-783::497-783
LAYNSFVNQTPFEFGNLKNLKTLWMPMCNLIGAIPESFANLSSLELLDLSFNFLTGNIPNGLFALRNLQFLYLYHNGLSGEIPVLPRSVRGFSLNEIDLAMNNLTGSIPEFFGMLENLTILHLFSNQLTGEIPKSLGLNPTLTDFKVFGNKLNGTLPPEFGLHSKIVSFEVANNQLSGGLPQHLCDGGVLKGVIAFSNNLSGELPQWMGNCGSLRTVQLYNNSFSGELPWGLWDLENLTTLMLSNNSFSGEFPSELAWNLSRLEIRNNLFSGKIFSSAVNLVVFDARNNMLSGEIPRALTGLSRLNTLMLDENQLYGKLPSEIISWGSLNTLSLSRNKLFGNIPETLCDLRDLVYLDLAENNISGEIPPKLGTLRLVFLNLSSNKLSGSVPDEFNNLAYESSFLNNPDLCAYNPSLNLSSCLTEKSATPQTKNSNSSKYLVLILVLIIIVLLASAFLVFYKVRKNCGEKHCGGDLSTWKLTSFQRLNFTEFNLFSSLTEENLIGSGGFGKVYRVASGRPGEYVAVKKIWNSMNLDERLEREFMAEVEILGRIRHSNVVKLLCCFSSENSKLLVYEYMENQSLDKWLHGRNRVSANGLSSPSKNCLLLKWPTRLRIAVGAAQGLCYMHHDCSPPIIHRDVKSSNILMDSEFRASIADFGLARMLVKPGEPRTMSNIAGSLGYIPPEYAYTTKIDEKADVYSFGVVLLELVTGKEPYSGGQHATNLVDWAWQHYREGKCLTDASDEEIIETSYVEEMITVFKLGLGCTSRLPSNRPSMKEILQVLRECCYPSASNGRRRVGIGFDIALLHGDTTYVSSYKDSNNKAISENEESCLYSV

SEQ ID NO: 118647 - protein, 117 aa, Glycine max
  Coding DNA Sequence Number=SeqID_1869
ADEGKAEKKVEEHKQQLAAEPALEPVSDFVELEEVVEDEDDQQERETPIKDSQEGIKMKEEQGKEKEKREITSAEGKEVPYPLVPSKKDKERNLARFLDVFKKLDEHEVCHKEFGSP

SEQ ID NO: 118648 - protein, 383 aa, Glycine max
  Coding DNA Sequence Number=SeqID_1870
  Gene Ontology: Mol. function=caspase activity; Cellular component =cytoplasm; Biological process=proteolysis
  Homolog annotation: Hit_ID=Q75LR0; Match level="QueryCoverage=83%, HitCoverage=87%, E-value=1e-59, Identity=39%"; Hit description =Putative metacaspase
  Pfam annotation: Domain name=Peptidase_C14; Domain location=117-373; Score=136.5; E_value=7.4e-38; Accession=PF00656.12; Description =Caspase domain
  Subcellular localization annotation: CTP_CleavageSite=28; ConfidenceScore=5.61e-01
MNGKHKTGSRRKNVPFPANTSTTRCLFSSKMNSSKRAGEAKFTCSGCERKFLLPTITNAYRCYKCDSVANSTLGSEQSRKDSGVCKHDQLNNAYPNGALLPPSASCSLSLSMTMGNKRAVICGVTYGKRKFKLEGTINDVNNMKNLLLDNFKFPIGCIRVLTEEQKDPNLIPTKKNILDSLNWLVKDCQSEDSLVFYFSGHGLQQPEDRKGDEIDGLDETICPVDFLREGMITDNEINSIIVQPLKQGVTLHAIIDACHSGTTLDLLYLCKKEKGSWKWKDNKPPHSKETMTTQTNGGLAICLSACEDGQMAADTAAFDGNRFNGLVTYLFSQIIRDNPEITYGGLLEKLHQEIGNIHQSKFSNSILKRIFHRKIDQVGFRLL

SEQ ID NO: 118649 - protein, 127 aa, Glycine max
  Coding DNA Sequence Number=SeqID_1871
  Gene Ontology: Mol. function=catalytic activity
VEDEVNCKFDVVMVDLDSSDVRNGVRSPPLEFIRKDVLLAAKLVLCEFGILAINVIPPSRSFYDNLVSHFQEVFHELYKIDVGNGENFVLIATASPLVFSVEDCGNSFLMRLKSVIPEAFINSITKI

SEQ ID NO: 118650 - protein, 254 aa, Glycine max
  Coding DNA Sequence Number=SeqID_1872
MDALIEIAQNSIMEDTVTEPHSSAKLNRIPGSDAVGYLDQDGNSESPVSEQQMEDSMTGKNVDHDLDEKVEEIDDDNHAIDVKDDVPLTIEELDQSGMDLDDNSQNCLLPLSKHHIIPESEKSENSVCANTKGQFILDEGISNKSELEFSLNGLKDVPVTVSTNVQEMGGKQFCSVDHEHDNVKGFQELRFDEIDIVENQLTTVCVWCGIEFDHDAVNSEIQPDSVGFMCPASKAKISGQVNVLDCGSPNAGCL

SEQ ID NO: 118651 - protein, 426 aa, Glycine max
  Coding DNA Sequence Number=SeqID_1873
  Gene Ontology: Mol. function=caspase activity; Cellular component =nucleus; Biological process=proteolysis
  Homolog annotation: Hit_ID=Q7XJE6; Match level="QueryCoverage=75%, HitCoverage=84%, E-value=2e-57, Identity=40%"; Hit description =Metacaspase 1
  Pfam annotation: Domain name=C1_4; Domain location=86-120; Score= -11.3; E_value=0.06; Accession=PF07975.2; Description=TFIIH C1-like domain
  Pfam annotation: Domain name=Peptidase_C14; Domain location=160-415; Score=142.6; E_value=1e-39; Accession=PF00656.12; Description =Caspase domain
  Pfam module annotation: Pfam domain module=C1_4::Peptidase_C14; Domain location=86-120::160-415
MDKSRTTRKYVYIPKTTPQGFVSPNINSSEHAGEATPTCFVSPKIDALNYYNSRKDVPFPTNTSTARCLVSSKISSSKLAGEAKLTCSGCQRKFLLPKITNAYRCYKCNSVTNSTIGSEQSRKDSGVFKHDQLNNAYPNGALLPPSASCSLSLSMTMGNKRAVICGVTYGKRKFKLEGTINDVNNMKNLLLDKFKFPIGCIRVLTEEEKDANLIPTKRNILESLKWLVKDCKSEDSLVFYFSGHGLQQPEYCKGDEIDGLDETICPVDFVREGMITDNDINSTIVQPLKKGVTLHAVIDACHSGTTLDLMYLCKKEKGSWNWKDSKPPHSKKPMTKTNGGLSICLSACKDSLMAADTAAFDGNRFNGILTYLFSKIIREHSDEITYVGLLEKIHEEIGKIHQSNFCNSFLKRIFQSKIDQVGFHLL

SEQ ID NO: 118652 - protein, 97 aa, Glycine max
  Coding DNA Sequence Number=SeqID_1874
  Gene Ontology: Mol. function=caspase activity; Biological process =proteolysis
  Homolog annotation: Hit_ID=Q6XPT9; Match level="QueryCoverage=96%, HitCoverage=26%, E-value=7e-15, Identity=42%"; Hit description =Metacaspase 3
MTMGNKRAVICGVTFGKRKFKLKGAINDVNNIKNLLLDIFKFPIGCIRVLRRTEGSQFNSNKKEHTGIIKLACEGLPVRGLISLLLCRTWSATNRIS

SEQ ID NO: 118653 - protein, 322 aa, Glycine max
  Coding DNA Sequence Number=SeqID_1875
  Gene Ontology: Mol. function=hydrolase activity; Cellular component =integral to membrane; Biological process=aromatic compound metabolic process
  Homolog annotation: Hit_ID=Q4PSG2; Match level="QueryCoverage=92%, HitCoverage=98%, E-value=1e-124, Identity=68%"; Hit description =Hydrolase
  Pfam annotation: Domain name=Abhydrolase_1; Domain location=81-298; Score=73.6; E_value=6.3e-19; Accession=PF00561.10; Description =alphabeta hydrolase fold
  Pfam annotation: Domain name=Peptidase_S15; Domain location=37-284; Score=-112.6; E_value=0.058; Accession=PF02129.9; Description=X-Pro dipeptidyl-peptidase (S15 family)
  Pfam module annotation: Pfam domain module=Abhydrolase_1::Peptidase _S15; Domain location=81-298::37-284
MLPKLSKCISFTASRDWLYRHLFASAGLRSVATDLGEGTTMHCWVPKMHKPCKPSLVLVHGFGANAMWQYGEHIRHFMGHFNVYVPDLVFFGESFTSRPERSESFQAECVVKMMEAHGVHKMSLVGISYGGFVGYRVAAHFPEVVEKIVLCCAGVCLEEVDMENGLFRVSNLDEASSILLPQTPDKLRELMKLSFVRPARGVPTWFLQDFIQVMCTDYIEQKRELLEAILKGRHLSDLPKIQQPTLILWGEQDQIFPLELGHRLKRHIGGNAQMAVIKNAGHAVNLEKAKEFGMHLKAFLIDSNTTKSCPTSPFSAGGNIHF

SEQ ID NO: 118654 - protein, 462 aa, Glycine max
  Coding DNA Sequence Number=SeqID_1876
  Gene Ontology: Mol. function=amidase activity; Cellular component =chloroplast
  Homolog annotation: Hit_ID=Q9FY73; Match level="QueryCoverage=98%, HitCoverage=71%, E-value=1e-137, Identity=56%"; Hit description =Putative subunit of TOC complex
  Pfam annotation: Domain name=TPR_1; Domain location=313-346; Score =11.4; E_value=0.23; Accession=PF00515.18; Description=Tetratricopepti de repeat
  Pfam annotation: Domain name=TPR_1; Domain location=347-380; Score =35.2; E_value=2.3e-07; Accession=PF00515.18; Description =Tetratricopeptide repeat
  Pfam annotation: Domain name=TPR_1; Domain location=381-415; Score =2.5; E_value=2.7; Accession=PF00515.18; Description=Tetratricopeptide repeat
  Pfam annotation: Domain name=TPR_2; Domain location=313-346; Score =15.2; E_value=0.24; Accession=PF07719.7; Description=Tetratricopeptid e repeat
  Pfam annotation: Domain name=TPR_2; Domain location=347-380; Score =24.9; E_value=0.00029; Accession=PF07719.7; Description =Tetratricopeptide repeat
  Pfam annotation: Domain name=TPR_2; Domain location=381-415; Score =3.7; E_value=12; Accession=PF07719.7; Description=Tetratricopeptide repeat
  Pfam module annotation: Pfam domain module=TPR_1::TPR_1::TPR_1::TPR _2::TPR_2::TPR_2; Domain location=313-346::347-380::381-415::313 -346::347-380::381-415
TDTTGCVRIPAAFCGILGFRPSHGVISTIGVLPNAQSLDTVGWFARDPSVLHRVGLVLLPLNSVELKRTRRIIFADDLFQLCKAPSQKTVYIIGKAIENLSGYQFPQHMNLCQYIASNVPSLKEFREKFTHQQNGVSILKALTSVMFYLQGPVIAISHLLFRYEFKTNHEEWVKSVKPRLGRGMSERVNAAMNATHDNIKTLYKDDGILVIPTVADYPLKLNTEKGFSSEFGDRAFALSSIASISGCCQVAIPLGCHNDCCASVSLISAHGADKFLLNTVLDMYSTLQEQVSVAYALPLPDTNGSMGTSELLKEKASLQGNAAFKGRLWNKAVDYYTEAINLNGTNATYYSNRAAAYLELGCFQEAEEDCNMAILHDKKNVKAYLRRGTARELLLRYKEALKECWRRIVDKDMYHRTAITRKFGRFSCTQILHWSDFQHALVLEPQNKTASLAEKRLRKSTS

SEQ ID NO: 118655 - protein, 113 aa, Glycine max
  Coding DNA Sequence Number=SeqID_1877
MVIINNCEDNAITSEGATSDNVDGMVSQRVSSRLRNQPKNYWGNDDNKRIKSGTDEDHNIGERTKLKNTCSHSINSSDNSLVFDKQDFEGILKIKKLLRDTNIYRLQSDEAYN

SEQ ID NO: 118656 - protein, 168 aa, Glycine max
  Coding DNA Sequence Number=SeqID_1878
MGSLRSKLTMLICLVQAPGEDGVIHAHQSGHVHLIAAEAVIAVTAEIAATVLGAFGLASRSRSPVRREESPVREDRSQSPDHKNSPQPSKTRKHSPSPDRSPQKRGDTSPDNDRLSRSPARDPEDRGYDSPKVNGRSGSPSCSPRDDDRSPIDDDNNHRHSPRGSESP

SEQ ID NO: 118657 - protein, 301 aa, Glycine max
  Coding DNA Sequence Number=SeqID_1879
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9ZPL8; Match level="QueryCoverage=99%, HitCoverage=83%, E-value=4e-54, Identity=44%"; Hit description =Protein phosphatase type 2C
  Pfam annotation: Domain name=PP2C; Domain location=1-292; Score =164.6; E_value=2.5e-46; Accession=PF00481.12; Description=Protein phosphatase 2C
MEDYHVAKIVKLVGQELGLFAIYDGHLGDSVPAYLQKHLFSNILKEEDFWTDPASSIIKAYETTDQTILSHSSDLGQGGSTAVTAILINNQKLWVANVGDSRAVLSRRGVAEQMTIDHEPNTERGIIENKGGFVSNMPGTCFNGDLLSSVDQTFWKYLFKFFVSISFWFARHQLFISVSYMPTSPIITDTNAISSVNNYVVDQGDVARVNGQLAVSRAFGDKNLKSHLRSDPDIRYVDIDLDAELLILASDGLWKVMANQEAVDIARRIKDPQKAAKQLVVESLNRESKDDISCIVVHFKG

SEQ ID NO: 118658 - protein, 337 aa, Glycine max
  Coding DNA Sequence Number=SeqID_1880
  Gene Ontology: Mol. function=histone-lysine N-methyltransferase activity; Cellular component=nucleus; Biological process=chromatin modification
  Homolog annotation: Hit_ID=Q1S3B8; Match level="QueryCoverage=95%, HitCoverage=58%, E-value=5e-82, Identity=51%"; Hit description=6,7 -dimethyl-8-ribityllumazine synthase; SET-related region; AWS; Pre- SET; Histone H3-K9 methyltransferase
  Pfam annotation: Domain name=Pre-SET; Domain location=46-149; Score =88.9; E_value=1.6e-23; Accession=PF05033.6; Description=Pre-SET motif
  Pfam annotation: Domain name=SET; Domain location=151-314; Score =131.6; E_value=2.2e-36; Accession=PF00856.18; Description=SET domain
  Pfam module annotation: Pfam domain module=Pre-SET::SET; Domain location=46-149::151-314
INVEKSMSELKGCDNLIKKLRRVAINVNKLVAEGQISRAPSIHPLDLSYGLEAIPIPVTNEIDDSPITPIDFTYITSIQVAKNVKVPSSDDYGCQCKGNSCRINKTCCFRLNNMYPYVRRGNCSRLVGARDIVFECGPRCGCGPDCGSRVSQKGLQYQLEVYRTSNKGWAVRTRNFIPIGALVCEVVGVLKRTEDLENASHNDYIIEIDCWETIKEIGGRKKRLPDEPLPAKIFLGQKDDETTKNEPEFCIDCSSFGNVARFINHSCDPNLFVQCVLNSHYGVKQARLVLFAGRNIRPKQELTYDYGYRLDSVVDADGKIKQLPCYCGEATCRKRLY

SEQ ID NO: 118659 - protein, 916 aa, Glycine max
  Coding DNA Sequence Number=SeqID_1881
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=84%, HitCoverage=71%, E-value=0.0, Identity=46%"; Hit description =Calmodulin-binding transcription activator 2
  Pfam annotation: Domain name=Ank; Domain location=618-650; Score =11.9; E_value=0.6; Accession=PF00023.20; Description=Ankyrin repeat
  Pfam annotation: Domain name=Ank; Domain location=651-683; Score =37.9; E_value=3.4e-08; Accession=PF00023.20; Description=Ankyrin repeat
  Pfam annotation: Domain name=IQ; Domain location=828-848; Score=24.4; E_value=0.0004; Accession=PF00612.17; Description=IQ calmodulin -binding motif
  Pfam module annotation: Pfam domain module=Ank::Ank::IQ; Domain location=618-650::651-683::828-848
MICPKSHEVYIEFVGWIQAGGLCPMTKTGKCLCLMQFYESRLKSCTSANILSFWHVDKSTLGDEVPTDSQKVTSPSSSLPTHHSCVSSLSTDSVSPTTSLMSLHEDADSEDIHHASSGLHPLHESQHSGNSPLTEKIGAGSNSSYLMHPFSGDNEQSSISGTDYIPVVHGDKFRGNDTAYTDGQKPHGMAPWGTVLQSTAKLHNDPSLASFPSILPSSMGDVLEQEHTIFGDLLMSKSGLTEEAESSQSLQSNWQIPFEDNSGGMPMLTQTQSFGLQFRSDYGTGLLGNETRNASSEIAPILYSFHGEPKEQPMQQNYPQELEDGQSQHALKSNSANKVPDEETINYGLTVKSTLLDRDESLKKVDSFSRWITKELGEVADLNMQSSPGISWSTDECQHVIDDTSLSPSLSQDQLFSINDFSPKWAYAESEIEVLIIGSFLKSQPEVTTCNWSCMFGEVEVPAEVLADGILCCQAPCHKVGRVPFYVTCSNRLACSEVREFDFREGFARNVDFADFYISSTEMLRHLRLEDFLSLKPVDPSNHSFEGDMEKRNLIFKLISLREEEDYSIKDEVTRELDISQHMVKEHLFHRQFKEKLYSWLLHKVTENGKGPNVLDEDGQGVLHLAAFLGYDWAINPIISAGVNINFRDVNGWTALHWAASCGRERTVAVLVSMGADCGALTDPSPAFPSGRTAADLASSYGHKGISGFLAESSLTHHLETLTMDDQKGGQQEISGMKVVQTVSERSATPVHYCDIPDAICLKDSLTAVRNATQAADRIHQVYRMQSFQRKQLTQYEGDDELGLSDQQALSLLASRACKSGQGDGLANAAAVQIQKKFRGWKKRKEFLMIRQRVVKIQKTIQNVRKECSKVFFILGSSFHHSMHLLGDLVLCQHSSNHELEHLVGRKSSRMSWQIQ

SEQ ID NO: 118660 - protein, 596 aa, Glycine max
  Coding DNA Sequence Number=SeqID_1882
  Gene Ontology: Mol. function=transferase activity; Cellular component= membrane; Biological process=metabolic process
  Homolog annotation: Hit_ID=Q9FGV3; Match level="QueryCoverage=66%, HitCoverage=72%, E-value=1e-157, Identity=64%"; Hit description =Similarity to limonene cyclase
  Pfam annotation: Domain name=Exostosin; Domain location=274-559; Score=271.2; E_value=2e-78; Accession=PF03016.6; Description =Exostosin family
MGISVVAMKLRHVAIRRLSVVGMFVAVIVVFQCCWTTYYSVLDAGGSSVALPIEVSISGTSEKKGVFRSTSATNVMLNATFVSHSKEYDSEKEADLDHELESDGGRNSREGHIPNNKGFKVGNHKDAIYSFTQKRPKYAVLSASDMLLAVKKPSNESRIQSVEMESQNEKPQVLKSPLSMSKSKPKMGTSSTRSKLVWPTSITQMNSLMLQSFNSSASMRPRWSSRRDRELLSAKLEIENAHAISNSSGLYAPIFRDVSKFSRSYELMERKLKVFIYREGAKPIFHQPKMRGIYASEGWFMKLMEGNKRFIVKDPRKAHLFYLPFSSQMLRVTLSNPKQMEQHLEKYVELIAGRYRFWNRTDGADHFLVACHDWASRITRQPMKGCIRSLCNSNVAKGFQIGKDTTLPVTYIHSVMDPLKECAGKPPSERSALAFFAGSMHGYLRPILLKHWANKEPDMKIFGPMPRDLEGKKMYMEYMNSSKYCICARGYEVHTPRIIEAIFSGCVPVIISDNYVPPLFEVLKWEAFSLFVRERDVPSLRDILLSIPEEKYLALHLGVKKVQQHFLWHKVPVKYDLFHMILHAIWKNRLSQIRPR

SEQ ID NO: 118661 - protein, 50 aa, Glycine max
  Coding DNA Sequence Number=SeqID_1883
MARPGDVDAVTVNYDTYNTVTRDFAITIYVVAYASKQKKENVLSLVSNKV

SEQ ID NO: 118662 - protein, 85 aa, Glycine max
  Coding DNA Sequence Number=SeqID_1884
  Subcellular localization annotation: CTP_CleavageSite=53; ConfidenceScore=5.80e-01
MSQFFDPNVLGSHCLSCSGRSYSTTTPNNVAFVSVAQTLRLTSYPLSVKSAVRTLAAKSCSLAPAPSLPLFDHSSSLILPSKDTR

SEQ ID NO: 118663 - protein, 148 aa, Glycine max
  Coding DNA Sequence Number=SeqID_1885
MHYIIVRILMLRSSNLAQAFEEDMILMWAFLTNCPIDWAHLIRYRMHKALRSSAPLPYSQLVTLFLRLFEIPLDSEPFVQVKRSFAIGVDAVTSFGYCLHTYVGERFDSLDGCIDAIDACFEGMDTRITQLEEDVSYLRRCFDLPPPS

SEQ ID NO: 118664 - protein, 205 aa, Glycine max
  Coding DNA Sequence Number=SeqID_1886
  Gene Ontology: Mol. function=structural molecule activity; Cellular component=intermediate filament; Biological process=nucleosome assembly
  Homolog annotation: Hit_ID=UPI0000DBF0F4; Match level="QueryCoverage =86%, HitCoverage=74%, E-value=5e-23, Identity=45%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MDRFLFKNEKPSQRVNLMLSHKVEPFGLNVLCFRGLKVLAFRGLKVLAFRGLNVLAFRGLKVLAFRGLKVLSFRGLKVLAFRGLKVLAFRGLNVLAFRGLNVLAFRGLNVLAFRGLKVLAFRGLKVLTFRGLKVLAFRGLKVLSLRGLNVLAFRGLNVLTFRGIKVLAFRGLKVLSFRGLKVLTFRRLKVLAFIGLKVLAFVGLK

SEQ ID NO: 118665 - protein, 227 aa, Glycine max
  Coding DNA Sequence Number=SeqID_1887
  Gene Ontology: Mol. function=oxidoreductase activity; Cellular component=membrane fraction; Biological process=negative regulation of transcription
  Homolog annotation: Hit_ID=Q9LSQ5; Match level="QueryCoverage=84%, HitCoverage=94%, E-value=6e-80, Identity=76%"; Hit description=1,4 -benzoquinone reductase-like; Trp repressor binding protein-like
  Pfam annotation: Domain name=FMN_red; Domain location=27-204; Score= -40.7; E_value=0.043; Accession=PF03358.6; Description=NADPH -dependent FMN reductase
  Pfam annotation: Domain name=Flavodoxin_1; Domain location=21-151; Score=48.5; E_value=2.3e-11; Accession=PF00258.15; Description =Flavodoxin
  Pfam module annotation: Pfam domain module=FMN_red::Flavodoxin_1; Domain location=27-204::21-151
MKAHFKIVTQLENRFSELDKLYYSMYGHVETLAREILRGANSVEGVEAKLWQIPETLPPEELVRLRAPPKSDVPIINPFKLPVADGFVFGFPTRLGMMAAQFKAFLDSTQYLWKAQMLACKPAGIFYSTSCQGVGQETAPFTAITQLVHHGMIFVPIGYTFGPGMFEMKEPKGGSPYGAGTYTGDGSRQPTELELQQAFHQGNHIATIIKKFKEDAHPIFTLHNRGY

SEQ ID NO: 118666 - protein, 662 aa, Glycine max
  Coding DNA Sequence Number=SeqID_1888
  Gene Ontology: Mol. function=RNA-directed DNA polymerase activity; Cellular component=chromatin; Biological process=chromatin assembly or disassembly
  Pfam annotation: Domain name=RVP_2; Domain location=331-439; Score= -24.4; E_value=8e-05; Accession=PF08284.2; Description=Retroviral aspartyl protease
  Pfam module annotation: Pfam domain module=RVP_2::Retrotrans_gag; Domain location=331-439::104-194
MAEHRTRKTTTYHLEDAIARLTNSQASINERYADLSSKVDSILEHLRLHDSGQAATTATANQHHQRNAVKLDIPRFDGRDPLGWIFKITQLFQYQNTPEEDRITVASLYLDDAALSWYQWMYSNGLITSWNAFLEALESRFAPTCYDDPKGALFKLMQRGTVNEYLTEFERLANRVIGLPPPFLLSCFISGLNPDIRREVLALQPISLLQATTLAKLQEEKLHHTVTIPRHYHPQIKAPNSPASQNLPTCVGLCYNCDEKWNANHRCKGRIMLLIVDEQPSPAAVELGLEEEPVTVIPDPPELLPDPSCSHISLHALSGLPSSETFRIFGVIKHARLTFLIDSGSTHNFLQPRIAHFLRLQVQATHPLHVLVGNGSTLACDQTCPAVPITIQGHSFTVNFHLLQISGADAVLGIDWLKKLGPVTTNYTTFIMNFNHLGHDISLKADVTLGLEPTSAAQLRRLILTGSASAFFHLSLVPDNIPDPPTARYSIPSIASLLLRYNHLFQPPSQLPPPRTVVHRIPLNPSSVPVNVRPYRYPHFQKSEIEKQVSDLLSAGLIRPSTSPYSSPVLLVKKKDGTWRLCVDFRALNSVTIRDRFPIPTIEELLDELGHASWFSKLDLRQGFHQILMHEEDVQKTAFQTHHGHFEYLVMPFGLCNAPSTF

SEQ ID NO: 118667 - protein, 211 aa, Glycine max
  Coding DNA Sequence Number=SeqID_1889
  Gene Ontology: Mol. function=protein binding; Cellular component =membrane; Biological process=defense response
  Homolog annotation: Hit_ID=Q1SGS4; Match level="QueryCoverage=88%, HitCoverage=44%, E-value=3e-28, Identity=38%"; Hit description =Leucine-rich repeat
MVVLSGNNFATLPNLKKLSKLVCLKLQHCKQLKSLPELPSRIDLQTGALGAGLYMCNCPELIDRERCIDMAFSWMMQLFQVLYTYPFYHVSGGVSPGSEIPRWFNNEHEGNCVSLDASPVMHHHNWIGVAFCTIFVVPQETISAMGVSGPDRRYPDSGDIPVDFYGDVDLELVLDKSDHMCLFFLDRETFIEKFHLKHKYLGRFLLKYDRG

SEQ ID NO: 118668 - protein, 113 aa, Glycine max
  Coding DNA Sequence Number=SeqID_1890
  Subcellular localization annotation: CTP_CleavageSite=39; ConfidenceScore=5.51e-01
MSAFIRSCTSSISPTLAWVCTAGLNQLKQCGSSPIVQVVATYPSVGGRRVTRGMRVPRKEYARSRHQRLFEENVGKTGKDAIYELLSEKVRELYLRMGKVLAPHTSVTRDGSL

SEQ ID NO: 118669 - protein, 177 aa, Glycine max
  Coding DNA Sequence Number=SeqID_1891
MAIMMEDMMSMKKINAAAVAATSAIAKVDPTPPSGLNQINHPTSDMVSKELGSTGGPHFVQVQNKHAFSPYGLPLNYTPPNVVHTPDENVNNSIPILIESQQHQADHARVSQPVGETHKVPYHNLANFEPRLGYATEGQEVGGVPLPNTLEGPQFCPQPQPLHFTARRVPPAMAEKK

SEQ ID NO: 118670 - protein, 582 aa, Glycine max
  Coding DNA Sequence Number=SeqID_1892
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=96%, HitCoverage=89%, E-value=0.0, Identity=63%"; Hit description =Putative receptor kinase
  Pfam annotation: Domain name=LRRNT_2; Domain location=25-63; Score =37.7; E_value=4e-08; Accession=PF08263.3; Description=Leucine rich repeat N-terminal domain
  Pfam annotation: Domain name=LRR_1; Domain location=117-138; Score =13.5; E_value=0.77; Accession=PF00560.23; Description=Leucine Rich Repeat
  Pfam annotation: Domain name=LRR_1; Domain location=140-162; Score =17.9; E_value=0.037; Accession=PF00560.23; Description=Leucine Rich Repeat
  Pfam annotation: Domain name=LRR_1; Domain location=164-185; Score =8.8; E_value=6.5; Accession=PF00560.23; Description=Leucine Rich Repeat
  Pfam annotation: Domain name=LRR_1; Domain location=186-208; Score =18.2; E_value=0.031; Accession=PF00560.23; Description=Leucine Rich Repeat
  Pfam annotation: Domain name=LRR_1; Domain location=93-115; Score =14.1; E_value=0.5; Accession=PF00560.23; Description=Leucine Rich Repeat
  Pfam annotation: Domain name=Pkinase; Domain location=327-558; Score =64.3; E_value=4.1e-16; Accession=PF00069.15; Description=Protein kinase domain
  Pfam annotation: Domain name=Pkinase_Tyr; Domain location=326-571; Score=31.4; E_value=2.1e-14; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=25-63::117 -138::140-162::164-185::186-208::93-115::327-558::326-571
MEFLPILSSISLLLCLVLWQGSGEPVEDKEALLDFVNKFPPSRPLNWNESSPLCDSWTGVTCNVDKSKVIAIRLPGVGFHGSIPPDTISRLSALQTLSLRSNVITGHFPSDFFNLKNLSFLYLQFNNISGPLPDFSAWKNLTVVNLSDNHFNGTIPSSLSKLTQLAGLNLANNTLSGEIPDLNLSRLQVLNLSNNNLQGSVPKSLLRFSESAFSGNNISFGSFPTVSPAPQPAYEPSFKSRKHGRLSEAALLGVIVAAGVLVLVCFVSLMFVCCSRRGDEDEETFSGKLHKGEMSPEKAVSRNQDANNKLVFFEGCNYAFDLEDLLRASAEVLGKGTFGTAYKAILEDATTVVVKRLKEVAVGKKDFEQHMEIVGSLKHENVVELKAYYYSKDEKLMVYDYHSQGSISSMLHGKRGEDRVPLDWDTRLKIALGAARGIARIHVENGGKLVHGNIKCSNIFLNSKQYGCVSDLGLATISSSLALPISRAAGYRAPEVTDTRKAAQPSDVYSFGVVLLELLTGKSPIHTTGGDEIIHLVRWVHSVVREEWTAEVFDLELMRYPNIEEEMVEMLQIAMSCVVKDA

SEQ ID NO: 118671 - protein, 387 aa, Glycine max
  Coding DNA Sequence Number=SeqID_1893
  Gene Ontology: Mol. function=signal transducer activity; Biological process=response to light stimulus
  Homolog annotation: Hit_ID=Q7XIJ3; Match level="QueryCoverage=75%, HitCoverage=63%, E-value=1e-46, Identity=38%"; Hit description =Putative phototropic response protein family
  Pfam annotation: Domain name=NPH3; Domain location=159-380; Score =71.5; E_value=2.8e-18; Accession=PF03000.5; Description=NPH3 family
MAGMWTCLQYPSCHYGLHEVHGLWAAHAFELIVPLCYDRSMEMTPSNVAMLCSAVHFLEMECDDDGPGTPNLKPHIEKFLEGVRFWTWSELLEALKQCQGLFSFKDYLAILDRIVDHLIERLASPGITSPNTCSSNRSSFQFSCDTSSNNSWRNNSSGATWWFEHLLFLKIDLLDKVIRTMICYDFDHGVVSRFLFYYHNSSCLGAAQAEKIESTEVVIDLLLLLDLRSISCKDLFNLNRTAVSLKMSRSFISKIESLIGPLLDQTTIDYLLLPSPHGKGQAYDVDFVLRLVHIFFFGGSFELTSNRLMRVAKMMDLFLVEVAPDPHLKPFEFEALITVLPDVARESHDQLYLAMDMYLKVSYQFALFYDSTSVQHSNPCVVCKFSL

SEQ ID NO: 118672 - protein, 127 aa, Glycine max
  Coding DNA Sequence Number=SeqID_1894
  Gene Ontology: Mol. function=serine-type peptidase activity; Biological process=proteolysis
  Homolog annotation: Hit_ID=Q67ZA2; Match level="QueryCoverage=97%, HitCoverage=35%, E-value=2e-25, Identity=41%"; Hit description =Prolyl carboxypeptidase like protein
MQNAYAKYVKEYYIGTFGVDVKTYDQKYLIRNAMSEDNSARLWWFQVCTEVAYFQWLPQMIVFAPQKLTQSKFLSKQTSSPHIPSYIVKCYNCGNCSEDVFNLLSPLKVMRKTAPLLMQFTKYGKRF

SEQ ID NO: 118673 - protein, 351 aa, Glycine max
  Coding DNA Sequence Number=SeqID_1895
  Homolog annotation: Hit_ID=Q01GB3; Match level="QueryCoverage=58%, HitCoverage=52%, E-value=2e-26, Identity=38%"; Hit description=[R] KOG2950 Uncharacterized protein involved in protein-protein interaction
MAAESSRSSAKRPFMEEDDNEFSKKPPVRFPKGKKVKPGDEVVVDKANVEEGEVDLVNAKTATNAAKEREKLRRFLKGKKVKPGDEVVVDKANVEEGEEVDLMNPKIAAAKERAKLRNQITSELLSEGAGGITNDLSAAEVTYEDNENFVDDGIQIEPFNLEKEREEGYFDAAGNFVEYVRENEIKDAWLDNVEVDPKYAALSSVATNDEDEGPPDLSSKDIGIMKRRIANVLEPGETVLQALRRLKGNSDRKAKMSAETKIVFDQLTEDAMKLMENDVYHEKQEVFDREAEGYEKLAQANYDMFADDDEHDTSKPSTDENNAVSQSSSVAINSGPEGGASQNDYVYDESS

SEQ ID NO: 118674 - protein, 217 aa, Glycine max
  Coding DNA Sequence Number=SeqID_1896
  Gene Ontology: Mol. function=heat shock protein binding; Cellular component=chloroplast inner membrane; Biological process=protein folding
  Homolog annotation: Hit_ID=Q1RSF1; Match level="QueryCoverage=63%, HitCoverage=54%, E-value=7e-23, Identity=40%"; Hit description =Expressed protein, putative
  Subcellular localization annotation: CTP_CleavageSite=29; ConfidenceScore=5.29e-01
MTASGLSGCPTRCPQLPFHPMGSRHARVMAFSVAGRNKQGIAFRQVERQLQLVKSAMDASYGDMSNDSAAVFPRINVRDPYKRLGISKEASEDEIQGARNFLIQKYAGHKPSVDAIESAHDKIIMQKFYERKNPKIDIKKKMREVNQSKFVQAVRGRFQTPSTKFIIKTSIAFLVLGVLTVLFPTEEGPTLQGWSIWYFVAVGNLLDGVSNSSYYHT

SEQ ID NO: 118675 - protein, 139 aa, Glycine max
  Coding DNA Sequence Number=SeqID_1897
  Gene Ontology: Mol. function=serine-type peptidase activity; Cellular component=cellular_component; Biological process=proteolysis
  Homolog annotation: Hit_ID=Q7XCY0; Match level="QueryCoverage=89%, HitCoverage=28%, E-value=1e-38, Identity=55%"; Hit description =Prolyl carboxypeptidase like protein, putative, expressed
MRLNLTFRYRLRSAMDSINAKLNRTKIENPWFIFSDLYSGAPSAWFRLKFPHLTCGSLASSAVVLAVYNYTEFDQQIGESAGPECKEALQEITQLIEHKLATSGKELKASFDAANFQYGNPDKVCKPLVEAKKAGEDLV

SEQ ID NO: 118676 - protein, 529 aa, Glycine max
  Coding DNA Sequence Number=SeqID_1898
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=96%, HitCoverage=62%, E-value=1e-168, Identity=41%"; Hit description =Putative receptor protein kinase
  Pfam annotation: Domain name=LRRNT_2; Domain location=22-63; Score =45.7; E_value=1.5e-10; Accession=PF08263.3; Description=Leucine rich repeat N-terminal domain
  Pfam annotation: Domain name=LRR_1; Domain location=114-136; Score =10.8; E_value=2.7; Accession=PF00560.23; Description=Leucine Rich Repeat
  Pfam annotation: Domain name=LRR_1; Domain location=138-157; Score =11.6; E_value=1.9; Accession=PF00560.23; Description=Leucine Rich Repeat
  Pfam annotation: Domain name=LRR_1; Domain location=160-182; Score =9.8; E_value=4.2; Accession=PF00560.23; Description=Leucine Rich Repeat
  Pfam annotation: Domain name=LRR_1; Domain location=184-206; Score =11.8; E_value=1.8; Accession=PF00560.23; Description=Leucine Rich Repeat
  Pfam annotation: Domain name=LRR_1; Domain location=208-230; Score =13.7; E_value=0.66; Accession=PF00560.23; Description=Leucine Rich Repeat
  Pfam annotation: Domain name=LRR_1; Domain location=232-254; Score =8.6; E_value=6.9; Accession=PF00560.23; Description=Leucine Rich Repeat
  Pfam annotation: Domain name=LRR_1; Domain location=256-279; Score =14.6; E_value=0.36; Accession=PF00560.23; Description=Leucine Rich Repeat
  Pfam annotation: Domain name=LRR_1; Domain location=285-312; Score =2.6; E_value=91; Accession=PF00560.23; Description=Leucine Rich Repeat
  Pfam annotation: Domain name=LRR_1; Domain location=335-357; Score =15.7; E_value=0.17; Accession=PF00560.23; Description=Leucine Rich Repeat
  Pfam annotation: Domain name=LRR_1; Domain location=359-381; Score =14.9; E_value=0.29; Accession=PF00560.23; Description=Leucine Rich Repeat
  Pfam annotation: Domain name=LRR_1; Domain location=383-405; Score =13.8; E_value=0.63; Accession=PF00560.23; Description=Leucine Rich Repeat
  Pfam annotation: Domain name=LRR_1; Domain location=407-429; Score =8.5; E_value=7.3; Accession=PF00560.23; Description=Leucine Rich Repeat
  Pfam annotation: Domain name=LRR_1; Domain location=431-453; Score =14.1; E_value=0.52; Accession=PF00560.23; Description=Leucine Rich Repeat
  Pfam annotation: Domain name=LRR_1; Domain location=455-477; Score =15.4; E_value=0.2; Accession=PF00560.23; Description=Leucine Rich Repeat
  Pfam annotation: Domain name=LRR_1; Domain location=479-501; Score =12.0; E_value=1.6; Accession=PF00560.23; Description=Leucine Rich Repeat
  Pfam annotation: Domain name=LRR_1; Domain location=503-525; Score =13.1; E_value=1; Accession=PF00560.23; Description=Leucine Rich Repeat
  Pfam annotation: Domain name=LRR_1; Domain location=66-88; Score=3.6; E_value=62; Accession=PF00560.23; Description=Leucine Rich Repeat
  Pfam annotation: Domain name=LRR_1; Domain location=90-112; Score =12.0; E_value=1.6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1; Domain location=22-63::114 -136::138-157::...
  Pfam module annotation: Domain location=160-182::184-206::208 -230::232-254::256-279::285-312::335-357::359-381::383-405::407 -429::431-453::455-477::479-501::503-525::66-88::90-112
MSILLMLVLLCARCLSCAQCGSVTEIQALTSLKLNLHDPLGALNGWDPSTPLAPCDWRGVSCKNDRVTELRLPRLQLSGQLGDRISDLRMLRRLSLRSNSFNGTIPHSLAKCTLLRALFLQYNSLSGQLPPAIANLAGLQILNVAGNNLSGEIPAELPLRLKFIDISANAFSGDIPSTVAALSELHLINLSYNKFSGQIPARIGELQNLQYLWLDHNVLGGTLPSSLANCSSLVHLSVEGNAIAGVLPAAIAALPNLQVLSLAQNNFTGAVPASVFCNVSLKTPSLRIVHLGFNGFTDFAWPQPATTCFSVLQVFIIQRNRVRGKFPLWLTNVTTLSVLDVSGNALSGEIPPEIGRLENLEELKIANNSFSGVIPPEIVKCWSLRVVDFEGNKFSGEVPSFFGNLTELKVLSLGVNHFSGSVPVCFGELASLETLSLRGNRLNGTMPEEVLGLKNLTILDLSGNKFSGHVSGKVGNLSKLMVLNLSGNGFHGEVPSTLGNLFRLTTLDLSKQNLSGELPFEISGLPSLQ

SEQ ID NO: 118677 - protein, 1047 aa, Glycine max
  Coding DNA Sequence Number=SeqID_1899
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=99%, HitCoverage=100%, E-value=1e-125, Identity=70%"; Hit description =Kinesin motor domain, putative
  Pfam annotation: Domain name=Kinesin; Domain location=25-442; Score =353.1; E_value=4.6e-103; Accession=PF00225.13; Description=Kinesin motor domain
MGSIAEEEAMSNLAGSEERILVSVRVRPLNEKELTRNDLSEWECINDTTIMYRNNLSATERSLYPTAYTFDRVFRNDSPTKQVYEEAAKEVALSVLSGINSSIFAYGQTSSGKTYTMSGITDFAIADIFNYIEKRTEREFVLKFSALEIYNESVRDLLSVDSTPLRLLDDPEKGTVVERLTEETLRDWNHFQELISFCEAQRQIGETALNEVSSRSHQILRLTIESSAREFLGNDKMSSLSASVNFVDLAGSERASQTNSAASTTPVHCDDDPPQDVDNPPPVSPSLHDVGGVRRIVAQDLLNGLWFAVFSGSEKRCIRRCHGRENRCTLMLSSLSSFNVASGCSGVTVVSSCGGGACCAGSSTRDASVLEREREKDREGTKERRGRNGHVPFRDSKLTRILQSSLAGNAKTAIICTMSPARSHVEQTRNTLLFASCAKEVTTNAKVNVVVSDKLLVKQLQKELARLESELKNSGPTRLKFDSAALLKEKDLQIEMLKKEVMDVSMQRDLAQSQIKDMLQVLGDDGSSTELDSSGHQYPKLRVRGSFDFENQTAERQNLSSFDCVESVRSFDASQYSDGHSLSSDENYFQLPDLEKNLPVRISSPALSIVSHDAAKNDLDQKSVEDNLGDRCREIRCIESDDLNSNTHTFSTASSPAVSGLTDVDNTDKENLDLCSSVLKNNKEVADLVLPSLFLQEHFVLPSSEKISPGLTQSSASSSKTTKLTRSRSCKASLMRYPSSDWFDQEEMIQNAPPIGSEKDFTRRPEGLQRKTCTHHSNANAKRLSWAGYANSLGRASDVQNMKSSIDNGSYKDNSLPQGRNGKNDLESSNLQGNPEVQETGMESKINTKKFKDVGLDPLQSEEEKQLEWPSEFKRLQKEIIELWNACNVSLVHRTYFFLLFKGDPSDSIYMEVERRRLFYLKQNFDHGNQTVEDGLTPESSKRHLRGERQMLSRQMQKKLSRSERESLYIKWGIRLSSKNRRLHLAHCLWSETEDLEHIRESATIVAKLVGSVEPDQAFKEMFVLNFAPRRTRKKSFGWTASMKNIL

SEQ ID NO: 118678 - protein, 396 aa, Glycine max
  Coding DNA Sequence Number=SeqID_1900
  Gene Ontology: Mol. function=protein kinase activity; Cellular component=integral to membrane; Biological process=protein amino acid phosphorylation
  Homolog annotation: Hit_ID=Q1S8N8; Match level="QueryCoverage=79%, HitCoverage=48%, E-value=2e-67, Identity=40%"; Hit description =Protein kinase
  Pfam annotation: Domain name=APH; Domain location=92-280; Score= -17.2; E_value=0.096; Accession=PF01636.13; Description =Phosphotransferase enzyme family
  Pfam annotation: Domain name=Pkinase; Domain location=90-361; Score =24.9; E_value=4.8e-10; Accession=PF00069.15; Description=Protein kinase domain
  Pfam annotation: Domain name=Pkinase_Tyr; Domain location=83-361; Score=20.1; E_value=1e-13; Accession=PF07714.7; Description=Protein tyrosine kinase
  Pfam module annotation: Pfam domain module=APH::Pkinase::Pkinase_Tyr; Domain location=92-280::90-361::83-361
MNISIILNVVLLLAIILLLLLYYNTTRKLNKIVKLGQIPTVKEKESDDVEISVDKKIEIGEGTKMVTVEERKELVFFDDKARFQMGELLRASAEALGHGILGNSYKAMLNDGSTIVVKRLRDLKPLSKEEFAKILNAIAEMKHPNLLPLLAYYHSRDEKLMLYTYSERGNLFSRLHDGRGGNRVPFSWNSRLSVARGVARALVYLHLNSKFHNVVPHGNLRSSNVLFDENDAVLVSDFGLASLIAQPIAAQHMVVYKSPEYGYARRVTVQSDVWSYGSLLIELLTGKVSVCSAPPGTNGVDLCSWVHRAVREEWTAEIFDKEICGQKSALPGMLRLLQIAMRCIERFPEKRPEMKEVMREVEKIQQAPEDDDDGSVDRSLTDDSLSTSTSIIGDER

SEQ ID NO: 118679 - protein, 198 aa, Glycine max
  Coding DNA Sequence Number=SeqID_1901
  Gene Ontology: Mol. function=oxidoreductase activity; Cellular component=vacuole; Biological process=response to oxidative stress
  Homolog annotation: Hit_ID=Q2WEC9; Match level="QueryCoverage=77%, HitCoverage=51%, E-value=8e-40, Identity=61%"; Hit description =Cationic peroxidase precursor
  Pfam annotation: Domain name=peroxidase; Domain location=33-195; Score=99.3; E_value=1.2e-26; Accession=PF00141.13; Description =Peroxidase
MEGGLWNKELLLKFVVLAVAVVNTLQRNGERHVCRVLFEHMSTCCVHWSDPTLAGPILRMHFHFCDASVLIAGDGGTERTAGPNLNLRGYEVIDDAKAKLEAVCPGVVSCADILTFAAPDSVVLIIFLTLPTGRRDGMVSIGTEALSLPGRNDNVATQKDKFLKKGLNTEDLVILADTLQFGKSMIKMSNIGVKTGSL

SEQ ID NO: 118680 - protein, 672 aa, Glycine max
  Coding DNA Sequence Number=SeqID_1902
  Homolog annotation: Hit_ID=Q10KE5; Match level="QueryCoverage=85%, HitCoverage=92%, E-value=4e-31, Identity=26%"; Hit description =Expressed protein
IPEHKGWVVPVWFRLCNGFYKDSGNLKLDNVWDGFGENDDHRVPHASDKHNNQFVIQGDSCKKTRLELHGIRNSDYVNSYGTQGKEELYLENMIQKERMLEKDSWSHTPEGVFSSCGSDSSKEAKRLTSDDTGMPDHCFKSSNLDSGGCELCEDDIILGDKCVVENDSVCQYPTSHISQVDNELSFLDNDGWLDIGDFEDVDRMLSCDLTFGAGSLNNEEEFCWLSSSHGAEGSDDALKSDFKFSYAEMSPLKNISDYNMDSKESIVGLPINDPNQRSSALDEKIRSQMDVIDNGVPAPLSMFSESDSDMKSVNIDDLLPKEKGDLLDLLGFQCRFNSKRKLPKPSAGRRKNGYLQNGGSVHPYADPEQCADTKQSFGASSSGVTSLDSIQKHKLNIDSDSLGCIQTQIPMTRPDYSHAPNHTSLFPTLSGSRSEHDGHLSPSLKESSYASNMESSHGHSLEAAALKTKENRENPGSAQQVGHHFENENEGHSEFRGVGLGFSPEIDSSTVQESSSMGSALDQASLEATSFCHLQQIMDQLDIKTKMCIRDSLYRLAKSAEHRHNNSNANGCIGDDETCKAMMAQDANRCAGLMDMETDTNPIDRSVAHLLFHRPSDPSVLLPNETLPFKSSATMHHGSVINPPVKTEKQVCQEDSTGVEKKVLRAFLHRMP

SEQ ID NO: 118681 - protein, 322 aa, Glycine max
  Coding DNA Sequence Number=SeqID_1903
  Gene Ontology: Mol. function=oxidoreductase activity; Cellular component=vacuole; Biological process=hydrogen peroxide catabolic process
  Homolog annotation: Hit_ID=P22196; Match level="QueryCoverage=97%, HitCoverage=97%, E-value=1e-142, Identity=80%"; Hit description =Cationic peroxidase 2 precursor
  Pfam annotation: Domain name=peroxidase; Domain location=43-284; Score=480.6; E_value=1.9e-141; Accession=PF00141.13; Description =Peroxidase
  Subcellular localization annotation: CTP_CleavageSite=47; ConfidenceScore=5.13e-01
MEGQSLYSLVFLVLALAIVNTVHGQGTRVGFYSSTCPRAEFIVRSTVQSHVRSDPTLAAGLLRMHFHDCFVQGCDASVLIAGDGTERTAFANLGLRGFEVIDNAKTQLEAACPGVVSCADILALAARDSVSLSGGPNWQVPTGRRDGRISQASDVSNLPAPFDSVDVQKQKFAAKGLNTQDLVTLVGGHSIGTTACQFFSNRLYNFTANGPDSSINPLFLSQLRALCPQNSGGSNRVALDTGSQTRFDTSYFANLRIGRGILQSDQALWNDPSTKSFVQRYLGGFKGLLFNVEFAKSMVKMSNIELKTGTDGEIRKICSAIN

SEQ ID NO: 118682 - protein, 267 aa, Glycine max
  Coding DNA Sequence Number=SeqID_1904
  Gene Ontology: Mol. function=DNA binding; Cellular component=nucleus; Biological process=regulation of transcription
  Homolog annotation: Hit_ID=Q1S0C7; Match level="QueryCoverage=99%, HitCoverage=72%, E-value=6e-58, Identity=53%"; Hit description=No apical meristem (NAM) protein
  Pfam annotation: Domain name=NAM; Domain location=1-50; Score=12.7; E_ value=1.1e-08; Accession=PF02365.6; Description=No apical meristem (NAM) protein
MAGFWKATGRDKSVYESIKLIGMRKTLVFYKGRAPNGQKTDWIMHEYRLETVENGPPQEEGWVVCRAFKKRTTNGQTKTIERWDRNYLYDEQACGSVSSTVVDHNIDLMVRQQQPQRFSAAQNFLYKQEEIIEEEQHLVQLPQLESPSLPLAKKQSSVMSLISENIINNEDIDNISQKGLSHNTAKKVTTDWRALDKFVASQLSQEERHEFIGVSSFATHHTTTSSDMALLLLQNNSRENERNYKFNPFLNTSSTSDCDIGICVFEK

SEQ ID NO: 118683 - protein, 196 aa, Glycine max
  Coding DNA Sequence Number=SeqID_1905
  Gene Ontology: Mol. function=nucleic acid binding
  Homolog annotation: Hit_ID=Q1S0C5; Match level="QueryCoverage=93%, HitCoverage=26%, E-value=2e-34, Identity=71%"; Hit description=RNA recognition motif. (A.k.a. RRM, RBD, or RNP domain), putative
RGFGRGRQPFNNRGNFNRSRSFYRGGHSQIGRMGFQDDHDFSMHPDFRQRQFGPQGAVRGGHYAGSRGAAFAGPSRPYHDRAWYGIPDGGPIEPIPPRRPYSPGGQFDMPSMGRHFDDPYLYDDNMHGMKRPFYMTDPEPDYMGPNRLRPRLDYADPPIFHGTHHHDSFGAGSRQYPPDYYGSDEDLELWDRHLQI

SEQ ID NO: 118684 - protein, 113 aa, Glycine max
  Coding DNA Sequence Number=SeqID_1906
MRMRLTTFIWLCHIDRIIRLELKIEEGDTATTFSTKVFNRVKSGLKGGKKRFTIVMHWNSDTDRWCMMMMMMCLDTTKKRQLVALLPGHYDLSLPYDCYTVIPPTSTSSTLQS

SEQ ID NO: 118685 - protein, 175 aa, Glycine max
  Coding DNA Sequence Number=SeqID_1907
  Gene Ontology: Mol. function=hydro-lyase activity; Cellular component= cytoplasm; Biological process=fatty acid biosynthetic process
  Homolog annotation: Hit_ID=Q6I5L0; Match level="QueryCoverage=50%, HitCoverage=40%, E-value=4e-38, Identity=89%"; Hit description =Putative beta-hydroxyacyl-ACP dehydratase
  Pfam annotation: Domain name=FabA; Domain location=81-167; Score=8.3; E_value=5.3e-08; Accession=PF07977.3; Description=FabA-like domain
MQHGCPLASERGKWQMAALDIVSSLPLFVHSFSHVVEEPLREAEIGGCEIWRNGSGQGLVGTRGEWWWYVVKGLSEEVEEPSKMEGKVFMWRAMAQVGGLVMLQPEVGGSRENFFFAGIDKVRFRKPVIAGDTLVMRMTLTKLQKRFGIAKMEGKAYVGGEVVCEGEFLMAMGSE

SEQ ID NO: 118686 - protein, 654 aa, Glycine max
  Coding DNA Sequence Number=SeqID_1908
  Gene Ontology: Mol. function=nucleic acid binding; Cellular component= ribonucleoprotein complex
  Homolog annotation: Hit_ID=Q1S0C5; Match level="QueryCoverage=91%, HitCoverage=62%, E-value=1e-168, Identity=53%"; Hit description=RNA recognition motif. (A.k.a. RRM, RBD, or RNP domain), putative
  Pfam annotation: Domain name=RRM_1; Domain location=391-462; Score =92.2; E_value=1.5e-24; Accession=PF00076.12; Description=RNA recognition motif. (a.k.a. RRM, R
  Pfam annotation: Domain name=RRM_1; Domain location=471-546; Score =13.1; E_value=0.0088; Accession=PF00076.12; Description=RNA recognition motif. (a.k.a. RRM, R
  Pfam annotation: Domain name=RRM_1; Domain location=569-640; Score =56.6; E_value=8.3e-14; Accession=PF00076.12; Description=RNA recognition motif. (a.k.a. RRM, R
  Pfam module annotation: Pfam domain module=RRM_1::RRM_1::RRM_1; Domain location=391-462::471-546::569-640
  Subcellular localization annotation: CTP_CleavageSite=35; ConfidenceScore=5.72e-01
MRTRNADSASKSATPKKTPPKKSPAAKRTTATKTRATKKNELSPAPDSNPDQSPLEQKSLGSASSAKSVKKKTPGRSRSKAINTPNSEEQCEAVADETPIEDDTEVAEKVEDVGVVDADNVEGEKEGGKGVGSVGLSDETDRKSMEVDELVQKVCESVGKENDVMEVEVAACWDASVSFRRPGRPIVDLNISADNEDCTGEKEGEKWKEELKDQEGDKGKEELKKQEGDNGKEELKELEGEKGEEELKELEGEKGEEELTELEGEKGNVELKEQKGDKGKEKLKEQEPEKAKGEETNLFGHEENSESFGVEGEAQMQKEDANPIKDGGEGPKIGENSDLGEQGKVELVEDPEENPEEDPEEPPEETSALEEEHRELEAIANQRKIKKEHEIFVGGLDRDATEEDLRKVFQRIGEIVEVRLHKNSSTNKNKGYAFVKFSDKEHAKKALSEMKNPVIHGKRCGTAPSEDNDTLFLGNICNTWTKEAIKQKLKDYGIEGVENIMLVPDVQHEGLSWGFAFLEFSCHADAMLAYKRLQKPDVMFGHAERTAKVAFAEPIREPDPEIMAQVKSVFINGLPPHWDEDHVRELFKSYGEVVRIVLARNMSSAKRKDYGFVDFSTHEAAVACVDGVNKSELGDGASKNYSFHCLPFCWFSAM

SEQ ID NO: 118687 - protein, 655 aa, Glycine max
  Coding DNA Sequence Number=SeqID_1909
  Gene Ontology: Mol. function=DNA binding; Cellular component=beta -galactosidase complex; Biological process=DNA integration
  Homolog annotation: Hit_ID=Q1SDN3; Match level="QueryCoverage=84%, HitCoverage=44%, E-value=0.0, Identity=58%"; Hit description =Polynucleotidyl transferase, Ribonuclease H fold
MAISGSSSEDDLTPPPPPPSLSHITMAQYQQLMNLLSKSSGPGDPISYTLPTPPQFTPSTPITTNTEPTIPQPNGSPSPFPNPSTPPTIDTPNPNIIDQHIQEPPSNHALPRRSNRDTHPPSYLSDYQFQIPSLKSAQSSSTCTYPIQSFLSYTHVSPSHRDFLMTLSSEHEPTSFHEAVKHQCWRDAMKCEIKALQLNQTWDIVQTPSHVRPIGCKWGIDYFETFSPVVKMATVRVVLALASINRWHLHQLDVSNAFLHGDLKEDVYMEILPSLLGYTSSQSCKLKKSLYGLKQSSRQWYEKLSNLLLICGYSNAHADHSLFIKAHNSEFTALIVYVDDIVLTGNSLAEIEHIKHILHTNFHIKDLGKQKYFLGIEVAHSDKGISLCQRKYCLDLLKDSGMLGCKPSSTPMDSSLRLHNDSSGFLDDPLSYRRLVGRLVYLTSTRPDIAFATQQLSQFMSKPTKAHHAAAIRVLRYLKGCPGKGLFFPRTCSPHLLGFSDVDWATCIDSRRSITGYCFFIGNSLVSWKTKKQTTVSRSSSEAEYRALASATCELLWLSYLLRDLRIPLSKSHVLYCDNNSALHIAVNPVFHERTKHLDIDCHLVCEKSQAGLMLLLPVPSSNQLADIFTKAVPPQSFNTYLSKLQLQNIFAPPA

SEQ ID NO: 118688 - protein, 829 aa, Glycine max
  Coding DNA Sequence Number=SeqID_1910
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=99%, HitCoverage=94%, E-value=0.0, Identity=50%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=71-196; Score =105.8; E_value=1.3e-28; Accession=PF01453.15; Description=D-mannose binding lectin
  Pfam annotation: Domain name=PAN_2; Domain location=348-419; Score =106.9; E_value=6.1e-29; Accession=PF08276.2; Description=PAN-like domain
  Pfam annotation: Domain name=Pkinase; Domain location=514-785; Score =138.5; E_value=1.8e-38; Accession=PF00069.15; Description=Protein kinase domain
  Pfam annotation: Domain name=Pkinase_Tyr; Domain location=514-785; Score=110.3; E_value=5.4e-30; Accession=PF07714.7; Description =Protein tyrosine kinase
  Pfam annotation: Domain name=S_locus_glycop; Domain location=210-335; Score=103.6; E_value=5.7e-28; Accession=PF00954.11; Description=S -locus glycoprotein family
  Pfam module annotation: Pfam domain module=B_lectin::PAN _2::Pkinase::Pkinase_Tyr::S_locus_glycop; Domain location=71-196::348- 419::514-785::514-785::210-335
MAIPLSLMLVIAMLFLFSSKISSESDTLTQLQPLHDGATLVSKEGTFELGFFSPGSSTNRYLGIWFKNIPLKTVIWVANRNYPIINKNTSTYTNTNTKLTITKDGNLTLLTANNTHHWSTNATTKSVNAVAQLLDSGNLILREEKDNTNSQNYLWQSFDYPSDTLLPGMKLGWEVTTEALNLNRYLTAWNNWEDPSSGQFAYGVARSSIPEMQLWNGSSVFYRSGPWNGFRFSATPIPKHRSLVNLNFVDTTKESYYQIFPRNRSLLIRTVVNQTVSTLQRFFWDEESQNWKLELVIPRDDFCSYNHCGSFGYCAVKDNSSVCECLPGFEPKSPWTQGCVHSRKTWMCKEKNNDGFIKISNMKVPDTKTSCMNRSMTIEECKAKCWENCSCTAYANSDITESGSSYSGCIIWFGDLLDLRQIPDAGQDLYVRIDIFKVDKYGSKKVMVVVASIVSSIIAMLVVLKFVYWRNKTKFRSEVIIKTKGKTNESEDEDLELPLFDFDFDTIVCATSDFSSDNMLGQGGFGPVYRGTLPDGQDIAVKRLSDTSVQGLNEFKNEVILCSKLQHRNLVKVLGYCIEEQEKLLIYEYMSNKSLNFFLFDTSQSKLLDWPRRLDIIGSIARGLLYLHQDSRLRIIHRDLKSSNILLDDDMNPKISDFGLARMCRGDQIEGTTRRVVGTYGYMSPEYAIGGVFSIKSDVFSFGVILLEVLSGKRNKEFSYSSQNYNLIGHAWRCWKECIPMEFIDACLGDSYIQSEALRCIHIGLLCVQHQPTDRPDTTSVVTMLSSESVLPQPKKPVFLMERVLVEEDFRQNMNSPTNEVTISELEPR

SEQ ID NO: 118689 - protein, 830 aa, Glycine max
  Coding DNA Sequence Number=SeqID_1911
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=94%, HitCoverage=89%, E-value=0.0, Identity=51%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=72-189; Score =142.4; E_value=1.2e-39; Accession=PF01453.15; Description=D-mannose binding lectin
  Pfam annotation: Domain name=PAN_2; Domain location=349-420; Score =96.0; E_value=1.2e-25; Accession=PF08276.2; Description=PAN-like domain
  Pfam annotation: Domain name=Pkinase; Domain location=515-786; Score =136.1; E_value=9.6e-38; Accession=PF00069.15; Description=Protein kinase domain
  Pfam annotation: Domain name=Pkinase_Tyr; Domain location=515-786; Score=113.8; E_value=5e-31; Accession=PF07714.7; Description=Protein tyrosine kinase
  Pfam annotation: Domain name=S_locus_glycop; Domain location=203-330; Score=95.8; E_value=1.3e-25; Accession=PF00954.11; Description=S -locus glycoprotein family
  Pfam module annotation: Pfam domain module=B_lectin::PAN _2::Pkinase::Pkinase_Tyr::S_locus_glycop; Domain location=72-189::349- 420::515-786::515-786::203-330
MAIQLPLMLLIAILLLLFSSKISSETDTLTQFQPLSDGTTLVSKEGTFELGFFSPGSSTNRYLGIWFKNIPVKTIVWVANRDNPIKSNTNNTNTKLTITKDGNLVLLTVNDTVHWTTNATEKSFNAVAQLLDTGNLVLIDEKDNNSQNYLWQSFDYPTDTLLPGMKIGWEVATGLNRYLTSWNNWEDPSSGHFAYGVARSNIPEMQIWNGSSVFYRSGPWSGFRFSATPTLKRRSLVNINFVDTTEESYYQLFPRNRSLVIRTVVNQTVFALQRFIWDEVTQNWKLDLLIPRDDFCGYNQCGSFGFCTEKDNSSVCGCLRGFEPKSPQNRGAKNSTHQGCVQSSKSWMCREKNIDGFVKMSNMKVADTNTSWMNRSMTIEECKEKCWENCSCTAYANSDITESGSGFSGCILWFSDLLDLRQFPDGGQDLYVRVDISQIDKDAKDGSKIAVVVVASIVPSIIAILVFTFFYRRSKTKFRSKVIIKTKGKINESEEEDLELPLFDFETIAFATSDFSSDNMLGQGGFGPVYKGTLPDGHNIAVKRLSDTSAQGLDEFKNEVIFCSKLQHRNLVKVLGYCIEEQEKLLIYEYMHNKSLNFFLFDTSQSKLLDWSKRLNIISGIARGLLYLHQDSRLRIIHRDLKSSNILLDDDMNPKISDFGIARVCRGDIIEGNTSRVVGTYGYMAPEYAIGGLFSIKSDVYSFGVILLEVLSGKKNKGFSFSSQNYNLIAHAWWCWKECSPMEFIDTCLRDSYIQSEALRYIHIGLLCVQHQPNDRPNMTAVVTMLTSESALPHPKKPIFFLERVLVEEDFGQNMYNQTNEVTMSEMQPR

SEQ ID NO: 118690 - protein, 121 aa, Glycine max
  Coding DNA Sequence Number=SeqID_1912
  Gene Ontology: Mol. function=sugar binding; Cellular component =membrane; Biological process=protein amino acid phosphorylation
  Homolog annotation: Hit_ID=Q1S7H1; Match level="QueryCoverage=60%, HitCoverage=8%, E-value=2e-26, Identity=64%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=15-79; Score =68.3; E_value=2.4e-17; Accession=PF08276.2; Description=PAN-like domain
MDWTKGCTRIEPWSCGVRNKDGFRRYAGMKVPDTTHSWINASMTLEDCKAKCLENCSCTAYANLDTNGKGSGCAPFVYADAKHNKHPKKVVLVVVVIVSVVLLMLLACYYIDINRTKYKVQ

SEQ ID NO: 118691 - protein, 96 aa, Glycine max
  Coding DNA Sequence Number=SeqID_1913
  Gene Ontology: Mol. function=RNA-directed DNA polymerase activity; Biological process=RNA-dependent DNA replication
  Homolog annotation: Hit_ID=Q1SP50; Match level="QueryCoverage=60%, HitCoverage=7%, E-value=1e-09, Identity=50%"; Hit description=RNA -directed DNA polymerase
MKRVLSKCIVEEQATFIEEIPIMDNVLVLTKLINKVVAHVQVHGVKICKEAPIISHQPFANDCFLFFYANSQEIEMMNDILKSYDEAIEAKLPRLF

SEQ ID NO: 118692 - protein, 166 aa, Glycine max
  Coding DNA Sequence Number=SeqID_1914
  Gene Ontology: Mol. function=protein serine/threonine kinase activity; Cellular component=membrane; Biological process=protein amino acid phosphorylation
  Homolog annotation: Hit_ID=Q2R1L0; Match level="QueryCoverage=68%, HitCoverage=31%, E-value=2e-23, Identity=67%"; Hit description =Protein kinase domain containing protein
  Pfam annotation: Domain name=Pkinase_Tyr; Domain location=33-152; Score=-133.5; E_value=0.00028; Accession=PF07714.7; Description =Protein tyrosine kinase
MVYQQRRKMKVNKKIWSFLSFDLATIINATNNFLNDNKLGEGGFWPVYKGTLLDGQEIAVKGFQGARSGQGLTEFKNEVILFAKLQHLNLGCCIEGEEKIGYMAPEYAIDGLFSIKSDVFSFGVLLLEMGSSINKNIEINVPMTKLNVVIALNRHRDCGKMALQSN

SEQ ID NO: 118693 - protein, 150 aa, Glycine max
  Coding DNA Sequence Number=SeqID_1915
  Gene Ontology: Mol. function=zinc ion binding
  Homolog annotation: Hit_ID=Q9SVI4; Match level="QueryCoverage=52%, HitCoverage=32%, E-value=3e-15, Identity=52%"; Hit description=ES43 like protein
MDFTAEKKESESKTENAHPTTLDSSSQLASALDSNNKEIEERQARELKAGLHPLKGGSGANGTITGKACPKGLYGTFCEFHDSKEVFLSCHFNLQSADTIEARCTLHSFKSYTKLDAVENDDISSTGAFNPDRVVEDSGKQESLEALTSQ

SEQ ID NO: 118694 - protein, 49 aa, Glycine max
  Coding DNA Sequence Number=SeqID_1916
MWRLNKHNGRQSIEMVLMNHMGVMEEIGDLAARMLTSKATTHITISRDN

SEQ ID NO: 118695 - protein, 81 aa, Glycine max
  Coding DNA Sequence Number=SeqID_1917
  Pfam annotation: Domain name=DUF1070; Domain location=13-70; Score =60.7; E_value=4.7e-15; Accession=PF06376.3; Description=Protein of unknown function (DUF1070)
MAGAAPKQLFGFGVVAMLATLILALFMPAAVQAQSASPAPAPTSDGTSLDQGIAYVLMLLALEQMRRVIVSYADAGLCSRL

SEQ ID NO: 118696 - protein, 86 aa, Glycine max
  Coding DNA Sequence Number=SeqID_1918
MIGWDIERKEEYLGEDAVAQGMQKGKAFVFFIWRVSDAIEKSEGFFCTHRFRFTFFHPRFLVRVIPKAAISFLLNHGPRPFITPLL

SEQ ID NO: 118697 - protein, 451 aa, Glycine max
  Coding DNA Sequence Number=SeqID_1919
  Gene Ontology: Mol. function=protein kinase activity; Cellular component=nucleus; Biological process=protein amino acid phosphorylation
  Homolog annotation: Hit_ID=Q0WP97; Match level="QueryCoverage=98%, HitCoverage=39%, E-value=1e-165, Identity=64%"; Hit description=COP1 like protein
  Pfam annotation: Domain name=WD40; Domain location=191-229; Score =10.4; E_value=2.3; Accession=PF00400.22; Description=WD domain, G -beta repeat
  Pfam annotation: Domain name=WD40; Domain location=241-279; Score =20.1; E_value=0.0078; Accession=PF00400.22; Description=WD domain, G- beta repeat
  Pfam annotation: Domain name=WD40; Domain location=283-322; Score =31.9; E_value=2.2e-06; Accession=PF00400.22; Description=WD domain, G-beta repeat
  Pfam annotation: Domain name=WD40; Domain location=326-364; Score =11.8; E_value=1.5; Accession=PF00400.22; Description=WD domain, G -beta repeat
  Pfam annotation: Domain name=WD40; Domain location=369-406; Score =32.2; E_value=1.8e-06; Accession=PF00400.22; Description=WD domain, G-beta repeat
  Pfam module annotation: Pfam domain module=WD40::WD40::WD40::WD40::WD4 0; Domain location=191-229::241-279::283-322::326-364::369-406
MEIEHYRREILQSEVINGIHEVYCEELSSSLNQDDAESELLLHFLISLKEQKHMDANKLAEEIRCLESDVKEVERRHDLRKSLLPSSLQNDSSLQIENVSLKESIISNANELRLMKIIPRLESAYFSMRSKIKLPETDTATHPDKDILINHDNWCGAQKDMEQHKATDALGAFFDSLCKYARYSKFEVRGILRNTDFNNPANVICSLSFDRDEDYFAAAGISKKIKIFEFNALFNDSIDIHYPVVEMSNRSRLSCVCWNNYIQNYLASTDYDGAVKLWDANTGQGFSRFTEHEKRAWSVDFSLLCPTKFASGSDDCSVKLWNINEKNSLATIRNVANVCCVQFSTHSSHLLAFGSADYSAYCYDLRNLRNPWCVLAGHRKAVSYVKFLDSETLVSASTDNMLKIWDLNKTSPVGPSTSACSLTLSGHTNEKNFVGLSVADGYIACGSETNE

SEQ ID NO: 118698 - protein, 188 aa, Glycine max
  Coding DNA Sequence Number=SeqID_1920
  Gene Ontology: Mol. function=RNA-directed DNA polymerase activity; Cellular component=chromatin; Biological process=RNA-dependent DNA replication
  Homolog annotation: Hit_ID=Q8H7X6; Match level="QueryCoverage=62%, HitCoverage=11%, E-value=9e-36, Identity=62%"; Hit description =Putative retroelement
MAEALIISSKRHSFLTLGYLHEKHDHYESWLGMVSIWNACASSLGPVLIDYNTLCMKFLYDGHLVELKALFQSPSSLPSARETDHHIHLLPHVTPVDVWPYRYPHYQKCEIELQVEAMLQKGLIQPSTNPFSSPVLLVRKHDGSWQFCVDYHALNSIMMCDRFPIPTIDELLDELGQARWFLKLDLLQ

SEQ ID NO: 118699 - protein, 127 aa, Glycine max
  Coding DNA Sequence Number=SeqID_1921
MVLFEKLLMKGERRDTGGNGHGDYLLGSCWHGSIGIINRISTGRSRSTIESLSSAIKLIHGLEREMVGALTSVDVSCGFNYNPLRLFVKSDRRTPNTGAITREDARVQIEREGKRKITKPAYLWDYV

SEQ ID NO: 118700 - protein, 469 aa, Glycine max
  Coding DNA Sequence Number=SeqID_1922
  Gene Ontology: Mol. function=protein serine/threonine kinase activity; Biological process=protein amino acid phosphorylation
  Homolog annotation: Hit_ID=Q9T014; Match level="QueryCoverage=86%, HitCoverage=36%, E-value=2e-38, Identity=32%"; Hit description=COP1 like protein
MDEELEVGEGVQHQTKDDGFSLNPEFPKILKPQEIYTSYSHISQDKNVVEAREHLHPSLFSDGAGAMVEELTVKSYNGSRLHIGTLNNPGPLHNSRSQWRHIYQPVGDSGMGSDCIIARKSVEATSSAWEDIGSTSFRDMLDRKPVNDEQGHVMQHLSTDVHTAEHKEDEGHAHEGIQTKVIHKSGFAEYSGRSTLKGKGVVCKGPSSNGLYIESRDQNPIKSGIDTQMDSNALPSSGLKTAKSPHNATGPGSGGSDTDGVTLREWLKSRHHKRSKTDHLSIFRKIVDLVDGSHFEGVAMRNLYPSYIKLLPSNQVMYLGLPAQKQTLDSVANSEVLQLDNSFIRKRLSETVISPSLNLQLKKQKFNENARVAGDWSQCPPRTDLYLQIANDIKVNAVGSQDYYNEYKEDIQFSKHNIGRMSRIPHISSAGQLQLTSLNEGLEDKWYASPEGGCTTSSNIYCLGVLLFE

SEQ ID NO: 118701 - protein, 70 aa, Glycine max
  Coding DNA Sequence Number=SeqID_1923
MEEEKETILQVPVEEVVEDNEAWLAGRILTQESFNKGEEGDQDSGGGENPIHFSFFVDMVDRGEVLSRSP

SEQ ID NO: 118702 - protein, 169 aa, Glycine max
  Coding DNA Sequence Number=SeqID_1924
MALAEAPCPQVDNLDIGGTNLPTKFHQEKVLATTPTLPSVVVRVITGCTLTNFSGNCTVSADGGGPLNGFNKEQWKNGPVMKSNDKSSQGRWGTNSGHNRKFTSPGAVIGTLDEPPIVGVVLRGRSDKVLKESCTWGYFAQEVWREHQLLDWWHQSNIGFDNQIPLGMQ

SEQ ID NO: 118703 - protein, 787 aa, Glycine max
  Coding DNA Sequence Number=SeqID_1925
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=99%, HitCoverage=92%, E-value=0.0, Identity=60%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=70-186; Score =132.7; E_value=1e-36; Accession=PF01453.15; Description=D-mannose binding lectin
  Pfam annotation: Domain name=PAN_2; Domain location=343-411; Score =116.5; E_value=7.6e-32; Accession=PF08276.2; Description=PAN-like domain
  Pfam annotation: Domain name=Pkinase; Domain location=505-762; Score =67.8; E_value=3.5e-17; Accession=PF00069.15; Description=Protein kinase domain
  Pfam annotation: Domain name=Pkinase_Tyr; Domain location=505-762; Score=76.0; E_value=1.2e-19; Accession=PF07714.7; Description =Protein tyrosine kinase
  Pfam annotation: Domain name=S_locus_glycop; Domain location=200-326; Score=164.0; E_value=3.9e-46; Accession=PF00954.11; Description=S -locus glycoprotein family
  Pfam module annotation: Pfam domain module=B_lectin::PAN _2::Pkinase::Pkinase_Tyr::S_locus_glycop; Domain location=70-186::343- 411::505-762::505-762::200-326
MALFLAMLVFSNPLVFFSQISYATDTITQSQPLLDGSTLVSKEGTFELGFFTPGNSPNHYVGIWFKNIPMRTVVWVANRDNPAKDKSNMLSLSKDGNLILLGKNRSLIWSTNATIAVSNPVVQLLDNGNLVIREEKDDNMDNEENFVWQSFDYPCDTQLQGMKLGWNLKTGLNRYLTAWKNWEDPSSGDFTSGLKLGTNPELVISKGSNEYYRSGPWNGIFSSGVFGFSPNPLFEYKYVQNEDEVYVRYTLKNSSVISIIVLNQTLFLRQRITWIPHTRTWSVYQSLPQDSCDVYNVCGAYGNCMINASPVCQCLEGFKPKSPQDWNQMDWTKGCVRSEPWSCGVKNKDGFRLIAGMKMPDTTHSWINRSMTLEDCKAKCLKNCSCTAFANMDTGGGGSGCSIWFGDLVDLRISESGQDLYVRMAISGTVNADAKHKHLKKVVLVVAITVSLVLLMLLAFSYIYMTKTKYKENGTWTEEKDDGGQENLELPFFDLATIINATNNFSIDNKLGEGGFGPVYKGTMLDGHEIAVKRLSKSSGQGLKEFKNEVILCAKLQHRNLVKVLGCCVEGEEKMLLYEYMPNRSLDSFIFDPAQSKLLDWPTRFNILCAIARGLLYLHQDSRLRIIHRDLKANFGLAKMCGGDQVEGNTNRIVGTYGYMAPEYAIDGLFSIKSDVFSFGVLLLEIISGKKNRTVTYEEHSDNLIGHAWRLWKEGIPEQLIDASLVDSCNISELVRCIQVGLLCLQHHPEDRPNMTTVVVMLSSENSLSQPKASNLVVDKSLVQPMK

SEQ ID NO: 118704 - protein, 56 aa, Glycine max
  Coding DNA Sequence Number=SeqID_1926
MILKVSGAITASINGGTIFVSSDNTIFGPFNVVDSLGQHKTDSKNIEPEIKEVLGF

SEQ ID NO: 118705 - protein, 153 aa, Glycine max
  Coding DNA Sequence Number=SeqID_1927
  Homolog annotation: Hit_ID=Q9FJ36; Match level="QueryCoverage=84%, HitCoverage=23%, E-value=1e-07, Identity=30%"; Hit description =Arabidopsis thaliana genomic DNA, chromosome 5, TAC clone:K16L22
  Pfam annotation: Domain name=KIP1; Domain location=12-74; Score=7.2; E_value=0.031; Accession=PF07765.3; Description=KIP1-like protein
MTNHHTRESIKFLESLIHPKNVEDLQRTKTDIENNVSKILELIKNKSHSTKGTELVGLVEDLYQKQQSLNALYDRVTEEFEKEVSRRRIKKSAMSFSDSDSEYFSPEEVDGIKRKSEKERHIVSDLDTLKQESDYKIKATTKFEEQLTSLTKE

SEQ ID NO: 118706 - protein, 437 aa, Glycine max
  Coding DNA Sequence Number=SeqID_1928
  Gene Ontology: Mol. function=metal ion binding; Cellular component =cytoplasm; Biological process=intracellular protein transport
  Homolog annotation: Hit_ID=Q9C7V6; Match level="QueryCoverage=69%, HitCoverage=87%, E-value=1e-28, Identity=27%"; Hit description=BZIP transcription factor, putative; 74638-73126
MVEEKEGFLKKLKELELNLESQNNQKNELEEKLRDTSYEVKQLANENKALQDRNHELRTTMTQKGEEISIFMKEQENHKNGASMEVMSLKAKLNGMRLELDTMHEQKNKLEQQNERSQKEYAESLAKVENLNTNLETQIDDQAKMIERLNEENKQAKIVYSKLKLIQVTAERKMNELAEEFRRKMEDNIRLLHQRIHVAEQLNNENKNSCKVTKQRYEDENKNLGLKIASYREETTTRVPIRFELVAQNSLDLVVEKVEEHTSRVTRMRCKVEFVKDWMKERNGEVKELREKVDCLRELLNKKEEQELVLRENMWKLEENVSKEGGEKLNLKKQVSQLEKKVGKLEKILKEKDEELREKSFTEKYITQESKGTKRGIEEHAKRIHRTAGGNGHREHENCKYVAQMESGARSSSSSSVSALSFLFYERQGTFSAYNNM

SEQ ID NO: 118707 - protein, 95 aa, Glycine max
  Coding DNA Sequence Number=SeqID_1929
MRMDYWKQKFPFNHRNLFLKLLLTIFFLGLAFRILFFHSLSPQISSVLESPFPEKVTLPEEPQTSPVPEEEPVPEPPLVIEHVPQTEDQLSPTDS

SEQ ID NO: 118708 - protein, 481 aa, Glycine max
  Coding DNA Sequence Number=SeqID_1930
  Gene Ontology: Mol. function=nucleic acid binding
  Homolog annotation: Hit_ID=Q1S0C3; Match level="QueryCoverage=95%, HitCoverage=80%, E-value=1e-125, Identity=57%"; Hit description=Zinc finger C-x8-C-x5-C-x3-H type (And similar), putative
MLHSSINEPNDLPPGFESSHFLNQPKVELSNIPLIKWECPPLVVVRSQWRVAAGEESREKENQKLREMRVLEALYPRLSAIPPSPSVSLDVEEEDYDDGITPLIPIIPIEEEESMDILPELAVALKPSPNVQSQNSPQYISAKTSISSASNASPAVSHDPCVRPLAEADLAAASSVVATIIRSNEQGTLIDMDLLGKIFTDPKILEQLINEHRTAATTTSASSKTVDIPTSGQKPAIPSVLLSTSTPDVTASGTTPTSAVSSLPSGFWLKPSNPSVSLLNPTPCKTPTLSVPAIPSFSLLSSTHDQPVTASVPLSRPVSGKPVTPSVSLLTHTPALDMHRPVSKNFHVSSGMPPALNSQSQQETALASGPKRAASLASIPYSQLSSGPLPSAAGNLRATINQAQSAATTMPYKLSTCSSAFAVKDANYYKNLIRQHGADKQDIQDSHIGIRHSNFQDMKPVGEVGAVLVKWWPSLADGNQP

SEQ ID NO: 118709 - protein, 140 aa, Glycine max
  Coding DNA Sequence Number=SeqID_1931
  Subcellular localization annotation: CTP_CleavageSite=31; ConfidenceScore=5.09e-01
MGTSTYRLLRATRPCLQRAARPHLQRAPNPRLQRTQVPRPPPDLGGGANCASTARGGGSNILPSDHYSDLPLPKCQLAFIEKYCALRQVRGEAPQQPEDGQQRATDTPPPPQSPPQLFYKAVALPTTRGRPAGDRIQSQR

SEQ ID NO: 118710 - protein, 164 aa, Glycine max
  Coding DNA Sequence Number=SeqID_1932
MGEAEEVQEKMKAEVEAMKERMATMVEAMMSIKEMVEVSAAYQTRARAKIMGEVEKVQEQMKADMEAMKEQMAHEIPHHILADFEPCLGYATEGQAVGAPPAMAEKGKVDHLKERLRAIEGGEDYAFANLEELFLVPNIITPHTFKVLDFDKYKGTTCSKNHLR

SEQ ID NO: 118711 - protein, 61 aa, Glycine max
  Coding DNA Sequence Number=SeqID_1933
MNEIRRFGGLGMEERRKRKGGCAGISGKCDIYRAGRLAICSSVIDYSIHVIDYQNKKIAFS

SEQ ID NO: 118712 - protein, 71 aa, Glycine max
  Coding DNA Sequence Number=SeqID_1934
MVKEECKGVSVSSKSDQGVPTGPKRIKVIPDWPTPPSVEGRSPEYEEPRDLRSNPFQGGRDDAILPPKGIG

SEQ ID NO: 118713 - protein, 156 aa, Glycine max
  Coding DNA Sequence Number=SeqID_1935
  Homolog annotation: Hit_ID=Q9LJR0; Match level="QueryCoverage=75%, HitCoverage=82%, E-value=5e-21, Identity=44%"; Hit description =Arabidopsis thaliana genomic DNA, chromosome 3, TAC clone: K7L4
MPRPFMCKTPMLPLKEESPHCNGNVKHHTPLGKETLKVYVLNKSNHQEKESYCEQQQAREGIRGVNQKLIMGCCPLKHACGLGSVAKHRDLFGVEYHQSSTSKSYCGMKNTHKGIYRRNHLSEFTSKAFNCFLTFNSMEPLPSKPTMVVEIPITSF

SEQ ID NO: 118714 - protein, 361 aa, Glycine max
  Coding DNA Sequence Number=SeqID_1936
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=93%, HitCoverage=37%, E-value=1e-103, Identity=60%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=Pkinase; Domain location=53-317; Score =106.3; E_value=9e-29; Accession=PF00069.15; Description=Protein kinase domain
  Pfam annotation: Domain name=Pkinase_Tyr; Domain location=58-317; Score=88.2; E_value=2.5e-23; Accession=PF07714.7; Description =Protein tyrosine kinase
  Pfam module annotation: Pfam domain module=Pkinase::Pkinase_Tyr; Domain location=53-317::58-317
MKTKVKINDSNEEELELPLFDFDTIAFATNDFSVTTSLAKVVLVLYINLSFPFNYVNVIFSKGTLPDGQDIAVKRLSQTSTQGLTEFKNEVIFCSKLQHRNLVKVLGCCINEQEKLLIYEYMPNKSLDFFLFDSSQSKLLDWSKRLNIINGIARGLLYLHQDSRLRIIHRDLKASNILLDNDMNPKISDFGLARMCRGDQNEGNTSRVVGTYGYMAPEYAIDGVFSIKSDVYSFGILLLEALSGKKNKGISYSNSSYNLIGHAWRLWKECTPKEFIDTCLGDSYVISEALRCIHIGLLCVQHLPDDRPNMTSVVVMLSSESVLPQPKEPVFLTEKVSVEEHFGQKMYYSTNEVTISKLEPR

SEQ ID NO: 118715 - protein, 120 aa, Glycine max
  Coding DNA Sequence Number=SeqID_1937
  Gene Ontology: Mol. function=protein serine/threonine kinase activity; Cellular component=membrane; Biological process=protein amino acid phosphorylation
  Homolog annotation: Hit_ID=O81833; Match level="QueryCoverage=95%, HitCoverage=13%, E-value=7e-20, Identity=43%"; Hit description =Putative receptor protein kinase
  Pfam annotation: Domain name=PAN_2; Domain location=1-57; Score=55.1; E_value=2.3e-13; Accession=PF08276.2; Description=PAN-like domain
MKVPDTNTSWISRYSNMTLEKCKEKCWENCSCTAYGSSDITGKGSGCILWFGDLLDLRLLPNAGQDIYVRVDISQIGAKGGSTSRKVLVVVTGIVSSIIAILVIFVLVYCNKFRSKGNLP

SEQ ID NO: 118716 - protein, 303 aa, Glycine max
  Coding DNA Sequence Number=SeqID_1938
  Gene Ontology: Mol. function=catalytic activity; Biological process =trehalose biosynthetic process
  Homolog annotation: Hit_ID=Q1W5S5; Match level="QueryCoverage=61%, HitCoverage=85%, E-value=5e-65, Identity=61%"; Hit description =Ramosa 3
  Pfam annotation: Domain name=Trehalose_PPase; Domain location=1-189; Score=137.7; E_value=3.2e-38; Accession=PF02358.7; Description =Trehalose-phosphatase
MTRKMRATLKGIARHFPTAIVTGRCRDKVYNFVKLTELGMDITGPTKSPKASVQDLVRKNEDCPRGPKVENNKFCLSLHFHCVDEKSWAVLAEKVRLVLNEYPQLRLTQGRKVLEIRPTIKWDKGKALEFLLESLGYKNLNDIFPIYIGDDRTDEDAFRVLRSRGQGIGILVSRVAKETNASYSLQCRLQVGGVQLLICNKVGKWATGSLMFATGSSELSFWESKPIMDKEFHWLIFTLVSRPFSSSSCSTQPPSHYNLSLPPSHCEKTCCANLSAGNADEDVEDLGGVKLQFHCEAVMIEEK

SEQ ID NO: 118717 - protein, 260 aa, Glycine max
  Coding DNA Sequence Number=SeqID_1939
  Gene Ontology: Mol. function=sugar binding; Cellular component =membrane; Biological process=protein amino acid phosphorylation
  Homolog annotation: Hit_ID=Q1S7G9; Match level="QueryCoverage=99%, HitCoverage=70%, E-value=9e-54, Identity=45%"; Hit description=S -locus glycoprotein; Curculin-like (Mannose-binding) lectin
  Pfam annotation: Domain name=B_lectin; Domain location=73-193; Score =154.1; E_value=3.7e-43; Accession=PF01453.15; Description=D-mannose binding lectin
MTIPLPFMLVMIIANLLFISSKISSETNTISQLQPLPDGTTLVSEDGTFELGLFSPGSSTNRYLGIWFKTIKPKTVVWVANRDNPINNTNSTTKLTITKEGNLVLLNQNNNIIWSTNTTTKATNVVAQLLDTGNLVLRDEEDNNPPKFLWQSFDHPSDTLLPGMKLGWEKVTTKGSLNLNRYLTAWNNWEDPSSGHFTYGFSRSTIPEKQMWNGSSLFFRNGPWNGIRFSGTPSLKHRPLFGLTFVYNADECYFQFYPKN

SEQ ID NO: 118718 - protein, 71 aa, Glycine max
  Coding DNA Sequence Number=SeqID_1940
MLHSDSTGRWGNEGKTNHNQAKRKLPRKEASMAMLDSFDRDMSKRGCKETLTKSKKDEDERYNSNLMVGEE

SEQ ID NO: 118719 - protein, 66 aa, Glycine max
  Coding DNA Sequence Number=SeqID_1941
MMGSSFPESEKEENTQASPFDLLKWKAGLKLRQNHGGCVLCVWMLLREITHTAPEYQTIARKGAPN

SEQ ID NO: 118720 - protein, 220 aa, Glycine max
  Coding DNA Sequence Number=SeqID_1942
  Homolog annotation: Hit_ID=Q9FJ33; Match level="QueryCoverage=72%, HitCoverage=57%, E-value=3e-20, Identity=42%"; Hit description =Arabidopsis thaliana genomic DNA, chromosome 5, TAC clone:K16L22
MEKSREEKLSQVWDCGSTLYDSYELNSFKRQLNTAIANSPSNRRTLSMSHLPERCLSSLQSQPQPPMSNNNKSFKISRTFQKLLRFVFKSSNKLRISSTRNTTSNNISTFQVAEKYANDRLYVVYDKSEPVLSTIPELPEFEVGVLSPDITSFVRKSSSERFMATTAIGALWDFFVQRGGAESLLTLTNLFIVLGLREALRKAQNSQDQNASTPNSVLDE

SEQ ID NO: 118721 - protein, 807 aa, Glycine max
  Coding DNA Sequence Number=SeqID_1943
  Gene Ontology: Mol. function=carboxypeptidase activity; Cellular component=proton-transporting two-sector ATPase complex; Biological process=ATP synthesis coupled proton transport
  Homolog annotation: Hit_ID=Q654T8; Match level="QueryCoverage=99%, HitCoverage=81%, E-value=1e-117, Identity=55%"; Hit description=Leaf senescence protein-like
  Pfam annotation: Domain name=DUF231; Domain location=630-804; Score =211.3; E_value=2.2e-60; Accession=PF03005.6; Description=Arabidopsis proteins of unknown function
  Pfam annotation: Domain name=DUF231; Domain location=74-247; Score =220.9; E_value=2.8e-63; Accession=PF03005.6; Description=Arabidopsis proteins of unknown function
  Pfam module annotation: Pfam domain module=DUF231::DUF231; Domain location=630-804::74-247
YHDEEYKCKRWNFPSYNFSVSVIWSPFLVEAAIFEDINGVSSSEVDLHLDRLDSKWADQYLDFDYIIVSTGKWFLKSAIYYENETILGCHSCPKRNLTELGFNFAYRKALKLVMNFIVTSNHKGLIFFRTFTPDHFENGEWFSGGTCNRTAPIKEGEMEMKYLNKMLREIELEEFGKAASEASKNGVNFKLVDFASLSQLRPDGHPGPYRQFHPFEKDQNANVQNDCLHWCLPGPIDSWNDIIMEMVVNGEGKGQQEKTPSTNEGNILASSDKGQGMLQQMRRLEKEKTEVLLKAEDDVLKQKDEELKNRGREQENLQTELKKLQNLQEFKPTMGNWGPMNLADYATLRSHHNLPVLKENEQNKDKKKKGCSTLHFVDERPMELVLESPFPEKVTLPEPQNPPQTSTVLEHVPELLPVPQHPTILEHAPELLPVPETPTILEHAPETEDQLSPTDSKKCDYFSGDWVPNPSGPAYTNESCDLIVSHQNCLKNGRPDTEFLYWRWAPRDCDLPQFDPERFLNMMWNRAWALVGDSISLNHVQSLLCILAKVEQPVLFYYNKENRCKSWRFPSYNFSMSLIWSPFLVEAAIFEDENGVSSSNVELHLDKLDSKWTDQYLDFDYIIFSTGKWFLKSAIYYENDTILGCHFCPKRNLTELGFNLAYRKALKLVMNFIVSSNHKGVIFFRTFTPDHFENMEWFNGGTCNRTAPIKEGEMEMKYLSKMLRDVELDEVGKAASEASKNGVNLKLVDIAPLSLLRPDGHPGPYRQFHPFEEDQNASKVQNDCLHWCLPGPIDSWNDIIMDMIVNE

SEQ ID NO: 118722 - protein, 100 aa, Glycine max
  Coding DNA Sequence Number=SeqID_1944
  Subcellular localization annotation: CTP_CleavageSite=31; ConfidenceScore=5.27e-01
MATPLNSPPPPRESATPFSPSTSKKTRKARRARMIKHDVRNKEHAIQKQNIVLYVLSRGDSLEEQASQENFVVHGRQDVLTTALRRLEHLQGAPAPLQGN

SEQ ID NO: 118723 - protein, 316 aa, Glycine max
  Coding DNA Sequence Number=SeqID_1945
MGETDEVQEWIKANLEAMKEQMATMMEAMMSMKKIMEVNAATIAATSAVAKVDPTPPSSLNQINHPTSDMVMEAKNWESKHAFLPYGLPPNYAPPSVVCPPDENVNNSTSILIESQQPRFDHAYVPQLIGETHEIPHHNLADFEPHLGYAAEGQAVGGVPLPKSLEGPQFLPQLQPLHFMVGRIPLAMVEKGKLDHIEERLKAVEGGGSYAFANTTKLCLVPDIAIPLKFKVLDFNKYKGTTCPKNHLRMYCRKMGAYTKDEKLLMHFFHESLTGAAVTWYTNLEPSRVHSWKDLMVSFIRQYQYISDMAPDRTQL

SEQ ID NO: 118724 - protein, 72 aa, Glycine max
  Coding DNA Sequence Number=SeqID_1946
MERENVEGVCDQNQFPPIFIGIYIRSSMRPHVACILKLPSTFPSCLTLTSIGSLQKLEIVKSQNFKLRLATI

SEQ ID NO: 118725 - protein, 235 aa, Glycine max
  Coding DNA Sequence Number=SeqID_1947
MEKDCWQTNAVMSPSDIISRTGLLYVIGRQHFPYDLLMLSQRNRLFLFNFSSLTANVADLLVLAGNLLVFDKNLWRKVNVMDDGPAKLKFIPDHFQVPTSSIESPESRTSSITEPGTDQSPRYCFLVELTAAELESLRLELADIEEREAHLKAQLEHIDEVLRSARLSGYLYIRTVLIARPTPRWATLPGEPPPLDDTEVDDWLPRFVILHGACKSRAVNLCSLFHILLRHLSIL

SEQ ID NO: 118726 - protein, 180 aa, Glycine max
  Coding DNA Sequence Number=SeqID_1948
  Homolog annotation: Hit_ID=Q10QE9; Match level="QueryCoverage=68%, HitCoverage=31%, E-value=2e-27, Identity=49%"; Hit description =Expressed protein
  Pfam annotation: Domain name=DUF677; Domain location=2-179; Score =33.6; E_value=7.4e-12; Accession=PF05055.3; Description=Protein of unknown function (DUF677)
MGFKMNQEVVKVILDCKKNIWKNPELFELLMFEKLRVRQSKLDKKVKRIYSWRKVSSMIFVATVAAVLICSVVAAAIATPDVAAALAAVTATPIGSMGKWIDSLLNNYENAMKEPKEVTFSMQVGTYVAIKDMENIWVLVDRLEVEIESLLHNVEFAIEEAVKVAIEEIQKKLGSFYEEC

SEQ ID NO: 118727 - protein, 61 aa, Glycine max
  Coding DNA Sequence Number=SeqID_1949
MDCAMSAQAILKYSLPPSFFFQVDSWLSALQSDCKLESDTFCKADCKLESDTSVPNGSIEM

SEQ ID NO: 118728 - protein, 243 aa, Glycine max
  Coding DNA Sequence Number=SeqID_1950
  Gene Ontology: Mol. function=nucleoside diphosphate kinase activity; Cellular component=mitochondrion; Biological process=CTP biosynthetic process
  Homolog annotation: Hit_ID=Q9SP13; Match level="QueryCoverage=99%, HitCoverage=100%, E-value=2e-80, Identity=65%"; Hit description =Nucleoside diphosphate kinase
  Pfam annotation: Domain name=NDK; Domain location=99-228; Score =275.3; E_value=1.2e-79; Accession=PF00334.9; Description=Nucleoside diphosphate kinase
  Subcellular localization annotation: CTP_CleavageSite=94; ConfidenceScore=5.73e-01
MASQVCKSASRAARSLLSSRFHSQGRALGAAAAVSLSSKVPLFYGKNGSGNGSASSSSSSSWISGALALPAAGALSIAVSVWGSAYMFQDQEVQAAELERTFIAIKPDGVQRGLISEIISRFERKGYKLVGIKVVIPKKEFAQRHYHDLKERPFFDGLCDFLSSGPVIAMGVISYGRKLIGATDPQKSEPGTIRGDLAVVVGRNIIHGSDGPETAKDEIKLWFKPEELVSFTSNAEKWIYGAN

SEQ ID NO: 118729 - protein, 119 aa, Glycine max
  Coding DNA Sequence Number=SeqID_1951
  Gene Ontology: Mol. function=RNA-directed DNA polymerase activity; Cellular component=chromatin; Biological process=chromatin assembly or disassembly
MVRNNREWVAQEILAPLLHCRGDGKQFSHIRGCRQKFLSKWFAKDCSHTIAGSISLHGEGYLKVRFNGGDSNQGINNHGVAFDISAVAQVIFKGATVNEDVMEQDDDKAVEKWPKNQIH

SEQ ID NO: 118730 - protein, 408 aa, Glycine max
  Coding DNA Sequence Number=SeqID_1952
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=98%, E-value=6e-86, Identity=45%"; Hit description =Integrase, catalytic region
  Pfam annotation: Domain name=Chromo; Domain location=310-365; Score =24.9; E_value=0.00029; Accession=PF00385.14; Description='chromo' (CHRromatin Organisation MOdifier
  Pfam annotation: Domain name=rve; Domain location=27-160; Score=1.3; E_value=0.0046; Accession=PF00665.16; Description=Integrase core domain
  Pfam annotation: Domain name=zf-H2C2; Domain location=1-38; Score =13.9; E_value=0.0052; Accession=PF09337.1; Description=His(2)-Cys(2) zinc finger
  Pfam module annotation: Pfam domain module=Chromo::rve::zf-H2C2; Domain location=310-365::27-160::1-38
MGGHIGVTKTITWLSENLTWPGLRADVANFVANCIECQFTKYETKHIVGLLCPLPVPFRPWEDLSLDFVIGLPFFQGKIVLLVVVDRFSKGIHFGIIPQAHTAHMSDGQVEVMNRVIEQYLRAFVHRWPETWGKLLPWVELSHNTSWNSSTGSTPYEIIFGHKPFSFPDYLAGSSKLDVVDDLLMTRDEVFASIRRKLLKAQAYMKKTADTKRREVTYDLGSWVLLKLQPYRQRSVKEAQAGSGKLAKRFYGPFQVIDRVGKVAYHLKLPDTTRIHPVFHYSLLKPFHGDPTSNTAAPLSKHFLNDQPLIIPLAILDYLRHVEKDSWEVLVQWKGLSPDETSWEDWAQLQQDHHLEDKVILQGSKEVDSSVATTAASEGQTREIDNAGVQIAKVKRRVTRPAYLRDYA

SEQ ID NO: 118731 - protein, 84 aa, Glycine max
  Coding DNA Sequence Number=SeqID_1953
MAYKFYMINRAATQANQIFVPDLRKAASGTGVTNGYSVTKEHIHSWFFARTISAKYTGQYAESEIKTMYSFCYEPKEGEAMCLR

SEQ ID NO: 118732 - protein, 392 aa, Glycine max
  Coding DNA Sequence Number=SeqID_1954
  Gene Ontology: Mol. function=metal ion binding; Biological process =protein amino acid phosphorylation
  Homolog annotation: Hit_ID=Q1SI63; Match level="QueryCoverage=88%, HitCoverage=90%, E-value=4e-41, Identity=35%"; Hit description=Zinc finger, RING-type; RINGv
  Pfam annotation: Domain name=zf-C3HC4; Domain location=333-374; Score= 24.9; E_value=0.00029; Accession=PF00097.15; Description=Zinc finger, C3HC4 type (RING finger)
MAPSAILVCGFCIFLFHLQSTRGNKQVNCNRLRCGDIDIEFPFGLRGSNQDRRCRYYPIQSFQLSCLDQTQTILTLPGFGNLTVKSIDYETQSIRVNDPAGCLPKRFLHKWNLSDDSPFALNPLIYGTIPFNLTFLRCPSNVTDSSQFPSVPISCLSDKSNYSTIVSWSQPIISSPLLSQQCEVMFRALVPLPVLDTPMLPFWPDLNTDLDLVWTQPNCRDCSLSGQLCGFSKDKTKTPQVRCFARDSTKGLSRSGKYGLAIGVGIPGVLCLIGICCCIGGKLRMLRHGGRSTDVPVRSVPLEMGLDGATIEKYPKTLIGESGRLLKPNDSTCAICLCEYEAKETLRSIPQCNHYYHAHCIDHWLKLNATCPLCRNSPTASLFSFSPTSSLA

SEQ ID NO: 118733 - protein, 153 aa, Glycine max
  Coding DNA Sequence Number=SeqID_1955
MHTKGKQKFPGLSLANKISKMIRTIFACLNGKASHKKSKVEPLEVTKPVYRDELTKKQRPRKAGKKTVRFAESEPTILGEDGEKEFEKTRSVSGNEVGEKEGIRVRIKLTKEEAARFLSKCNRGVLEFEDVARELVLIPVNRVSIVSDGTINL

SEQ ID NO: 118734 - protein, 379 aa, Glycine max
  Coding DNA Sequence Number=SeqID_1956
  Pfam annotation: Domain name=PPR; Domain location=159-193; Score =16.4; E_value=0.085; Accession=PF01535.11; Description=PPR repeat
  Subcellular localization annotation: CTP_CleavageSite=54; ConfidenceScore=5.82e-01
MTLNLCTPCFSRMLHHPFSSSSSLPNTHTPLPSLLFFSPSSLPNPNQSTFISTKASVSESHNETSDDTAANLFDQQLILRLAATAKDADEALLMIADNSSRNDGVVSTSDCCSIISAALNRNNPQLALSIFYAMRATFHQVGESGPLAERWKWSRPNANVYTLLIQGLAAVLRVSDALRVIRYICEIGVSPGEEVPFGKIVKCPSCRIAVGVAQPQQGIQIVSCAKCRYQYELVSGDIVSIESEEISMDITAWERGLRYVKLMKQSIPAAVHSIVVQTPSGLARTHRFATETVDLPAQEGERVTVAVAAPSNVYRKVGPFKFSPRAPDFYPGEAMCITNHKDGRESLLLRAPRKEVNSSLLKPSLIFPLLALLPPVMCL

SEQ ID NO: 118735 - protein, 80 aa, Glycine max
  Coding DNA Sequence Number=SeqID_1957
MDEEATCRPRQQKGTSHSRWFETQNHATWSSGVCDNLGNEPFTMVHLHVLGFLYGSHHGARVNPSLYDTISMMVFTYTLS

SEQ ID NO: 118736 - protein, 137 aa, Glycine max
  Coding DNA Sequence Number=SeqID_1958
MVSDVYVGGDTSLRVNSKMYTKLDSCLVIPPTPNRAKPRAIVKFLGGAFIGAVPEVGATLTSGLPQANLSPAQLEDLPLFSIGHSNGALLQVLAGSLFPKKIPKQFKECDEKCCPAVGSCSQPNDASCGGNSFLLNS

SEQ ID NO: 118737 - protein, 677 aa, Glycine max
  Coding DNA Sequence Number=SeqID_1959
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=96%, HitCoverage=74%, E-value=0.0, Identity=56%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=69-193; Score =126.2; E_value=9.1e-35; Accession=PF01453.15; Description=D-mannose binding lectin
  Pfam annotation: Domain name=PAN_2; Domain location=349-417; Score =105.7; E_value=1.3e-28; Accession=PF08276.2; Description=PAN-like domain
  Pfam annotation: Domain name=Pkinase; Domain location=512-675; Score=- 3.9; E_value=2.5e-08; Accession=PF00069.15; Description=Protein kinase domain
  Pfam annotation: Domain name=Pkinase_Tyr; Domain location=512-676; Score=-21.9; E_value=4e-11; Accession=PF07714.7; Description=Protein tyrosine kinase
  Pfam annotation: Domain name=S_locus_glycop; Domain location=207-337; Score=154.6; E_value=2.6e-43; Accession=PF00954.11; Description=S -locus glycoprotein family
  Pfam module annotation: Pfam domain module=B_lectin::PAN _2::Pkinase::Pkinase_Tyr::S_locus_glycop; Domain location=69-193::349- 417::512-675::512-676::207-337
MTIFTLILAIANLLLFLSKASSIDTLTLSQSLPDGTTLVSKDETFELGFFSLRNSTNRYLGIWFKNIPVKTVVWVANRDYPLKDNSTKLIITNDGNLVLLTKNNKVQWSTNTTTKASRPILQLLNTGNLVLRNDNEDNKNNNKSSNNNNEDRFLWQSFDYPSDTLLPGMKLGWYRKTGLNRRVIAWKNWDDPSPGNFSWGITFDSNPEMVLWKGSFKYHRSGPWNGIRFSGAFGGSNRLSTHPLFVYKLINNDDEVYYSYSLTNKSVISIVVMNQTLLRRQRNIWIPENGTWRLFQTAPRDICDTYNPCGSYANCMVDSSPVCQCLEGFKPKSLDTMEQGCVRSEPWSCKVEGRDGFRKFVGLKFPDTTHSWINKSMTLEECKVKCWENCSCTAYANLDIRGAGSGCSIWFGDLIDLKVVSQSGQYLYIRMADSQTDAKDAHKKKELLLIGTIVPPIVLVILLAIFYSYKRKRKYEEENVSVVKKDEAGGQEHSMELPLFDLATLVNATNNFSTDNKLGQGGFGPVYKGVLAGGQEIAVKRLSRSSGQGLTEFKNEVILCAKLQHRNLVKVLGCCIEEEEKMLLYEYMPNKSLDSFLFDSTKSKILDWSKRFHILCATARGLLYLHQDSRLRIIHRDLKASNILLDNNLNPKISDFGLARMCGGDQIEGNTNRVVGT

SEQ ID NO: 118738 - protein, 252 aa, Glycine max
  Coding DNA Sequence Number=SeqID_1960
  Gene Ontology: Mol. function=hydrolase activity
  Homolog annotation: Hit_ID=Q665W3; Match level="QueryCoverage=78%, HitCoverage=72%, E-value=2e-75, Identity=70%"; Hit description=Icc protein homologue
MTPPARAVPRHTASPTLPAAQQPQREKSAAAAPAPQCADAAPDTTAINQRRHGLVALGIQIRTEQIALQTIHFGVQRAIRLHRQPAPAGRHGINGEVGAVRRDPAPDECGRTPGGAPAGNFAAPHPADADCAGCAGQARYSQRPADDGAAAPACSDRGTDAACGPATPADSRSACRAARQKPGCPAAPAASARRAAHACPQRCRPAPAYPPSPAENRDCPAARRTASADVQCPQQNADKLRRCDPGRDRQWR

SEQ ID NO: 118739 - protein, 213 aa, Glycine max
  Coding DNA Sequence Number=SeqID_1961
  Gene Ontology: Mol. function=transcription factor activity; Biological process=regulation of transcription, DNA-dependent
  Homolog annotation: Hit_ID=Q8Y092; Match level="QueryCoverage=99%, HitCoverage=76%, E-value=6e-59, Identity=63%"; Hit description =Probable transcription regulator protein
  Subcellular localization annotation: CTP_CleavageSite=30; ConfidenceScore=5.47e-01
MPCPASASWRRVSPLDAHSVGLMRKNSPSRCHTGQTLCASSWLNPSSWCIGRTGQQANRAAAQHAGAQRGVAQFANANSDIGLLLKQVDDNVIGVQLQLNLRIARAKFGNQRHDNMQGKWRIGVDAQPSGRNVAPLRDMLFGLLHRREDLPRVIEKNQPLFGQRQATRGAVQQRGLQFAFEAAQRPADAGAGLIQLFRCGGNRTGVHHRDPGA

SEQ ID NO: 118740 - protein, 416 aa, Glycine max
  Coding DNA Sequence Number=SeqID_1962
  Gene Ontology: Mol. function=calcium ion binding; Cellular component =extracellular region; Biological process=pathogenesis
  Homolog annotation: Hit_ID=Q8XQP2; Match level="QueryCoverage=92%, HitCoverage=85%, E-value=1e-51, Identity=35%"; Hit description =Probable hemagglutinin/hemolysin-related protein
MANITAADNATVISTKDQFYKWIDKSVAGANGGKLEITIDGEVHMVDISEDGKWSFDPKTSWLDGTHVIQLVSIDKATNPSPPRIFILDMDTTPPAKPEIWRVIDDAAAEDHYLTPGEATSDKTPALAGVAEPGTIVTLYDNGKEIGSVVADKMGAWSITPELADGEHQLTVMAKDTVGHESPISDAFNLTIADGVVTQAVNEAVSVTPAESTTMDAVPFPGKPIKTINKNIISLSADNAEPNALVQIVIDQTVYTTRADASGKWQFDSPEMKEGLHVAGIRYLDRAGNWGPSTQLIRNIDTSAPEAPQIMRVIDNEGSADTYLTPGNYTNDKTPTLYGVAQPDSVVKIYDIRSNVIGSVKAGADGRWSFTPELTTDGTHVFSASYTDRFGAESPRSDNFALTLDTSVPGPPSWSE

SEQ ID NO: 118741 - protein, 292 aa, Glycine max
  Coding DNA Sequence Number=SeqID_1963
  Gene Ontology: Mol. function=structural molecule activity; Cellular component=integral to membrane; Biological process=entry of virus into host cell
  Homolog annotation: Hit_ID=UPI0000397AC1; Match level="QueryCoverage =41%, HitCoverage=33%, E-value=1e-13, Identity=38%"; Hit description =COG2885: Outer membrane protein and related peptidoglycan-associated (lipo)proteins
  Pfam annotation: Domain name=OmpA; Domain location=178-277; Score =62.9; E_value=1e-15; Accession=PF00691.11; Description=OmpA family
  Subcellular localization annotation: CTP_CleavageSite=40; ConfidenceScore=5.28e-01
MKIAKKLLLASLVCAPVFTTFSTQAQNSFDGAWRSLSPVSAEQARVVYYRPASLTGEKPANIYVDGEFHTSLLAGGYTVFCVAPGTHSLGSYVNDAPDYQGKRAQSWTDKLAAGKTYYIRANLDDSGRPLVVSQQQAQQELLSTKRQAHLLSRASSVQRCQEGTTEAYDNYAFSSDLLFRFGSANSNDISAQGREALSSFASMLKKENAAQRHIIVTGFTDPIGSDSSNMALGQRRAEAVKALLIAQGMNAANITAQSMGESQVDTNCSGSLQEQKACYASERRVIISVENK

SEQ ID NO: 118742 - protein, 333 aa, Glycine max
  Coding DNA Sequence Number=SeqID_1964
  Gene Ontology: Mol. function=transferase activity; Cellular component= membrane; Biological process=teichoic acid biosynthetic process
  Homolog annotation: Hit_ID=Q5PC08; Match level="QueryCoverage=98%, HitCoverage=95%, E-value=2e-84, Identity=48%"; Hit description =Putative glycosyl transferase
  Pfam annotation: Domain name=Glycos_transf_2; Domain location=6-177; Score=137.7; E_value=3.1e-38; Accession=PF00535.16; Description =Glycosyl transferase
MSVMLSVIVPMHNAGELLEPFLASLLAQREQRLEVIIVNDGSTDGSGEIAHRYAAAHPHIRVIDQANAGVSNARNAGLAVARGKYVAFPDADDVLAPDMYSTLLEQAEQHQLDVMQCNGERYFTSQDELQPIFPEARLRTTDVITGVQWFERALKSRKFIHVVWLAIYRLDFIRQHRLYFEPGLHHQDIPWTTEVMFNAKRVKYLSTPLYRQRVHDKSISNRRRTGQANVDYQRHYMKIVEMLERLNRRYAGTVAIRPAFHWQITREALGICHSIRREPDPAAQSQITEEFYQRGIDRAMFANARGLKQGWHVMLWRHRLKQWRTITAARNRA

SEQ ID NO: 118743 - protein, 80 aa, Glycine max
  Coding DNA Sequence Number=SeqID_1965
MARIFWERQGHKMSWKKKVVQEDSYPGVATCTQHYCWGTQQTVKWRNCPSAIILPEEGSSGKVPEIIFPESFRKNLLPEE

SEQ ID NO: 118744 - protein, 99 aa, Glycine max
  Coding DNA Sequence Number=SeqID_1966
LDRVQQHAEANYGHYAPCVNQEERIRQYQDDVSDHPWLGCDPRLTTSRYLAPIVRQFVKFRDMPEGGANSIQTHLGLPGCFPEGGAFWRKQPSSPGRAR

SEQ ID NO: 118745 - protein, 136 aa, Glycine max
  Coding DNA Sequence Number=SeqID_1967
  Gene Ontology: Mol. function=DNA binding
  Homolog annotation: Hit_ID=Q1S0F5; Match level="QueryCoverage=88%, HitCoverage=22%, E-value=7e-15, Identity=36%"; Hit description=IMP dehydrogenase/GMP reductase
MAVLANAYDTFNRRCEKSGARIVCCTPTLYVWMVSHLFHHESRPVYPLQGHHICPEKGKANWEHLLANMVEASVNWFPRWKEGRVGVLSSCEGFSNIPLMGMRGCINYNLILAIRQLGYPMRRASSEESITPFIAR

SEQ ID NO: 118746 - protein, 107 aa, Glycine max
  Coding DNA Sequence Number=SeqID_1968
MGSLASHDTRGKKYGGKGMKMKMEVTDWALLWFNVGYIICGISGIACITQISWGGGGEDLWLYVLILRCWRVTSLRETGSFTYLSKHRIGKVFGTFPLALKSKGGQS

SEQ ID NO: 118747 - protein, 168 aa, Glycine max
  Coding DNA Sequence Number=SeqID_1969
MKIITLRSTMLLRSSSCGSKEKEYEQDRRLCLLVYRRQRTTALHEGVTECTRDGEHRHGEPDPSCIVPNLVKIQILNPPTPESYSYTSCSRKSSTRRLHDCHGVVEATQRQLKGEGFAVMQNVRGRKRERSTGRIQEVRLCENEKGKHIPFRTVFKTDIEVLLLTLVL

SEQ ID NO: 118748 - protein, 103 aa, Glycine max
  Coding DNA Sequence Number=SeqID_1970
  Homolog annotation: Hit_ID=Q683B0; Match level="QueryCoverage=37%, HitCoverage=8%, E-value=7e-07, Identity=66%"; Hit description=MRNA, complete cds, clone: RAFL21-63-G01
MVRSGGRGQEKELWLEAHLREECLVVSRRREAILRVRSMRSKSLLEGTDWRSLSKERSREREATSERERNSRRSTSPIFSALGFCEGHRRFTVSPLTTTTSLS

SEQ ID NO: 118749 - protein, 122 aa, Glycine max
  Coding DNA Sequence Number=SeqID_1971
  Gene Ontology: Mol. function=nucleoside-triphosphatase activity; Cellular component=protein complex; Biological process=protein catabolic process
  Homolog annotation: Hit_ID=Q1SKI7; Match level="QueryCoverage=60%, HitCoverage=17%, E-value=6e-16, Identity=66%"; Hit description=AAA ATPase; 26S proteasome subunit P45; Nucleic acid-binding, OB- fold
MTTANYTEVSLLGSWTFQVSASEQTMDHLRGPEHVKCPVVEGLSDQIRQLRESIEQPLTNLELFLRVGIGMKLPKGVLHYGAPRTRKTLLAKPISCKVDAIFLKVQLLSLCCAKKVLDDGFV

SEQ ID NO: 118750 - protein, 133 aa, Glycine max
  Coding DNA Sequence Number=SeqID_1972
MVGKDLGSRDGPHDVQIQNNYTFPPYGSPPKEDANNSAPILIESRQPQSDHAHVSQPMGETHGMPHHNLADFVPCLGYATEGQTVGGIPMPNTLEGPQFRPQPQPLHSTVGKNPHAMAEMGKLDHLKENAQGH

SEQ ID NO: 118751 - protein, 288 aa, Glycine max
  Coding DNA Sequence Number=SeqID_1973
  Gene Ontology: Biological process=penicillin biosynthetic process
  Pfam annotation: Domain name=AAT; Domain location=112-286; Score= -50.5; E_value=0.054; Accession=PF03417.7; Description=Acyl-coenzyme A:6-aminopenicillanic acid acyl-transferase
MGSCSVDRVFEVGPCKAGYEMGLLIGQGFSEMMSRVVTDLILQNQLRPFPHTPQTTFFLTTKPNFQGIEKRFCLSTSGSRFWRLFQKKEQKVTMLIPRMIALMFLLSVNLWLLRRTTKMQMLPLLATPTLIKGILPDGLFFVDCAFGFNSQGLAFTLDSDPPAEDEIVAGGIGRNFISRDLLEATSMDDAMNRIKSSEVSVGHSYNLFETSTRRIVNVETASRKRISVYEVQDENSISRQKRAAVLTKESKGDFLSLLEDMDDKKYPIYTTEAQDMPINTPHSCNLIT

SEQ ID NO: 118752 - protein, 281 aa, Glycine max
  Coding DNA Sequence Number=SeqID_1974
  Gene Ontology: Biological process=response to biotic stimulus
  Homolog annotation: Hit_ID=P13240; Match level="QueryCoverage=58%, HitCoverage=89%, E-value=2e-71, Identity=79%"; Hit description =Disease resistance response protein 206
  Pfam annotation: Domain name=Dirigent; Domain location=106-277; Score= 308.3; E_value=1.4e-89; Accession=PF03018.5; Description=Dirigent -like protein
MSFAAYKMMQCPTGIDNCAVGFLTHSRSDFVPLQPDDIDVEWPSRPCHHVGSLPNLIVTVANVLEVYAVRLQEDQSPKAAIDSRSDTLLDGIVGASLELHRDKAAFIACIAKLVVEVPCKRKQYHTPCKHLVLFFHDIIYNGNNAANATSAIVGAPEGANLTILANQFHFGNIVVFDDPITLDNNLHSKPVGRAQGFYIYNTKNTYTSWLGFTFVLNNTDHDGTITFAGADPIMQKTRDISVTGGTGDFFMHRGIATIMTDAFEGEVYFRLRVDIKFYECW

SEQ ID NO: 118753 - protein, 68 aa, Glycine max
  Coding DNA Sequence Number=SeqID_1975
MEGMRGKEKEMYFGHCMRARNGILQLSFFYLLFKQLVYHASPSSLSVVEDEEGSTSSRSTMAINILIL

SEQ ID NO: 118754 - protein, 158 aa, Glycine max
  Coding DNA Sequence Number=SeqID_1976
MATRIRPSFDDDTILHCISIDPLINQSLQPASAISSSLPSERMVMEPATASPWRYRRGSSSFWSKRPSPFGSLGKPRLVAAEQVDSESDVFVVVGGDVGGDVLGEPVEGDGEEGVHGEDGGGDGREEGEADQQGGAFDGAGAMMVVSILEGKEGKKTM

SEQ ID NO: 118755 - protein, 272 aa, Glycine max
  Coding DNA Sequence Number=SeqID_1977
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q84T14; Match level="QueryCoverage=97%, HitCoverage=100%, E-value=1e-105, Identity=77%"; Hit description =Vacuolar ATPase subunit E
  Pfam annotation: Domain name=vATP-synt_E; Domain location=16-267; Score=315.1; E_value=1.3e-91; Accession=PF01991.8; Description=ATP synthase (E31 kDa) subunit
MNDADVSKQIQQMVRFIRQEAEEKANEISVSAEEEFNIEKLQLVEAEKKKIRQEYERKERQVEIRKKMSSRPLTSIKIKFWSVSPTRIGLDLIPAFHNTATSTDCDYCEYSMQLNASRIKVLQAQDDVISSMKEAASKELLNVSHHHDDHVYRNLLKDLIVQCLLRLKEPSVLLRCRKDDLHLVENVLDSAAQEYAEKANVDPPEIIVDNQVYLPPGLTHQNSHDLYCSGGVVLASRDGKIVCENTLDARLDVVFRKKLPEIRKQLFGQIVA

SEQ ID NO: 118756 - protein, 357 aa, Glycine max
  Coding DNA Sequence Number=SeqID_1978
  Homolog annotation: Hit_ID=Q84YF3; Match level="QueryCoverage=74%, HitCoverage=88%, E-value=5e-32, Identity=30%"; Hit description =Hypothetical protein 4B
  Pfam annotation: Domain name=DUF1191; Domain location=22-289; Score =269.2; E_value=8.1e-78; Accession=PF06697.3; Description=Protein of unknown function (DUF1191)
MNWDFIWVLLLTLCCCCCSFGHSLDNTAAASESLNSLVQDFAFRSLVKHRPQTGALYDALLPRNLSGMDVSVVRLRSRRLWNKGANFSYFRIPPRTMSIPHVRRLAIVYQNLGNWSSHYYNLPGYSFISSVVGFMVFDASNVTDTSERNLTLNTMGQPISIQFPNITFMARGSNSINTRVRCVAFNDNGTFQLTEMSSPGVCNSRDQGHFSVVLPLEKRRGTWYLWVIGFVVGFFGLIIVGYVVFSSRRLLKTKRIQVMEKQASEDQVLESRWVGNSKMPSATVTRTQPVLENDVSRMKIITSLLTRASFSNEGDLTVKIKTWPSRYQQEAQNLTSAHACKVAKGGKRENPSPDTPG

SEQ ID NO: 118757 - protein, 115 aa, Glycine max
  Coding DNA Sequence Number=SeqID_1979
MSKLTLQKSLSFNSSLCRRYKIHFQKGYFGLQLLFPKQVFYKHNNDFQNPLSEIYKTLFGIAFSGVENEELPWEGGVSLPWCTEEGIVVVVVCYCEGVLGLREETKKVLGLRDRS

SEQ ID NO: 118758 - protein, 207 aa, Glycine max
  Coding DNA Sequence Number=SeqID_1980
  Homolog annotation: Hit_ID=Q1SP02; Match level="QueryCoverage=56%, HitCoverage=26%, E-value=8e-13, Identity=35%"; Hit description=IMP dehydrogenase/GMP reductase
MTGIKGAPYRACIDALTVTDVCWMPYDEHRGVRGYDLISSYTGQVRWGPIIVYIRPEWVVRQMGYIQTVPPSPVRDSLTGTDIDDRWVHFLDHVAPTGELCVVPGQVAPDYMEWFFQISHPFVTPKEDTTEPRPTPPPPTHDDDFVRSPYAFCVDCTTCVRMGRIAEHLERVINLRMVTAETDLYDIMDLFLRIARDDNPDDSLRPR

SEQ ID NO: 118759 - protein, 168 aa, Glycine max
  Coding DNA Sequence Number=SeqID_1981
  Gene Ontology: Mol. function=RNA-directed DNA polymerase activity; Biological process=RNA-dependent DNA replication
MEVGIGPILDLTPKEEKRIEGLKSEERKVPLATLSFQGYALYWWTSLVTERRIHGDPLVEYWNDLKSDLRKRHIPSYYERNLMVNLQRLRQGSMSVEECRQQMELLLLRVGLREEERTSITRFLSGLNMEVRNKETTSCPSSSGSEDEVRGEESSEEVYPHEEDDLLM

SEQ ID NO: 118760 - protein, 62 aa, Glycine max
  Coding DNA Sequence Number=SeqID_1982
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q05990; Match level="QueryCoverage=88%, HitCoverage=12%, E-value=2e-16, Identity=78%"; Hit description =Ribulose bisphosphate carboxylase large chain
MGTFPLLSLRRCESASLYKNGCDLAREGNEIIREASKWSPELAAACEVWKEIKFEFEAMDTL

SEQ ID NO: 118761 - protein, 85 aa, Glycine max
  Coding DNA Sequence Number=SeqID_1983
GKEGGGSRPARPGELGCFHQKAPPFVEQPGRSKYLTPIVRQSVKFCDMSGVERKGVQIAIRPTWAFQDLPTEGSAFWWKQLSSPG

SEQ ID NO: 118762 - protein, 279 aa, Glycine max
  Coding DNA Sequence Number=SeqID_1984
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9ZQG9-2; Match level="QueryCoverage=93%, HitCoverage=82%, E-value=1e-104, Identity=58%"; Hit description =Isoform 2 of Q9ZQG9
  Pfam annotation: Domain name=Glyco_hydro_17; Domain location=1-242; Score=184.1; E_value=3.3e-52; Accession=PF00332.9; Description =Glycosyl hydrolases family 17
IKLYDADPNVLSAFSNSDVEFIIGLGNEYLQSMRDPSKAQSWVQQHVQPYISLNQNHLHHSNSFPPSSGAFRQDLIQYIQPLLSFHAQIKSPFLINAYPFFAYKDNPNQISLNYVLFQPNQGATDPNTNLHYDNMLYAQIDAVYAAIKALGHTDVEVRISETGWPSKGDPDEVGATPQNAEIYNSNLLKRIEQKQGTPANPSVPIDIFVFALFNENLKPGPVSERNYGLYYPDGTPVYNIGLEGYLPEMVIESKSNALSTNFLIYIFTCLLFIWELSRP

SEQ ID NO: 118763 - protein, 134 aa, Glycine max
  Coding DNA Sequence Number=SeqID_1985
  Homolog annotation: Hit_ID=Q9LWW3; Match level="QueryCoverage=79%, HitCoverage=20%, E-value=4e-07, Identity=26%"; Hit description=Salt -inducible protein-like
  Pfam annotation: Domain name=PPR; Domain location=45-79; Score=10.6; E_value=0.41; Accession=PF01535.11; Description=PPR repeat
  Pfam annotation: Domain name=PPR; Domain location=80-114; Score=33.0; E_value=1e-06; Accession=PF01535.11; Description=PPR repeat
  Pfam module annotation: Pfam domain module=PPR::PPR; Domain location =45-79::80-114
MKVIGRKKFCGLRLQRLFLNVVSEVGVALDIVEKMCEAGFTLSTEVLQCLVHFFVRMKDFEGAFRMIADLEDMNFKPTTNMYNAIMAGYFREKNISGVLRVLKKMRGANVKPDSQTFSYLIRNCEKEEDIMKVA

SEQ ID NO: 118764 - protein, 75 aa, Glycine max
  Coding DNA Sequence Number=SeqID_1986
MDKAMAVILKYFLSVRINVSNRKGSSRKVTYGGGKHDGLKRHGSRRIKAVPAQNKATSNPRSFEKLKMEYASQTT

SEQ ID NO: 118765 - protein, 124 aa, Glycine max
  Coding DNA Sequence Number=SeqID_1987
  Homolog annotation: Hit_ID=Q1T4S3; Match level="QueryCoverage=98%, HitCoverage=8%, E-value=2e-07, Identity=30%"; Hit description=Zinc finger, CCHC-type
  Subcellular localization annotation: CTP_CleavageSite=36; ConfidenceScore=5.04e-01
MNLISVSQFCKDSKHVLHKGLVGSDELYQFLALLTSMSQLKGSSNVFNSVPSNKTAVVNTASCNTAVDNAASCKSVSCTTVPCNFVSCASPVVNTASCKAVSFSTWHSRLGHPSVNAMKVVFQL

SEQ ID NO: 118766 - protein, 120 aa, Glycine max
  Coding DNA Sequence Number=SeqID_1988
MVQSAIEASLNEYEDNIIETNPSVAPIRPKPIFEYDERVRSVASHQAYRYRRPRGGARYQLLFPLVRVNFELGVIMVIAVSFGKPVVPAALMNRPTRGERRFAYWALAECILAYYVGTDE

SEQ ID NO: 118767 - protein, 383 aa, Glycine max
  Coding DNA Sequence Number=SeqID_1989
  Gene Ontology: Mol. function=nutrient reservoir activity; Cellular component=cellulose and pectin-containing cell wall
  Homolog annotation: Hit_ID=Q43557; Match level="QueryCoverage=97%, HitCoverage=98%, E-value=1e-143, Identity=66%"; Hit description =Unidentified precursor
  Pfam annotation: Domain name=CBM_4_9; Domain location=34-198; Score= -18.0; E_value=0.098; Accession=PF02018.8; Description=Carbohydrate binding domain
  Pfam annotation: Domain name=DUF642; Domain location=51-378; Score =740.8; E_value=8.9e-220; Accession=PF04862.3; Description=Protein of unknown function, DUF642
  Pfam module annotation: Pfam domain module=CBM_4_9::DUF642; Domain location=34-198::51-378
MAYTYFHVLTACTSMFLVTWNMTKSDTASVCEISGLLPNGNFEQGPKPSQLKGSVVTGHDAIPNWTISGFVEYIKSGQKQGDMLLVVPEGDYAVRLGNEASIKQKLKLIKGSFYSITFSAARTCAQEEKLNVSVVPTTEKRDWGIIPIQTMYGSNGWESFTCGFRADFPEAEIVIHNPGKEEDPACGPLIDSVALKVLYPPKRTRANLLKNGNLEEGPYIFPNSSWGALIPPHIEDSHGPLPGWIVESLKAVKYIDSDHFAVPEGKRAIELVAGKESALAQVVITTIGKTYDLTFAVGDANNECEASMMVEAFAGANTVQVPYQSKGKGGFVRGKLRFKAVSTRTRLRFLSTFYTMKSDNSGSLCGPVIDDVKLLGVRYPTQA

SEQ ID NO: 118768 - protein, 202 aa, Glycine max
  Coding DNA Sequence Number=SeqID_1990
MMEAMMNMKKIMEVNMVAGTSVVAKVNPMPSSGLNQMNHPTSNMVGKDLGSMGGPYYVQIQNKHAFPPYGLPPNYTPPNVAYTPSENVNNSTPILIESRQPQTDHAHVSQTMGETHEIPHHNLADFEPCLGYATEGTTVGGIPLQNTLEGPQYHPQPHPLHSTAGKNPHAMAEMGKLDHLEERLRAIEAGEDYAFAKVPDFD

SEQ ID NO: 118769 - protein, 67 aa, Glycine max
  Coding DNA Sequence Number=SeqID_1991
MTADKGKPIFEVVLPLGLPFKVTLDWRYPAPHNQRGKRPTHPASSPKNTTLEKILLIRDRACDLLVR

SEQ ID NO: 118770 - protein, 141 aa, Glycine max
  Coding DNA Sequence Number=SeqID_1992
MRAHTAYSRLTTSNANNKKCGDLGHVAPLPPKKLSRLLPCLGIGPVSRPCDLSPKLLRGRAYKRGGTLPLLTEAEPIETFIEPNAIDNAPRQVAQLDRPAEVVAVRLPRRVVLLDEGSGDRRSYYLTGGDRNSVGLAEARD

SEQ ID NO: 118771 - protein, 48 aa, Glycine max
  Coding DNA Sequence Number=SeqID_1993
MTFRNSIGAVGGKAGEINRDAIIAVRRHVIPLRVLLLCDSKNYSSVGV

SEQ ID NO: 118772 - protein, 153 aa, Glycine max
  Coding DNA Sequence Number=SeqID_1994
MVGYTPSSFTDLVFASKKIEVDPKRGKFDHPTRTTEKTGANEEGEKEGETHAVTAIPIRPSFPPTQQCHYSANNKPPPYPPPSYPQRPSLNQPQTITLAKVHQPPFLREYDSNATCACHGEAPGRSIEHGRALKRKVQGLIDAGWLKFEENCV

SEQ ID NO: 118773 - protein, 322 aa, Glycine max
  Coding DNA Sequence Number=SeqID_1995
  Gene Ontology: Mol. function=transcription factor activity; Cellular component=intracellular; Biological process=regulation of transcription, DNA-dependent
  Homolog annotation: Hit_ID=Q7CJ56; Match level="QueryCoverage=94%, HitCoverage=99%, E-value=1e-129, Identity=73%"; Hit description =Putative transcriptional regulator
RPSAIQQRAGEELSAHRQLAARAVNGAEQQLRGDLPQFLRIVIHPRNVQAVSAGARRLVYREELHLLIEPHLVADGDGAQRDDAVQADDVIRAVLRLRQIGADLALLRGNFRIRRAADNQKLLLRLLRQIAPGQHADLAVIEEHAAQLLIVEIAVDQDQRHAVHLGQLEIGGAVALVVAHRRQQDAARLVTEQRLNGAHFRLFAAVGVEQHDLVALLTRNARYGLDQAGIERVVHAAGDDADNLAAAAFQLLRERVGHIVQLFGDGVNALAGFRLDQLGLIEGAGNGDIGHPGAAGDIHDSGIGIGFRHRLSLRYASTDPLL

SEQ ID NO: 118774 - protein, 223 aa, Glycine max
  Coding DNA Sequence Number=SeqID_1996
  Gene Ontology: Mol. function=hydrolase activity
  Homolog annotation: Hit_ID=Q8RN16; Match level="QueryCoverage=96%, HitCoverage=25%, E-value=3e-23, Identity=33%"; Hit description=RloE
  Subcellular localization annotation: CTP_CleavageSite=54; ConfidenceScore=5.10e-01
MFSQVDINSFGSFADLSWRKSLKDAGNNVQNFKRLNILYGRNYSGKTTLSRIFRALETGRIPHNYVDPNFTIRGDKGDVTQVGLAGHGYDVRVYNRDFVSDNLSFLVNQTDGEIKTFAIVGEKNKEIEDTITAIQTKLGSVESKAGLRHELEAKKKERDRTKDNHKTASDALEGKLRSHANNKIKQNRIYGPAVYNIESIKKDIGSVKKTSFIALTTEEQAAK

SEQ ID NO: 118775 - protein, 134 aa, Glycine max
  Coding DNA Sequence Number=SeqID_1997
  Homolog annotation: Hit_ID=Q8H6Q8; Match level="QueryCoverage=63%, HitCoverage=2%, E-value=6e-07, Identity=38%"; Hit description=CTV.20
FALSWIFSWQYRYGKTENSKQYPPLQRHAFVKWWSQFDTSKAAPDQVKNWFQSNPEFLKPADPETSLFLNQKSQLAAFLASSKSKESLAQNLKEVLQLLQQEVEEEPSKKEAESSETNDDQEDDPFYQNEEYCF

SEQ ID NO: 118776 - protein, 123 aa, Glycine max
  Coding DNA Sequence Number=SeqID_1998
  Gene Ontology: Mol. function=DNA binding; Biological process =regulation of transcription, DNA-dependent
  Homolog annotation: Hit_ID=UPI00005F9C07; Match level="QueryCoverage =96%, HitCoverage=85%, E-value=3e-41, Identity=67%"; Hit description =COG1733: Predicted transcriptional regulators
  Pfam annotation: Domain name=DUF24; Domain location=27-117; Score =124.7; E_value=2.6e-34; Accession=PF01638.8; Description =Transcriptional regulator
  Pfam annotation: Domain name=PadR; Domain location=27-102; Score= -13.9; E_value=0.042; Accession=PF03551.5; Description=Transcriptional regulator PadR-like family
  Pfam module annotation: Pfam domain module=DUF24::PadR; Domain location=27-117::27-102
MAENLSDKFSRGELLNVNCPSREVLKRITSRWSVLVLLALRAETLRFSELRRRIGGISERMLAQTLRYMEEDGFIERIAYEVVPPHVEYRLTALGHEVEGQVIGLADWLESNVHRIIKAPQTA

SEQ ID NO: 118777 - protein, 420 aa, Glycine max
  Coding DNA Sequence Number=SeqID_1999
  Gene Ontology: Mol. function=glutamate-5-semialdehyde dehydrogenase activity; Cellular component=membrane; Biological process=electron transport
  Homolog annotation: Hit_ID=UPI00005F718B; Match level="QueryCoverage =100%, HitCoverage=86%, E-value=0.0, Identity=78%"; Hit description =COG1271: Cytochrome bd-type quinol oxidase, subunit 1
  Pfam annotation: Domain name=Bac_Ubq_Cox; Domain location=9-420; Score=717.2; E_value=1.1e-212; Accession=PF01654.8; Description =Bacterial Cytochrome Ubiquinol Oxidase
MFGLDAFHLARIQFAFTVSFHIIFPAITIGLASFLAVLEGMWLKTRNETYRDLYHFWSKVFAVNFGMGVVSGLVMAYQFGTNWSGFSQFAGSITGPLLTYEVLTAFFLEAGFLGVMLFGWNRVGPGLHFFATCMVALGTIISTFWILASNSWMHTPQGYIIENGIVVPQDWFKIVFNPSFPYRLFHMSVAAFLASAFFVGASGAWHLLRGNDNPAIRKMFSMALWMALIVAPIQAMIGDAHGLNTLEHQPAKIAAIEGHWENPPGEATPLILFGIPDMDEERTKYALEVPYLGSLILTHSLDKQVPALKSFPKEDRPNSLVIFWSFRVMVAMGLLMITLGVLSLWLRYKKRLYNSRPFLWFALLMGPSGLIAILAGWFTTEIGRQPWVVYGVQRTIDAVSAHGDLHMNISLLAFILVYST

SEQ ID NO: 118778 - protein, 296 aa, Glycine max
  Coding DNA Sequence Number=SeqID_2000
  Gene Ontology: Mol. function=hydrolase activity; Cellular component =integral to membrane; Biological process=aromatic compound catabolic process
  Homolog annotation: Hit_ID=Q1M5Q2; Match level="QueryCoverage=98%, HitCoverage=99%, E-value=1e-128, Identity=73%"; Hit description =Putative dienelactone hydrolase family protein
  Pfam annotation: Domain name=AXE1; Domain location=38-278; Score= -220.6; E_value=0.049; Accession=PF05448.3; Description=Acetyl xylan esterase (AXE1)
  Pfam annotation: Domain name=BAAT_C; Domain location=159-296; Score= -65.7; E_value=0.0023; Accession=PF08840.1; Description=BAAT  Acyl -CoA thioester hydrolase C t
  Pfam annotation: Domain name=DLH; Domain location=84-294; Score =184.7; E_value=2.3e-52; Accession=PF01738.9; Description =Dienelactone hydrolase family
  Pfam annotation: Domain name=Peptidase_S9; Domain location=112-293; Score=-68.9; E_value=0.0088; Accession=PF00326.11; Description =Prolyl oligopeptidase family
  Pfam module annotation: Pfam domain module=AXE1::BAAT_C::DLH::Peptidas e_S9; Domain location=38-278::159-296::84-294::112-293
MTRLTAQDFPQELLELYDYYAHGRISKREFLSLAAKFTIAGMTGATLLSAMSPNYALAEQVSFTDPDINAEYIHYPSPQGHGEVRAYRVRPTHASGKLGAVVVVHENRGLNPYIEDVARRVAKAGYVALAPDGLSSLGGYPGNDEEGRAMQAKVDPAKLMNDFFAAVDFLMQHPEGNGKVGITGFCYGGGVANAAAVAFPELACAVPFYGRQPKAEDVARIQAPLLLHYAALDKGINEGWPAYEAALQASHKTYEAYIYPGVNHGFHNDSTPRYDKAAADLAWGRTLGWFEKYLHA

SEQ ID NO: 118779 - protein, 168 aa, Glycine max
  Coding DNA Sequence Number=SeqID_2001
  Gene Ontology: Mol. function=transporter activity; Cellular component= integral to membrane; Biological process=transport
  Homolog annotation: Hit_ID=Q0JZV2; Match level="QueryCoverage=65%, HitCoverage=20%, E-value=8e-32, Identity=61%"; Hit description =Putative MFS transporter, ADT family
MEKPKAEILTTCAKIFAKPCRQKSLYKLADFFRYLLTGELRIVLSSHTDRNSLMNQPNPQTARSGAFSPFAYGLFAVIWTASVLGNTGSFIRDVASAWLITGLSDNPTAVALMQTAATLPVFLLALPAGVLSDIVDRRRLLIVVQLLMASVSGTLLLLSHNHWLTVNG

SEQ ID NO: 118780 - protein, 273 aa, Glycine max
  Coding DNA Sequence Number=SeqID_2002
  Gene Ontology: Mol. function=hydrolase activity; Cellular component =membrane; Biological process=aromatic compound metabolic process
  Homolog annotation: Hit_ID=Q3KB51; Match level="QueryCoverage=98%, HitCoverage=99%, E-value=1e-120, Identity=76%"; Hit description =Alpha/beta hydrolase fold
  Pfam annotation: Domain name=Abhydrolase_1; Domain location=48-268; Score=127.7; E_value=3.3e-35; Accession=PF00561.10; Description =alphabeta hydrolase fold
  Pfam annotation: Domain name=PGAP1; Domain location=17-188; Score= -93.6; E_value=0.09; Accession=PF07819.3; Description=PGAP1-like protein
  Pfam annotation: Domain name=Peptidase_S15; Domain location=8-247; Score=-92.6; E_value=0.0033; Accession=PF02129.9; Description=X-Pro dipeptidyl-peptidase (S15 family)
  Pfam annotation: Domain name=Peptidase_S9; Domain location=34-273; Score=-77.3; E_value=0.033; Accession=PF00326.11; Description=Prolyl oligopeptidase family
  Pfam module annotation: Pfam domain module=Abhydrolase_1::PGAP1::Pepti dase_S15::Peptidase_S9; Domain location=48-268::17-188::8-247::34-273
MSTFKTKDGVNLYFKDWGKGQPVLFSHGWPLDADMWDSQLNFLAERGYRVIAFDRRGFGRSDQPWEGYDYDTFADDIHGLIEHLQLDEVTLVGFSMGGGDVSRYIGRYGTAKVKGLVLLGAVTPIFGKTDDHPEGVESAVFDGIKAGLLKDRAQFIKEFATPFYGTNAGQTVSDGVLTQTLNIALLASLKGTLDCVTAFSETDFRADIAKVDVPTLVIHGSHDQVVPFEATGKLVHEMIAGSQLKVYENGPHGFAVTHQDQLNADLLAFLQGN

SEQ ID NO: 118781 - protein, 522 aa, Glycine max
  Coding DNA Sequence Number=SeqID_2003
  Gene Ontology: Mol. function=hydrolase activity; Biological process =signal transduction
  Homolog annotation: Hit_ID=Q2X918; Match level="QueryCoverage=97%, HitCoverage=77%, E-value=0.0, Identity=80%"; Hit description=Twin -arginine translocation pathway signal precursor
  Pfam annotation: Domain name=Amidohydro_3; Domain location=59-506; Score=526.6; E_value=2.7e-155; Accession=PF07969.2; Description =Amidohydrolase family
MTTASLIFTNGKFHTVDRANPLATAVAIKDGKFLAVGSEADVMRFAGSDTQIIDAKGHTGIPGLNDSHLHLIRGGLNYNLELRWEGVPSLADALRMLREQALRTPSPQWVRVVGGWSEFQFAERRMPTLDEINAAAPDTPVFILHLYDRALLNRAALKVVGYTKETPNPPGGEIQRDSNGNPTGMLIARPNAMLLYATLAKGPKLPLEQQVNSTRQFMRELNRLGLTSAIDAGGGFQNYPDDYDVIAELHAKKQLTVRIAYNLFTQRPGHELEDFEKWTDMLKPGQGTNFLRHNGAGEMLVFSAADFEDFLEPRPDLAPGMEDELERVVRHLVEHRWPFRLHATYNESISRMLDVFEKVNRDIPFNGLHWFFDHAETITEANIERVKALGGGLAVQHRMAFQGEYFVDRYGKEAAKQTPPVARMLEAGVPVGLGTDATRVASYNPWTALYWLVSGRTVGGMQLYDDNARIDRETALMLWTKGSAWFSSEQSAKGEIKVGQLADLVLLSKDFFSVSGRGDQRH

SEQ ID NO: 118782 - protein, 427 aa, Glycine max
  Coding DNA Sequence Number=SeqID_2004
  Gene Ontology: Mol. function=transporter activity; Cellular component= integral to membrane; Biological process=transport
  Homolog annotation: Hit_ID=Q8U8V4; Match level="QueryCoverage=79%, HitCoverage=63%, E-value=6e-84, Identity=48%"; Hit description=MFS permease
  Pfam annotation: Domain name=DUF894; Domain location=1-351; Score =309.8; E_value=4.8e-90; Accession=PF05977.4; Description=Bacterial protein of unknown function (DUF894)
  Pfam annotation: Domain name=MFS_1; Domain location=58-383; Score= -16.6; E_value=0.0018; Accession=PF07690.6; Description=Major Facilitator Superfamily
  Pfam annotation: Domain name=Oxidored_q3; Domain location=98-226; Score=-32.6; E_value=0.06; Accession=PF00499.10; Description=NADH -ubiquinoneplastoquinone oxidore
  Pfam module annotation: Pfam domain module=DUF894::MFS_1::Oxidored _q3; Domain location=1-351::58-383::98-226
MAAYGADVASYFFVIAALLWWKRPAKAATALNEHFFGAFRAGLRYVKASRELHRVLLRAALYFAFASAIWALLPLVARTMLHGSAGFYGLLLGAVGAGAIAGALLLPRLRARLSHDGLMLLSAVLSALVMVALALSPPQWLALLLMLVLGTGWIIALTTLNGVAQAVLPDWVRGRGLAVYLMVFNGTLAGGSLAWGLIAQHMGLAPTLMLAGAALLITALLAKRLALPAGEADLQPAQHWAEPVVSDAVDIRRGAVLIQIRYRVPQADRAAFQHAMHKLAQARRRDGAYAWGLMEQTDDAGALLEWFMVESWQEHLRQHQRVSRADAELQQAVLQFHQGDEPPQAGQRRQALAPPDSRVAAGALIPRQIGDIAPALAVQLARHQRTARQVRARQIKRQITTAEPGEMRLQFGREIMHAQRLLLIQHA

SEQ ID NO: 118783 - protein, 282 aa, Glycine max
  Coding DNA Sequence Number=SeqID_2005
  Gene Ontology: Mol. function=two-component sensor activity; Cellular component=membrane; Biological process=two-component signal transduction system (phosphorelay)
  Homolog annotation: Hit_ID=UPI0000E68E47; Match level="QueryCoverage =99%, HitCoverage=82%, E-value=2e-92, Identity=58%"; Hit description =diguanylate cyclase/phosphodiesterase domain 2
  Pfam annotation: Domain name=GGDEF; Domain location=155-282; Score =80.2; E_value=6.5e-21; Accession=PF00990.12; Description=GGDEF domain
  Pfam annotation: Domain name=PAS_3; Domain location=52-148; Score =95.1; E_value=2.2e-25; Accession=PF08447.1; Description=PAS fold
  Pfam module annotation: Pfam domain module=GGDEF::PAS_3; Domain location=155-282::52-148
MSEEALRQQIQNLKKHNARLKRLAHDARNKLNAALDGTGLCLWQLDIPSGKLVIFNRRWGAMLGFQAKETKARFDAWRECLHPEDADEVLRAFYDHIEGRAPYYEALHRMIGKNGKITWVLDRGRVSEWDEQGNPLKVTGTHIDMTKEKNYEAQLSLLAHHDPLTALPNRHALQAHFSQLQRAGPLCVAFIDLDNFKHVNDTLGHRSGDEVLIQLSQRIRDLLPSEAIVGRLGGDEFVLLLPFLIDYPKVRILAHAGLDAALTPFDIHNGHARIGASIGIAP

SEQ ID NO: 118784 - protein, 216 aa, Glycine max
  Coding DNA Sequence Number=SeqID_2006
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q1I798; Match level="QueryCoverage=77%, HitCoverage=34%, E-value=3e-16, Identity=28%"; Hit description =Putative two-component sensor/response regulator protein
MPDAQRAVREEAQSWWRRAQPVQRVKPSVSKRILSLLLLLGFCLSAWGATTLNFSPRYGLVAPEVTLSPQSQQWLKQHSVLRVGVWNNPLPPYSVSFEANTYEGLSADYLAIVAKALNLPVKIKVYKTRLELVDALNDGEVDLIPYYTLAANQDTHLALSLPYSLARSVLISKRNATFDSELKNSRYRLLYYGDAELKALLHKRYPRATLAPAAPP

SEQ ID NO: 118785 - protein, 164 aa, Glycine max
  Coding DNA Sequence Number=SeqID_2007
MAHRDKLWSFCVLLSSRGGGLDDTRRQVMVIRTLLLSVRLDEINAQRQIMVILRPLSFRNNKLSDKHAEKNYGAASRVINAQRQIMVILRPLSFRSSESSGGRRQIMVIPHTFSPSRGDRVQWHAKTNYGHSAPCHPGSIVSEDTQRKIMVILLLVSPKRNEFD

SEQ ID NO: 118786 - protein, 81 aa, Glycine max
  Coding DNA Sequence Number=SeqID_2008
MTIICLCVPSKTTVSGWQKVSGMTIICLCMSSGSPPLDDKRAQNDHNLSLRAIENDCVWMAKGERNDHNLSLHVIGLAASG

SEQ ID NO: 118787 - protein, 214 aa, Glycine max
  Coding DNA Sequence Number=SeqID_2009
  Subcellular localization annotation: CTP_CleavageSite=36; ConfidenceScore=5.02e-01
MTEPSKKRKGTSSRSQWHSGSQEAPIPPSIPFGSLFSSEEQCIRYTNLFSSRFIVDPKFIDMEFFSNENFECFQAFENSNLIPFMSLKLPVYSELVKAFYSNLEIHEGTLMSEVYGIKMVIDQSLFYDLTKLPSEGVPFEGALIDEWKFDFSVHDARRLVCTNQADMTGRLLAGSLAFESRILHYLIVCILLPRSSNLAQVSEEDLIVMWAFHK

SEQ ID NO: 118788 - protein, 187 aa, Glycine max
  Coding DNA Sequence Number=SeqID_2010
  Homolog annotation: Hit_ID=Q1SP02; Match level="QueryCoverage=78%, HitCoverage=38%, E-value=4e-20, Identity=32%"; Hit description=IMP dehydrogenase/GMP reductase
MYDQLDEACRTTTRQLAGYLTLLQCWIYEHFPSVHQCVTDDTYQETSPRASRWLTSKAHMKGITGAPYRARCDGLTVTYVSWLPYTEHRGVRAFQEISSFQGQLRWGPMIVTVRPERVVRQFGYIQSIPPPPVSADYIEWFFRISHPFMTPTQAADQQRDAPAADPEDYIQPPSPQVPVALTPLHMW

SEQ ID NO: 118789 - protein, 116 aa, Glycine max
  Coding DNA Sequence Number=SeqID_2011
VLLPDSRFTRPDMGFHPTKLNVVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 118790 - protein, 173 aa, Glycine max
  Coding DNA Sequence Number=SeqID_2012
  Gene Ontology: Mol. function=chitin binding; Cellular component =extracellular region; Biological process=chitin metabolic process
  Homolog annotation: Hit_ID=Q86AI8; Match level="QueryCoverage=92%, HitCoverage=33%, E-value=6e-12, Identity=35%"; Hit description =Similar to Homo sapiens (Human). Mucin 2
MSKSCGFGMTGPLDESISCFLIRVDPWVLVPITIRGLHVLALRGLHALTLGLHVLALRGLHIRGLHALTSRGLHVLALRGLHAFTLGTSYPHRQRTTRPRLERTTRPQHQRAAHPRLQRTSRPRLHRATCPHLLRASRPRHQRTARPRHQRAAHPHLQRTTHPRLERAARPHL

SEQ ID NO: 118791 - protein, 59 aa, Glycine max
  Coding DNA Sequence Number=SeqID_2013
MLLSSSVIHICVRVVMLVRTIRTCLFAAARMWSPLKARTRSPLKAREYAALRRQGRVTF

SEQ ID NO: 118792 - protein, 137 aa, Glycine max
  Coding DNA Sequence Number=SeqID_2014
MESRKRARTEDIPSSSTPAPPLQELAHNRPIISMEHFLEQVAWPEAQLPLMRPNEVNSEPTDPQSPVVNPPSSPELEAVPPSPPLIVISDASSDEAATPPDSPVVEIADPLVSPIGGVANLSNSSSGEVVALTNSPV

SEQ ID NO: 118793 - protein, 107 aa, Glycine max
  Coding DNA Sequence Number=SeqID_2015
MNACPKNMCKPNCPMACFPTKNHALMPLRHFTEHLVGARLGINSKRTETMCTKRRSKYTNEKLESLGMEYLLVGDEQKRKTESKNAKKDDPRAANSSIPWRWLAQAS

SEQ ID NO: 118794 - protein, 168 aa, Glycine max
  Coding DNA Sequence Number=SeqID_2016
MAKFDPEIVRDFYAIAWPTEEGVRDMRSWVRGQWIPFDGDAINQFLGHPLILEEGQYNILPNDHNSDLPLPKCQLVYAILTQVSVHVAQLISNAIYQFAGITPPRHPVDPKKSNRALGFPALIIGDVSSIGACRPRIFFINGFLCFLEDEWQWNGEGRERGDATSRRR

SEQ ID NO: 118795 - protein, 66 aa, Glycine max
  Coding DNA Sequence Number=SeqID_2017
MEHEIFLATWLTEIDFSPNGLRFSNLQPQPRLINHEKPMLCRWHKLNPLKIEGRRFALDSARDYFP

SEQ ID NO: 118796 - protein, 257 aa, Glycine max
  Coding DNA Sequence Number=SeqID_2018
  Gene Ontology: Cellular component=cell outer membrane
  Homolog annotation: Hit_ID=Q4ACM0; Match level="QueryCoverage=44%, HitCoverage=52%, E-value=6e-49, Identity=86%"; Hit description =Chemotaxis protein
FGVRLLRVFIGVQLLRHKVFGFQKQVDNLGAQAHFLASCTVQQVLQQVGGFLQHRKAKGRRAALDRVRRAEDGVQRLDIGGQRIQLQQMLLHVGQQLVRLIKEGLIKIANVHAHGVTSGCESRLVGAGAAAGLPPRAPAFGWPAQSPTAPAHQHGDATVNRVIGAVLFQAHGGRHAHHPQHLAFRQTAGDQLAPGGVGAIGRQFPVAVATLAAGVRDIIGVAGQADLIRQIVEDRRYRPQNIAHVALDLRAAGFDIG

SEQ ID NO: 118797 - protein, 42 aa, Glycine max
  Coding DNA Sequence Number=SeqID_2019
MPEKPSLLIHDALGIMGLPAITYHQKMKTLNEASLLSSELET

SEQ ID NO: 118798 - protein, 108 aa, Glycine max
  Coding DNA Sequence Number=SeqID_2020
MYIKYGPKYIMKPSQQNKLSNETKTPHTYSQNNSKAPKFLKDMVISWKGKQGSKGLSKELIQGKSIWLEAYKNKIASIISKYACELGSINKNQAKAIVQAINGAKHTK

SEQ ID NO: 118799 - protein, 95 aa, Glycine max
  Coding DNA Sequence Number=SeqID_2021
MTKARQKGVRKSSISGTYRLKTEERRRTNEERRRTVENLREITHGNVTEALRKRLGKRKEKLATQLAQASSARPGELGCFLQKAPGELPGRPKWV

SEQ ID NO: 118800 - protein, 78 aa, Glycine max
  Coding DNA Sequence Number=SeqID_2022
  Subcellular localization annotation: CTP_CleavageSite=63; ConfidenceScore=5.39e-01
MVIPPTFSPSRGDRVRWNAEASYGHSVSRRPASIVSNKTRRQIMVPLAGRFTGRMLSYPNFVRGPSVVGMRPSFDHFE

SEQ ID NO: 118801 - protein, 72 aa, Glycine max
  Coding DNA Sequence Number=SeqID_2023
MAKGAKFFCARLPLDSLLLNDKGRIICLCAFTTQLGAKSVMQSYPARALGRRLQVDWARVQREGPRVLMSLR

SEQ ID NO: 118802 - protein, 191 aa, Glycine max
  Coding DNA Sequence Number=SeqID_2024
GAERSLIHVDPEIEKVDGPHRKKLRTYLRIVARDKVDVTYENWKQVPAAQKDLIWEDIHAEFDIPEASYLRKKKRKYFRLWGSVDKDSVDDTVCEKYDISKEKWAQFCQSCRDPSWEAIWKQNSAPHMLSCGGYEFLENKLLEEKKKKQLAKAAKSGSTHTVIDPLSPIRRHVKWKMNRTKKAGQMTSETI

SEQ ID NO: 118803 - protein, 127 aa, Glycine max
  Coding DNA Sequence Number=SeqID_2025
MPPTRHPLDPDKSNRALGFLALITGLCQSFGVPITPSKVIRPPITRAFIKKYCTPRQVQGDALEAADAPPPPHQANPAGSLGMERYLQHLVRQQAANHRGQVQIHEFYQFSLSQQGQGFAPFACLTP

SEQ ID NO: 118804 - protein, 245 aa, Glycine max
  Coding DNA Sequence Number=SeqID_2026
  Gene Ontology: Mol. function=nucleoside-triphosphatase activity; Cellular component=membrane; Biological process=proteolysis
  Homolog annotation: Hit_ID=Q1H1N7; Match level="QueryCoverage=99%, HitCoverage=53%, E-value=1e-116, Identity=87%"; Hit description=DNA repair protein RadA
MILVGHVTKEGSLAGPRVLEHIVDSVLYFEGDQNSSFRLIRAFKNRFGAVNELGVFAMTEKGLREVSNPSALFLSHHESPVPGSSITVTQEGTRPLLVEIQALVDTAHAPNPKRLCVGLEQNRLAMLLAVLHRHAGVACYDQDVFINAVGGVKISEPAVDLAVLLAIVSSLKNKPLPSKLIVFGEVGLAGEVRPVQRGQERLKEAAKLGFTHAIIPKANAPKGGVAGLHVEAVDRLEQAIDVLRA

SEQ ID NO: 118805 - protein, 60 aa, Glycine max
  Coding DNA Sequence Number=SeqID_2027
  Gene Ontology: Mol. function=structural constituent of ribosome; Cellular component=ribonucleoprotein complex; Biological process =response to antibiotic
  Homolog annotation: Hit_ID=Q9XQE1; Match level="QueryCoverage=98%, HitCoverage=88%, E-value=5e-22, Identity=76%"; Hit description =Chloroplast 30S ribosomal protein S12
  Pfam annotation: Domain name=Ribosomal_S12; Domain location=1-60; Score=12.5; E_value=1.1e-05; Accession=PF00164.15; Description =Ribosomal protein S12
TPGLPDSALRKVARVRLTSGFEITAYIPGGRVKDLPGVRYHIVRGTLDAVGVKDRQQGRS

SEQ ID NO: 118806 - protein, 91 aa, Glycine max
  Coding DNA Sequence Number=SeqID_2028
AIRASSTIKSYSEPHELIAIHASSTIEPGAPRIDCLALFVHHPPSYSEPHELIVIHASSVIKYGASKKEEGETGVTYFRSFWVGTIVIEIN

SEQ ID NO: 118807 - protein, 91 aa, Glycine max
  Coding DNA Sequence Number=SeqID_2029
  Subcellular localization annotation: CTP_CleavageSite=26; ConfidenceScore=5.42e-01
VLLSSFGNIQARRCARFFSAGQGRSSAMAKGSVGKLSYPNFVRGPLFGGMQPSLDRFEGCANSNQAHLGLLGGSNRRRCLLVEATQLAWAS

SEQ ID NO: 118808 - protein, 83 aa, Glycine max
  Coding DNA Sequence Number=SeqID_2030
MGYVGVRELSWRWATGDGGFMRALWMWKTCCAPSPDRNLVPHVMEWYLEICRGGQETLGTSGRVLLPKTKLDQSRPNPGIVGQ

SEQ ID NO: 118809 - protein, 66 aa, Glycine max
  Coding DNA Sequence Number=SeqID_2031
RGGRCKTQGASPGGAVVGADLGGTGEARLIALCARTPKGNRPAHPGNGSAGGRVQRLEEHRTSRGV

SEQ ID NO: 118810 - protein, 147 aa, Glycine max
  Coding DNA Sequence Number=SeqID_2032
  Gene Ontology: Cellular component=protein complex
  Homolog annotation: Hit_ID=Q967D3; Match level="QueryCoverage=49%, HitCoverage=23%, E-value=2e-21, Identity=78%"; Hit description =Putative multidrug resistance protein
MMCAAGTRIASSSSMIKQKEESCSNKDHIAVICDYHSKIELRLKLQDACLSLARKELGGKKKDEGEPEHYIARAGVPMEVMGLMLGEFMDEYTICVVDVFAMPQSGMVFVLKLLIMFFRLTCLTCLNKPKDQRWLLAGTIRIIDLAL

SEQ ID NO: 118811 - protein, 155 aa, Glycine max
  Coding DNA Sequence Number=SeqID_2033
  Gene Ontology: Mol. function=ribonuclease H activity; Cellular component=mitochondrion; Biological process=DNA integration
MTVSYKDWHEMLPFALHGYRTSVCTLIGATPFSLVYRMEVVLLFEVEVPSLRILVESGLEESEWAQTHFDQLNLMEGNRLAAMSHVCSRKFNERDLVLKKVSQAQKYHSGKWAPNYEGPFVVEKEFSGGTLLLASMDDEELPSPMNSDIVKQYYA

SEQ ID NO: 118812 - protein, 36 aa, Glycine max
  Coding DNA Sequence Number=SeqID_2034
MALALPSGNLGGQLAEPMVDVGWVVDDYDHSKAFFH

SEQ ID NO: 118813 - protein, 91 aa, Glycine max
  Coding DNA Sequence Number=SeqID_2035
VVVVGEIEGPPKCLAGVRRKMLVPQWHIRSEAPSRLDYGLGVLHVSPPWVEVMQSYPARAWDRRLQVDWARDAREGPRVLMSLGVDFGSMG

SEQ ID NO: 118814 - protein, 487 aa, Glycine max
  Coding DNA Sequence Number=SeqID_2036
  Gene Ontology: Mol. function=DNA binding
  Homolog annotation: Hit_ID=Q1SWX1; Match level="QueryCoverage=89%, HitCoverage=87%, E-value=1e-40, Identity=30%"; Hit description=IMP dehydrogenase/GMP reductase
MGPIQRQAFRKVYGKILDLAIAEVFTEAVVSLAQYYDQPLRCFTFGDFQMVPTIEEFKEILGCPLGGRKPYLFSGFLPSLSKIAAVIGDSTKELDRMKQTRNGVVGLPRKYLEGKARDMASQEKWGPFVDILALLIFGVVLFSNVDGLVDLAAIDAFLAYHHSKESSVVAILADLFDTFDRRCEKNSARIVYCLPALCVWLISHLFRQDTRHPCPLQSYRSCAEKGRVVWDQHLAGIGGSTINWFPRWKEGKEGVLFSCGDYPNVPLIGTRGCINYNPALAIRQLGYPMRGAPTEESLSPFLVRDLGAQGLKVIQRIHKAWRSPLRKDKELRGIRNGVIEGYHGWLRIHTLGLGWLSKLKVVDEEKFEAPEEDEEVRALKLELGKARLAKEKFKSAATHIQKECTELQEENAATARALEQETKRARKEEHGREKFRGALWGSNNELKLRREERDRSQVHGMILKEELVACARSKRVWLTLGSTEQAC

SEQ ID NO: 118815 - protein, 132 aa, Glycine max
  Coding DNA Sequence Number=SeqID_2037
  Gene Ontology: Mol. function=transporter activity; Cellular component= integral to membrane; Biological process=transport
  Homolog annotation: Hit_ID=Q0B170; Match level="QueryCoverage=93%, HitCoverage=23%, E-value=5e-38, Identity=66%"; Hit description=Drug resistance transporter, EmrB/QacA subfamily
MAGMAMILLWQLGGVTAAGAAGSRLYRHLVRAGAVARRAPDRAHHPAGAEADADCADALHHRLWLYLSGAAFFYSSTLTPNVDFTTLVLMRSAQSIGLGFLFVPLTTIAFITVPQRLNADASALFTMFRNVA

SEQ ID NO: 118816 - protein, 119 aa, Glycine max
  Coding DNA Sequence Number=SeqID_2038
MLKELCCKLSNLNFKICNLKYLPSLTFYPVEAKLHDESRLIQRCFDDNKGDDKKLKGQSKYEFKMFKIESRTLQDSRGKLISRIKNQDSRIKIPRIKIKIQESREDLIKISKKGFSKTE

SEQ ID NO: 118817 - protein, 122 aa, Glycine max
  Coding DNA Sequence Number=SeqID_2039
GVVLAEVLLADSRFTRPDMGFHPTKLNFVPSDADEAPLDVSICLHAFGIVGCGSFSGVKSCEREVRPIPIQALFVGDAGGISKVPTLNVGGLVPPHCSLKSVVSDDACPGACFVQREATTLS

SEQ ID NO: 118818 - protein, 378 aa, Glycine max
  Coding DNA Sequence Number=SeqID_2040
  Gene Ontology: Mol. function=5'-nucleotidase activity; Cellular component=integral to membrane; Biological process=nucleotide catabolic process
  Homolog annotation: Hit_ID=Q418N0; Match level="QueryCoverage=92%, HitCoverage=57%, E-value=2e-43, Identity=33%"; Hit description=5' -nucleotidase precursor
  Pfam annotation: Domain name=Metallophos; Domain location=29-265; Score=16.3; E_value=0.018; Accession=PF00149.18; Description =Calcineurin-like phosphoesterase
MEKVMFKLKQLTACVALALTAGAAWAEGVSVLHVGDQESWLLSAQDRLATVIKNAETQAIAEGRTVLKLNAGDAFLPGPRFTASLNNLANSYPDGGQDFYDAIALRQIGFDAMVFGNHEFDLGPQMAARFAKVSGSTYLSSNLNFNATAEFSALKASGKVAPSKVITTTAGHKIGLVGATTPLLPNISSPGAVNVIGFDANNTEAQNLQALIPLIQAEVNRLRSEQGVTTVILMSHLQNAANEISVVIPALTGVDLVLSGGGHELMVDPDDALINGGVAATYTSHPVNAVDAHGRTVPVLTSHFGNRYVGQVNFTIDDANGTFVGIESSKMMRVSGATADADRVTGDAMIQAQVVTPVLNYISALNAQIIGTTAVKLM

SEQ ID NO: 118819 - protein, 341 aa, Glycine max
  Coding DNA Sequence Number=SeqID_2041
  Homolog annotation: Hit_ID=Q1GYL7; Match level="QueryCoverage=97%, HitCoverage=9%, E-value=2e-60, Identity=41%"; Hit description =Filamentous haemagglutinin-like protein
  Subcellular localization annotation: CTP_CleavageSite=59; ConfidenceScore=5.01e-01
MHTYTATTFSSNITGLVADTNNFYSANATAGSYQATQDGANIRVLPYIIVKSTTGVSPTAMSVTADQNLRSFGSLMAGQGGTLALLSNGNLTMNGSLSDGFSTATSAGVLQANAQTFSYQLVAGADYNAANLMQTVAGTGNLSLATSKIIRTGTGDISMAAGGDITLASNATVYTIGQAASTLAGFTLPSSVSTTQNPNVINAASYVNNGGDISIQAQGNITGSATTQSVNQWLLRQGGNGTDTSWWIRNDLFNQGVAALGGGNVVVSAGGNVTNLSAASATNAQYDNTGDQASGAYVVNGGGDVTVTSNGNITNGVYYVGRGQLDIHVGGSILKSSLSAM

SEQ ID NO: 118820 - protein, 290 aa, Glycine max
  Coding DNA Sequence Number=SeqID_2042
  Homolog annotation: Hit_ID=Q5XM22; Match level="QueryCoverage=26%, HitCoverage=42%, E-value=7e-31, Identity=85%"; Hit description =Resistance-like protein HAAS-2
  Pfam annotation: Domain name=DUF1723; Domain location=100-159; Score =40.7; E_value=4.9e-09; Accession=PF08330.1; Description=Protein of unknown function (DUF1723)
MAITQGLGRVIGRLVGRDRHDDHDAADVPERRRPIASARRQRIHQMTADARDMAEDVADMTDDVPDLAAEAPEMRADVQGGDGAEGSDADDAAEGFPGGPRDPSVLASFADHVAHAIWSGQRWHGETSTFHLPVGELTITLDDVSSLLHLPITGALHSFHALSMEEARFLLTGLFEVSAEEARAEEARAEEARAETALTRRAYVRLGWVRDIYETRCQVRQWIVAAHAYLLQLVGCTLFANKSATYVHLVHLDAFRDLAQSGGYAWGVAALVHMYDQLDEASRTTTRQLV

SEQ ID NO: 118821 - protein, 135 aa, Glycine max
  Coding DNA Sequence Number=SeqID_2043
  Homolog annotation: Hit_ID=UPI00006BA270; Match level="QueryCoverage =97%, HitCoverage=85%, E-value=3e-18, Identity=37%"; Hit description =cationic outer membrane protein OmpH
  Pfam annotation: Domain name=OmpH; Domain location=1-133; Score=18.4; E_value=7.8e-05; Accession=PF03938.4; Description=Outer membrane protein (OmpH-like)
VLNAMPEKKKADADLKTFLDTKQAEIKKKADAGQAKLKQYSEEAPKKTADENKAREAELAKMQEEIQQMNDKAQKDFVAKQDAAYEPIEKKLNEAVSKVAKAAGYDFIMDANSSAFVYKGGPDATPAVKKELGVQ

SEQ ID NO: 118822 - protein, 232 aa, Glycine max
  Coding DNA Sequence Number=SeqID_2044
  Gene Ontology: Mol. function=dTDP-4-dehydrorhamnose reductase activity; Biological process=extracellular polysaccharide biosynthetic process
  Homolog annotation: Hit_ID=UPI000068A769; Match level="QueryCoverage =48%, HitCoverage=39%, E-value=9e-25, Identity=49%"; Hit description =putative dTDP-4-dehydrorhamnose reductase
  Pfam annotation: Domain name=4HBT; Domain location=19-106; Score =11.8; E_value=0.021; Accession=PF03061.12; Description=Thioesterase superfamily
  Pfam annotation: Domain name=RmlD_sub_bind; Domain location=92-232; Score=-30.5; E_value=3e-11; Accession=PF04321.7; Description=RmlD substrate binding domain
  Pfam module annotation: Pfam domain module=4HBT::RmlD_sub_bind; Domain location=19-106::92-232
MEKEVSTTVKVRFSDCDPIGHLNNVKYLDYMFNAREDHVETFYGFTYEEYTKKTGCTWIAIQNEIAYLKEVRYNTQVVISSKTIDIQDRTAKVEILMKSLDESTIHAVLWVTTLDITDEDQVDTFFYDNKPDFCINASAYTAVDLAEKEKEKAFAVNADGVAHLAQACSEHKTVLIHVSTDYVFDGETNLCYSEDDFTNPIGGYGASKLRGEELALEINPQTIILRTLLAVF

SEQ ID NO: 118823 - protein, 94 aa, Glycine max
  Coding DNA Sequence Number=SeqID_2045
MEPKRIKVIPEWPTPPTPLIELVRNHVPSWENAQEMGFQTLPYFNIPNTTNTYVFVLFTGVEEKIPEFHEPRDLRSNPFQGGGNDAILPHKGIG

SEQ ID NO: 118824 - protein, 212 aa, Glycine max
  Coding DNA Sequence Number=SeqID_2046
  Homolog annotation: Hit_ID=Q47522; Match level="QueryCoverage=17%, HitCoverage=45%, E-value=5e-14, Identity=97%"; Hit description=LacZ protein
RVPFAIQAAQLLGRAIGAGLFAITPAGERGMCCKAIKLGIRYSRALEAGPCSKNMIHTVESTMLHGDEAAIKPYDPSPSKKSSTCWPGAVVQDAYITPQSQRNRYGLHNFPRTPYSRTLLTKSKSKLIHMKGDSSQISSTPVRQSHTTMYPELLFPLVRVNFELGVIMVIAVSFGKPVVPAALMNRPTRGERRFAYWALAECILAYYVGTDE

SEQ ID NO: 118825 - protein, 204 aa, Glycine max
  Coding DNA Sequence Number=SeqID_2047
  Gene Ontology: Mol. function=receptor activity; Cellular component =integral to membrane
  Homolog annotation: Hit_ID=Q8S403; Match level="QueryCoverage=93%, HitCoverage=24%, E-value=3e-35, Identity=48%"; Hit description =Putative phosphate transporter 1
  Pfam annotation: Domain name=SPX; Domain location=2-186; Score=3.0; E_ value=2.2e-06; Accession=PF03105.10; Description=SPX domain
MVKFSKELEAQLIPEWKEAFVNYRQLKKHIKRIKLTRVSKQSQAPEESFGRSVFDSFRFIRNKFRYSDNNNLQDIIQFVIFQLILLVVPVRRKTTEESEEVYETELAQLFSAEDEVQVFFAKLDGELNKVNQFYKKQETEFVERGEMLKKQLNILLDLKQILSDRRKKNPSLKPSNTGVFPRSPGQDSNYSGQFFINLFFSCFV

SEQ ID NO: 118826 - protein, 56 aa, Glycine max
  Coding DNA Sequence Number=SeqID_2048
MARDGDGQQRCRWKMIPFSSLMALPFDEVFLDFDRWKFEVLGMEENVEEALAAQQL

SEQ ID NO: 118827 - protein, 142 aa, Glycine max
  Coding DNA Sequence Number=SeqID_2049
  Gene Ontology: Cellular component=chloroplast
  Homolog annotation: Hit_ID=P03938; Match level="QueryCoverage=55%, HitCoverage=59%, E-value=1e-16, Identity=79%"; Hit description =Hypothetical 14 kDa protein ycf68
MGSLAFGIAGPAGGPHDGLLAQWHISMAYFSCLNRGFETKLILRRIDGAIQVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 118828 - protein, 100 aa, Glycine max
  Coding DNA Sequence Number=SeqID_2050
MIDPPSPIRRHVIWKMACTKKTRQMTSDVAKEIADKIASQDSFVAHGRQDVLIAAIGRLEHPGRVRAAGAGVTIKQYFRPTPRTSCTSFSMAPEDLEQLT

SEQ ID NO: 118829 - protein, 136 aa, Glycine max
  Coding DNA Sequence Number=SeqID_2051
MQFQFQSHMQSQGLALPLEPEVGPSVARASTKESCVDPLGNDPNTGDSEKCGLYIEENSPWLVALERLYEGSTTVHNISLCHDQVKGALGSMKSADRPNHDVDDPLYLMTLTISQLFLKSLQVMCDVVGCYRVWGD

SEQ ID NO: 118830 - protein, 184 aa, Glycine max
  Coding DNA Sequence Number=SeqID_2052
MSFPAFRYLGMGTSGGEAHDQQIVVPRPDKREALLGGSLVMVGCLIYPSGFEVSSPGRAPPARNGLKGKGECSFHPRNFSPLLKNASTHGILAFSDPRPPLCAFCFHFRVLATPYKKWLQRNSPRRGLEEMPQEKDPVLPQSLIVITSGVPSTNNASRPSGDGHSTGRGVSSSGRISIRTSQRR

SEQ ID NO: 118831 - protein, 75 aa, Glycine max
  Coding DNA Sequence Number=SeqID_2053
MEVLAAGVSLSEACALSKNHALSEALSLLSELGESGGESKKHLHAQHVISSLSEVFVSSRSKCAQLAQQMFTDSH

SEQ ID NO: 118832 - protein, 138 aa, Glycine max
  Coding DNA Sequence Number=SeqID_2054
GYIYLGLTENKRGYISCGSVLVEGTSTRLFKENKGGYIPCGSLLVKGFLQGWKRNLKDYRSLGDWMLAAGVSLSEACALSENHALSKALSPLSELGESGGESEKHLHTQRVISSLNEAFVSSSAKRAQLAQKMFTNSH

SEQ ID NO: 118833 - protein, 791 aa, Glycine max
  Coding DNA Sequence Number=SeqID_2055
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=Q9S7J8; Match level="QueryCoverage=97%, HitCoverage=77%, E-value=0.0, Identity=75%"; Hit description=Copper -transporting ATPase RAN1
  Pfam annotation: Domain name=E1-E2_ATPase; Domain location=206-446; Score=309.3; E_value=7e-90; Accession=PF00122.10; Description=E1-E2 ATPase
  Pfam annotation: Domain name=Hydrolase; Domain location=450-698; Score=114.3; E_value=3.6e-31; Accession=PF00702.16; Description =haloacid dehalogenase-like hydrolase
  Pfam annotation: Domain name=Hydrolase_3; Domain location=453-721; Score=-92.4; E_value=0.094; Accession=PF08282.2; Description =haloacid dehalogenase-like hydrolase
  Pfam module annotation: Pfam domain module=E1-E2_ATPase::Hydrolase::Hy drolase_3; Domain location=206-446::450-698::453-721
SNEQDKIILGVVGVYSLIDTQVLEGILSSTKGVRKFHFDKVSGELDVLFDPEVLSSRSVVDAIQEGSNGKFKLHVRSPYTRMASKDVEEISTIFRLFISSLFLSIPLFFMRVVCPHIPPFYSLLLWRCGPFLMGDLLKWALVSVIQFVIGKRFYIAAGRALRNGSTNMDVLVAVGTTASYIYSVCALLYGALTGFWSPTYFETSAMLITFVLLGKYLECLAKGKTSDAIKKLVELAPATALLVVKDKGGKSIEEREIDSLLVQPGDTLKVLPGAKVPADGIVTWGSSYVNESMVTGESVPIMKEVNASVIGGTINLHGVLHVEATKVGSDTVLSQIISLVEMAQMSKAPIQKFADYVASIFVPTVVSLALLTLLGWYVAGSIGAYPEEWLPENGNHFVLALMFAISVVVIACPCALGLATPTAVMVATGVGANNGVLIKGGDALERAQRVKYVIFDKTGTLTQGKATVTAAKTFTGMERGEFLKLVASAEASSEHPLAKAILAYARHFHFFDDSSATTGTENDAKTDAKSGWLFDVSDFFALPGRGVQCFIDGKHILVGNRKLMEENGIDISTEVENFVVELEESAKTGILVAYNDILTGALGIADPLKREAAVVIEGLQKMGVKPVMVTGDNWRTARAVAKEVGIQDVRAEVMPAGKADVVRSFQKDGSIVAMVGDGINDSPALAAADVGMAIGAGTDIAIEAAEYVLMRNSLEDVITAIDLSRKTFTRIRLNYVFAMAYNVVAIPVAAGVFYPSLGLKLPPWVAGACMALSSTLRVSYKTTHIIIEVKD

SEQ ID NO: 118834 - protein, 66 aa, Glycine max
  Coding DNA Sequence Number=SeqID_2056
  Homolog annotation: Hit_ID=Q1S5N2; Match level="QueryCoverage=68%, HitCoverage=9%, E-value=8e-08, Identity=54%"; Hit description=Viral capsid/hemagglutinin protein
MLFDLGLLQQWATGSHATVYKAKEQIAANFKNQESRYKKVWKIIDTHWDLQLHSNLHAASFYLNPK

SEQ ID NO: 118835 - protein, 190 aa, Glycine max
  Coding DNA Sequence Number=SeqID_2057
MPTKKANANGIVEEPEKYSKLRTFIGKKSAEVSNSGLPGNLVKVTLSNTKLADASVQWASLPSSISKIGREVMKHRDVAQIATIEAMQEPAAAESLLQCLSKVLNFNKIVYLTQNDTLRARVSTPNGMQSQHPKQPTTMTINLILRARSSTTPTNQLLATHTNKNPCSEHKFPKQTNKEEEQEQEEDNKD

SEQ ID NO: 118836 - protein, 52 aa, Glycine max
  Coding DNA Sequence Number=SeqID_2058
MEHKVDFKDNRSVDPEKYTFSLTGRKPISLEEKRKLGEGYIPLLQTSIPEKM

SEQ ID NO: 118837 - protein, 568 aa, Glycine max
  Coding DNA Sequence Number=SeqID_2059
  Homolog annotation: Hit_ID=UPI0000163167; Match level="QueryCoverage =22%, HitCoverage=2%, E-value=6e-21, Identity=44%"; Hit description =UPL1 (UBIQUITIN-PROTEIN LIGASE 1); ubiquitin-protein ligase
MGRLMGMSRRLKLVDEVAKCFCVINGSADGGVWQKAKSPPYKQTIAAYVLLEWASLHKFPMVVGKKSAMPFHHGVAIYHCLEGSSTYYGGDDEILFKLQIEALMAGEVKCHKYSRRRPSDGWTFTVEKLGSSGKRGGGGGWKFASMPDGSSRPLNEMEKMNSEQRSDTTRRMGGHGEVTIFADTNLGTRIAFNAPPDITAASLKRDFEKAHFSCLPDIGEIQVKGLMVKRKSCFYYLPDSFPIQYAFPAIRGTWFLHVEVKHLKRLCIPCPPGDAAVLSKHKDLKTCNGEDKAKCNSEENKMEGFQPRSCFAEEHETTNHVSKKLNKKRISNENHTQNEATGMPERYPCRFGDKSTGMANKSSDVILENKVENLVELHANSMRCSLSKVSTQVISVTGIIHKYFSSFNGIDNYSSSSNSDVTSKAFHGEIEVLSNTRQHSCSKRQSDSLPQFTPKTPPHVLHASLHVDLVPKKSGCKSRKSKVGKHLKSDGKNRKSKVGKHLQSGGENRKSKIGNRLLAASRSLGVSITKHDPTLSFRRFKDRKLRQDKSQMKGSIFSISGSDDDGLV

SEQ ID NO: 118838 - protein, 439 aa, Glycine max
  Coding DNA Sequence Number=SeqID_2060
  Gene Ontology: Cellular component=chloroplast envelope
  Homolog annotation: Hit_ID=Q1ZY13; Match level="QueryCoverage=62%, HitCoverage=69%, E-value=5e-70, Identity=53%"; Hit description =Fgenesh protein 89
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHETKVGVAEMRMLRWMCGKTRQDKIRNGAIRERVGVAPIVEKMVENRLRWFWHVERRPVDSVVRRVDQMERRQTIRGRGRPKKTIREVIKKDLELNDLDRSMFPDHDLKVEAVYPGHFVDTTSNYWDVPFSVAVDLASVTTSDSSTAYHLSAHYTSGSPKQFENIQNQNDRVPPPTLLPGLAFKSVFSYRKKVDIWRSEAKKLKLVQPYDIFLSNPHVSASGIIGAAATTAFGDNSARAQVEDGSPGFFLQASGIKSSFLADIFASVSFTAQHGNFQRLFLDLTRFQARLDFPSGFKFLSAATGRTHLLNSQNPAIQTILPNATLSLQQQIVGPVSFRVDSGITVDLKNPDRPIHAPEPVFALEYALKVLGSAKAVAWYFPKRQEFVAELRFFET

SEQ ID NO: 118839 - protein, 86 aa, Glycine max
  Coding DNA Sequence Number=SeqID_2061
  Gene Ontology: Mol. function=methyltransferase activity; Biological process=metabolic process
  Homolog annotation: Hit_ID=A0E2S4; Match level="QueryCoverage=80%, HitCoverage=30%, E-value=1e-07, Identity=41%"; Hit description =Chromosome undetermined scaffold_75, whole genome shotgun sequence
MDVRDMSDFQSGSFGAVIDKGTLDSILVSVAMVMLIEMLLMTHYRVLKDKGVYVLVTYGAPLYRLRLLQESCSWTIKLHVIGWLKS

SEQ ID NO: 118840 - protein, 105 aa, Glycine max
  Coding DNA Sequence Number=SeqID_2062
MRTRSPLKARACSPLQARMCNPLMARTYGPLKVIASPYQLDLAPYASEPYNAQRNAPGLLRDKHTLRSSRILGEMEVDEPWLGLWLPLNYQVVFVIGSAVGRLCG

SEQ ID NO: 118841 - protein, 269 aa, Glycine max
  Coding DNA Sequence Number=SeqID_2063
MFISNIICKLSAIIYMPEIIYKATIAPTNKDQYPCSTNVYTGPPSCQRCFSKLTCEVRTPLSHVHPDVTWFQILVRTFGAHRGATVKHILRPLFNPLTFIHGLHSIWPQTRDPPHRLSSASDSYNKHRHSTTTPNCIAEIERRHEEELTKLKVDHDQLEARVRHPQGNKQSTHTLSECTQGESPPQCTGNTADYLGSSINHLTGYGGLPPKSIDNFDTLVKRFSTQYTTSRSHRMTSITLASLQQADDESLKKFMDKFGRTIVLQDPKS

SEQ ID NO: 118842 - protein, 69 aa, Glycine max
  Coding DNA Sequence Number=SeqID_2064
MSAEKNPFLVYLTTDVAYGCFPQSLNNQSVRNYSVNASMLKAQVEKDEGPSGEGQSPQVEKDEGSSGVG

SEQ ID NO: 118843 - protein, 177 aa, Glycine max
  Coding DNA Sequence Number=SeqID_2065
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=P30126; Match level="QueryCoverage=98%, HitCoverage=100%, E-value=4e-74, Identity=70%"; Hit description=3 -isopropylmalate dehydratase small subunit
  Pfam annotation: Domain name=Aconitase_C; Domain location=2-103; Score=121.2; E_value=3e-33; Accession=PF00694.9; Description =Aconitase C-terminal domain
MANKFTQHTGIVAPLDAANVDTDAIIPKQFLQKVTRTGFGAHLFHDWRFDDDAGTQPTASFVLNKPEFKGTSILLARENFGCGSSREHAPFNNQLLPVTLSDEQVDELFKLVQANPGISFEVDLEAQVVKAGDKTYSFKIDDFRRHCMLNGLDSIGLTLQHEEAISAYERQQPAFMN

SEQ ID NO: 118844 - protein, 46 aa, Glycine max
  Coding DNA Sequence Number=SeqID_2066
MCVPNRELEGREFESKRRHGRSDWCEGLFFKFWLAWTLRREVFSSS

SEQ ID NO: 118845 - protein, 70 aa, Glycine max
  Coding DNA Sequence Number=SeqID_2067
MRMGYQESRVKVTNSALSVLDQSEVCESDVSFANKETRVKSIKVVALVDGTLELGLILKAVDVGPLEVVM

SEQ ID NO: 118846 - protein, 103 aa, Glycine max
  Coding DNA Sequence Number=SeqID_2068
MEREMIIMIMDTLLVLYYEKMVGYMPSSFEDLVFAGKRIEVGLRRGKFDYAASTSVGNRRNGIGGAKKNEGDAHVVTITPTWANSQQTPHNPMYQYPPHQYNY

SEQ ID NO: 118847 - protein, 136 aa, Glycine max
  Coding DNA Sequence Number=SeqID_2069
  Gene Ontology: Mol. function=helicase activity
  Homolog annotation: Hit_ID=Q9LTU4; Match level="QueryCoverage=95%, HitCoverage=9%, E-value=1e-33, Identity=51%"; Hit description =Helicase-like protein
MVESERLSYIRNNQKKLRVDKYSSLQTSLDTGTAKGLTKGKRVILPSMFVGSPRYMDQLYFDGMAICSHVGFPNLFITLTCNPNWPEIRRLLSPLNLKLIDRLDIVSRIFRLKYEHMLSDLTKGQLLGKVVAYING

SEQ ID NO: 118848 - protein, 130 aa, Glycine max
  Coding DNA Sequence Number=SeqID_2070
  Homolog annotation: Hit_ID=O22938; Match level="QueryCoverage=68%, HitCoverage=9%, E-value=2e-15, Identity=55%"; Hit description =Putative receptor-like protein kinase
MPTTQNIAAGKYTLQGNHMPSGTVLLVRKLISMDMKIMHYQSKIVIVIELRRLRKLSHENVMKPIGYVICSGVALLIHQYLPNEHWLNFFMNLQCYLEFSLTGVLDYHNDESKVQSQIGFESSMCIHTCA

SEQ ID NO: 118849 - protein, 370 aa, Glycine max
  Coding DNA Sequence Number=SeqID_2071
  Subcellular localization annotation: CTP_CleavageSite=26; ConfidenceScore=5.29e-01
MASVGTHLRLGMCSCTFSCGPSFGSSSSTKKRKLSNKANIGSRNKKFKNDDDYEVWKIKKVLEKSNIGTMRRLILRREMEEEFVLSVLGDDADQIDSGVSVQIWDVDTKSILSCFQEMGFFKKLCIPWCDILFHSERFDIYIAYFRKWAPTGAEKREELEPEKRHANRDRVLAFKKSNFSLLVAGYEVTSRGRGGPLFAPLKMGQVATPNFAHHFYSKLQKEAIFGVVKCTSMLWDFEFQEFAESMLNLTCLITLVEMMGRVNLGLNVRMVVIKIFKSIQRLTNWNEENVTGFMIVGIELLGYFGSLEGLMGTRWATGDGGFMFDLWKVVPGDMSRESGDLGDIRRALGSQPIKEQRPRSNEACVAAGQL

SEQ ID NO: 118850 - protein, 218 aa, Glycine max
  Coding DNA Sequence Number=SeqID_2072
  Gene Ontology: Mol. function=RNA-directed DNA polymerase activity; Biological process=RNA-dependent DNA replication
MAEKENLDHVEERFRAIEGGGVHAVADMVELYLVPDVVIPSKFKVPDFDRYKGTTCRKNHLKMYCKKMGANTKDEKLLMHFFQESLTRAAYQYNSDMAPDRTQLQNLCKKGHESFKEYAQRWRDLAAQVAPPMMEREMITMIVDTLPVFYYENIVGYTPSSFVDLVFAGERIEVILKRGKFDHPTLTNKKPRANREDQKEEGTHAITAIPTWPNFPPT

SEQ ID NO: 118851 - protein, 87 aa, Glycine max
  Coding DNA Sequence Number=SeqID_2073
MEPTPRTHIEILGPTPRKEYALRHPYRTRARARVMGGTDEVQERIKADLEAMKEKMATMMEAMMSMKKIMEVNAAAVAATSAVAQWT

SEQ ID NO: 118852 - protein, 158 aa, Glycine max
  Coding DNA Sequence Number=SeqID_2074
MGEVEEVHKQIKADMSTLKDQMASMTEAMLSMRRLIESNIAAAAATNTATKADPILPFATNPAHQLAPDIVGPGEEVLGSTGGPHLGYNKNAYPYGLPPNFTPPTMHENMDHVVLVTFEGQLPHPIGGAREEPREHAQVDVDLYPPFIAEGPAFNAMP

SEQ ID NO: 118853 - protein, 138 aa, Glycine max
  Coding DNA Sequence Number=SeqID_2075
  Gene Ontology: Mol. function=RNA-directed DNA polymerase activity; Cellular component=mitochondrion; Biological process=RNA-dependent DNA replication
EAEQMLIEVHEGSFGTHANGYAMARKILRTGYYYLTMENDCCIHGIDVIGAIEPKVSNEHHFILVAIDYFTKWVEAASYASMTRSVVVRFIKKEIIYRYGLPRKIIMDNGTNLNNKMMKEMCKDFKIQHHNSTPYSPR

SEQ ID NO: 118854 - protein, 67 aa, Glycine max
  Coding DNA Sequence Number=SeqID_2076
  Homolog annotation: Hit_ID=Q8S8I2; Match level="QueryCoverage=98%, HitCoverage=32%, E-value=7e-07, Identity=40%"; Hit description =Protein ULTRAPETALA2
MVVLNVWSALEMEPALLPASRATQELILVKVLFPHCKVFPRCLPEWNSVFVFPMIPDVSLPPSTPSP

SEQ ID NO: 118855 - protein, 60 aa, Glycine max
  Coding DNA Sequence Number=SeqID_2077
MKKGQECENSHGGREGSGGGNEDSGGVVENFMIMYNTVFIATLEPRISYIGLLWYKHAGK

SEQ ID NO: 118856 - protein, 959 aa, Glycine max
  Coding DNA Sequence Number=SeqID_2078
  Gene Ontology: Cellular component=nucleus
  Homolog annotation: Hit_ID=Q9FIH7; Match level="QueryCoverage=76%, HitCoverage=53%, E-value=1e-87, Identity=32%"; Hit description =Similarity to SET-domain transcriptional regulator
  Pfam annotation: Domain name=GYF; Domain location=234-288; Score=6.7; E_value=0.039; Accession=PF02213.6; Description=GYF domain
MVFSTVFLHEDDTFFSRKRPRVSDLGHQDIDLHADAGSSSDISLFSHQDIERGTGDVPSSSNTDDKVDPDSGVEMSCPSNVKSGYVPVCSTTGHISHMDQSFCGYVQQPAFVSGWMYVNENGQMCGPYIKEQLYEGLTTGFLPSELPVYPVINGTLMSPVPLNYFKQFPDHVSTGFAYLSMGFSGTRVPTMAAYEQDRSFEHAAPLAVNPDSQPVSQSHVNYCIKESNHLGVECCWLYEDEKGMKHGPHSINELISWNRHGYLKDSTVISHSDNKYDTFVLLSAVNALKGDISGTICRSGSPSNEVGDMVNLIGEISEDISSQLHMGIMKAARRVVLDGIIGDIIAEFVTEKKRTRHKLESADCTPGNNMSKFSAEISRGSAISSDPASSHTLDDQTCHESSRLPPAIIKSVGSIENFWWSYAVVRKVLLDYSMQVMWNAVFFDTLAEYLSSWRKKKLWSHRKPQPSANECEDHTEKIESEALVINPDTSESNVDGYNQFGVLATEKNCPRLFSSSSSLKGGNLLEGQKVSCLYDNSRDLTCILESVENELHFSSKVSLADYIQSFIEKEVNKLIPFPEENKFNEVAVGDTRFSEKLADKTSVKEILNDKSVDPAKAGNSFGESASGNHMSDVFSKAFKELCGYVDDVVEEEIDDLPPGLEKSQTVALHYNSKFRPSRSAECNLKITEYVATALCRQKLHDEVLEKWRSLFLDSVPKQVFISSSTIKKHFKSDGHKKRKTVNASKEHLNSATSGLGRVKEGAKSSSEVPPVIGKYTYCRKKLSRKELISSKSVAENDSRPGKQPVAKLRKHFSGDVGEAAEVKIASVIHGKTKMIKGKKDTTSKGKSSVSVNSSSHNDQLSLKNKAGQKVLKFSDDVKDFVKSNVKKLSASTDNSVVMKKIVKSDGTVKEKESQHPVAPPRAIAPGWSGAFRCQNRRPERANHIALQLFHTSAHGCAFV

SEQ ID NO: 118857 - protein, 69 aa, Glycine max
  Coding DNA Sequence Number=SeqID_2079
  Subcellular localization annotation: CTP_CleavageSite=42; ConfidenceScore=5.17e-01
MGFMVAELGDIFGSKPHTGSMGFLCGVYKVLGSPTTTTMLLSCGSPKGLRVLKEENLSWVWMPLRGVSS

SEQ ID NO: 118858 - protein, 183 aa, Glycine max
  Coding DNA Sequence Number=SeqID_2080
  Gene Ontology: Mol. function=structural constituent of ribosome; Cellular component=ribonucleoprotein complex; Biological process =translation
  Homolog annotation: Hit_ID=Q05462; Match level="QueryCoverage=73%, HitCoverage=100%, E-value=2e-57, Identity=82%"; Hit description=60S ribosomal protein L27
  Pfam annotation: Domain name=KOW; Domain location=53-88; Score=31.8; E_value=2.4e-06; Accession=PF00467.19; Description=KOW motif
  Pfam annotation: Domain name=Ribosomal_L27e; Domain location=100-183; Score=198.2; E_value=1.9e-56; Accession=PF01777.8; Description =Ribosomal L27e protein family
  Pfam module annotation: Pfam domain module=KOW::Ribosomal_L27e; Domain location=53-88::100-183
MGRKEKENMSKGRPRRRRRRRRRKWKMEVWGSERVRDGKDGGEVANAKMVKFLKPNKAVIVLQGRYAGKKAVIVRTFDEGTRERPYGHCLVAGIKKYPAKVIKKDSAKKTAKKSRVKAFVKLVNYQHLMPTRYTLDVDLKDAVNPDVLNAKDKKVTALKETKKRLEERFKTGKNRWFFTKLRF

SEQ ID NO: 118859 - protein, 135 aa, Glycine max
  Coding DNA Sequence Number=SeqID_2081
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=Q9S7J8; Match level="QueryCoverage=99%, HitCoverage=20%, E-value=2e-39, Identity=58%"; Hit description =Copper-transporting ATPase RAN1
  Pfam annotation: Domain name=HMA; Domain location=40-104; Score=53.6; E_value=6.5e-13; Accession=PF00403.16; Description=Heavy-metal -associated domain
MAPGIRGLQLTSLAGDSDELEDVRLLDSYDEIDGGARRIQVSVTGMTCAACSNSVESALKSLDGVISASVALLQNKADVVFNSALLKDEDIKNAIEDAGFEADILPESSTVAHETLVGQFTIGGMTCAACVNSVE

SEQ ID NO: 118860 - protein, 95 aa, Glycine max
  Coding DNA Sequence Number=SeqID_2082
MVEREMITMIVDTLPVFYYETLVGYMPSSFANLVFAGERIEVGLKRGKFDYVAPAGTSNRRFRATVAKKKEGDVQKGAILNKCQRSHYAKRAQCA

SEQ ID NO: 118861 - protein, 187 aa, Glycine max
  Coding DNA Sequence Number=SeqID_2083
  Homolog annotation: Hit_ID=Q1RUD8; Match level="QueryCoverage=64%, HitCoverage=26%, E-value=2e-07, Identity=32%"; Hit description=IMP dehydrogenase/GMP reductase
  Subcellular localization annotation: CTP_CleavageSite=19; ConfidenceScore=5.39e-01
SHTSFFMKVDPFFPYKVTACAPRKGRQTGFSNVPLMGTRGCINYNPILAIRQLVYPMRGASSEESIMPFITQGFSDPNARILRGIRKAWSAVQKKDKELRESRNGIIDGYHKWLKARTLELDWLPKLKVSSEVEAETPEDSEEVQALKVELERAQAVKEKFKTTAIKVRKECNELRDINVATAEALE

SEQ ID NO: 118862 - protein, 134 aa, Glycine max
  Coding DNA Sequence Number=SeqID_2084
METISKRFEQLDVCGKVHLKTKLQEIAYPDMNSMCPPSEKVIMDKWMNITDTGYVIASQYNVIVVSLSRQQNMTFFPLRRFFYETIVLYHHWRCCGIHIVILRQSNGPPSYIGRMQRYTNLSRLKTEFIDLGEQ

SEQ ID NO: 118863 - protein, 137 aa, Glycine max
  Coding DNA Sequence Number=SeqID_2085
  Gene Ontology: Mol. function=nucleoside-triphosphatase activity; Biological process=DNA metabolic process
  Homolog annotation: Hit_ID=Q5N6Y9; Match level="QueryCoverage=84%, HitCoverage=27%, E-value=7e-20, Identity=50%"; Hit description =Putative recA protein
  Subcellular localization annotation: CTP_CleavageSite=40; ConfidenceScore=5.35e-01
MASLLRNANISLLKRSLFHSDLLTRFCFKPGVLGTSQVLSFSTRKRRSKSDGSDSGEENLSKKDLALQQAIDQITSAYGKGSIMWLGRSVAPKNVPVVSTGSFALDIALGVGGLPKVVWVSIVYFAKYVSGYEMWFQ

SEQ ID NO: 118864 - protein, 191 aa, Glycine max
  Coding DNA Sequence Number=SeqID_2086
  Gene Ontology: Mol. function=protein binding; Biological process =proximal/distal pattern formation
  Homolog annotation: Hit_ID=Q2HW56; Match level="QueryCoverage=100%, HitCoverage=39%, E-value=5e-78, Identity=80%"; Hit description =BTB/POZ
  Pfam annotation: Domain name=Ank; Domain location=122-155; Score =10.1; E_value=1.1; Accession=PF00023.20; Description=Ankyrin repeat
  Pfam annotation: Domain name=Ank; Domain location=157-189; Score =37.6; E_value=4.3e-08; Accession=PF00023.20; Description=Ankyrin repeat
  Pfam module annotation: Pfam domain module=Ank::Ank; Domain location =122-155::157-189
MVEKASIEDVMKVLLASRKQDMQQLWATCSHLVAKSGLPPEVLAKHLPIDIVAKIEELRLKSSLARRSLVPSHHHHHHHHHHHAAAALDLEDQKIRRMRRALDSSDVELVKLMLMGEGLNLDEALALPYAVENCSREVVKALLELGAADVNYPSGPAGKTPLHIAAEMVSPDMVAVLLDHHADPNVRTVDG

SEQ ID NO: 118865 - protein, 459 aa, Glycine max
  Coding DNA Sequence Number=SeqID_2087
  Gene Ontology: Mol. function=translation elongation factor activity; Cellular component=nucleus; Biological process=transcription
  Homolog annotation: Hit_ID=Q10KZ5; Match level="QueryCoverage=51%, HitCoverage=90%, E-value=2e-24, Identity=37%"; Hit description =Expressed protein
  Pfam annotation: Domain name=TFIIS; Domain location=133-234; Score =99.6; E_value=9.6e-27; Accession=PF08711.1; Description =Transcription factor S-II (TFIIS)
MKSWSLDEWRNYFGSANSDIFEIIEHAIIVAASDCPKEFRVRRDWIAERLFSCRLTRCVGCDRVELAVGADSKKEKHDGDDGDNDKSGFERDGVEFEGAGASKESKVNGDANLGDSNYSFGEAEALSDEMEEESQYVAEILRIKDVLLNPEDEDGFLRYKEMWFLLDSEAVIFESLRRLQLMELTVDCLKATEIGKAVNPLRKHGSKDIRQLARTLINGWKEMVDEWVKATTTTAITGSEEGTPDSVNPSVVDDDEEEGLPSPPLDEGAFFVTQAGSMELSQFFDGMDDDGNPRPTGPFSKNHENGRKPAFDSHVLEMRKLQPSHDTVVINRDVKSQQQAKENKAAVMPVRPNKPVTADSGPGRPPKSNVQRKSNMEPKMQQKMENNSITRRPPTAQLDKSKRSDDDAVQVKLEATKRKLQESYQQAEKEAENNTSYGNKRSSQARFAPKYTFQTWISQ

SEQ ID NO: 118866 - protein, 67 aa, Glycine max
  Coding DNA Sequence Number=SeqID_2088
MESKGVGENIRWDEEDECGYTYPASMHGEMVEVETHGENRQEEWRDSMHGVYDEFGYNNLVFQWKGI

SEQ ID NO: 118867 - protein, 50 aa, Glycine max
  Coding DNA Sequence Number=SeqID_2089
  Subcellular localization annotation: CTP_CleavageSite=21; ConfidenceScore=5.10e-01
MFGVRSRALAPSLSKSHGCCSASSNVSAFLTSNHCTWGGGGHARSCCSDM

SEQ ID NO: 118868 - protein, 91 aa, Glycine max
  Coding DNA Sequence Number=SeqID_2090
MPFCGRARRGSRVRFPKEENARSRHQRLFVENAGKTEGNRSTNAGLLLLRTLHRRGNQTYVVLFKGESSDSFYLEGDHFKALDLKNDPFTW

SEQ ID NO: 118869 - protein, 90 aa, Glycine max
  Coding DNA Sequence Number=SeqID_2091
MLRNFADYLTMDVKYLEVVKQRLHATKQWFPNKIRGYPTRSLHPPCTYTTYNITMTFSTSSTSHLNIIIYINIASSHFNDIINNNNIISY

SEQ ID NO: 118870 - protein, 136 aa, Glycine max
  Coding DNA Sequence Number=SeqID_2092
  Gene Ontology: Mol. function=ATP binding; Biological process=defense response
VDVTYESWKEVPTAQKDLIWEDIQAEFQIPEASDSRTKKKILQTVGERWRQFKSDLTRKWALTADKDGVDDIDVQKKAQAIQKQNTAPHVLSHGGYQYLEQKLMAEKTKKRKDWKKLPSPEALRASLTLHLPLDAM

SEQ ID NO: 118871 - protein, 88 aa, Glycine max
  Coding DNA Sequence Number=SeqID_2093
  Pfam annotation: Domain name=zf-CCHC; Domain location=11-28; Score =12.4; E_value=0.0089; Accession=PF00098.13; Description=Zinc knuckle
MKKGEDSSLAPKCNECDQPEHLRFDCLVPKRRIEKSDKRNFKEKEEKKAYITWEDNGLDSSSDSENEIINLDLMAKDYESGEEVMSSN

SEQ ID NO: 118872 - protein, 419 aa, Glycine max
  Coding DNA Sequence Number=SeqID_2094
  Gene Ontology: Mol. function=structural molecule activity; Cellular component=extracellular region; Biological process=keratinization
  Homolog annotation: Hit_ID=UPI000044A8F0; Match level="QueryCoverage =45%, HitCoverage=99%, E-value=2e-32, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFRGLHGLTFRGLHVLAFRGLHALAFQGLHVLTFRGLHALTFRGIHVFTFRGLHVLTFRGLHTLAFRGLHVLTLRGLHTLAFRGLHVLAFSGLHVLAFTGLHAFTLRGLHALAFRGLHILAFRGLHILTFRRLDALAFRGLHALTFRGLHILTFRGLHALAFRGLHALAFKGRHVRDFRGLHALAFRGLCVLTFIPGPPPDLEGGPIVRAQPEGGYCAATMHTGARFHPAIAKRRHHSAQRPQCRSPPAEVSVGLCRHDIGITPTRHPVDLEESNSALVFPALVTGLCQSYKMPVPPPRSCHRDIGIAPARHLVDPEKSNRVLWFPALITGLCHFYRVPVAPNKVIRPPTNQAFIKKYCAPRQVQGKTPQQPRHGRQRATDAPPPPPKPLISSTKARALPTTRGQPAGDQVQSQ

SEQ ID NO: 118873 - protein, 107 aa, Glycine max
  Coding DNA Sequence Number=SeqID_2095
MATFYGYKLSMFQNIFGMGKKTENYTSDEMSPCIKIKKKYQNKLFLYFGLCVDESSLIGPTSLDWIDLCEELLGVRPQEGKLQGSVVKLSWFAHHFSQLNNNDGNVQ

SEQ ID NO: 118874 - protein, 39 aa, Glycine max
  Coding DNA Sequence Number=SeqID_2096
MALLLLFAKTLRYVESGGLNLDGVTQDGSYDAIKIIFEY

SEQ ID NO: 118875 - protein, 56 aa, Glycine max
  Coding DNA Sequence Number=SeqID_2097
MAQEEGTCTDQIPEPSSAPAPEETQPSTPVMEPNYLKFQHFELFACTKSVFELRID

SEQ ID NO: 118876 - protein, 40 aa, Glycine max
  Coding DNA Sequence Number=SeqID_2098
MASIIVAIFSFKASMSAFICSCTSSTSPITLALAQVRTWG

SEQ ID NO: 118877 - protein, 125 aa, Glycine max
  Coding DNA Sequence Number=SeqID_2099
  Gene Ontology: Mol. function=helicase activity
  Homolog annotation: Hit_ID=Q9LTU4; Match level="QueryCoverage=99%, HitCoverage=8%, E-value=5e-29, Identity=50%"; Hit description =Helicase-like protein
MDQLYFDGMAIGNHVGFPNLVITLTCNPNWPEIRRLLSPLNLKPTDRLDIVSRIFRLKYEHMLSDLTKGQLLGKVVAYMHTIEFQKRGLPHVHLLLFLHPDNKYPSSTDIDKIISTEIPSHEDDP

SEQ ID NO: 118878 - protein, 261 aa, Glycine max
  Coding DNA Sequence Number=SeqID_2100
  Homolog annotation: Hit_ID=Q0BAX0; Match level="QueryCoverage=44%, HitCoverage=22%, E-value=8e-07, Identity=31%"; Hit description=Outer membrane efflux protein precursor
  Subcellular localization annotation: CTP_CleavageSite=69; ConfidenceScore=5.31e-01
MADSTSELMMFAEMSGHRPAAPAAAPVRSAPVQRVPVAPVQRFATAPAPQPMFTQSQAAPVAPPIAAPRAQPAPTPTPSPAPAPAAPIAPPPVQPVQGGGFLTEEQRQPEPKQTNPLLKSVRTFNSQQPAPVPVNEAEVKAQSEFSYVSPPVAETRITAADAAVARSPVSLSGAVDETVAESELRQKFLSAARITWRISPALKSSVAQTDAAAASVDEAKGQRWPQLDVSASSATKEFGGGVKSDGVRATCRRSACRWRPT

SEQ ID NO: 118879 - protein, 88 aa, Glycine max
  Coding DNA Sequence Number=SeqID_2101
MSSRTQRVISLLSEKIVSFALSMRMTLSQISLTRAKRENDAKRAFTDKKPFLSLNCREREAGLNRLREPSVEQRTEEKLSKEEKGFNF

SEQ ID NO: 118880 - protein, 99 aa, Glycine max
  Coding DNA Sequence Number=SeqID_2102
MTLSDFNVMLGFKIKELVQTLEYQLAFMKKPDCHFQSPLFQPDAFKDSLFHDPTLCLAHKWFIRSLHGKKESIGSVTSKDLFPIWCICCDVNASSEHGC

SEQ ID NO: 118881 - protein, 118 aa, Glycine max
  Coding DNA Sequence Number=SeqID_2103
  Gene Ontology: Mol. function=RNA-directed DNA polymerase activity; Cellular component=intracellular; Biological process=RNA-dependent DNA replication
MVRECNVLGHKVSSTSIEVDPAKMEVPPPNCVKVVRSFLGHAGFYRSAFNLLKERLISVLVGFSLGCSLSFELMCDASDMTMGEVLGQMRGKVFHTIYYASRMLDEPRKIIPPLRKNC

SEQ ID NO: 118882 - protein, 194 aa, Glycine max
  Coding DNA Sequence Number=SeqID_2104
  Subcellular localization annotation: CTP_CleavageSite=40; ConfidenceScore=5.25e-01
MCYAGGSNWSSVSSLASKIAFAPQKMHQIKKRSLEAGFTNARLKQRGPSEFLEEYRLLEATLWLLHESQWILQCLDYLLSFELKHDIKVKGHGAVSHLESGDELHRYVMEGLLLDESYVLPPNGSLVVGDSLIEAKFSENPILGGSGSLLWGGGDGQGCDYRTLDNEIHDHGGSDNGSVARQRCQCEMDNGHDA

SEQ ID NO: 118883 - protein, 295 aa, Glycine max
  Coding DNA Sequence Number=SeqID_2105
LGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPSRRALGLMASGATCVQRLDGSRALCKFTPSIAFRYVLHRCKSRDIRCRESFAGVCVCREDEEAGRTGRRGHPLPPDGIDNDPSAGSPTETLLRLLLPLNDKVQWTSHNVAGSEPLTSPQSEHFTGPFNR

SEQ ID NO: 118884 - protein, 75 aa, Glycine max
  Coding DNA Sequence Number=SeqID_2106
  Gene Ontology: Mol. function=catalytic activity; Biological process =auxin mediated signaling pathway
  Homolog annotation: Hit_ID=P33083; Match level="QueryCoverage=98%, HitCoverage=82%, E-value=8e-29, Identity=83%"; Hit description=Auxin- induced protein 6B
  Pfam annotation: Domain name=Auxin_inducible; Domain location=1-75; Score=121.2; E_value=2.9e-33; Accession=PF02519.5; Description=Auxin responsive protein
MGIRKALFSANEVSSKAVHAPKGYLAVYVGEKMKRFVIPVLYLNHPSFQDMLSQAEEEFGYDHPMGGLTIPCSED

SEQ ID NO: 118885 - protein, 291 aa, Glycine max
  Coding DNA Sequence Number=SeqID_2107
  Gene Ontology: Mol. function=nucleoside-triphosphatase activity; Cellular component=chloroplast
  Homolog annotation: Hit_ID=Q2PMM5; Match level="QueryCoverage=99%, HitCoverage=12%, E-value=1e-172, Identity=100%"; Hit description =Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSS

SEQ ID NO: 118886 - protein, 314 aa, Glycine max
  Coding DNA Sequence Number=SeqID_2108
  Gene Ontology: Mol. function=kinase activity; Cellular component =cytoplasm; Biological process=intracellular protein transport
  Homolog annotation: Hit_ID=Q94CG5; Match level="QueryCoverage=78%, HitCoverage=28%, E-value=7e-41, Identity=36%"; Hit description =Kinase interacting protein 1
  Pfam annotation: Domain name=Spectrin; Domain location=151-252; Score= -1.4; E_value=0.054; Accession=PF00435.11; Description=Spectrin repeat
MDFRCLSMLLSRKGPLKRIYSSTNYVPTISSSVLTKVEALVDIDKLQKEILSLQTKKEFERSLYEHSYEKYWEIEDQIKRPQYEDNDASALMAAPTLKSCQQTLDKLKEIQTQSSNDAKEEYQREQIKKCIDEEVEQEEHNMGMLREKIKQNLEEYSSNSLTVNEMVECIHELVNKVCTLESAVSSRNRMVKRLKSEIDGLQTNLKKLEEDREMLIEGSEVTNKKLMELEEELQRVKMFNQSVRTQDDTLQTHFTEASCNLEHFFGKLNNMKPDEEEENLVLYKKKRTTSDDKSGGNLKSMMITCLLITQMSRQ

SEQ ID NO: 118887 - protein, 62 aa, Glycine max
  Coding DNA Sequence Number=SeqID_2109
MKNGGKPSRNRPWKRPGREKREVVAASTPRRAGFLPPEGTAFCWNTLEGPSGHDCYLHTLVY

SEQ ID NO: 118888 - protein, 178 aa, Glycine max
  Coding DNA Sequence Number=SeqID_2110
MTWADHERIYITKLPFDSKEIPKSLHERLTLDVPYYHNWLRAFSTSSWSDEFSSQMCKCETSRILFFIYIFFHQSQVCAGFILESRLKSKLVILDLRGLYWACNVVRGKRDMKEKVIEAQRVFKGYIDGGSYRNLPFGGRATRGLTGASSMGGKCAELPPTFIRGKRQKNRKGVVYKL

SEQ ID NO: 118889 - protein, 132 aa, Glycine max
  Coding DNA Sequence Number=SeqID_2111
MQQPIPGCPSQPLNIHGITLKGKQDENWEQLFTPMISQWNKQVDFRVDGYPRQEGLLNFNSNYMVFASEHQFPAQEFHILQSSVETQGIDRRRVVVEAEEYSQQMAERGHGMYYTPPTFSQYPTQMYQYPFK

SEQ ID NO: 118890 - protein, 164 aa, Glycine max
  Coding DNA Sequence Number=SeqID_2112
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=83%, HitCoverage=25%, E-value=5e-71, Identity=95%"; Hit description=NADH -plastoquinone oxidoreductase subunit 2
  Pfam annotation: Domain name=Oxidored_q1; Domain location=23-155; Score=-41.8; E_value=3.9e-05; Accession=PF00361.10; Description=NADH- Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 118891 - protein, 102 aa, Glycine max
  Coding DNA Sequence Number=SeqID_2113
MSPPPLEPHNHSHTHLKFSRRLLLQARFSIGLHIAKSLKLSGTWTFLSLENPRHAEALRKADGLKRCASLDDPSLSANAQLILLSDSSSRSAEECCAQWMAC

SEQ ID NO: 118892 - protein, 91 aa, Glycine max
  Coding DNA Sequence Number=SeqID_2114
  Gene Ontology: Mol. function=protein dimerization activity
  Homolog annotation: Hit_ID=Q1SCU4; Match level="QueryCoverage=79%, HitCoverage=18%, E-value=3e-15, Identity=54%"; Hit description=Zinc finger, BED-type predicted; HAT dimerisation
MVEHLGFIIYFEGLQPLFKIPSRNTINSDIVKIYEYEKVNIMGYLESIGSRIALTTNLWTVGNQKKWYMTITACSHMVEVLSKVLLQCIME

SEQ ID NO: 118893 - protein, 68 aa, Glycine max
  Coding DNA Sequence Number=SeqID_2115
MKLGPVSGPVKVVGQWSNRSSHQVYSKSAESDQVIMDKMHDRSNNQIDLVMPSDPDWTHSTDWVVPDF

SEQ ID NO: 118894 - protein, 159 aa, Glycine max
  Coding DNA Sequence Number=SeqID_2116
MTSVALINLQQANNESLHDFVAQFLQIAVKIQDLEPRVALHAMIATMKLEAFANSLYTSYNILLGIPTLNKLGAIVSTPHLAMKFPSSTREIVIMKANQVDACECYVKSCKIEINQLENGGCMWIIVNVLITLGFTLAKCNQIPIVVKLKSSPKGVVQR

SEQ ID NO: 118895 - protein, 90 aa, Glycine max
  Coding DNA Sequence Number=SeqID_2117
IGEKGTIWENEHTATPLGLEIIPQVKELMDEGLVHKSLNPCALLVPKISIMRHQVPMIGGMMNVLSGATLFSKITHESNIFMIHTHRDSL

SEQ ID NO: 118896 - protein, 225 aa, Glycine max
  Coding DNA Sequence Number=SeqID_2118
MVAILKEFQLRLDLDLLVDGLEIKNQAGGEASYTVEAENDGKVSKLYDGAWKKIGGKQSLPMGNNPNKSERKGKNSSLCGSLVTDFCGRIAEEVPMEMVARKLQQLNCSHVPMGKVQQNKEEDLGNHQLRPCALVQFAREPTQPRDLLDITIKALMLCFMTNWSRRWAAGRHHCFKYRSTTAIAATTSRYFDSPQPHCGRISCIFPPLPKRQQPQDVHLEDKVKL

SEQ ID NO: 118897 - protein, 240 aa, Glycine max
  Coding DNA Sequence Number=SeqID_2119
  Gene Ontology: Mol. function=DNA-directed DNA polymerase activity; Biological process=nucleobase, nucleoside, nucleotide and nucleic acid metabolic process
  Homolog annotation: Hit_ID=Q1SHA0; Match level="QueryCoverage=59%, HitCoverage=35%, E-value=5e-14, Identity=60%"; Hit description=DNA -directed DNA polymerase B
  Pfam annotation: Domain name=zf-DNA_Pol; Domain location=100-235; Score=-71.8; E_value=0.01; Accession=PF08996.1; Description=DNA Polymerase alpha zinc finger
MLVIGLCVLAVVLVVYVIVGILGSIVGGTTYGFLPPIFATFEAVQEGKVFQLLTVKSIPNLVLSLISIPFTTFSNLAKFFAVVLWPPFGSPSLYPMPIYGEASNHKYRGCEPLVLSYPSYSGTFDYPPIFKSICLLGSERQRPTNVASEEAEYNFLAGLLVVSSSLADFASSVMMKHYIKADLYKLFSYFFHVFDTVFCIEKMKAKSRIPIEKELIKTRAVIKSAASTAQETKIVAPLGG

SEQ ID NO: 118898 - protein, 103 aa, Glycine max
  Coding DNA Sequence Number=SeqID_2120
MSFSGSDSDGSPVSHRKSMLKKDILDIGEELESFSNSTTSLPFSNKEKFLNLMKGLEISYGVNIISGIDINVVSVDSDVGGFQVDVFKPLTKVDEAIGGGNEG

SEQ ID NO: 118899 - protein, 63 aa, Glycine max
  Coding DNA Sequence Number=SeqID_2121
  Gene Ontology: Mol. function=oxidoreductase activity; Biological process=metabolic process
  Homolog annotation: Hit_ID=Q5CAF5; Match level="QueryCoverage=93%, HitCoverage=21%, E-value=6e-10, Identity=70%"; Hit description =Neomenthol dehydrogenase
MAEATKRYAVVTGANKGIGFAICKQLASKGIIAVLTATNEKLKDLVFLAVWFFINLMLQTLRV

SEQ ID NO: 118900 - protein, 77 aa, Glycine max
  Coding DNA Sequence Number=SeqID_2122
MEESTGRQSIPLQFLPSECHVSQRALRGRAKARLTSALSKGGKMSGVVTNVYLWKTSEKPKETGQNENSKFGSCIYA

SEQ ID NO: 118901 - protein, 73 aa, Glycine max
  Coding DNA Sequence Number=SeqID_2123
MEQRNIPNRQREGTGPATLSDPHLTSPTPFFLGSPFAPLDDPAATHCLTIEEKALHCSIVTCLSSKVFVVYRR

SEQ ID NO: 118902 - protein, 67 aa, Glycine max
  Coding DNA Sequence Number=SeqID_2124
RARKLRWRRDREKENTALRRRNIPRYGGEGEEAETCDDARVRQTRCSNVDRDLEGRRRLEEEESAKA

SEQ ID NO: 118903 - protein, 385 aa, Glycine max
  Coding DNA Sequence Number=SeqID_2125
  Gene Ontology: Mol. function=ubiquitin-protein ligase activity; Cellular component=ubiquitin ligase complex; Biological process =protein ubiquitination
  Homolog annotation: Hit_ID=Q10PB1; Match level="QueryCoverage=93%, HitCoverage=87%, E-value=2e-46, Identity=36%"; Hit description=U-box domain containing protein, expressed
  Pfam annotation: Domain name=U-box; Domain location=13-87; Score =79.8; E_value=8.4e-21; Accession=PF04564.6; Description=U-box domain
MPGSLEPLDLGVHIPYHFRCPISLELMRDPVTVCTGQTYDRASIESWVSTGNTTCPVTRATLSDFTLIPNHTLRRLIQEWCVANRAFGVERIPTPKQPADPALVRSLLNQASSDSAPAHLRLSSLRRLRQLARDSDKNRSLIASHNLLQILLPIVFNNGSDELSHESLALLVMFPLGESECASLASDSMKIGYLSRMLAHNSFDVRVNSAALVEIVVVGTHSPELRAEVSSVDEIYDGVVDLLRSPISHPRALKIGIKALFALCLVKNTRQKAVAAGAPAGAGHGGAALPDSGGMRGVCSARADGADAGKDNPEDLQPRDGVRRWCAALAVLGVGAVPARGGGGGRADSASASHAERLHGESEEEGADAAEASSGFVAARFRRKL

SEQ ID NO: 118904 - protein, 111 aa, Glycine max
  Coding DNA Sequence Number=SeqID_2126
  Gene Ontology: Mol. function=RNA-directed DNA polymerase activity; Biological process=RNA-dependent DNA replication
MDTYSGHNQIRMHPDDMDKMAFITGQSNYCYKVMSFGLKNAGATYQQLINKILTKLIKKIVEAYVNELVVKSLEVGRPMRPFLYFATYAKIKGLLGPPCGVLNLPYMVDKY

SEQ ID NO: 118905 - protein, 70 aa, Glycine max
  Coding DNA Sequence Number=SeqID_2127
MVSKNRNNSTTEVSFHQQTNLAMHTKCKFHHDICCPADLNDEEELHDSKAFNDSHGIRRYGGSRQQGGVA

SEQ ID NO: 118906 - protein, 113 aa, Glycine max
  Coding DNA Sequence Number=SeqID_2128
GAVGSVKLADRADHDVDDHLYLITLTIPQLFLKSLQAYDRERSMRVGNANVYGFLEPQSIQRSGLVLFFNTFALALVGNINILIVQYATMFVFNSALKGLDDTPQSKSKVVAR

SEQ ID NO: 118907 - protein, 123 aa, Glycine max
  Coding DNA Sequence Number=SeqID_2129
MGTAIEIGEKFGGEWRVPPVPQAIHPGWIRQLHWRYGPDKGALAFIIGEICPLSRQGASCQLHWRIMHSASRQPHWWIMHLAIFSGGTNVHPPTQHRSRHLQWRNSNIASSSGGIHGGTDPPC

SEQ ID NO: 118908 - protein, 92 aa, Glycine max
  Coding DNA Sequence Number=SeqID_2130
MSENLSIAVVNVSDKFRLSLNCKISINIQAGRRLKMKGQNRTALLVTSNLKSAIDEWIAQKKANHQGRGRGIPYALQLNLPQRSNQKPKKRK

SEQ ID NO: 118909 - protein, 101 aa, Glycine max
  Coding DNA Sequence Number=SeqID_2131
MVPAGEVCVVPGQASDPLPDGNAPQPRVVPQAPQTDIPHVPDLGAPSTSVRPAVEEPRHVVEVFHGIVERSERHLSLGMVTPGSSTHEVIEECLRMAKSVT

SEQ ID NO: 118910 - protein, 183 aa, Glycine max
  Coding DNA Sequence Number=SeqID_2132
  Gene Ontology: Mol. function=phosphopantetheinyltransferase activity; Biological process=macromolecule biosynthetic process
  Homolog annotation: Hit_ID=Q2RAV1; Match level="QueryCoverage=51%, HitCoverage=38%, E-value=1e-16, Identity=39%"; Hit description=4' -phosphopantetheinyl transferase superfamily protein
MGQEKTIQLRWTTKLDTARNPKSKGILGVYLVSSHLYIVQLAFSYPMHWSLKEAYVKAIGSGLTGGLNKVEFSHTRWTNISAKVDGKTMTEWRFWLLELGDRHCVSIARVHPISATTSYKTTLKKVDFTEEEYTLGLHLPNDECMPPAGMASPPRMVHVAVDSPAPEAISCQLVSPIKLASCS

SEQ ID NO: 118911 - protein, 57 aa, Glycine max
  Coding DNA Sequence Number=SeqID_2133
MGSDQAPSFEKRFYYVRVKNLELASLRKLGQRMDQVQHQAFSKAHNTKKELYSSFQV

SEQ ID NO: 118912 - protein, 74 aa, Glycine max
  Coding DNA Sequence Number=SeqID_2134
MMTNDNIWYVVGGAKRHAKRMSMTMGSKVRYPVITPKGGCMQLSKASRDIILFGNNIMEVGTTSDNASSKKGKL

SEQ ID NO: 118913 - protein, 222 aa, Glycine max
  Coding DNA Sequence Number=SeqID_2135
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=71%, HitCoverage=18%, E-value=1e-29, Identity=43%"; Hit description =Receptor-protein kinase-like protein
MRLLSIITTSLTLFFLLLFLSIHLQAYTLEDNFTISCGTTGIVFDDERTWTGDADTKYLSGGQGRTVLTEATTQDPSVNQVPYTTARLSRSQFNYSFPVSAGPKFVRLFFYPAYYPSFPRTDASFSVQSNGFTFLKGFNASLNADAEATKTIFREYVVNINDGEILILSFTPSQPNSYAFINGIEVQGGEEEKKMGLSFVSVEKKGSKWVLRNNKASTFKKS

SEQ ID NO: 118914 - protein, 193 aa, Glycine max
  Coding DNA Sequence Number=SeqID_2136
  Homolog annotation: Hit_ID=Q9C7W4; Match level="QueryCoverage=39%, HitCoverage=16%, E-value=1e-09, Identity=41%"; Hit description=Acyl -CoA synthetase, putative; 23993-27872
  Subcellular localization annotation: CTP_CleavageSite=82; ConfidenceScore=5.30e-01
MCETNATRMSACRDGTTTHLKVISIFVILVTSVSTCSPTRMPHSSTASGIASPWEGPPLRRPRHARRCTPSPSREPRRQLARGAARARAIRTGGERGCKMWYLWCQFYKIDYEYAILIELRRIRLAMLMDFIMLLYMIPWQLQALERLPLNKSKKLKILGWQYIHGMNSYKWWVIHFKYYCALSTSCIYLAID

SEQ ID NO: 118915 - protein, 215 aa, Glycine max
  Coding DNA Sequence Number=SeqID_2137
  Gene Ontology: Mol. function=nucleoside-triphosphatase activity; Cellular component=membrane; Biological process=cell division
  Homolog annotation: Hit_ID=Q1SK92; Match level="QueryCoverage=79%, HitCoverage=17%, E-value=4e-38, Identity=54%"; Hit description=AAA ATPase, central region; DEAD/DEAH box helicase, N-terminal
MKGIDTISKEVCRSFELGICNILPFDPEYRNGKLVISANRILVGLPSVEYREMILKTLLAKEKHKNLDFKELATMTEGYTGSDLKNLCITAAYRPVRELRQQERMKDMEKKKREAEGQSSEDASNNKDKEEQEITLTPSNMEDMRRAKSQELKNAGSIEYGDGYMALGSSDPFLFPLKMVTCTCLASEGSVMNELKHWNDLYGEGGSRKKLLVVD

SEQ ID NO: 118916 - protein, 84 aa, Glycine max
  Coding DNA Sequence Number=SeqID_2138
MKNTNKEEATRKEHDPQRKNKKQEQRKKKQEHEEEEEAEKWHRKVTRTNELLLFYKQKVGILALSPSLQGVPAKTLNAQSNDPN

SEQ ID NO: 118917 - protein, 121 aa, Glycine max
  Coding DNA Sequence Number=SeqID_2139
  Subcellular localization annotation: CTP_CleavageSite=41; ConfidenceScore=5.04e-01
MPIFPCRSISWDHAHKTPSGPGEVQQGPGVSSTGYGPLSVLPGARSPPARSCHRDIGIAPTRHLVDPEESNRALGFPALIMGLFQFYGELVTPNKVIKPPINRAFIKKHCAPRQAQGEASQ

SEQ ID NO: 118918 - protein, 261 aa, Glycine max
  Coding DNA Sequence Number=SeqID_2140
  Gene Ontology: Mol. function=sulfuric ester hydrolase activity; Cellular component=integral to membrane; Biological process =metabolic process
  Homolog annotation: Hit_ID=P30845; Match level="QueryCoverage=99%, HitCoverage=47%, E-value=9e-83, Identity=56%"; Hit description =UPF0141 membrane protein yjdB
  Pfam annotation: Domain name=Sulfatase; Domain location=10-261; Score= 113.9; E_value=4.8e-31; Accession=PF00884.13; Description=Sulfatase
MDAQRAPGPRPKLVILVVGETARSQNFQLNGYPRATNPRLSRKEGVISFNDVSSCGTATAISVPCMFSQMTRGQYDDVRAATEENVLDMLQRTGIRVLWRNNNNGGCKGVCERVPTEDMPALKVAGQCVNADGTCYDDVLLHQLGARIDAINGDALIVLHQLGSHGPTYFERYPAASRAFSPTCDSNQIQHCSNEALVNTYDNTLVHTDHLLGKAIDLLQGYADQRDVALIYVSDHGESLGERGMYLHGTPYFIAPREQTQ

SEQ ID NO: 118919 - protein, 390 aa, Glycine max
  Coding DNA Sequence Number=SeqID_2141
  Gene Ontology: Mol. function=L-lactate dehydrogenase (cytochrome) activity; Biological process=electron transport
  Homolog annotation: Hit_ID=Q8ZFV8; Match level="QueryCoverage=56%, HitCoverage=57%, E-value=1e-100, Identity=81%"; Hit description=L -lactate dehydrogenase [cytochrome]
  Pfam annotation: Domain name=FMN_dh; Domain location=1-220; Score =198.3; E_value=1.8e-56; Accession=PF01070.8; Description=FMN -dependent dehydrogenase
MPVPGSRYRDAHSGMSGPNAALRRVLQAFAHPQWAWDVGLLGKPHDLGNVSAYRGKPTSLEDYIGWLGANFDPSISWKDLEWIREFWDGPMIIKGILDPEDAKDAVRFGADGIIVSNHGGRQLDGVLSTARAMPAIADAVKGDITLLADSGIRSGLDVVRMIALGADSVLLGRAFVYALAAAGEAGVANLLDLIDKEMRVAMTLTGAKTIAEINAGSLAPAGDTNTRPAASSPRKEHLVLKLVVGGVVHVAVAELFAAQILPGVALGVDIEMFVIVVGAVDIQRAIADKLAGQMRRDATRRGADNPADVEALLEAGSLFHRLFRQQRAAHQQRPAAVTIEYQRQALVARRLQRNIEEIARGGGLHLFVSVLAALPAPGPQHPLPIGAEAQ

SEQ ID NO: 118920 - protein, 60 aa, Glycine max
  Coding DNA Sequence Number=SeqID_2142
RCRREYQEYHKATSKRTSDMKDLTRHDNEVMVLSKKLMAGRDTGKDTKEIMFATCYTGSL

SEQ ID NO: 118921 - protein, 72 aa, Glycine max
  Coding DNA Sequence Number=SeqID_2143
  Subcellular localization annotation: CTP_CleavageSite=15; ConfidenceScore=5.01e-01
MGPDRCRETQETGTREVARKPKNFSSFFPPSTLLFLFFFSTIEAPNSSSFLPQIARKSHFRSLGAYLYFVGL

SEQ ID NO: 118922 - protein, 147 aa, Glycine max
  Coding DNA Sequence Number=SeqID_2144
  Homolog annotation: Hit_ID=Q3BPM8; Match level="QueryCoverage=38%, HitCoverage=13%, E-value=6e-10, Identity=50%"; Hit description=6 -phosphofructokinase
MALATVRSGWVTDEVKVVPTKGLPFFWKLLSQVAAKAGAAAPHSSAAIRIGCFMVTVLVKWQHRPRPGGRAASNLACGGPFAPGRSPIVGCFGGRCNVPCAPHRAQSIGAIRQRGFALDQRRQVGARLGGDTEAVAADEAGGHSSFH

SEQ ID NO: 118923 - protein, 174 aa, Glycine max
  Coding DNA Sequence Number=SeqID_2145
  Homolog annotation: Hit_ID=Q1GVZ2; Match level="QueryCoverage=87%, HitCoverage=56%, E-value=4e-17, Identity=32%"; Hit description =Hypothetical protein precursor
  Subcellular localization annotation: CTP_CleavageSite=50; ConfidenceScore=5.30e-01
MKHPILIAALLCGAAAPAFAATCESNFQKKGNPFVGTTFTSSVTHPDLTVASAIGQMRVIAKNANMDVLSEDVEGGSMLIEEPESMAHKPIPMIISATSEGGQGTVGMVVKVNKGAIASADGVREEMCKLLNQIKPGKAGEQAAKATPQASVVTIAADRFGFQLRNQNKDNPAA

SEQ ID NO: 118924 - protein, 112 aa, Glycine max
  Coding DNA Sequence Number=SeqID_2146
MNLRVEDAGKNGGSLVTVSLPEDPLGVLPELPEEDLPEDFRKKGSSGSNETIFGITGLPESSRNTSSGMFPEYVLLEIFRKRVLPDYLLVVPEALSGRSLLPEHSGRIVYVY

SEQ ID NO: 118925 - protein, 137 aa, Glycine max
  Coding DNA Sequence Number=SeqID_2147
MEERSLAEKKKAEKPHGEEDHQGSLLSRKREEEGSFFAEKIPIVLWGLENAGRQNNEQGQLLHLTMCVTHLLLPPLRRHNHFSASPNTPHAIRSQPSQQPRRHRFSPRHRQTLRTHPRFHCKVYDARGAAQEGERVA

SEQ ID NO: 118926 - protein, 157 aa, Glycine max
  Coding DNA Sequence Number=SeqID_2148
MIKGGDEYAQNNKEGPLRVHRSYSKLKNKTNRKSHEEHRTRNNVGFDHSRDLAAPRLRFLFFLLLLSYFSQFPSLLNAGTPSQPPTRPGELRLSLEVMSSPRRAGARPGKPDAGLGELGPRKCKENTPLPSFLGMFCFLDRNTEWFIALHCNWRLTL

SEQ ID NO: 118927 - protein, 1423 aa, Glycine max
  Coding DNA Sequence Number=SeqID_2149
  Gene Ontology: Mol. function=RNA-directed DNA polymerase activity; Cellular component=chromatin; Biological process=chromatin assembly or disassembly
  Pfam annotation: Domain name=Chromo; Domain location=1198-1244; Score= 21.5; E_value=0.0029; Accession=PF00385.14; Description='chromo' (CHRromatin Organisation MOdifier
  Pfam annotation: Domain name=rve; Domain location=889-1045; Score =100.1; E_value=6.8e-27; Accession=PF00665.16; Description=Integrase core domain
  Pfam module annotation: Pfam domain module=Chromo::RVT_1::Retrotrans _gag::rve; Domain location=1198-1244::524-693::117-206::889-1045
PFASIIFGALVDPSMADPSLTLEDAIRKLTAHQLSLGETLQAMTLKLDDLLHRLPSVLPDPHTSSPSPSSGPTPVQATTHKIKLNVPRFDGTDPLGRIFKITQFFEYHGTLENKRLTIMPFYMDGRALAWFQWMVGNGQFTSWPAFLQALQTRFALSQYEDPTGTLFKLTQRGTVAEYLTTFEDLANRTIGLPTPFLLSCFISGRNSDIRCEEEKILDARPIPLLRPPPPLPSPSLVQPLPLRTITPPFSLLLPSPTHPPPPAVRRLTQEEIASRRKRGLCFNYDERYHRGHRCTSRAFLFIFEEGDPNSPLINQPDPQLEPQTLNQLDSLDPYPTQISFNSLAGNVAPETLRFMGTINDHPVVLLHHSIAGHGGQWAVIGVQLLVRRPRDHHSSHSVRRGPTRPVLIDYNSLCMKFFHAGQFVELKDSFIPNPMVCTSKDEASSEVATTSVPALQALIDKFYSLFQAPDHLLAVRAIDHRIHLIPQASSMDVRPYRYPHFQKQEIEAQVEIMLQKGLIQPSTSPFSSLVLLVRKQDGSWRFCVDYRALNALTIKDRFSIPTIDELLDELGGARCFSKLDLLQGYHQICMHVSDIPKTAFRTHHDHYEFRVMSFGLCNTPSSFQATMNSLFRPYLCRFIIVFFDDILIYSASIEEHLTHLEVVFQVLLDHQFVLKLSKCFFAQSQVEYLVPQTIRAVRSFLGLAGFYRRFIKGYASIAAPLVKITTMPKFQWSMAPQAAFDHLAFYDRDGRFWELFAITTTVKRRRQYLLGHRFLIITDHRSLKELLTQAIQTPEQHTYLASSFFLTDDTLSALSRLYFAASDCPSAHPHFTITNDLVLHKKRIWLSRGFAMIPTLLTEYHCTPTGGHMGIAKTLARITENFYWSGIREDVAHHEDLSLDFIACLPPYHGNTVILVVVDRFSKRIHLGMLPTSHTAHTVASLFMEIVRKIHGLPCSLVSDRDPLFVSKFWQELFRYSGTQLRMSSAYHSQSDGQMEVMNRVIEQYLRAFVHGKPKTWGKLLLWVEWSHNISLNAATGSTPYEIIFRRQPFNFPDYLMRSSKLDAVEDMLTNRDETFRVIRKKLLKAQATMKKVADTKRRDEEYQPRDWVLVKLRPRQQFSAKESLEIRGKLTKRFFGPFKVVERIGPVAYHLQLPEKARIHPVFHCSLRKRFQGNPDSPNLSEVVQLPSQFIQNQPLISPLAILSYRKASSTGSWEVLVQWEGLSPDETSWEDWNILQQEYHLEDKVILQGLPDDSLTDTGEIMTSKDQDTVATTTRVPLAATHQANIGVQTPFASIREVVDEEGGMEFFERVEESIGGWIWRWLMDAKQDCQVLDANPEGPRARHLPQALRGGVQAWHGFRPRPLYHQHRPHREAVVKGNIKERSGGGGGGGGGGWHRDDGCNKGWELGRHCAIELLGLVLV

SEQ ID NO: 118928 - protein, 87 aa, Glycine max
  Coding DNA Sequence Number=SeqID_2150
METQHDMSPSKEFASSNPVDSSGVKDQSTSEAETPLPIINVGEGNESNDNEVIEDGKKGRYMLFGTTSREEISMVRIRRVAIIATSI

SEQ ID NO: 118929 - protein, 101 aa, Glycine max
  Coding DNA Sequence Number=SeqID_2151
MEKGKEKGRTKQWDEEQQPIGIQTTTSGTTLRSARSLLMDIERRVGRRGRMVMERMVVAEGKGCCGGREEGGAEEDGEAVKKKRMKGKLRMEKGGEAKGEC

SEQ ID NO: 118930 - protein, 139 aa, Glycine max
  Coding DNA Sequence Number=SeqID_2152
  Gene Ontology: Mol. function=sugar porter activity
MSKETDVESPSNNLTVQKVYGVAARYCLPGSFLSIINKWAVMKFPYPGALTALQYYTSAVGFQAKEEKVQVADDSLSEANPLSEWHLLSGLGNPRRGSVRDVLAQCTASPPSKRAQEKAEKTEGKQLRELRLEGVKSRI

SEQ ID NO: 118931 - protein, 269 aa, Glycine max
  Coding DNA Sequence Number=SeqID_2153
  Homolog annotation: Hit_ID=Q1S6B9; Match level="QueryCoverage=55%, HitCoverage=38%, E-value=7e-46, Identity=66%"; Hit description =Senescence-associated
MVEEVETYLEEEAFHLIPATMAATKMKKKQKREEEAFTWEEDAESRREEEEERRRCIISKKKQKNEEAEAEPSEEGRRRSRSRTVRGRKKKKQARERERRDTRSPIGRCMQPGHKDTLLRATRGHRVGPSPDPRRDPQPHRQGLQRRARVWRLLRDSPPDATTMKVEDSRYFFSFRVPKGSDPDEEEEDMLSFGLTIASKGQEGLLKELDAILENCSCFSMQSVSENVKKKGEALDGSVVREVSPKDLESRKKKEMMEGRCMAYWTTVS

SEQ ID NO: 118932 - protein, 87 aa, Glycine max
  Coding DNA Sequence Number=SeqID_2154
  Gene Ontology: Mol. function=protein dimerization activity
  Homolog annotation: Hit_ID=Q1SCU4; Match level="QueryCoverage=98%, HitCoverage=17%, E-value=6e-13, Identity=41%"; Hit description=Zinc finger, BED-type predicted; HAT dimerisation
MAITGHFIDDNWELQSCVLRFVYVACPHTTKILSQDGLNVLGEVIEKVRNDVAFWTTSPKREETFRETARQIKVFVTKKLILDCKTR

SEQ ID NO: 118933 - protein, 41 aa, Glycine max
  Coding DNA Sequence Number=SeqID_2155
MYAKSWLKHKQQVYIDFGDKRLQKYAEVDSNDEVLENTITT

SEQ ID NO: 118934 - protein, 262 aa, Glycine max
  Coding DNA Sequence Number=SeqID_2156
  Gene Ontology: Mol. function=methyltransferase activity; Biological process=metabolic process
  Homolog annotation: Hit_ID=Q1SVR1; Match level="QueryCoverage=70%, HitCoverage=59%, E-value=2e-59, Identity=59%"; Hit description=SAM (And some other nucleotide) binding motif
  Pfam annotation: Domain name=Methyltransf_11; Domain location=61-157; Score=35.4; E_value=2e-07; Accession=PF08241.2; Description =Methyltransferase domain
  Pfam annotation: Domain name=Methyltransf_12; Domain location=61-157; Score=15.7; E_value=0.019; Accession=PF08242.2; Description =Methyltransferase domain
  Pfam annotation: Domain name=Ubie_methyltran; Domain location=30-185; Score=-147.9; E_value=0.085; Accession=PF01209.9; Description =ubiECOQ5 methyltransferase family
  Pfam module annotation: Pfam domain module=Methyltransf _11::Methyltransf_12::Ubie_methyltran; Domain location=61-157::61 -157::30-185
MAILHGWQQEAEAATMSIARRAASDASSTQEAIKILRGNWLLAIEQHHIQYSESSVINDILDIGCSIGISTRYLADKFLTAKGLDLSPYFLAVAKHKEKRAQPRKFPIRWIHANGEDTGLPSKSFNLVSIAFVMKSKVVQELSPVLFTLYKCTEPFIDEFYLTDMDETLREAGLVNITSISASMKQVYTKIWCNINSFEHQHDCPLTKMYFCPFLEAPINCYRVLLIGVLLTSCALFACAFLIVNVEGKGSIDNKTILVSRI

SEQ ID NO: 118935 - protein, 82 aa, Glycine max
  Coding DNA Sequence Number=SeqID_2157
MEEFMAQEPQPEPEVAHEATPEATPRTSPITSPVVEVSEGEEDAEDTDYAADLQEAQSTWEPWPTAAQETPQSAQDTSSPHG

SEQ ID NO: 118936 - protein, 101 aa, Glycine max
  Coding DNA Sequence Number=SeqID_2158
  Gene Ontology: Mol. function=methyltransferase activity; Biological process=metabolic process
  Homolog annotation: Hit_ID=Q1SVR1; Match level="QueryCoverage=80%, HitCoverage=23%, E-value=4e-19, Identity=60%"; Hit description=SAM (And some other nucleotide) binding motif
  Subcellular localization annotation: CTP_CleavageSite=36; ConfidenceScore=5.25e-01
MALSLPLQNLSAVISPSGNATTPTARPPRGRHWAVHVAALVQMGGYEEGKLERPKWVGETPLSRIVQALISFKPVFSVLKHGPTKWTWSDGLAGLVRTRLG

SEQ ID NO: 118937 - protein, 678 aa, Glycine max
  Coding DNA Sequence Number=SeqID_2159
  Subcellular localization annotation: CTP_CleavageSite=35; ConfidenceScore=5.03e-01
MGKIGWVSLNSVPNKLFKFNLNVFLRFKDYFFKVLDSGVVVNGLPLMLNKDGESRFLFYWQADPTKFKSFNEDLLILVERVKPTGGTVSLSAAAPAEGGQSTIEVGPVVVGTAEIAPNALSSVLVKRKQDDSVGPSSRKKSRAPLSLRALRQVIRLTPDVGCHSSVQDVPSASPIVEASIVVDVVIVTPVPPPLSVVLVREATLIVAEESAPVSLASFVVASLSTVAAPLLSVSVVTTNALVVPSSSSSTHMVPPPTTLASTYTSSHPRVSLNHIYTSNDDDSLWGMGLPEFQHLMDSTKVFLKRSQVILEENRQRHQEVMNKVASMEAETAKWRASACTVRRLERLKVASVVVALTEAVRSNHQLSSKVGSVLAKLLRTRLDGDELFKCYKDLKEKKMNLAGRVEDVVMKKYELAKKVADLEARLKESESMLEESELRAAREREASKELKEELLIFKKEVVEQHEKGFNKAVKQVGFFTKELDLGLFDPFKDVVVMISVESLTMQKARPCRCRGLANQSGVGRLTYGVSPLMVMRSKYDFHLIEGVRTKGGPWVLQECVPRADLGLTKGRALDFVNLQGSPNVELGFDKSYVQRMCCAFAYMSLVDSPRADLGYCKPFGGSTKELFDQGFGHRAFAYMSLTMGSTYWRCNGVLLHMCHSWSGTYRKLSDVLLNTCHS

SEQ ID NO: 118938 - protein, 144 aa, Glycine max
  Coding DNA Sequence Number=SeqID_2160
MATTPFPVAPTPQHHHCNPFNPIAATKITSKCKGVILHSLYYRMTIAKGGKLVLCNFSLYPNLPQPCVTPHRCNLTKLVQIAMFAFSTSLNDHRQQHRSLNLTSRACSIVVEFFDDAKKYQREGINVAGGGRCHCDEGGLKVKG

SEQ ID NO: 118939 - protein, 115 aa, Glycine max
  Coding DNA Sequence Number=SeqID_2161
MAYTLQHRPLPTYSQQRQVGTMTTQCYLWLHRIQGDTLTSPLSLPLLTPQKQKGGGSQLLDRLKQRKFAFSREGEKCLYQYGAKTSPSSRGGFVVRGAMASILQGETANGNDLSC

SEQ ID NO: 118940 - protein, 387 aa, Glycine max
  Coding DNA Sequence Number=SeqID_2162
MDVKGIKWVGNMYQKFENMFLEVEDVMYEAYPHMESAGRGQYLSLLKHFPFVRGDACISNSVKYIENQMQAVGESVKKLYSEIVGDLLPPEKVGIELPIDKRADAGLCRKPFHVYKERHAKADTKQRTEDSRIVHGVDNVATLAALYDGTSKADASSMLSLRNSVKEGKFSSPSRQYVRRMDVKSNVRIDENPVNKKMDATKIINKTNLAETDACRTSQSYEISNKNQNQNHGVTIAKPASEEVARLASDTHCSNEIENSCTKQFPNVPLLLKSAEEKPVDTISSSSCAPFGEPVEQGHETMQEDHLKLEEACVMVNGDEIQLPPKEGGNLNTKKSARKQEYKELVAWHMNSEKVKGDCMKNLDPTLPQEQNKLLLPSMSEPEWELL

SEQ ID NO: 118941 - protein, 226 aa, Glycine max
  Coding DNA Sequence Number=SeqID_2163
  Gene Ontology: Mol. function=ferric iron binding; Biological process =aromatic compound metabolic process
  Homolog annotation: Hit_ID=Q65XP4; Match level="QueryCoverage=96%, HitCoverage=34%, E-value=9e-19, Identity=31%"; Hit description =Putative transcription factor
  Pfam annotation: Domain name=M; Domain location=119-139; Score=10.7; E_value=4.9; Accession=PF02370.7; Description=M protein repeat
  Pfam annotation: Domain name=M; Domain location=63-83; Score=8.0; E _value=11; Accession=PF02370.7; Description=M protein repeat
  Pfam module annotation: Pfam domain module=M::M; Domain location=119 -139::63-83
MESKYIEDYMSLDKTMKEIEKKRDLLHQTRAEDDHVNCAPVLKSMMEKKAASDALLKLEKEMGNEQKLNLEIAELEEQLKVLKCVNSEKADRENKRKIEIEEIEEKLEDMIFDMSVKDDENQALKKKVQEAKTELEDSRQQIIKLIECICLTIHELPWFLKGVTKIQIKKFGEVSARSFKKVCMNRYKNNKKASSESVKLCAKWHKEILDSTWHPFKIVEVEGKEI

SEQ ID NO: 118942 - protein, 91 aa, Glycine max
  Coding DNA Sequence Number=SeqID_2164
  Subcellular localization annotation: CTP_CleavageSite=17; ConfidenceScore=5.26e-01
MSKTDDNGFSVTRVRVRVRVTKGLRLPEALSLGSPSCPPPSTPKLPLGPPPTTRMPKALPHTTSPPLHQSRTMEDIQSLKGRDQRNGSNGQ

SEQ ID NO: 118943 - protein, 45 aa, Glycine max
  Coding DNA Sequence Number=SeqID_2165
MRYLKLVKQISRAHRNPAYKPQVFESKETEAAAEPHRIGEGRKEM

SEQ ID NO: 118944 - protein, 230 aa, Glycine max
  Coding DNA Sequence Number=SeqID_2166
  Homolog annotation: Hit_ID=Q7F761; Match level="QueryCoverage=52%, HitCoverage=21%, E-value=4e-09, Identity=32%"; Hit description =Putative transcription factor
MESLILATEKQMKARSDVLSLLEKHQMEKKVVSDALLKLEKEMGNEQKLNLQIAELEEQLKVLKCVNSEEADHENKRKIEIEEIEEKLEDMIFDMSVKDDENQALKKKVQEAKTELEDARQQIIKPSGTERDRKERPKEVKFYFSHFQGNQSAPERSSYGESKIYSVGNGVGIACMKEETKRIKGKEKKIQMIKMEKEKIEGENTTTEKTREREERVMDKIRTIMSIKRN

SEQ ID NO: 118945 - protein, 69 aa, Glycine max
  Coding DNA Sequence Number=SeqID_2167
  Subcellular localization annotation: CTP_CleavageSite=52; ConfidenceScore=5.01e-01
TRLVKWWSQFDTSKAAPEQVKNWFQSNPKFLKPADPETSLFLNQKSQLAAFMASSKSKESLAQNLKELR

SEQ ID NO: 118946 - protein, 41 aa, Glycine max
  Coding DNA Sequence Number=SeqID_2168
MGCYNIGWAKVEFEDNKVAMYPGNVLALHMSKPQGFKYSSG

SEQ ID NO: 118947 - protein, 147 aa, Glycine max
  Coding DNA Sequence Number=SeqID_2169
MLVVITTLLSHDHLLLISGSTISTTTITDKRKPIFFLQCRTRKIHTIHKASREKPTVRARMRVTPRPTVRVRPKVIVLILVSVPRELSLGSPSCPPPSTPKLPLGPPPATRMPKALPHTTSPPLHQSRAMEDIQSLKGRSELPSIQS

SEQ ID NO: 118948 - protein, 332 aa, Glycine max
  Coding DNA Sequence Number=SeqID_2170
  Gene Ontology: Mol. function=ferric iron binding; Biological process =aromatic compound metabolic process
  Homolog annotation: Hit_ID=Q7F761; Match level="QueryCoverage=78%, HitCoverage=45%, E-value=9e-28, Identity=32%"; Hit description =Putative transcription factor
  Pfam annotation: Domain name=XH; Domain location=153-273; Score=44.9; E_value=1.5e-10; Accession=PF03469.5; Description=XH domain
MESLILATEKQMKARSDVLSLLEKHQMEKKAVSDALLKLEKEMGNEQKLNLEIAELEEQLKVLKCVNSEEADHENKRKIEIEEIEEKLEDMIFDMSVKDDENQALKKKEQEAKSELEDARQQIIKLLAVGTVLSQLMLSVQKLIECICLTIQELPRFLKGVTKIQNKKIWGEILDSTWHPFKIVEVEGKEIQEVIDENDPKLLSLKNDLGEEAYVVVVTALKELHEYHNSDDAENTHNSSEKQVIPEIWDSQNGRRATVTEALNKIYSVGNRVRIACMKEETKRIKGKEKKIQMRKMEKEKIEGENATTEKTQEREERLMDKIRTIMNIKRN

SEQ ID NO: 118949 - protein, 55 aa, Glycine max
  Coding DNA Sequence Number=SeqID_2171
MAIQNVQVDLVLIMPRPHLIPLQNNWIMDYCAKIYTVTIPIMTKDQAECFDDANG

SEQ ID NO: 118950 - protein, 388 aa, Glycine max
  Coding DNA Sequence Number=SeqID_2172
  Gene Ontology: Mol. function=protein binding; Cellular component =integral to membrane; Biological process=defense response to fungus
  Homolog annotation: Hit_ID=Q1T435; Match level="QueryCoverage=99%, HitCoverage=83%, E-value=2e-60, Identity=33%"; Hit description =Leucine-rich repeat; Leucine-rich repeat, cysteine-containing type
  Pfam annotation: Domain name=LRRNT_2; Domain location=15-53; Score =59.2; E_value=1.4e-14; Accession=PF08263.3; Description=Leucine rich repeat N-terminal domain
  Pfam annotation: Domain name=LRR_1; Domain location=123-145; Score =13.8; E_value=0.61; Accession=PF00560.23; Description=Leucine Rich Repeat
  Pfam annotation: Domain name=LRR_1; Domain location=147-170; Score =13.6; E_value=0.72; Accession=PF00560.23; Description=Leucine Rich Repeat
  Pfam annotation: Domain name=LRR_1; Domain location=172-194; Score =17.4; E_value=0.05; Accession=PF00560.23; Description=Leucine Rich Repeat
  Pfam annotation: Domain name=LRR_1; Domain location=196-218; Score =18.8; E_value=0.019; Accession=PF00560.23; Description=Leucine Rich Repeat
  Pfam annotation: Domain name=LRR_1; Domain location=220-242; Score =17.3; E_value=0.054; Accession=PF00560.23; Description=Leucine Rich Repeat
  Pfam annotation: Domain name=LRR_1; Domain location=301-328; Score =6.5; E_value=18; Accession=PF00560.23; Description=Leucine Rich Repeat
  Pfam annotation: Domain name=LRR_1; Domain location=330-353; Score =5.2; E_value=30; Accession=PF00560.23; Description=Leucine Rich Repeat
  Pfam annotation: Domain name=LRR_1; Domain location=356-378; Score =13.6; E_value=0.72; Accession=PF00560.23; Description=Leucine Rich Repeat
  Pfam annotation: Domain name=LRR_1; Domain location=98-121; Score =10.7; E_value=2.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=15 -53::123-145::147-170::172-194::196-218::220-242::301-328::330 -353::356-378::98-121
MLQALVSAQHHIMCIKTEREALLQFKAALLDPYGMLSSWTTADCCRWEGIRCSNLTGHVLMLHLPGQFHYSYAFNSITVASLRYMRGEIHKSLMELQQLKYLNLSWNDFRGRGIPEFLGSLSNLRYLDLSCSQFGGKIPTQFGSLSHLKYLDLAGNFYLEGSIPRQLGNLSQLQYLDLGGNQFEGKIPSQIGSLSQLQHLDLGDNSLEGNIPSQIGNLSQLQLLNLRFNSLEGSIPSQLGNLSNLQKLYLGRYSDDVGAPKIDDGDHWLSNLISLTHLSLYNISNLNTSHSFLQMIAKLPKLRELRLFDCSLSDHFILSLRPSKFNFSSSLSILDLSVNSFTSSMILQRLSNVTSNLVELDLSDNLLEGSTSNHFGHVMNSLEHLDLS

SEQ ID NO: 118951 - protein, 53 aa, Glycine max
  Coding DNA Sequence Number=SeqID_2173
MVGAFLQNTVTLTGLPMILPSESDLTYYCVMNRWMTMKNLMLEDTGTPRSDRM

SEQ ID NO: 118952 - protein, 113 aa, Glycine max
  Coding DNA Sequence Number=SeqID_2174
  Homolog annotation: Hit_ID=Q1SK92; Match level="QueryCoverage=56%, HitCoverage=8%, E-value=3e-14, Identity=59%"; Hit description=AAA ATPase, central region; DEAD/DEAH box helicase, N-terminal
MQAKAIANEASVQVSLMSQCQPSFTSKWFGEDEKNIRVLFTQPAKVDSMIGQRTRIGEHEAMRKRMKDMEKKQREAEGESSEDASNNRDKEEQEIKARPLNMEDMRQAKSQVG

SEQ ID NO: 118953 - protein, 209 aa, Glycine max
  Coding DNA Sequence Number=SeqID_2175
  Gene Ontology: Biological process=regulation of GTPase activity
  Homolog annotation: Hit_ID=O04084; Match level="QueryCoverage=35%, HitCoverage=15%, E-value=1e-28, Identity=74%"; Hit description =Serine carboxypeptidase isolog; 30227-33069
  Pfam annotation: Domain name=ArfGap; Domain location=5-118; Score= -36.0; E_value=0.031; Accession=PF01412.9; Description=Putative GTPase activating protein for Arf
MAAVLRRLRDLQSSAGNKICVDWSQKNPQWASVSYGVFIVGEVQVDEGYLHTIAAGGVSREQGGILHAEDGGERVAAGGAAALTGREGIGKLSLVAASAANVVQAGTKEFTSKEATVDLPYVAFAVRPNLGVWEFHYARYVAVNETNGRALFYWFYEAMTKPQDNPLVLWLNGGLGCSSVGYGATQDIGPFLVDTDGRGLKFNNFSWNK

SEQ ID NO: 118954 - protein, 113 aa, Glycine max
  Coding DNA Sequence Number=SeqID_2176
  Homolog annotation: Hit_ID=Q9LIA7; Match level="QueryCoverage=71%, HitCoverage=20%, E-value=5e-08, Identity=35%"; Hit description =Similarity to transcription factor
  Pfam annotation: Domain name=XH; Domain location=8-113; Score=6.8; E _value=5.8e-07; Accession=PF03469.5; Description=XH domain
MSLYYRSHKHMIIVCYNQTGIICKTWHVICREVIDENDPKLLSLKNDLGEEAYVAVVTALKELHEYHNSDDAKNTHNSSEKQVIPKIWDPQNGRRATVTEALKYISNRVIKMR

SEQ ID NO: 118955 - protein, 80 aa, Glycine max
  Coding DNA Sequence Number=SeqID_2177
MESLILASKEQVKARFDFVNLLEKHQRKTQTDELLKFEKEMENEHKLKLEIVELEEQLKVLKSMNVMGADHEETIKKEIE

SEQ ID NO: 118956 - protein, 94 aa, Glycine max
  Coding DNA Sequence Number=SeqID_2178
MATLVTGGGGDPNPPHSSVAPPVHPALEKTNLNHTIIEMLDSTNYLFYMSQVELVIRGYNLLHFIHEVQILQRFATIGDANVGRVTEVFKLRDQ

SEQ ID NO: 118957 - protein, 96 aa, Glycine max
  Coding DNA Sequence Number=SeqID_2179
MIASVAELLYELKPDCEAESGPLNNIDNTQEFSPLKCKEAYPSGTKTQQVETSIRVGQTLMMHASHAGGLNVSICKNGKASTTDADLEHFWEWHQW

SEQ ID NO: 118958 - protein, 79 aa, Glycine max
  Coding DNA Sequence Number=SeqID_2180
  Homolog annotation: Hit_ID=Q6Z8A8; Match level="QueryCoverage=85%, HitCoverage=15%, E-value=9e-14, Identity=51%"; Hit description=F-box family protein-like
MAATINGLEHGGKVGMVFEMYKNCGKFFKLLEETIKAKVEEKHFERRQNGELFEMKIALMLGTSVSKLSLMSDRGNCRR

SEQ ID NO: 118959 - protein, 198 aa, Glycine max
  Coding DNA Sequence Number=SeqID_2181
  Homolog annotation: Hit_ID=Q1RZ12; Match level="QueryCoverage=24%, HitCoverage=16%, E-value=1e-13, Identity=87%"; Hit description=HhH -GPD; Helix-hairpin-helix DNA-binding, class 1; Endonuclease III/Nth
MDSKIYPKVNENPRAFFSSSSPILFESSIQYPWGAGLRQYLLKTIYSCYSNNMDFIQEKPYDGDIPSSIEELLLLPGIGPKITHPGQCPRDMCRYSCAPHLQSSWMGFIVAFILTIGNTSRAIWANVIKEKAIENPKMPMAESLTCGTFVGFLLSLPTAMDFHFHAQFVSIDLPGFSPGRSRLFCSLVWYNILFGCSE

SEQ ID NO: 118960 - protein, 135 aa, Glycine max
  Coding DNA Sequence Number=SeqID_2182
  Gene Ontology: Mol. function=RNA-directed DNA polymerase activity; Cellular component=chromatin; Biological process=RNA-dependent DNA replication
  Homolog annotation: Hit_ID=Q8H6Q8; Match level="QueryCoverage=65%, HitCoverage=49%, E-value=9e-36, Identity=74%"; Hit description=CTV.20
MENFEYGLKMSFITFLNSEEAFFRPNGTTFHSYFPKGTVKVVLYLSGSFIWICQYPNFMSNFENILEEFSLLSKSFLFGIGYLIHCKAWFKEKSKVIFLPKCQVVIPSLDMWRGNKDPMNGVPRITSFLRFCTSR

SEQ ID NO: 118961 - protein, 60 aa, Glycine max
  Coding DNA Sequence Number=SeqID_2183
MTATVESGNPADLLDSTEEDMLDAKYWEINAQLMKGKIVALELLKILLENAGAVFRTSER

SEQ ID NO: 118962 - protein, 179 aa, Glycine max
  Coding DNA Sequence Number=SeqID_2184
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEP

SEQ ID NO: 118963 - protein, 84 aa, Glycine max
  Coding DNA Sequence Number=SeqID_2185
  Gene Ontology: Mol. function=hydrolase activity, hydrolyzing O -glycosyl compounds; Cellular component=apoplast; Biological process =carbohydrate metabolic process
  Homolog annotation: Hit_ID=Q2HTE2; Match level="QueryCoverage=97%, HitCoverage=14%, E-value=8e-29, Identity=78%"; Hit description =Sialidase
MYKPQFAGFVDVDLAADKNIFLRSLIDHSVVESFGAGGKTNILSRVHPELAVMNQAYLFVFNNGIEPIVVENLKAWSMISADIK

SEQ ID NO: 118964 - protein, 45 aa, Glycine max
  Coding DNA Sequence Number=SeqID_2186
MKPPVTYRFRFHNICLINHYGFRWGKEKLYVTARYIGDHTLLIAS

SEQ ID NO: 118965 - protein, 1244 aa, Glycine max
  Coding DNA Sequence Number=SeqID_2187
  Gene Ontology: Mol. function=RNA-directed DNA polymerase activity; Cellular component=chromatin; Biological process=chromatin assembly or disassembly
  Pfam annotation: Domain name=Chromo; Domain location=1149-1197; Score= 21.8; E_value=0.0025; Accession=PF00385.14; Description='chromo' (CHRromatin Organisation MOdifier
  Pfam module annotation: Pfam domain module=Chromo::RVT_1::Retrotrans _gag; Domain location=1149-1197::451-620::103-193
MADHTTSKTTTDRLEDAVTRLTHNQASLNEKYTKLSGKVDSILDHLRLHEATPSHSSPRVSFSQRNNVKLDIPRFDGRDPMGWIFKITQLFDYQNTSEEERITVASFYLDGTALSWYQWMFRNGFITSWPGFLQALESRFAPTFYEDPKGALFKLSQRGTVNDYLTEFERLANRVIGLPPPFMLSCFISGLSPEIRREVLALQPISLPQATALAKLQEDKLRDRRRFSPRPGDLPSSSTNNPNPKQKSQFVQRTLEEIAFRREKGLCYNCDEKWSSNHRCKSRILMLIADNPTPETDEPNHENSTSPVANVNKAPDSLSEDPYPHISLHALSGLPSSDTFQLYGELNHARITVLIDNTNLSLQGHQFSVSFHILPISGADAVLGIEWLKQLGSVVTDYTSLIMKFHHLGQAIELQADVTNGPEPVSATQKTEIEKQISDLLSAGLIRPSTSLYSSPVLLVKKKDGTWHMCVDYRALNAVTIRDRFPIPTIDEMLDELGQAAWFSKLDLRQGFHQILMHEPDIEKTTFRTHHGHYEYRVMPFGLSNAPSTFQAAMNTLLAPFLRRFATVFFDDILVYSKTLSSHIHHLEAIFKALLQGQFYLKRAKCVFTQDQVEYLGHVVSGRGVEPDPTKIQAMTQCPTPSSAKELRGFLGLTGFYRKFIRNYASLAKPLTTLLCKYAFEWKEDSQASFDKLKTTMTQAPVLALPDFSEPFVVETDASQTAMGALHTIVTAIRKWRQYLLRSSFTILTDHKSIQELMTQAGASNIVADALSRAPSSPGQLLLLSVPHLEFIEDLRRTLHDDPQFQALLSKVQEDPSAHMDCRVHNELIFFQGRIWLPRSNPYIPTILLEYHATPLRGHVGVAKTSHRLASSEHSPAVWITATSPSPNGNLGGYFNGLHHTLTSILRLHSYSRHHGSLLQGSSLGSTANSVLGLQGRDSLLRPRLQASRLSPEHRVRQRPYVSQLLLARALSLAWNPPPHEYGLPPPDRRPNGGFTPFEVIYGKAPPALPHYIPGLTNNEAVDDLVHTRQEIHKKLQQRLLKAQAAMKHHADAKREDISFTVGQWVYVKLRPYRQRSVTGAPHSKLSKRYFGPFQITTLIGQVAYRLQLPEIARIHPVFHSSLLRAHHGPPPLTPDTWSLEVLDHKPVPRPLCFLDSKLDDSTSPPTRMVLVQWDGQPPKDTTWESWPELRTTYHLEDKVVFGEGSIVSTVHEPDTASTIHELKSPRPRRETSKPHYLRDYVTT

SEQ ID NO: 118966 - protein, 269 aa, Glycine max
  Coding DNA Sequence Number=SeqID_2188
  Homolog annotation: Hit_ID=Q9SJZ7; Match level="QueryCoverage=29%, HitCoverage=25%, E-value=9e-19, Identity=67%"; Hit description =Putative DnaJ protein
  Pfam annotation: Domain name=DnaJ_CXXCXGXG; Domain location=215-269; Score=-18.6; E_value=0.00064; Accession=PF00684.9; Description=DnaJ central domain (4 repeats)
MVHGYFKGFGIFQFVGLYSTAKVNVGLHDVEDDSEDEHENDLEVPVDAKVVVEKPAQPSTLIYPKEDDQSGAVVKENVHWKSKSAIKQKKKDNSSKDQKESQDQSDSINVGSRTFETTDIEKAEDVSAIDVKEKLKKVTSMKKKGDGCCCTSNLKPQVFVDAQADTDWGLFGRNQNGLSGGVATSVDTDDLAIHLICSNHCLRAIIVAQVPEVLGMEQMMLNMRAKPGTTPSRCSTCGGQGRVVSSMRTPLAIFQRSMTCSACNGTGEI

SEQ ID NO: 118967 - protein, 73 aa, Glycine max
  Coding DNA Sequence Number=SeqID_2189
MAAAGRTNVRDAGGGEGDREEDDYKLVNGYNRLTIITVKLNVGLASFSPGSGTLRFVNGASSVGLVYSANIGL

SEQ ID NO: 118968 - protein, 673 aa, Glycine max
  Coding DNA Sequence Number=SeqID_2190
  Gene Ontology: Mol. function=RNA-directed DNA polymerase activity; Cellular component=chromatin; Biological process=chromatin assembly or disassembly
  Pfam annotation: Domain name=Chromo; Domain location=487-538; Score =42.9; E_value=1.1e-09; Accession=PF00385.14; Description='chromo' (CHRromatin Organisation MOdifier
  Pfam annotation: Domain name=rve; Domain location=237-367; Score =41.6; E_value=2.7e-09; Accession=PF00665.16; Description=Integrase core domain
  Pfam module annotation: Pfam domain module=Chromo::rve; Domain location=487-538::237-367
  Subcellular localization annotation: CTP_CleavageSite=49; ConfidenceScore=5.69e-01
MDKCCPVSKVVASTSVRVTSLLKLSNPRAWTSVVQAVSVKLSRENKLLVLKMRSVRCTRNTLANVSFVEWTHIGVVMRGILAVVPPKTNPPPKRREPIPVIVILHLSASRGAKRKWWGREGISPCATYIEFQEKLCAIQTSLTNYPDFLIHDYLIFYKGSIWIPDDNPFIPSLLNEFHSTPLGGHFGVLKTTHRLQANFTLPNLRRDVRNYIKHCQICQQTKPVPGKPAGLLQPLPLPYGVWEDLLMDFITHLPNSQNHTTLMVVVDRFSKGVHFGALHSNFTAYRVANLFHDIICKLHGFPKSIVSDRDPIFDGQTEVVNRVLEQYLRPFIHAKPVEWVKYLPLAEWSYNTSLHSSTGVTPFEIIYYKPPPSIPTSLLPSSNNEAAESLLRDCTSVHQKLQHCLLKAQSTMKHFADMKGLPESFDRFFRPFEITERIGPVAYRLNLPTASKIHPVFHCSLLRRYYGPIPPTTHNLPPTAQGNQPILEPLAILAHKDDNTTSPPTPLVLVQWKGLPPEETSWEPLSAISDKLHLEDKVPLPAGGVLPCSRIQGSPTTPIRTIAPGHILLPAPNGEDRMNSSAGFEDASAYGGSVSPTKESPSCSKLDAEKPYSSSIKQSDACFFRGQRLTSRQSGFSIGSSSYGAVPEVDDLSRGDFISETKALAPDVEMLSE

SEQ ID NO: 118969 - protein, 86 aa, Glycine max
  Coding DNA Sequence Number=SeqID_2191
  Homolog annotation: Hit_ID=Q5VR44; Match level="QueryCoverage=50%, HitCoverage=10%, E-value=2e-11, Identity=70%"; Hit description =Ribosomal protein-like
MGYYLANGIYPDWATFVKTVPMSQGPRRKLFTKCQEATRKDVEQIMTYKMLKYLMVLLLTLLHANKSVVHTRGIHQQLQTYLVEHI

SEQ ID NO: 118970 - protein, 122 aa, Glycine max
  Coding DNA Sequence Number=SeqID_2192
MGRSDSGGSIQQPLGEREVIPIIDSLTKEACLETFDSESSFFERLVDSRRVNGDTSHPPRRSVGRNVRVSPHNRHRHSVVSPLSPSIVASNEWRRRKGDWRCQFKEMSQEQAHHYRKPWIRA

SEQ ID NO: 118971 - protein, 574 aa, Glycine max
  Coding DNA Sequence Number=SeqID_2193
MAGYEWVKDDILKYKSSLTSMDHFFKVMATYAMVDGMPLMFNKDGETCFPFYWHSNPTRFKSYDEDLLTLVEKVNKAILEQLPTSLVCIMDDFAWRPLLNQVEPAGGTVPSSLVALVVEEVGQPVGEVGPIAIVAEVPPSSSSSILAKKKKDDGVGLSSHKKSKAFFSLRALRQAAGLMPSASRLSTVQDVPPAPPTVEAHNTLATLAPSPPPPINVLKDTPTAIEVTVLATQADSTVAPSSTVVAPLLSAGVATIGAPMVLPSSAVALVASLSAILATVASPSLSSRPRVSLDHLYTSSDVDSLWGATYKPEQKTPIGFMSASDENLIRLARVASWEAKVTKWRATARTLWRVECPKVANAIVAFAEAVKLNHQLSFKVGGVLAKLLCTRLDGDELFKRCKDLQAEKTDLGRKMETVVAERDGLAKAVVDLEAWLKESESRLEEFKLRATKEREAIKKIKEELLLYKQTSFFVKDLDMGLLDSFKDVKDNILLDEDDIVVKEEEEKVVDEGQGAMEQGDDACFFVKDLDLGLLDSFKDVKDKIFLDEDDIVAEEEEVIDEGQGATEQGDDACV

SEQ ID NO: 118972 - protein, 459 aa, Glycine max
  Coding DNA Sequence Number=SeqID_2194
  Gene Ontology: Mol. function=RNA-directed DNA polymerase activity; Cellular component=mitochondrion; Biological process=RNA-dependent DNA replication
  Pfam annotation: Domain name=RnaseH; Domain location=234-347; Score= -34.7; E_value=0.098; Accession=PF00075.14; Description=RNase H
MPGIHPSIICVKMAICSQAKLVSQKKRKMGEERHKAVKDEVYVDNMVVKSYSVAQHVADLEEVFGEICKYNMRLNLKKCTFGVGKGKFLPKLAKKAKPFYKLLQKIEPFLWDEACEQAFLAFMKTIAMPPVLSRLKPGVPLLLYLSVADKVVSLTFVQEDGKHQLPIYFTSRILHDAEKWYQMIEKVVLALITSDRRLRLYFQSHQVVVKTNYPVKQKDGKHQLPIYFTNRILHDAKKWYQMIEKGSVAGIILEGPDNVTLEKALKLDFKTSNNQAEYKALITLQKLSNEVGDKKLKCYIDSHLVQGQMYHIPRESNTGVNLLSTLANTKKIGHLKTIIQETLQAATIDTKEANYYVILDGELFKKGLTTPLYKCLNSPQADYIMRELYEGIYGLHTGEHFLATKAVHVGYYWSTLRADTLDLTRRVDAVMWGPELHTLAWRDTFDKKGGPAKQSSPTL

SEQ ID NO: 118973 - protein, 283 aa, Glycine max
  Coding DNA Sequence Number=SeqID_2195
MAPSQFSVFLPIKAKLEARLETLECLPVKYVCGDTLVNKDLEHHEISDRYEDHHGVIMVDTINAFEVFVSEIDVDIQNGVKMTLSGLIGQPSTGKSTHKARFLALTKDDVHAYVGLAPAGLLSGLFTNWAKYPAYMKGSIEGSFRGISMLKASSRIVAQFMVKVNLPSRRVSNMDCSSTSGFRFLIWTTIQPNMFMNFWSDSSSACHRLAKAVEVMQYDQLGVLRTMLMPPLKDVGKTQQKIVSSLVGLHDVVDKEVSTSRPPFMAVYMREVGIVLGVDGVSR

SEQ ID NO: 118974 - protein, 162 aa, Glycine max
  Coding DNA Sequence Number=SeqID_2196
MIEANDNDLRNSIEANDKYSTKSLDMNPYKMYLDYNKFFITTKELHILLDKVVLRQESSSCDNRQAKQAYKRKDCEMQKGSVVINGSEGIKLNSLEKGINGWHLMTMRFERSIRTLLEMTEKFVYPLAFSALLEDVLASISSLLESSRLLASSTKVDAHPWY

SEQ ID NO: 118975 - protein, 180 aa, Glycine max
  Coding DNA Sequence Number=SeqID_2197
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=6e-23, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGIVHKPQVNIGANQKGLHVHAIRGLHALAFRGSHTLAFIGLHALTFRGLHALAFRGLYVLTFRGMHTLAFRGLYVLTFRGLHILACRGLHVLAIRGLHVLTFKGLHALTLRGLHVLTFIGLHALTFRGLHVFTFIGLHALTFRGLNFPAFRGLDFLTFSGLDVLAFRGLDVLAFRGLD

SEQ ID NO: 118976 - protein, 146 aa, Glycine max
  Coding DNA Sequence Number=SeqID_2198
  Gene Ontology: Mol. function=RNA-directed DNA polymerase activity; Cellular component=nucleus; Biological process=RNA-dependent DNA replication
MDVGGKRDGNCSAVWNQNCYFMWLWRNKHEHKDDFIRPLKPWEVILKACDEYSNGGVVHVMASGNTSSEIMIGWKPPLVSWVAINTDGAARGQGRWATSGGPIRVNDGRWICGFAKQIGSTTAYVAELWGVFRRAQISSFQGCEVH

SEQ ID NO: 118977 - protein, 234 aa, Glycine max
  Coding DNA Sequence Number=SeqID_2199
  Subcellular localization annotation: CTP_CleavageSite=35; ConfidenceScore=5.05e-01
MDMNIGGLISGQMTMMAQSNSSRLGFPALITALCRLRGVGSDALTSYKNLRPVIDLAYIIKNCWNANDQTVNFPEARKSKLRAADVPFSFAPIAGILASSTSAPLLALADPSAQSSQTSDAKLQSLLEGQILIMQSLQELAQQRPIMSVEQFIEKVARPGTRPSFMGDNESFIALAPQQNELEPEKDHSFEAIIPGAVYFLKRILETRSNEAAHPRPVPVSADAPFPGVDPSSP

SEQ ID NO: 118978 - protein, 198 aa, Glycine max
  Coding DNA Sequence Number=SeqID_2200
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=7e-16, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
STLEDPTVAQERLKGNYWPLNRECKSRTLKMRTRRPLKVRACSPLKARMCTPLEVRACSPLMARTCNPLKVRACSPTKVKAHDPLTARTCSPLKLKARTYSPLEVRACSPLVVRTCSPLKARTCSPLTVRASTYSPLEVRACSPLMVRTRSPLKARTCSPLTVRARTYSPLEVKARSPLMVRTCNPLKARTCIPLNGE

SEQ ID NO: 118979 - protein, 127 aa, Glycine max
  Coding DNA Sequence Number=SeqID_2201
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=67%, HitCoverage=16%, E-value=1e-29, Identity=77%"; Hit description=NADH -plastoquinone oxidoreductase subunit 2
  Pfam annotation: Domain name=Oxidored_q1; Domain location=1-113; Score=-75.3; E_value=0.0011; Accession=PF00361.10; Description=NADH -Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSASTIPGISMNPIIEIAQDTLF

SEQ ID NO: 118980 - protein, 299 aa, Glycine max
  Coding DNA Sequence Number=SeqID_2202
  Gene Ontology: Mol. function=transporter activity; Cellular component= integral to membrane; Biological process=transport
  Homolog annotation: Hit_ID=Q39H82; Match level="QueryCoverage=85%, HitCoverage=62%, E-value=1e-110, Identity=81%"; Hit description =Major facilitator superfamily (MFS_1) transporter
RARALGVQGGRQCRLRARAAARRARDHSARPAQHRVVLGGRARRDDRAHADRPLVQEASVDEEEGRGGRPPDAVARPRDGRDRRAGAARVLEILLPREHQQLFHVLPDRQVPPVGAGRADPPVRVPRGGGGRHADRRARRRPDRPQVRDLGVDLGRRAVHDAAAVREPVLDERAVRDHRRRAGVGVRRDPRLCDGADARQGRDGRGPVLRLRVRAGRRRRGRARPARGRDEHHVRLQGVLVPAADRRADGVPAEPRKQPAQEGMTKRPRRARRGRSIGSKRKYDGGFRPPSSHAASGTA

SEQ ID NO: 118981 - protein, 125 aa, Glycine max
  Coding DNA Sequence Number=SeqID_2203
  Subcellular localization annotation: CTP_CleavageSite=27; ConfidenceScore=5.05e-01
MLLSSNVIYICVGVVMLVRMVRTLLFAAARVKSCPSMHSSCVIASLSGCARTVGPPPISGGGPGTVWIWSPLKVRTRSPLKARACSPLKFRTCRLSKARECSPMMARTCNPLKVRASPPLKMGNM

SEQ ID NO: 118982 - protein, 119 aa, Glycine max
  Coding DNA Sequence Number=SeqID_2204
  Gene Ontology: Mol. function=ribonuclease H activity; Biological process=DNA integration
MSHGRLYQQRMKSAFDKKVRLRKFHEGDLVLKKMSHAVKDHRGKWAPNYEGPFVVKRAFSGGALGQDHLGLPSGVETKHERQKPIKVLKDGCKWGWGHDRPSLSLLCAKQAEDVAARQP

SEQ ID NO: 118983 - protein, 187 aa, Glycine max
  Coding DNA Sequence Number=SeqID_2205
  Homolog annotation: Hit_ID=Q1SMF0; Match level="QueryCoverage=98%, HitCoverage=34%, E-value=8e-24, Identity=40%"; Hit description =Tetratricopeptide-like helical
MEIVQMLLIRLRYSLLEMMFCNGLEVAHENGFVAVIMRSDTETGSRGRSSFVLIECERSGTYKCRNKEFVRKDTGSRKCGCPFRLRGKPVHGGEGWMVKLICGIHNHELAKSLVGHPYAGRLTKEEKKIIADMTKSMVKPKNILLTLKEPNVDSCTTIKQIYNARSAYRSSIRGADTEMQHLMKLLE

SEQ ID NO: 118984 - protein, 201 aa, Glycine max
  Coding DNA Sequence Number=SeqID_2206
  Gene Ontology: Mol. function=RNA-directed DNA polymerase activity; Cellular component=signal recognition particle, endoplasmic reticulum targeting; Biological process=RNA-dependent DNA replication
GVLTDPKRIKVIPEWPTPPTPLIELVRNHAPAWEDAQERGFQTLPCSNIPNTTNIYVPSWNDLKSALRKRHIPSYYERELMDKLRRLRQGSMSDEEYCQQMELLLLRAGLREEERTSIARFLSGLNMEVRDKVELFPYRDLDDLVQLCIRVEQQLKRKPTSKSYGSHSYPKKDQGQVILRAAPFKPKGDNGKTIEKQPPKA

SEQ ID NO: 118985 - protein, 241 aa, Glycine max
  Coding DNA Sequence Number=SeqID_2207
  Gene Ontology: Mol. function=metal ion binding; Cellular component =nucleus; Biological process=abscisic acid mediated signaling
  Homolog annotation: Hit_ID=Q985Y4; Match level="QueryCoverage=99%, HitCoverage=78%, E-value=2e-89, Identity=67%"; Hit description=Pirin- related protein
RALIERRPAKDHDVTAIAAGLKRDVVTRPEDEQLVGGEDIACHIERTGENIDRPFLMIGGKGKFHSRLQRQIDIKCIGKGRNGGGKALEFADHHPTGSALDIDQRHVFLGGMGKGRGDFFHMVGQGKPGLQAGHGKRMAAQVFRRAFRMHDAAPGGHQVNVSGANDEFGAETVAMLDFAVEQIGDGGKPDMRMRLDVQRLTSLQYRRSHAIEKDERDRQAAAAASVARAAPQSRQYRWCGG

SEQ ID NO: 118986 - protein, 105 aa, Glycine max
  Coding DNA Sequence Number=SeqID_2208
MDKVDIFVPHPLTNACLLIQLSSECGCKPLVCLLKRPALLSVDFQDSSIRDYSSCTLVGESSTTRDPRSLNPFSEIRRREEEVSRKRDRLYNEDQSKFIIEYASG

SEQ ID NO: 118987 - protein, 185 aa, Glycine max
  Coding DNA Sequence Number=SeqID_2209
  Homolog annotation: Hit_ID=Q1SKD7; Match level="QueryCoverage=91%, HitCoverage=43%, E-value=1e-14, Identity=28%"; Hit description =Ankyrin
MGVSFIEGKIGNGSEELSTKRSRRDATGEGSSTAPEFDSNRFWSAEHQQRFEAIRGWSFHRERHVQLREDEYTDFQEEIACRRWTLLVTPMAKFDPEIVLEFYANAWPTEEGVRDIRSWVRGQWIPFNAYALSQFLGDPLVLEEGQQCEFSQRRNRADGFDEEAIAQLLCTLGQDFARTAAGRRV

SEQ ID NO: 118988 - protein, 124 aa, Glycine max
  Coding DNA Sequence Number=SeqID_2210
MTQELVTRGNTFRLSAPRHSVTPSVIDEQRPMWSSVPLPEMSEFLIGGYVGARASLLSTTPLFVTMTQELVARGDTFRLSAPRRSVTPSVIDEQRPMWSSAPFPEMSTSSGGDFFKSHKLSRTT

SEQ ID NO: 118989 - protein, 172 aa, Glycine max
  Coding DNA Sequence Number=SeqID_2211
  Gene Ontology: Mol. function=phospholipase C activity; Cellular component=membrane; Biological process=intracellular signaling cascade
  Homolog annotation: Hit_ID=Q9LT86; Match level="QueryCoverage=64%, HitCoverage=27%, E-value=7e-42, Identity=69%"; Hit description=MAP3K protein kinase-like protein
  Subcellular localization annotation: CTP_CleavageSite=63; ConfidenceScore=5.37e-01
MVNGNVVLRMQFADGNGGMKAGSCPNRAESPSMNTTSRSLVLVNFFRDLPDVTKSCKDNSAPLLSMVNTCYEAAGKRWPNFIAVDFYKRSDGGGAPDAIDVANGHLVCGCENMASCKANMTFGVCQLPEAEATPPREAAAARDTSFGIRNCKPVYLLWSFATTVFGGMLVSL

SEQ ID NO: 118990 - protein, 286 aa, Glycine max
  Coding DNA Sequence Number=SeqID_2212
  Homolog annotation: Hit_ID=Q1T132; Match level="QueryCoverage=57%, HitCoverage=33%, E-value=2e-18, Identity=29%"; Hit description=IMP dehydrogenase/GMP reductase
  Pfam annotation: Domain name=DUF1723; Domain location=44-93; Score =18.3; E_value=0.0034; Accession=PF08330.1; Description=Protein of unknown function (DUF1723)
MKQMPYVVGRDPSDEGPLQQGVDGPLYWPQLDPLGAVRVEACKPQWPGSVNGFLERWHQETSFFHLSIREMTITLDDVSCLLHFLVIGKSINHVPSLFDREAVKILLMSHMHIPTETEAFAATNAVMTYLLHLINNMIFADNSSTHIHVTYLKYLNNLNACHEYAWGGEDYVVDKSVATRLKPLRGSGRALLIMERLDDLHMDAIMWCPYKAHRAVRPFGSGDANQNTIWRSNSSLNTTNVSRDDGVNEESNENSVGVGGGNKRGGYQGRRDFRGKGEPNGFGLTI

SEQ ID NO: 118991 - protein, 312 aa, Glycine max
  Coding DNA Sequence Number=SeqID_2213
  Gene Ontology: Mol. function=protein-tyrosine kinase activity; Cellular component=integral to membrane; Biological process=protein amino acid phosphorylation
  Homolog annotation: Hit_ID=Q9LT87; Match level="QueryCoverage=96%, HitCoverage=49%, E-value=6e-68, Identity=43%"; Hit description =Similarity to serine/threonine kinase
MAKESTNRKNILVIFGNCPLDFTGSNFTLASSLCSNHGDRGKCCRYINTNVAISVARFANATGNLGVPQNASDTCLQTIFQTLQLNGVAQNATAFCGFGTKIPVNYECRGRTSVAQMLQSPRFTEVTKNCKAPLGEESKCKKCLNAGFGYLHHIGIEDNISLSTCRDATFAALASQVDEISIIDIAICFFGVQGLLIPPVSESSPSFPAPKASPSPPLVADGPITAVAVITLIVLIVLIRQKSRELDEPDNFGKSCSKTLPPCATWKFQEGSSSMFRKFSYREIKKATEDFSTVIGQGGFGTVYKAQFSDGL

SEQ ID NO: 118992 - protein, 84 aa, Glycine max
  Coding DNA Sequence Number=SeqID_2214
  Homolog annotation: Hit_ID=Q1SM20; Match level="QueryCoverage=93%, HitCoverage=20%, E-value=2e-13, Identity=43%"; Hit description =Nucleic acid-binding, OB-fold
MARIPDKIKSIDGSKETLKLAVRITDLWFVGTPNKFEQAEMVIVDSEGDQIHVVCKADHLKSWKADLKENSTYVMHNFKVVKND

SEQ ID NO: 118993 - protein, 402 aa, Glycine max
  Coding DNA Sequence Number=SeqID_2215
  Homolog annotation: Hit_ID=Q2QXB9; Match level="QueryCoverage=32%, HitCoverage=12%, E-value=3e-10, Identity=31%"; Hit description =Expressed protein
MFLFALDNPPPSSIMLISGDVDFAPALHILGQRGYTVILVIPANVGVSSALCNAGKFVWDWPSVVRGEGFVPPSKALVPPRGGPVDLAGYLMGCHINDNSDGQNEEEAIVYRGMSQSYYNSREFSMVSQSLSEYNCGTSNTTYLPTTMRSHSFPSVLNDAPGGSMMPSSDLNECQLWVQPGDLNGLKGQLVRLLELSGGCLPLARVPAEYQKLYGRPLYVSEYGAIKLVNLFKKMGDTMAVEGKGNRKFVYLGNWRTGPSAPPLSLAKKDKKGKGAQEENMNIVTGGCSSDEFSDEERVVIEEPDESSCIGKGNQGRAAKCEVDDHFIEQFKYELQEILVSYSCRIFLGCFEAIYQQRYKKQLEYQRFGVDKLEGLFEKVSDVVVLHEEPASKKKFLAAVGG

SEQ ID NO: 118994 - protein, 753 aa, Glycine max
  Coding DNA Sequence Number=SeqID_2216
  Gene Ontology: Mol. function=RNA-directed DNA polymerase activity; Cellular component=chromatin; Biological process=chromatin assembly or disassembly
  Pfam annotation: Domain name=rve; Domain location=431-587; Score =77.0; E_value=6e-20; Accession=PF00665.16; Description=Integrase core domain
  Pfam annotation: Domain name=zf-CCHC; Domain location=144-161; Score =6.5; E_value=0.084; Accession=PF00098.13; Description=Zinc knuckle
  Pfam annotation: Domain name=zf-H2C2; Domain location=388-429; Score =12.7; E_value=0.0075; Accession=PF09337.1; Description=His(2)-Cys(2) zinc finger
  Pfam module annotation: Pfam domain module=rve::zf-CCHC::zf-H2C2; Domain location=431-587::144-161::388-429
MSSPASPSSFHRIKLEYKDPTGALFKLTQRSIVNAYLSEFEDLVNWIIGLPPSFLLSFFISGLAPEIRHEATGLARLQEEKFLESCRTWRGPFTPVSSANLSPSSSPVMPLSPSLSLPPPIKPSPLLEVKHLSLEELALRREHDLCFNCNEKFHRGHCCTSKVFLLIADEDEGFSLDNPDLDLSPDPPDPPTVPLTQISLHIMEGHLALETLQLLGLIAEHQVLILVDGDSTHNFVQEHLVQGVTFTANLHVLSLSGANLVLGVQWLKSLGLVLIDYNALTMKFFHNERLIELKRDTNATLHPLTPPQLHRLIRTEGSNHPPLYHLKDLPITIYTFFLTQSLLMYDLISAMPTEHQDYSLANNLIMHHGCIWLPLASPFTQTLLKEYHSSPIGGHFGISKTLARIRENFTWPEIRNDAEKFVTSCVDCQHAKYETKRDLSLDFIIGSPAFRGHTVILVVVDRFSKGFHLGMLPTHHTLHTITVLFMDMVDKIHGRSRSLTSDRDPLFLSQFWQALFKLSGTCLRMSLAYHPQSDGQTEVLNRVIEQCLRAFVHNKPSLWGKFLGWVEWAYNTSCHSSTGVSPYEVTLDKKPFNFPQYLAGTSNVEAVNDLLSNMEVVFAKIRKKLLKAQEGMKHIADAKRRDATFNPRDWVIVKLRPHRQTSASRNTTSYSKLAKRYYDPYQILERIGKVVYKLQLPEATLLDNQPIITPLAILSSRQGPESKLQVQLFEVVRDDDSNEPQAQHGPRYMPVRK

SEQ ID NO: 118995 - protein, 102 aa, Glycine max
  Coding DNA Sequence Number=SeqID_2217
MTLIIPSSTTFKLLLNEYKATCNNLDVPSSMHYFMKEKWFTQLNIADCAVKCHIVYNHWRKTTKIGSGWRDFSKSQSFKVDMELVFEFPDSNVNYAFIWPCL

SEQ ID NO: 118996 - protein, 74 aa, Glycine max
  Coding DNA Sequence Number=SeqID_2218
MTESDKVNLKWANLEMTSSNLSELVLDQGQYLQSTNLDKACVLVHVVLEVHWSMLCLRFITAINGTEPQHNAVQ

SEQ ID NO: 118997 - protein, 70 aa, Glycine max
  Coding DNA Sequence Number=SeqID_2219
MATPSKSTPIIASDTLEPKGKTMTMTESNANILQCPLNQQLHSSLDGPVAILWDIENCPVPCDVRPEDVA

SEQ ID NO: 118998 - protein, 416 aa, Glycine max
  Coding DNA Sequence Number=SeqID_2220
  Homolog annotation: Hit_ID=Q2QZ53; Match level="QueryCoverage=74%, HitCoverage=80%, E-value=3e-15, Identity=22%"; Hit description =Expressed protein
MESGKLATILSSLISQLLLLLLHNIFPFPPNSVPPNNSTDSILPLLLFSHQLAATLSLSPKHRKNKRKRDFQHPNPLTRTPDSFRNTFLMSSSSFEWLSGLLEPLLECRDPAPLFHSLHLSSGARLAIGLSRLAEGQDYQQISARFAVSDPVAKFCVKQLCRVLCTNFRFWVSFPSPSDLPSISQSFQSLSGLPNCCGAVLCTRFNIVVNANSTTTTTTTNDKVSVSQVAAQIVVDSSSRILTIAAGFLGHKSDSQILQASTLYNDIQQGTLLNAPCNQFLIGDSEYPLLPWLMVPYANPAPASAEENFNSAHEIMRLPALRAAASLRNWGVLSRPVCEELKTAVAYIGACSILHNSLLMREDFSALASEFEDCNQGCYGEPCNAMLDGEAVSSKALALRDNLAAVAKKIRDSKNS

SEQ ID NO: 118999 - protein, 36 aa, Glycine max
  Coding DNA Sequence Number=SeqID_2221
MQDEAISTWNILPTVFSQHYKICHEGIHKKVVKRID

SEQ ID NO: 119000 - protein, 202 aa, Glycine max
  Coding DNA Sequence Number=SeqID_2222
MSLKPAAMDGATAIGEAGEGLEGLGDGGEVGRGGEGDPEAEVGAEDAAELLDAEFSDGVGDGEAGGDLLVVLALGETGEADGEAGAGGEVEGVEEGGGVAALEEGLQEAGEPLEGGGGHEEGVAEGVRGAGEGIGVLKIAFAFVFAVFGGEGECGGELVGEEEEREDGISGIVWRDGIWGERENVVEEEKEELGDEGGENGG

SEQ ID NO: 119001 - protein, 112 aa, Glycine max
  Coding DNA Sequence Number=SeqID_2223
MWDVVENGNYIPIDEKGGENPRSAWTKDHQTKYFLYSKARNTRPSNNCLDNSKVQNIMNNLRSLKEFDGTLQVHELELMEDEGQRKGKFIASKSSNYCSNQATKEHSNSLCP

SEQ ID NO: 119002 - protein, 118 aa, Glycine max
  Coding DNA Sequence Number=SeqID_2224
  Gene Ontology: Mol. function=protein disulfide oxidoreductase activity; Cellular component=chloroplast; Biological process=cell redox homeostasis
  Homolog annotation: Hit_ID=Q9SEU7; Match level="QueryCoverage=91%, HitCoverage=63%, E-value=4e-41, Identity=69%"; Hit description =Thioredoxin M-type 3, chloroplast precursor
  Pfam annotation: Domain name=Thioredoxin; Domain location=13-115; Score=84.5; E_value=3.3e-22; Accession=PF00085.10; Description =Thioredoxin
MGCQCLLWLESIATPVTKDLWDNSILKSETPVLVIFYANWCGPCRMVHRIIDEIATEYAGKLKCFIVNTDTDMQIAEDYEIKAVPVVLMFKNGEKCDSVIGTMPKEFYVAAIERVLKS

SEQ ID NO: 119003 - protein, 90 aa, Glycine max
  Coding DNA Sequence Number=SeqID_2225
MEEFFKNMLKNICLKDYKSEHSMALSFSYAITKPFLRVQDKSMNCELQRPKNGVVALIKCESKESSPELPEKPSKLEIGSPIIFIEAPKA

SEQ ID NO: 119004 - protein, 137 aa, Glycine max
  Coding DNA Sequence Number=SeqID_2226
  Homolog annotation: Hit_ID=Q9LTC5; Match level="QueryCoverage=44%, HitCoverage=44%, E-value=5e-07, Identity=40%"; Hit description =Nicotiana EREBP-3-like protein
  Pfam annotation: Domain name=AP2; Domain location=17-82; Score=133.8; E_value=4.6e-37; Accession=PF00847.10; Description=AP2 domain
MEEARKGEQEKERGEEEVKYRGVRKRPWGKFGAEIRDPTKPTGRQWLGTFDTAEEAARAYDRAAIALRGALAILNFPHEFHSHLPFISSSSSSSCSSTGVVGSSSSAQQGEVIEFEYLDDKVLEDLLELEEKRGKKE

SEQ ID NO: 119005 - protein, 113 aa, Glycine max
  Coding DNA Sequence Number=SeqID_2227
MESKSISHECSLEHTQNTILPSISKSLKQEIPEAQRGNKTKKNTSSFVAQRLNLGQNKRGLKATGLVGHSQNEGGTVREGMRRRRRRRRRRRRVDDGGFVKGRRRGGERKGSH

SEQ ID NO: 119006 - protein, 121 aa, Glycine max
  Coding DNA Sequence Number=SeqID_2228
GVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTL

SEQ ID NO: 119007 - protein, 216 aa, Glycine max
  Coding DNA Sequence Number=SeqID_2229
  Gene Ontology: Mol. function=DNA binding
  Homolog annotation: Hit_ID=Q1S0F5; Match level="QueryCoverage=90%, HitCoverage=40%, E-value=3e-25, Identity=35%"; Hit description=IMP dehydrogenase/GMP reductase
MGPLQMQAFRNVYRKILDLTIAEISTEAIVSLTQYYDQPLRCFMFGDFQLVPTVEEFEEILGCPFGGRKPYLFSGFLPSLSKIEVVVRDSARELDRVKQTRNGVVGLPWKYLEGKARDMANQEEWVPFMDILALLIFGVVLFPNMDGLVDLAAIDAFLAYHHSKESPVVAILADLFDTFDRRCEKSSARIICCLPALCVWLVSHLFQQDIRHPCPL

SEQ ID NO: 119008 - protein, 205 aa, Glycine max
  Coding DNA Sequence Number=SeqID_2230
  Gene Ontology: Mol. function=nucleoside binding
  Homolog annotation: Hit_ID=Q1YDM1; Match level="QueryCoverage=99%, HitCoverage=63%, E-value=4e-79, Identity=71%"; Hit description =Conserved hypothetical membrane protein
MNLIGLPPELGLAWLTAMLVGIWGAVPLIFTLVPASSLTVADITVFSALILFAHGLPIEQKIIEKAGPGMIVTTALRVGGGLLYAFLLHQLLEATGWLSGPVNPAWIAMSATPEWTAYFLGLGETMVWMLVILLALSFCLEILRLTGLLALMMKALSPLLRLAGIRGEAEHLTAIGLFLGISYGAGFLIREAQSGTISPRQVFLS

SEQ ID NO: 119009 - protein, 165 aa, Glycine max
  Coding DNA Sequence Number=SeqID_2231
MASRDQVWSFCTQDTRRYLTVICTPLLGRHSCVRWQAETKFGHSAPKIRGDTLRLSAPLCQSDTVVSDGKQRPSLVILHPRYAEIPYGYLHPLLLWQTQYVSDSKQRLTQSSAPFVPPGTTKSFTCGNFMTSKEGQLSYPNFVRGPLLDDMRPFFGPREVLGTHH

SEQ ID NO: 119010 - protein, 547 aa, Glycine max
  Coding DNA Sequence Number=SeqID_2232
  Gene Ontology: Mol. function=methylcrotonoyl-CoA carboxylase activity; Cellular component=mitochondrion; Biological process =leucine catabolic process
  Homolog annotation: Hit_ID=Q9LDD8; Match level="QueryCoverage=83%, HitCoverage=75%, E-value=0.0, Identity=81%"; Hit description =Methylcrotonoyl-CoA carboxylase beta chain, mitochondrial precursor
  Pfam annotation: Domain name=Carboxyl_trans; Domain location=1-473; Score=607.1; E_value=1.5e-179; Accession=PF01039.12; Description =Carboxyl transferase domain
MGHDLYEEPLPSGGVVTGIGPVHGRLCMFVANDPTVKGGTYYPITVKKHLRAQEIAAQCKLPCIYLVDSGGAFLPKQAEVFPDRENFGRIFYNQAVMSAQGIPQIALVLGSCTAGGAYIPAMADESVMVKGNGTIFLAGPPLVKAATGEEVSAEDLGGATVHCKTSGVSDYFAQGICRGYFLLHTSEDELHALALGRNIIKNLHMAGKDVLANGLQNINYEYKEPLYDINELRSIAPTDLRQQFDIRSVIDRIVDGSEFDEFKKLYGTTLVTGFARIFGQPVGIIGNNGILFNESALKGAHFIELCTQRNIPLVFLQNITGFMVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGQDHDMKENKRSGAPYIFIIKMFLVRQFVFPTKSCMRIRSKANSLLCIDSSYAPIKLNNMYNIKGVTYREKLIKIDSANNQAIHCVNLDPL

SEQ ID NO: 119011 - protein, 67 aa, Glycine max
  Coding DNA Sequence Number=SeqID_2233
MASKSLQCVNYERIHSLNDENHQVPVSVNSNGIPRSTSPPEIKLRRLIVTIQVCETNAKRGYESIQS

SEQ ID NO: 119012 - protein, 270 aa, Glycine max
  Coding DNA Sequence Number=SeqID_2234
  Gene Ontology: Mol. function=peptidase activity; Cellular component =cytoplasm; Biological process=response to oxidative stress
  Homolog annotation: Hit_ID=Q8LGH3; Match level="QueryCoverage=96%, HitCoverage=87%, E-value=2e-51, Identity=40%"; Hit description=4 -methyl-5(B-hydroxyethyl)-thiazole monophosphate biosynthesis protein, putative
  Pfam annotation: Domain name=DJ-1_PfpI; Domain location=114-251; Score=112.0; E_value=1.8e-30; Accession=PF01965.14; Description=DJ -1PfpI family
  Subcellular localization annotation: CTP_CleavageSite=53; ConfidenceScore=5.18e-01
MITCHPAFYDRLPRFWAVKSNLQVSRGLTTSRGPGTTYQFALSLAEQLFGDSVANEVAESMFMRTDDDHAAKEFNKVEWSVGHHTPSVLVPVAHGSEEIEVVTVVDILRRAKAKVIVASVEKSLEVLASQGTKIVADILIGDAQESAHDLIILPGGTAGAQRLSKSRILKKLLKEQNSAERIYGAVCSSLAILQKQGLLKDKRATAHASTLDKLKDKEINGAKVVIDGKLITSEGLATVTDFALAIVSKLFGNGRARSVAEGLVFEYPKK

SEQ ID NO: 119013 - protein, 242 aa, Glycine max
  Coding DNA Sequence Number=SeqID_2235
  Gene Ontology: Mol. function=protein dimerization activity; Cellular component=nucleus; Biological process=regulation of transcription, DNA-dependent
  Homolog annotation: Hit_ID=Q6QPK1; Match level="QueryCoverage=67%, HitCoverage=40%, E-value=2e-33, Identity=48%"; Hit description=AREB -like protein
  Pfam annotation: Domain name=bZIP_1; Domain location=124-184; Score =40.4; E_value=6.3e-09; Accession=PF00170.11; Description=bZIP transcription factor
  Pfam annotation: Domain name=bZIP_2; Domain location=124-181; Score =37.2; E_value=5.6e-08; Accession=PF07716.5; Description=Basic region leucine zipper
  Pfam module annotation: Pfam domain module=bZIP_1::bZIP_2; Domain location=124-184::124-181
  Subcellular localization annotation: CTP_CleavageSite=84; ConfidenceScore=5.57e-01
MDVPKQPPPPLSLNSNHSQRQAQQHQQQPPPLFPKPANVTFAAAPMHLLNNAQLASPGRRRGLIGVAEHSMNVGMVGLATANVTASASSKISPDVITRSNNVDNSPISPHYVINRGRKFSAIEKVVERRQRRMIKNRESAARSRARKQAYTFELEAEVAKLKELNRELQRKQEEIMEMQKNKDLDPACRPRVSKIHCLRRTLTGPWMIYKKTQKLFRVSKRCVFVFWEESKGLHGSVRIDYG

SEQ ID NO: 119014 - protein, 54 aa, Glycine max
  Coding DNA Sequence Number=SeqID_2236
MAVRMKGEINIKIIIITLGSWQRWECRVAAILRLGSVVESTSVLCCAASTRVGI

SEQ ID NO: 119015 - protein, 43 aa, Glycine max
  Coding DNA Sequence Number=SeqID_2237
MEGQWKVMEGGGGSPEVAQCGRKSKEGKVLIKRVANKILRLKL

SEQ ID NO: 119016 - protein, 644 aa, Glycine max
  Coding DNA Sequence Number=SeqID_2238
  Gene Ontology: Mol. function=transcription factor activity; Biological process=regulation of transcription, DNA-dependent
  Homolog annotation: Hit_ID=Q2R3B9; Match level="QueryCoverage=99%, HitCoverage=51%, E-value=1e-152, Identity=59%"; Hit description =Expressed protein
MAIPGLALLPSKLTFLSEAGLISHALLLCYIENRFFNYSSIYYYGFEDEVMYPSYMVVMTTLLGLALVRSLSVDHRIGGKAVWILTCLFSSKLAMLFISSKSVVWVSAVLLLAVSPPLLLYRDRSKTTARMKPWQGYVHACVVALSVWFCRETIFEALQWWNGRSPSDGLLLGFCILLTGLACVPIVAIHFSHVLSAKRCLVLVVATGLLFILMQPPLPVSLTYQSNLIKTARHSTDDISIYGYIAGKPTWPSWLLIIAILLTLASITSIIPIKYIVELRTFYSIAMGVALGIYIAAEYFLWAGILHVLIVVTMVCASVFVVFTHLPSATSTKLLPWVFALLVALFPVTYLLEGQLRIKNILEDSEIGNLGEEEKKLTTLLAIEGARTSLLGLYAAIFMLIALEIKYKLASILREKVIDSGGIRQNHSGQSASASFLPRMRFMQHRRTTTAPSFTIKRMAADGAWMPAVGNVATVLCFAICLVLNVNLTGGSNRSIFFLAPILLLLNQDSDFVTGFGDKHRYFPVTVVISAYFVITALYRTWEDVWQGNSGWGLQIGGPDWIYVVKNLALLILTFPSHILFNRYVWSHTKQSDSSPWITLPLNLLPIACTDVLKIKILGILGVIYSLAQYLITRQQYISGLKYI

SEQ ID NO: 119017 - protein, 59 aa, Glycine max
  Coding DNA Sequence Number=SeqID_2239
MRILLWLKRSSLYGGSAASNSGSWWPSMVVDGGRGVSRVISLSAISLGLGCVLSAIIHA

SEQ ID NO: 119018 - protein, 275 aa, Glycine max
  Coding DNA Sequence Number=SeqID_2240
MCDNWSEYLKTIYLEVAGNIFLDQSTRWTDQQHSLYIRSLEASFVNELHRSMRLHHLSLKNSTDEAYKCRFLQNSHNMPKQSLALQDGCQKKINLERVAPMLESTADSHVLAGSQFKLTSVDGGCSLREHGLLCDEEIHARGSSIFTLEMACSSTEVTDQNFKDEDARSSCMPLVKRLKTATADSSSTDQVVPFGKVHTPDVSTSSNASSENKGHELLSEPPVSYHFPTSDLPYFLRGRVYKLGLGFEALEFLIHCRKIKVSSSHWQKAKASPNE

SEQ ID NO: 119019 - protein, 65 aa, Glycine max
  Coding DNA Sequence Number=SeqID_2241
  Homolog annotation: Hit_ID=Q2R3B9; Match level="QueryCoverage=74%, HitCoverage=4%, E-value=4e-08, Identity=59%"; Hit description =Expressed protein
  Subcellular localization annotation: CTP_CleavageSite=31; ConfidenceScore=5.19e-01
MLGGASATAAYAMGMVSDALSSVAFTTSAIVVSAAGALVVGFPLLTIELYGCIYSSSLCNPIPTH

SEQ ID NO: 119020 - protein, 107 aa, Glycine max
  Coding DNA Sequence Number=SeqID_2242
  Homolog annotation: Hit_ID=Q2R3B9; Match level="QueryCoverage=74%, HitCoverage=7%, E-value=3e-13, Identity=46%"; Hit description =Expressed protein
MEDDPDLQCNDDKHQGNGAINDADAVELVGVAGDPPERPSGGSIKLKEERDEEEEKQVAEGSSGRENEGVMRSDVEQERDQDKVKSVTAALEWAQYEAVTGASPPCS

SEQ ID NO: 119021 - protein, 167 aa, Glycine max
  Coding DNA Sequence Number=SeqID_2243
  Subcellular localization annotation: CTP_CleavageSite=40; ConfidenceScore=5.63e-01
MVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRYLSSLAHEAPGFVFVARTRRPGARGAVVIPSLPTVDE

SEQ ID NO: 119022 - protein, 91 aa, Glycine max
  Coding DNA Sequence Number=SeqID_2244
MVVPRASHVNPIIAFAMHIISMPEKECTLRRRCRIRAKARVMSEIEEVQEGMKADMEAMKEQMATMMEAMMSMKKILEVNATAATATSTVA

SEQ ID NO: 119023 - protein, 134 aa, Glycine max
  Coding DNA Sequence Number=SeqID_2245
  Gene Ontology: Mol. function=phosphoric monoester hydrolase activity; Biological process=dephosphorylation
  Homolog annotation: Hit_ID=Q32W70; Match level="QueryCoverage=59%, HitCoverage=35%, E-value=2e-18, Identity=64%"; Hit description =Tyrosine specific protein phosphatase family protein
  Pfam annotation: Domain name=Y_phosphatase2; Domain location=28-133; Score=-36.7; E_value=0.0027; Accession=PF03162.4; Description =Tyrosine phosphatase family
  Subcellular localization annotation: CTP_CleavageSite=25; ConfidenceScore=5.43e-01
MARLLSQPMFRHRMTMAPRRYSCRRSTSSWSTTALIFRVGFPDSANFEFLKSLRLRYVICLCPEPYPETTFEFFKANGIRLYQFGINGCKLLQTVHWFKAIDFYAYVNARFFIATTNVLGDKQIYILNKLWKRR

SEQ ID NO: 119024 - protein, 213 aa, Glycine max
  Coding DNA Sequence Number=SeqID_2246
  Gene Ontology: Mol. function=hydrolase activity, acting on ester bonds; Biological process=lipid metabolic process
  Homolog annotation: Hit_ID=Q5J7N0; Match level="QueryCoverage=55%, HitCoverage=34%, E-value=4e-36, Identity=67%"; Hit description=GSDL -motif lipase
MASENLGLEPTLPYLSPLVVGERLLVGANFASAGIGILNDIGFQFLHIIHIYKQLKLFAHYQQRLSAHIGEEGARRHHSWRQRFCQQLLPAPIFTKISPVFSPRLRDLYHIRVQLPNSEEVLLEKFIFKQTLNPQLVEMIKGVNQEIGAHVFIAVNAYEMHMDFVTNPQAFETYTRFGIHFSHSEKANRIIVQQMMTGSALPKFCYLMMISSS

SEQ ID NO: 119025 - protein, 145 aa, Glycine max
  Coding DNA Sequence Number=SeqID_2247
  Gene Ontology: Mol. function=nucleic acid binding
  Pfam annotation: Domain name=zf-CCHC; Domain location=125-142; Score =24.6; E_value=8.7e-05; Accession=PF00098.13; Description=Zinc knuckle
MYPLFPLPSNPLYQHGILVSIASKFICSSELSPNAEWDEFQGLERSRRNSLPAHFRQFKVSYNTLKDKWSLNELISQCAIEEDRQKDRSKSAHLSLTSQNKKRKKIKDDAKGSSQQKKQKKDEEFSCYFCKKLGHMKKKCPKYAA

SEQ ID NO: 119026 - protein, 37 aa, Glycine max
  Coding DNA Sequence Number=SeqID_2248
MPANSSPSRPSFPVAGSEISPPVPAITGEDSGQLVKK

SEQ ID NO: 119027 - protein, 962 aa, Glycine max
  Coding DNA Sequence Number=SeqID_2249
  Gene Ontology: Mol. function=nucleic acid binding; Cellular component= plastid chromosome
  Homolog annotation: Hit_ID=Q8H902; Match level="QueryCoverage=90%, HitCoverage=96%, E-value=0.0, Identity=61%"; Hit description =Putative DNA binding domain containing protein
  Pfam annotation: Domain name=PPR; Domain location=131-165; Score=8.2; E_value=0.79; Accession=PF01535.11; Description=PPR repeat
  Pfam annotation: Domain name=PPR; Domain location=200-234; Score=4.6; E_value=2.1; Accession=PF01535.11; Description=PPR repeat
  Pfam annotation: Domain name=PPR; Domain location=361-395; Score=4.5; E_value=2.2; Accession=PF01535.11; Description=PPR repeat
  Pfam annotation: Domain name=PPR; Domain location=833-867; Score=4.3; E_value=2.3; Accession=PF01535.11; Description=PPR repeat
  Pfam annotation: Domain name=SAP; Domain location=530-564; Score =38.7; E_value=2.1e-08; Accession=PF02037.17; Description=SAP domain
  Pfam module annotation: Pfam domain module=PPR::PPR::PPR::PPR::SAP; Domain location=131-165::200-234::361-395::833-867::530-564
  Subcellular localization annotation: CTP_CleavageSite=32; ConfidenceScore=5.22e-01
MSSLILPYTYTYGYARFPFKLNRFSPRTVTVRAAVSSPDKRGRKKKQAKDDDSAVENGLRFSFMEELMDRARNRDSNGVSEVMYDMIAAGLSPGPRSFHGLVVSHALNGDEEAAMESLRRELAAGLRPVHETFLALIRLFGSKGRATRGLEILAAMEKLNYDIRQAWLILIEELVWNKHLEDANEVFLKGAKGGLKATDEVYDLLIEEDCKAGDHSNALDIAYEMEAAGRMATTFHFNCLLSVQVAFLDLATCGIPEIAFATFENMEYGEDYMKPDTETYNWVIQAYTRAESYDRVQDVAELLGMMVEDHKRIQPNAKTHALLVECFTKYCVVREAIRHFRALKNFEGGIKVLHNEGNHGDPLSLYLRALCREGRIVEMLEALEAMAKDNQPIPSRAMILSRKYRTLVSSWIEPLQEEAELGYEIDYISRYIDEGGLTGERKRWVPRRGKTPLDPDAHGFIYSNPMETSFKQRCLEELKLHNKKLLKTLQNEGLAALGDGVSESDYIRVQERLKKLIKGPEQNVLKPKAASKMLVSELKEELDAQGLPIDGNRNVLYQRVQKARRINRSRGRPLWVPPVEEEEEEVDEELDALISHIKLEEGNTEFWKRRFLGEGLNGDQEMPTDAAESEVPEVLDDVDAIEDAAKEVEDDEADDDEEEAEQAEEEVEPAENQDVNRIKEKEVEAKRPLQMIGVQLLKDIDQPTATSKKFKRSRKVQVEDDDDDDWLPLDLFEAFEEMRKRKIFDVSDMYTLADAWGWTWERELKKKPPRRWSQEWEVELAIKVMQKVIELGGRPTIGDCAMILRAAIRAPLPSAFLTILQTTHSLGFKFGSPLYDEIISLCVDLGELDAAVAVVADLETTGISVSDLTLDRVISAKQRIDNTSNGVITDAGFNGRLPASHCCQLQRQCLFIPPTRNDAVENLTSPTTNNSGFTVDKKVVVLSRPGPLHWLIQLNDALDFVD

SEQ ID NO: 119028 - protein, 98 aa, Glycine max
  Coding DNA Sequence Number=SeqID_2250
  Homolog annotation: Hit_ID=Q9LKI5; Match level="QueryCoverage=74%, HitCoverage=8%, E-value=4e-14, Identity=63%"; Hit description=DNA repair endonuclease UVH1
MDLHGKVGSDKGRARREGKVLHEAANFIVRFAFANPDTIACGLSNNVRTYAPRLSDCKIQTIKASMEVSESECKLRMIMPTILEDPRCDEEDIVGGVE

SEQ ID NO: 119029 - protein, 232 aa, Glycine max
  Coding DNA Sequence Number=SeqID_2251
  Gene Ontology: Mol. function=nutrient reservoir activity; Cellular component=apoplast; Biological process=auxin mediated signaling pathway
  Homolog annotation: Hit_ID=Q1SKM2; Match level="QueryCoverage=96%, HitCoverage=99%, E-value=2e-90, Identity=74%"; Hit description=Cupin region
  Pfam annotation: Domain name=Cupin_1; Domain location=64-215; Score =175.5; E_value=1.3e-49; Accession=PF00190.13; Description=Cupin
  Pfam annotation: Domain name=Cupin_2; Domain location=99-177; Score =30.2; E_value=7.3e-06; Accession=PF07883.2; Description=Cupin domain
  Pfam module annotation: Pfam domain module=Cupin_1::Cupin_2; Domain location=64-215::99-177
MKVFYFFVVLLALASSVAFGYDPSPLQDFCVAINDTKTGGLYGVFVNGKFCKDPKFAYADDFFFGGLGPGNTANPQGSKVTAVTVNEILGLNTLGISLARIDFAPKGLNPPHTHPRGTEILVVLEGTLYVGFVASNQNDNRLFTKVLYKGDVFVFPIGLVHFQQNIGYGNAVAIAGLSSQNPGVITIANAVFGSKPPISDEVLAKAFQVDKNVIDYLQKQFGYNNKVNGKHN

SEQ ID NO: 119030 - protein, 212 aa, Glycine max
  Coding DNA Sequence Number=SeqID_2252
  Gene Ontology: Mol. function=transferase activity
  Homolog annotation: Hit_ID=Q2HSJ7; Match level="QueryCoverage=72%, HitCoverage=45%, E-value=2e-15, Identity=34%"; Hit description =Tetratricopeptide-like helical
MKHLTSISNIPAFPIHVDQNGALVEIMVNAAQKRETMKQFSLPYLACTRIGLNDKRVGEAIGEFPMCLHASEDGEGVGKEILLAVGFDESVPEEGGKGENVVEDGKGIGESGEEGVGAGNEEGNEEVVLLEGVMDDARLHLFQVLTFLAGFEEGAIWIRILTAVATAILTTTMKAMQPRKILFLVWATSFLNMAQPNPSPGFASIFYFGPNN

SEQ ID NO: 119031 - protein, 205 aa, Glycine max
  Coding DNA Sequence Number=SeqID_2253
  Homolog annotation: Hit_ID=Q2R3B9; Match level="QueryCoverage=85%, HitCoverage=16%, E-value=2e-28, Identity=40%"; Hit description =Expressed protein
VTGGLAAVVACFVFGLEGGNTRDREEPVEATVEAGEVVGGVVHAEGGDGGPGEEGGGGDGEAGEEEALQGDGDGRVFEEEPLEVQGGPDAEEEGGVSAEEGGQDSDGDGGVEGGKEGGGGGEEEGELGEDEGEPDGEEGGGLEVEGVEDVGDHEADEKGGDHGGATEVQEEEGGGEQGDGDPVVVGEGRRGFEGSGRRGVAMGVK

SEQ ID NO: 119032 - protein, 116 aa, Glycine max
  Coding DNA Sequence Number=SeqID_2254
  Homolog annotation: Hit_ID=Q2R353; Match level="QueryCoverage=62%, HitCoverage=17%, E-value=6e-16, Identity=60%"; Hit description =Expressed protein
MGRGWWWKVAVLAVVVAVVWRGWQVGGLEKESAFNFVREWSEKLGIWAIPLYVSLHTVSIALCLPSAIFFETAAPLLFGFLPSVFCVFSAKILAASLSFSIGRLYAFSWASLVQIF

SEQ ID NO: 119033 - protein, 47 aa, Glycine max
  Coding DNA Sequence Number=SeqID_2255
MKMARQVKKHMIEFKFHSNRICSRLSIIDLNNNKTGEVEMLAKAKEK

SEQ ID NO: 119034 - protein, 160 aa, Glycine max
  Coding DNA Sequence Number=SeqID_2256
  Gene Ontology: Mol. function=nutrient reservoir activity; Cellular component=apoplast
  Homolog annotation: Hit_ID=Q2R353; Match level="QueryCoverage=68%, HitCoverage=26%, E-value=5e-31, Identity=54%"; Hit description =Expressed protein
  Pfam annotation: Domain name=SNARE_assoc; Domain location=7-100; Score=38.3; E_value=2.6e-08; Accession=PF09335.1; Description=SNARE associated Golgi protein
MATYRFGTISNIFLLMRLVFRSSSSAMEWAQRNRYFHLISRGVERDGWKFVLLARFSPVPSYVINYTLAATDVRFLLDFFLPTAIGCLPMILQNTSIGSLAGAAVASASGSKKSQIWSYFFPVVEMLLHSVNARNRWLHWHLRGTTRPIRHYHVMGLNEA

SEQ ID NO: 119035 - protein, 85 aa, Glycine max
  Coding DNA Sequence Number=SeqID_2257
  Homolog annotation: Hit_ID=Q00M75; Match level="QueryCoverage=47%, HitCoverage=8%, E-value=1e-09, Identity=71%"; Hit description=PPR -repeat containing protein
MKPYISLGEREYSRRLYSDRQYFSTRGSSLCEGMGEGCCTQPYPCICKEAVSGFDPMTNKSPRHNFTAAPGLALISAQGNWPIFA

SEQ ID NO: 119036 - protein, 164 aa, Glycine max
  Coding DNA Sequence Number=SeqID_2258
MDEWKRDGHNIPAFGNWDFTDEFPITCYFECATPARLHNKPRPLRNHIKQETRNKERRCRHVNGNANKGKLYDVREQQRKPIRISKHVQVQQYDTVPRTPKPVDEDLYKIPPELLHTTNKRWSECLTLINSQGTCWWRLAVVKFLVVSIFLLESYTWHFGGIAH

SEQ ID NO: 119037 - protein, 619 aa, Glycine max
  Coding DNA Sequence Number=SeqID_2259
  Gene Ontology: Mol. function=protein serine/threonine kinase activity; Cellular component=membrane; Biological process=protein amino acid phosphorylation
  Homolog annotation: Hit_ID=Q1SAX1; Match level="QueryCoverage=55%, HitCoverage=57%, E-value=1e-130, Identity=67%"; Hit description =Protein kinase
  Pfam annotation: Domain name=Pkinase; Domain location=66-340; Score =88.7; E_value=1.8e-23; Accession=PF00069.15; Description=Protein kinase domain
  Pfam annotation: Domain name=Pkinase_Tyr; Domain location=66-340; Score=76.3; E_value=9.7e-20; Accession=PF07714.7; Description =Protein tyrosine kinase
  Pfam module annotation: Pfam domain module=Pkinase::Pkinase_Tyr; Domain location=66-340::66-340
MNCFPCCGPKKSNSKREHGSPPPELVTAKAQDMKKQKADEQNQAGTANIQAQAFSFRELATATKNFRQECLLDEGGFGRIYRGIIPATGQLVAVKQLDRNGMQSSNEFLAEVAELSLLHHENLVNLIGYCADGDQRLLVYDLFAARTLENRLFENKPDEGPLNWFDRMKIVVGASKGLEYLHETTNPPLIFRDLKASSILVDSDLLAKLCDVGMAKLSGGDKINNGPPRLMGTYGHCAPEYVRAGQLTMKSDVYSFGVVLLELITGRRAIDTTRPNEEQNLVAWATPLFRDPKRYPDMADPLLNKNFPEKDLNQVVAIASMCLQEEAEARPLISDVVNALSFLSAPPPPAAPVPKKSDVAESERESESESGSEAISSKGSRRSSVDESQHDSDSHLPPAVSSKPSRKSSTRSSKGALSSESGDEVSVSSSSKSSRKSHGDLSHKSSKKSSVKDLSQKSSKKSSVKDLSQKSSRKSSVEDLSQQKSSKKSSVEDLSQKSSRKSSTTKDLSQKSSRKSSIRDLSQKRSRKSSSKVLSHKSSMASDDGSISSSSCRSSSVGSERSSMRLSQGSFHSDPSYSSKRKEDESMHLLDRASSLRSDEDSGHPFDQTSSSGSSVYSR

SEQ ID NO: 119038 - protein, 443 aa, Glycine max
  Coding DNA Sequence Number=SeqID_2260
  Gene Ontology: Mol. function=ubiquitin-protein ligase activity; Cellular component=ubiquitin ligase complex; Biological process =protein ubiquitination
  Homolog annotation: Hit_ID=Q1SAW5; Match level="QueryCoverage=97%, HitCoverage=96%, E-value=1e-126, Identity=56%"; Hit description=U box
  Pfam annotation: Domain name=Arm; Domain location=227-269; Score =16.5; E_value=0.099; Accession=PF00514.13; Description=Armadillobeta- catenin-like repeat
  Pfam annotation: Domain name=Arm; Domain location=270-310; Score =21.2; E_value=0.0037; Accession=PF00514.13; Description =Armadillobeta-catenin-like repeat
  Pfam annotation: Domain name=Arm; Domain location=350-394; Score =19.6; E_value=0.012; Accession=PF00514.13; Description=Armadillobeta- catenin-like repeat
  Pfam annotation: Domain name=U-box; Domain location=59-133; Score =77.3; E_value=4.8e-20; Accession=PF04564.6; Description=U-box domain
  Pfam module annotation: Pfam domain module=Arm::Arm::Arm::U-box; Domain location=227-269::270-310::350-394::59-133
MVTEEKVHALKDKLRESVKIIVESDDYTVDAADEAMDALSALKDLKCTTSLSRNLDDAAVPPHFRCPLSGNLMTDPVILASGQNFDRAFIQRWLNEVRRICPKTQQVLSHSILTPNCFLQNMISLWCKEHGVELPKPVWDIHGEKLAEDHRLHMRSLLYKLSLSVSEQKEAAKELRQLTKRIPTFRTLFGDSEVIQLMLRPLSPGTASVDPELHEDLITTLLNLSIHDNNKRVLAEDEKVISLLIESLKYSGTVETRSNAAAAIFSMSAIDANRHIIGKSGVIKYLVDLLEEGHPPAMRDAASALFKLCYTHENKGRTVREGAVQVILGKIVDHVLVDELLALLALLSSHHMAVEALVNHGAVPFLLDILREKENTSEERIKENCVVILCTICFNDREKRREIGEDEMVNGTLYELAQRGNSRAQRKARAILESLHVSQSSTS

SEQ ID NO: 119039 - protein, 535 aa, Glycine max
  Coding DNA Sequence Number=SeqID_2261
  Gene Ontology: Mol. function=nucleic acid binding
  Homolog annotation: Hit_ID=Q5QLZ5; Match level="QueryCoverage=38%, HitCoverage=29%, E-value=7e-19, Identity=29%"; Hit description =Putative kinase-like protein splice variant 1
  Pfam annotation: Domain name=R3H; Domain location=248-306; Score =52.5; E_value=1.4e-12; Accession=PF01424.13; Description=R3H domain
  Subcellular localization annotation: CTP_CleavageSite=46; ConfidenceScore=5.75e-01
WAMSSLTLKGKPSDHAPVASVSSSARTPTSSNASPAVDAPSTAPVRVSSTPDFAEHLVPTSPTSTDGWGELENGLGENDKDGWDDLEPLEEIKPTPALVNIQAAQRRPVSQPVSQIKQASSLLSKSTPKLSKDEDGDLWGSIAAPAPKSSKPLSLKSTVTDDDDPWASIAAPAPTTKAKPLSAGRGRGAKLAAPKLGAQRINRTTSSGMEILRAAIVELFQGNKAMVEELAFLVKDNLPCKHLVLTMEEALVNFLQDDDTSSDGILELEPMNSYNRLLLHRLAEIFGFAHESVGEGDDRHLILERCPDTSIPPILVSDILWKYDEPQSLVTSHQILRRSVASPVSQKNTASLSQSLEERKAAYLIARERIFSMKLEEVKEPGEQKPRSVPVVARRMIAHALGQRIHTKNQNDLASDSMKDGVLTDELSAQDKNQEESTLKKVSEESSHLRGNSNNRIRNNSSNAATLNKRKDQTTVDKDLPQFSAERKQGLSVSKDYMKKEHLGAAKRMFAHALGVHSGKDGSVPRSRSGEIKKN

SEQ ID NO: 119040 - protein, 570 aa, Glycine max
  Coding DNA Sequence Number=SeqID_2262
MELEEAEDEEWYTTSSKYSFKNNAGNGCKVRRWLLKRGLCLGRKILVAGFLASAAPVVVPPLVVASAVGIVVSMPCAIFLASHACTQSLMSKLLPRPTPQDTLLREEMCFQTGNDVIHTYEEEQVLVYEIKRDIEMVGVQCLKNGENMTSGSECGPQEEDATDGIEGHSRGETNGVQVQLISGDKNVVVTMIEEFKTPFDVTTVVLEESEDQAMEGDIEEAELQRETKGLLEKIRDEARTDMTRERGEYVEGICGGANESDKKFGPAVEDMEVAWEDTHSGIVEEDLGKEQDPNVCEEMLHSRNDESKDTMLEGKVFDNTNDSHKPMAEPSELLIPAEPIGDLPIEALVYNISVEEDSSENIDIHIVAKEEQEPPPDCPTILQNEKLDNNNSDFENQESQLHELNKRTYPLDAEAIEIANEGEVDLFDGKRIDPDECGYTIYLHEALTSELMNMLAGSSKVDGQTDSTEVLVSSVEEESRPSECSSGENIVCPSQEVVVLDEEKIWKAMNIIRKIVGYEGRMQGSCSDELKALYIFTGVEPPTGTLDDPAEIKEKLHFLMSIVGIKSNDA

SEQ ID NO: 119041 - protein, 726 aa, Glycine max
  Coding DNA Sequence Number=SeqID_2263
  Gene Ontology: Mol. function=identical protein binding; Cellular component=cytoplasm; Biological process=negative regulation of enzyme activity
  Homolog annotation: Hit_ID=Q2HV71; Match level="QueryCoverage=99%, HitCoverage=95%, E-value=0.0, Identity=70%"; Hit description =Protease-associated PA; Proteinase inhibitor I9, subtilisin propeptide
  Pfam annotation: Domain name=PA; Domain location=331-423; Score=13.9; E_value=0.012; Accession=PF02225.12; Description=PA domain
  Pfam annotation: Domain name=Peptidase_S8; Domain location=85-564; Score=75.1; E_value=2.2e-19; Accession=PF00082.12; Description =Subtilase family
  Pfam annotation: Domain name=Subtilisin_N; Domain location=1-79; Score=52.0; E_value=2.1e-12; Accession=PF05922.7; Description =Subtilisin N-terminal Region
  Pfam module annotation: Pfam domain module=PA::Peptidase _S8::Subtilisin_N; Domain location=331-423::85-564::1-79
MDKSLMPQVFASHHDWYESTIHSINLATADDPSEQQKLVYTYDDAMHGFSAVLSSEELETLKNTHGFVTAYPDRSATIDTTHTFEFLSFNPSNGLWNASNFGEGVIVGMIDTGVWPESESFKDDGMSRNIPSKWKGTCEPGQDFNTSTCNFKLIGARYFNKGVKAANPNITIRMNSARDTRGHGSHTSSTVAGNYVNGASFFGYAKGVARGIAPRARLAMYKVLWDEGGHGSDVLAGMDQAIADGVDVISISLGFDSVPLYEDPVAIAAFAAMEKGVLVSSSAGNAGPILGTLHNGILWVLTVAAGTIDRTFGSLTLGDGKIIVGCTLFAANSIVEKFPLIYNKTVSACNSVKLLTGVATREIIICDALDSVSVLTQIASVTAASVYGAVFISEDPELIERRRLFTPSIVISPNDAKSVIKYAKSAQKPFASINFQQTFVGIKPAPAVAIYSSRGPSPSYPGILKPDVMAPGSNVLAAFVPNKPSARIGTNVFLSSDYNFLSGTCMACPHASGVAALLKAAHPDWSAAAIRSALVTTANPLDNTQNPIRDNANLFQYASPLAMGAGEIEPNRALDPGLIYDATPQNYVNLLCALGYTNNQILSITRSRSYECSANPSSDLNYPSFIVLYSNKTRSTVREFRRIVTNVGDGAATYKVKVTQPKGSVVKVSPETLAFGYKNEKQSYSVTVKYTRNKKENISFGDIVWVEDGGARTVRSPIVVAPNELA

SEQ ID NO: 119042 - protein, 303 aa, Glycine max
  Coding DNA Sequence Number=SeqID_2264
  Gene Ontology: Mol. function=sugar binding; Biological process =protein amino acid phosphorylation
  Homolog annotation: Hit_ID=Q9ZVQ6; Match level="QueryCoverage=95%, HitCoverage=94%, E-value=2e-58, Identity=41%"; Hit description =Putative phloem-specific lectin
  Pfam annotation: Domain name=F-box; Domain location=7-54; Score=40.7; E_value=5.1e-09; Accession=PF00646.23; Description=F-box domain
  Subcellular localization annotation: CTP_CleavageSite=44; ConfidenceScore=5.10e-01
MTQSVVVDFNNLPEGCIANILSFTSPRDVCRLSLLSSTFRSAAQSDAVWNKFLPSDFHTILSQSSSLSLPSKKDLFLYLCQKPLLIDDGKKSFQLDKVYGKKCYMLSARNLFIVWGDTPRYWRWTSLPDARFSEVAELRSVCWLEIRGWINTGMLSPETLYGAYLVFKPNPSGFYGFDYQLVEVSIGIAGGENRKRNVFLDAERGRRLRYQIVPRRAGTGIFNRARFLAPVEAPPVEDNDSLDLQHPKERADEWLEVELGEFFNDGQEDKELEMGVYEIKSGDWKGGLLVQGIEIRPKRTPIN

SEQ ID NO: 119043 - protein, 294 aa, Glycine max
  Coding DNA Sequence Number=SeqID_2265
  Gene Ontology: Mol. function=sugar binding; Biological process =protein amino acid phosphorylation
  Homolog annotation: Hit_ID=Q9FLU7; Match level="QueryCoverage=88%, HitCoverage=97%, E-value=4e-34, Identity=35%"; Hit description =Phloem-specific lectin-like protein
  Pfam annotation: Domain name=F-box; Domain location=28-75; Score =43.9; E_value=5.4e-10; Accession=PF00646.23; Description=F-box domain
MKPHISMFRLGDRIFFSPYGKQESSGTTTINLLPEGCISYILSYTTPVDACRLSLVSKAFRSAAQSDTLWDRFITSALSSLVSPSSFPSSHSKKHLYFALCDRPIIIHNGTKSIQLDKRTGKRCYTLSTRVHLIDSEWGLAPLQWEHIRLPNSRFQQFGVLVSAPEAWFDISGRIKALSLSPRTEYAAFLLFKMVYATPTEVHYHPWVLGYLVITLPDSSSVRTIDVCLLKNLQQHSCVRRSDGWLEFELVGFFDLGLEDDQVQIIKVTDTRPNSNWKHGFILEGIEIRPKHVY

SEQ ID NO: 119044 - protein, 330 aa, Glycine max
  Coding DNA Sequence Number=SeqID_2266
  Gene Ontology: Mol. function=protein kinase activity; Cellular component=cytoplasm; Biological process=protein amino acid phosphorylation
  Homolog annotation: Hit_ID=Q5QLZ5; Match level="QueryCoverage=80%, HitCoverage=32%, E-value=1e-112, Identity=79%"; Hit description =Putative kinase-like protein splice variant 1
  Pfam annotation: Domain name=HEAT; Domain location=105-141; Score =14.7; E_value=0.34; Accession=PF02985.12; Description=HEAT repeat
  Pfam annotation: Domain name=HEAT; Domain location=144-180; Score =14.3; E_value=0.45; Accession=PF02985.12; Description=HEAT repeat
  Pfam annotation: Domain name=HEAT; Domain location=223-259; Score =17.5; E_value=0.048; Accession=PF02985.12; Description=HEAT repeat
  Pfam annotation: Domain name=HEAT; Domain location=66-102; Score =13.4; E_value=0.82; Accession=PF02985.12; Description=HEAT repeat
  Pfam module annotation: Pfam domain module=HEAT::HEAT::HEAT::HEAT; Domain location=105-141::144-180::223-259::66-102
MEILSLKDSVEKDTFFRKLPNLAEQLPQQIVLKKLLPLLASALEFGSASAPALTALLKMGSSLSAEEFRVKVLPTIVKLFASNDRAIRVGLLQHIDQFGESLSAQVVDEQVYPHVATGFSDTSAFLRELTLKSMLILAPKLSQRTFSGSLLKHMSKLQVDEEPAIRTNTTILLGNIASHLNEGTRKRVLINAFTVRALRDTFPPARGAGIMALCATSSYYDITEIATRILPNVVVLTIDLDSDVRSKAFQAVDQFLQMAKQHYEKDCCHGHTAEDLPNTNTAEATEGTAIGISSLPGNAGATYKWRTGVAEDYRVRVDSNDQKLTVTTTY

SEQ ID NO: 119045 - protein, 67 aa, Glycine max
  Coding DNA Sequence Number=SeqID_2267
MEEVWWVTMVLVTTVGGDSRVMTMVVGYWLTITMEKSLEIASDDNVQDNAEVHMKESWRRNDSVENP

SEQ ID NO: 119046 - protein, 116 aa, Glycine max
  Coding DNA Sequence Number=SeqID_2268
  Subcellular localization annotation: CTP_CleavageSite=32; ConfidenceScore=5.05e-01
MTLLVIWAVLSTLLVDLTKHHAQEGRVRTRSRCNSVADGRRNRIFTSQMMELGKTLEQCEKCSIWVVRESIGAKGGGERMVARGEGGDGGGIKKKGKEEYGRGIENEKVYGAGDAS

SEQ ID NO: 119047 - protein, 283 aa, Glycine max
  Coding DNA Sequence Number=SeqID_2269
  Gene Ontology: Mol. function=hydrolase activity; Cellular component =nucleus; Biological process=carbohydrate metabolic process
  Homolog annotation: Hit_ID=Q0EAF2; Match level="QueryCoverage=91%, HitCoverage=80%, E-value=1e-150, Identity=95%"; Hit description =Catalytic subunit of protein phosphatase 1
  Pfam annotation: Domain name=Metallophos; Domain location=9-204; Score=139.7; E_value=7.8e-39; Accession=PF00149.18; Description =Calcineurin-like phosphoesterase
MIYFVTDSETSFQKGDVHGQYSDLLRLFEYGGLPPEANYLFLGDYVDRGKQSLETICLLLAYKIKYPENFFLLRGNHECASINRIYGFYDECKRRFNVRLWKTFTECFNCLPVAALIDEKILCMHGGLSPDLLNLDQIRNLQRPTDVPDTGLLCDLLWSDPSKEVQGWGMNDRGVSYTFGADKVSEFLQKHDLDLICRAHQVVEDGYEFFANRQLVTIFSAPNYCGEFDNAGAMMSVDETLMCSFQILKPADKKVKLNFGSTTTTKPGNSPAGVKVWRYLDIC

SEQ ID NO: 119048 - protein, 438 aa, Glycine max
  Coding DNA Sequence Number=SeqID_2270
  Gene Ontology: Mol. function=nucleic acid binding; Cellular component= nucleus
  Homolog annotation: Hit_ID=Q9SWF9; Match level="QueryCoverage=96%, HitCoverage=98%, E-value=0.0, Identity=80%"; Hit description=Zinc finger CCCH domain-containing protein ZFN-like
  Pfam annotation: Domain name=zf-CCCH; Domain location=125-151; Score =45.5; E_value=1.8e-10; Accession=PF00642.15; Description=Zinc finger C-x8-C-x5-C-x3-H type (and similar)
  Pfam annotation: Domain name=zf-CCCH; Domain location=286-312; Score =41.8; E_value=2.3e-09; Accession=PF00642.15; Description=Zinc finger C-x8-C-x5-C-x3-H type (and similar)
  Pfam annotation: Domain name=zf-CCCH; Domain location=344-370; Score =45.1; E_value=2.3e-10; Accession=PF00642.15; Description=Zinc finger C-x8-C-x5-C-x3-H type (and similar)
  Pfam annotation: Domain name=zf-CCCH; Domain location=38-64; Score =44.1; E_value=4.7e-10; Accession=PF00642.15; Description=Zinc finger C-x8-C-x5-C-x3-H type (and similar)
  Pfam annotation: Domain name=zf-CCCH; Domain location=83-105; Score =20.0; E_value=0.003; Accession=PF00642.15; Description=Zinc finger C- x8-C-x5-C-x3-H type (and similar)
  Pfam module annotation: Pfam domain module=zf-CCCH::zf-CCCH::zf -CCCH::zf-CCCH::zf-CCCH; Domain location=125-151::286-312::344 -370::38-64::83-105
METNNNLNLIVPNPQDSLWMMNLRTGETMDSGSYPERPGEPDCSYYIRTGLCRFGATCRFNHPPNRRLAIATARMIGEFPERIGQPECQARTCKFGATCKFHHPKDQAGIAGRVALNILGYPLRPNEPECTYYLRTGQCKFGNTCKFHHPQPSNMMLSLRGSPVYPTVHSPTTPGQESYAGGITNWSRGSYIPSPRWQGPSSYGPLILPQGVVSVPGWSAYSGQMGSISTSDSPQQAMRNGQTYETSHQGELANAGSQGAYSQFRSGTVPVGFYTLQRENIFPERPGQPECQFYVKTGDCKFGAVCQFHHPRERLIPAPDCVLSPIGLPLRLCNLIEAVSHFLQGEPLCVFYSRYGICKFGPSCKFDHPMEIFSYNITTSPSADAPSRHLLGSSSGTAALNLSSEGLVESSSAKPRPLSLSEIRQIPSGDDNIDDDVA

SEQ ID NO: 119049 - protein, 354 aa, Glycine max
  Coding DNA Sequence Number=SeqID_2271
  Homolog annotation: Hit_ID=Q5JLN0; Match level="QueryCoverage=82%, HitCoverage=71%, E-value=8e-87, Identity=50%"; Hit description =Lysine ketoglutarate reductase trans-splicing related 1-like
  Pfam annotation: Domain name=DUF707; Domain location=35-334; Score =392.7; E_value=5.6e-115; Accession=PF05212.3; Description=Protein of unknown function (DUF707)
IHVLPNFMQPKLSSWKMDTAVDADQNVIVDPVIDKCKNQCRPSGSEALPAGIVSITSNLELRPLWNPPMPKKGRHTIELKVNASTNLFAMVVGIKQKDLVNKMVKKFIDSNFVVMLFHYDGIVDEWKDLEWSSRVIHVSAIDQSKWWFAKRFLHPDIVAEYDYIFLWDEDLGVEHFHPDKYVSIIKREGLEISQPALDPKKSEVHHQITARGRRSSVHRRTYRASNDGKGCDKSSTAPPCTGWIEMMAPVFSRAAWRCVWYMIQGDRTKKVGVVDAEYIVHYNRPTLGGIDKTMVSSQEKDHRVDVRRLSYQELDIFRKRWEKAVEEDKLLDHGHDRESLEDLKDNMTPGIKLS

SEQ ID NO: 119050 - protein, 45 aa, Glycine max
  Coding DNA Sequence Number=SeqID_2272
MKQAICSATYEYYLSWDSCHEAKIPNIEKCLDVVTTLKAKKGTSE

SEQ ID NO: 119051 - protein, 113 aa, Glycine max
  Coding DNA Sequence Number=SeqID_2273
  Homolog annotation: Hit_ID=Q2HW10; Match level="QueryCoverage=90%, HitCoverage=58%, E-value=5e-23, Identity=60%"; Hit description =Wiscott-Aldrich syndrome, C-terminal
MGDRMERLVILPFSFGCVSEASIVVGSPHPRRSRSDTDSPTAATKGPKGDKDISESLSGESMRNLLRFHEDVQKSKTFLSFNRLLKGFKNIPQLFGEYKLNLKPFILSVIMYA

SEQ ID NO: 119052 - protein, 116 aa, Glycine max
  Coding DNA Sequence Number=SeqID_2274
MVKFPFDLNAKPDDEEEASAKVGGGSETKLSVSETADNIGPDNDLEVTPDNDVHPTHAADSGYDEDRASIVEGGSGTGNSRKRKRSFLEEYEKGTGKSFKMGEQQWQCDLRAKKRR

SEQ ID NO: 119053 - protein, 164 aa, Glycine max
  Coding DNA Sequence Number=SeqID_2275
  Homolog annotation: Hit_ID=Q47522; Match level="QueryCoverage=31%, HitCoverage=64%, E-value=4e-24, Identity=100%"; Hit description=LacZ protein
MLTIFVNYGLSIGHQERPQGYIARFPWNGYILRVLSRSRTKTFNSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 119054 - protein, 118 aa, Glycine max
  Coding DNA Sequence Number=SeqID_2276
VSIYDAPESDLRVKSYDHLNFSRASVVQFRASRYVMRLNRTSVVSIYDAPESDLRVKSYDHLNFLESFRCSISSVSICDVLELDLRVKSYDHLNFSRDSVVHFERLDILCACIGHPSE

SEQ ID NO: 119055 - protein, 277 aa, Glycine max
  Coding DNA Sequence Number=SeqID_2277
  Gene Ontology: Mol. function=DNA binding
  Homolog annotation: Hit_ID=Q8LAV4; Match level="QueryCoverage=99%, HitCoverage=100%, E-value=3e-48, Identity=39%"; Hit description =Putative DNA-binding protein
  Pfam annotation: Domain name=DUF296; Domain location=88-205; Score =184.8; E_value=2e-52; Accession=PF03479.5; Description=Domain of unknown function (DUF296)
MANRWWTGSVGLENSGDSMKKPDLGFSMNESAVTGNHTGEEEEKENSDEPREGAIDVSTTRRPRGRPPGSKNKPKPPIFVTRDSPNALRSHVMEIAAGADIADCVAQFARRLQRGVSILSGSGTVVNVTIRQPTAPGAVMALHGRFDILSLTGSFLPGPSPPGATGLTIYLAGGQGHVVGGGVVGPLLAAGPVLLMAATFSNATYERLPLEDDDQEHGGGGGSPPGITGGPGEASSSISVYNNNVPPNLGLSNGQHLNHEAYSSSPWVHSPHARPPF

SEQ ID NO: 119056 - protein, 399 aa, Glycine max
  Coding DNA Sequence Number=SeqID_2278
MADDLFEGLPPPSSNTLLPRQQQQLQPQPIVVATNINDTESSAVPAPKPILKSALKRPNPTQPDTQAAAPKKSLKFKTSTDASEAQVIEAMQKISSHIKNPAKFSKAAKLAIQLIQAGSVKSEISDYFFAILEAAMSSSITCTDPSVRADYHSLFSVAQNTKEHLNKKQKNQLATWTINAVVANDLYTDDSFVFSKAAGQIKEAISNLPVATEEEDAEEAKSLKDSTVIVDEGGKTPATDNDNDGEEAQADPFGLDALIPNSTKKGEKLKAKNEAAVKIREDEEETNRFLKSKREVLITCLEIAARRYKTPWCQTVIDILVKHAFDNVARFTARQRDAVGKLWASIREQQTRRKQGKSVNGKLDVNAFEWLQQKYAGEKISIRHSVGASGDRRAQQWLG

SEQ ID NO: 119057 - protein, 395 aa, Glycine max
  Coding DNA Sequence Number=SeqID_2279
  Homolog annotation: Hit_ID=Q7XDY9; Match level="QueryCoverage=85%, HitCoverage=82%, E-value=1e-54, Identity=38%"; Hit description =Expressed protein
  Subcellular localization annotation: CTP_CleavageSite=79; ConfidenceScore=5.51e-01
MLSLSCVTPKDLFHSTPSPSPHRRHFVKPISAVLNSSSFKKHQQPPPPQLQVYQPFRPPPAPLPSQFGTLDIAGRIDVLANRLALWYEYAPLIASLIREGFSPPTIEETTGISGVEQNRLIVGAQVRDSLVQSNADPDLLAAFETGGAELLYEIRLLSASPPHASSLRIGATGRPRRSSHSKEHRNPSEQRTSALEQALRVAETEAARNVILEELEGKGEEGDTVGEGEAAARVPVVRLRIGEVAEASSVVLLPVSAAEEREILEAPFESRSQGEFGVVVAEKGWGKWVVLPSWDPVVGLGKGGVVVSFPDARVLPWKVNRWYKEEPILVVANRSNREVGADHGFYLVNSDAEGLKVQRGFALKEKGFTQSLGTVLLVVRPPKEENDELSDEDWE

SEQ ID NO: 119058 - protein, 141 aa, Glycine max
  Coding DNA Sequence Number=SeqID_2280
  Homolog annotation: Hit_ID=Q0EAF2; Match level="QueryCoverage=40%, HitCoverage=17%, E-value=7e-22, Identity=87%"; Hit description =Catalytic subunit of protein phosphatase 1
MVGCDARVKTTITSSKKKKKAEITANLNGCFKLQQIRLLQENLSGSGTELADLRLRQLHLLARAAANFEKAVDYVVHKSLSKGSEQRIACLDDQTAVVLLAEGNRLRVTAWGDCENWFEFGEGKRGKVGIGLRRGIDDFDY

SEQ ID NO: 119059 - protein, 319 aa, Glycine max
  Coding DNA Sequence Number=SeqID_2281
  Gene Ontology: Mol. function=nucleic acid binding; Biological process= RNA-dependent DNA replication
  Homolog annotation: Hit_ID=Q1SLA4; Match level="QueryCoverage=68%, HitCoverage=40%, E-value=2e-66, Identity=55%"; Hit description=Zinc finger, CCHC-type; Lipocalin
MVLTLVKNHLMVDGGGGGDDSTKILSFKDMCLTGKVPQITRLTMDLIEQKLAKIEFEDGNPLKPTVIIDDSMFEGLYALWQEALVIKLIGKSIGFHVMKERLTRIWKLNAGFEILDIDHGYYMVTFDQEAYRVKLIGEEPWMIFDNYLIVELWTPDFISPVASINKTMVWIRFPGLNNLVYYDETILLALASAIGKPVKVDINPKDVRRGRFARVCIEVNLTKPVVGRVWLKDLWYHVEYEGSARWNQQWKKNNNTQGVNNDGAGQFQPPIMVETTIRGKMPPILEEVRETMNVTPTVMNDLNKNRIWQLQIPLFMENG

SEQ ID NO: 119060 - protein, 35 aa, Glycine max
  Coding DNA Sequence Number=SeqID_2282
MDESSYMILAKVAEAKQLASLLSELWACVLIPVES

SEQ ID NO: 119061 - protein, 611 aa, Glycine max
  Coding DNA Sequence Number=SeqID_2283
  Gene Ontology: Mol. function=two-component sensor activity; Cellular component=membrane; Biological process=signal transduction
  Homolog annotation: Hit_ID=Q8W229; Match level="QueryCoverage=93%, HitCoverage=98%, E-value=0.0, Identity=63%"; Hit description =Putative ethylene receptor
  Pfam annotation: Domain name=GAF; Domain location=191-340; Score =52.4; E_value=1.5e-12; Accession=PF01590.16; Description=GAF domain
  Pfam annotation: Domain name=HisKA; Domain location=376-441; Score =35.5; E_value=1.8e-07; Accession=PF00512.15; Description=His Kinase A (phosphoacceptor) domain
  Pfam module annotation: Pfam domain module=GAF::HisKA; Domain location=191-340::376-441
MEITPPPLLLLFLLLLFFLCYLVLCASATDVDFDNCNCDDGEGIWSIHSILVGQKVSDFFIAVAYFSIPIELLYFVSRSNVPFKLLFLQFIAFIVLCGMTHLLNAYSYHGPPSFQLLLSLTVAKFLTALVSCATALTLPPLIPLLLKIKVRELFLRQNVMELGQEVGMMKKQKEASWHVRMLTREIRKSLDKHNILYTTLVELSKALDLHNCAVWMPNEDRREMHLTHELKTNSAKNFQNSIPVNDPDVLEIRKTKGVKILRPDSAIGAASSGGSAELGAVAAIRMPLLHVSNFKGGTPQLVETCYAILVLVLPSSSTRVWTYHEMEIVEVVADQVAVALSHASVLEESQQMRQKLEERNRALQQAKKNAMMASQARKSFQEVMSHGMRRPMHSILGMLSLFQEDNLRSEQKIIGDTMLKVGHVLSSLINDVMEISENEKGGFRLEMKPFLLHSMMREAASIAKCLCVYEGFGFEIDVQKSLPETVMGDEARTFQVILHMIGYLLNMNDKGTLNFRVFLESDGGDRDDKNIGIWRSSSQNEYVHIKFDFQITESSQSDKAISTIHYSSRRQYYNNEPKEGLSFSMCKKLVQDTFPLLSSEFMRSSINCINC

SEQ ID NO: 119062 - protein, 59 aa, Glycine max
  Coding DNA Sequence Number=SeqID_2284
MTMLRFEPDKQVGFREYMRSDGTRSYFFCLDTVRSLFLGAGFTEVDLCSCIQFNTCAPA

SEQ ID NO: 119063 - protein, 405 aa, Glycine max
  Coding DNA Sequence Number=SeqID_2285
  Gene Ontology: Mol. function=RNA-directed DNA polymerase activity; Biological process=RNA-dependent DNA replication
  Homolog annotation: Hit_ID=Q1RXD8; Match level="QueryCoverage=95%, HitCoverage=64%, E-value=9e-26, Identity=31%"; Hit description=RNA -directed DNA polymerase
MEIKEAAWEYGNQKCPGPNGLNWKFIKQFGNLLKDDVKRFLDEFHQNGVLPRGTNSSFITFIPKIDDPLELCDFKPISLVGPSSEFGMQQGLRQGDPLAHFLYVVVAERLSGLMREAVSKNLFASYLVGKNKSRFGMLGVERSEGVKFARVLNCNLLALPFTYLGIPIGANPRRVETWKSVIDKFRKKLAPWKYKTLSFVRRICLINLEKGGKFVGLFGKKIVVQMSMEVIDSKYKGWRGLVKGESEKISSMWWKDLCLSCGEGDVSSWVNRSFVWKLGEGDQARFWLDNWGSEECFASKFQRLFGLSLQQFEMEQLRELMRMVEDMRIVRGIKDNWVWVEDGSGIFNVKSAYRTIHDDMVGSQISPPMKSVWSLKTVLPSSPKIHYWQHCHHLQRQIEKEIQAV

SEQ ID NO: 119064 - protein, 185 aa, Glycine max
  Coding DNA Sequence Number=SeqID_2286
  Gene Ontology: Mol. function=RNA binding; Cellular component=exosome (RNase complex); Biological process=rRNA processing
  Homolog annotation: Hit_ID=Q9FMB3; Match level="QueryCoverage=51%, HitCoverage=66%, E-value=4e-32, Identity=71%"; Hit description =Arabidopsis thaliana genomic DNA, chromosome 5, TAC clone:K15E6
  Subcellular localization annotation: CTP_CleavageSite=70; ConfidenceScore=5.16e-01
MVTPFTPSDPRLTVEVTGHKSHGPVPQPGSVVIARVTKVMARSASADIMCVGPKSVREKFTGIIRQQDVRATEIDKVDMHLSFHPGDIVRALVLSLGDARAYFLSTAKNELGVVSAESIAASAEIKSNSYIISCTVSSAEHLSDRDFHQCWAILKWCNYDPVSWTEMQCPLTGQIEQRKVAKAAS

SEQ ID NO: 119065 - protein, 112 aa, Glycine max
  Coding DNA Sequence Number=SeqID_2287
  Homolog annotation: Hit_ID=Q1SXD5; Match level="QueryCoverage=82%, HitCoverage=86%, E-value=1e-39, Identity=77%"; Hit description=Cupin, RmlC-type
  Pfam annotation: Domain name=Cupin_3; Domain location=26-100; Score =110.4; E_value=5.3e-30; Accession=PF05899.3; Description=Protein of unknown function (DUF861)
MASTSTPGSSSELTITVEHNPSKSRLSELGINWWPKWGCPPGKFMLKFDAQETCYLLRGKVKVYPKGSSEFVQFGAGDLVTIPKGLSCTWDVSIAVDKHYKFESSSTTPSPE

SEQ ID NO: 119066 - protein, 288 aa, Glycine max
  Coding DNA Sequence Number=SeqID_2288
  Gene Ontology: Mol. function=ammonium transporter activity; Cellular component=membrane; Biological process=transport
  Homolog annotation: Hit_ID=Q6F5D8; Match level="QueryCoverage=71%, HitCoverage=56%, E-value=4e-45, Identity=69%"; Hit description =Putative ammonium transporter
  Pfam annotation: Domain name=Ammonium_transp; Domain location=1-250; Score=-35.0; E_value=1.2e-09; Accession=PF00909.11; Description =Ammonium Transporter Family
MGASPSGDYSFFLYQWAFAIAAAGITSGTIAERTQFVAYLIYSSFLTGLVYPIVSHWFWSSDGWASAARSNGNVLFGSGVIDFAGSGVVHMGGQLSRRHWLGALRLLVGHWNAIDVCNGLLDGFAAITSGCAVVEPWAAIVCGFEAAWVLIGLNKLAAKVEYDDPLEAAQLHGGCGAWGVFFTRLFAKRVYMEEICGVGRPFGALMGGAGDSDIGGVRVGHGDHGGVVQKMNLLRISRDEIGEGIVLSTLVAAFTVTTWTRRSIEHGRGNPNWRRGTGRSKNMMKLEK

SEQ ID NO: 119067 - protein, 134 aa, Glycine max
  Coding DNA Sequence Number=SeqID_2289
MIAAGRVLTASSTSAVIVEEPKEEARVLKVCNYSVSGIGKFYFGELQVEVTPDKANIGAVIGFLFGILCWQIARGVQNVPDSSLQYANDNALLLAKSLKGALLAIFYSSTFLSAFTSVGLVLLGLQLKSKKNKD

SEQ ID NO: 119068 - protein, 414 aa, Glycine max
  Coding DNA Sequence Number=SeqID_2290
  Gene Ontology: Mol. function=ubiquitin thiolesterase activity; Cellular component=intracellular; Biological process=ubiquitin -dependent protein catabolic process
  Homolog annotation: Hit_ID=Q6Z1P7; Match level="QueryCoverage=85%, HitCoverage=85%, E-value=1e-122, Identity=56%"; Hit description =Carboxyl-terminal peptidase-like
  Pfam annotation: Domain name=DUF239; Domain location=205-384; Score =347.2; E_value=2.7e-101; Accession=PF03080.5; Description =Arabidopsis proteins of unknown function
MGIIIGRKRRCSCSTPREDHHLLLLTFFVAILLQRAVVESSTLNYTRHRHTSTLRLERISKHLNKINKPPVLTIESPDGDLIDCVHKRKQLALDHPLLKNHKIQKMPTEMPKGMKVMRVEDDMEKVRVREKAWQMWHLNGTRCPKGTVPIRRSTVHDVMRAKSLYDFGKKRSRVDSLSRRNDAPDILSGNGHEHAIAYTGSSQEMYGAKATINVWDPSIQVINEFSLSQLWILSGSFDGTDLNSIEAGWQSDSYRATGCYNLLCAGFIQTNSRIAIGAAISPVSSYDGNQYDITILIWKDPKVGNWWMSFGDNTLVGYWPAELFTHLADHATMVEWGGEVVNSRTNGQHTFTQMGSGHFAEDGFGKASYFRNLQTVDTDNNLSSVQGISTLAENTNCYDIKSYYSNEWGTYFYY

SEQ ID NO: 119069 - protein, 86 aa, Glycine max
  Coding DNA Sequence Number=SeqID_2291
  Gene Ontology: Mol. function=ribonuclease H activity; Biological process=DNA integration
MGEMCEEFKIQHHNSTPYRPKMNGAVDVANKNIKKIIQKMTVSYKDWHKMLPFVLHDAQGRVRAGTRLVVSRSSSRNWLCMLRRPY

SEQ ID NO: 119070 - protein, 73 aa, Glycine max
  Coding DNA Sequence Number=SeqID_2292
MEEWQCNHALSVAMSGLCENDSDHALSIESSLNMSLGFLMGLLRAKRELTVKRGDALDMSCALSELSKSLTFL

SEQ ID NO: 119071 - protein, 67 aa, Glycine max
  Coding DNA Sequence Number=SeqID_2293
MQTNDVQAPLFPFIASCKQNVEFEGSSQNGRKQGTDETATAKNSASYIGKRLLESLVAVAGLLIWLS

SEQ ID NO: 119072 - protein, 225 aa, Glycine max
  Coding DNA Sequence Number=SeqID_2294
  Homolog annotation: Hit_ID=Q946Z2; Match level="QueryCoverage=30%, HitCoverage=13%, E-value=1e-22, Identity=72%"; Hit description =Putative acyl-CoA synthetase
  Pfam annotation: Domain name=Tryp_alpha_amyl; Domain location=34-111; Score=25.0; E_value=0.00026; Accession=PF00234.12; Description =Protease inhibitorseed storageLTP f
MDSNACLPHLLVLAITLVLVSHAMGDSAQDKQRCAESLTGVATCLPYLGADAKAPTADCCSGLTQAMKANKKCVCLILKDRDDPDLGLNINMTIAVGLPSLCKTPDNLSQCSGTWHIGDAIWESKFCLTQMCNMYMKVNPNRIEDLWHLTFITFCPQRSHSNHLYCAVIPREGSNIDDAEVLRYCKKNLASFKVPEKVFITDSLPKTATGKILRRLVAEHIVSQI

SEQ ID NO: 119073 - protein, 268 aa, Glycine max
  Coding DNA Sequence Number=SeqID_2295
  Gene Ontology: Mol. function=protein binding; Cellular component =integral to membrane; Biological process=protein amino acid phosphorylation
  Homolog annotation: Hit_ID=Q1SWI6; Match level="QueryCoverage=81%, HitCoverage=87%, E-value=5e-39, Identity=45%"; Hit description =Leucine-rich repeat, plant specific
  Pfam annotation: Domain name=LRRNT_2; Domain location=26-66; Score =49.3; E_value=1.3e-11; Accession=PF08263.3; Description=Leucine rich repeat N-terminal domain
  Pfam annotation: Domain name=LRR_1; Domain location=119-144; Score =9.7; E_value=4.4; Accession=PF00560.23; Description=Leucine Rich Repeat
  Pfam annotation: Domain name=LRR_1; Domain location=146-168; Score =14.2; E_value=0.48; Accession=PF00560.23; Description=Leucine Rich Repeat
  Pfam annotation: Domain name=LRR_1; Domain location=193-218; Score =11.1; E_value=2.3; Accession=PF00560.23; Description=Leucine Rich Repeat
  Pfam annotation: Domain name=LRR_1; Domain location=220-242; Score =14.5; E_value=0.38; Accession=PF00560.23; Description=Leucine Rich Repeat
  Pfam module annotation: Pfam domain module=LRRNT_2::LRR_1::LRR_1::LRR_ 1::LRR_1; Domain location=26-66::119-144::146-168::193-218::220-242
MNSSIYILVFVQLWLLSLPCRESVCIPSERETLLKFKNNLIDPSNRLWSWNHNHTNCCHWYGVLCHNVTSHLLQLHLHTSDSAFEYEYYHGFYRRFDLEAYRRWIFGGEISPCLADLKHLNYLDLSGNEFLGKGMAIPSFLGTMTSLTHLNLSYTGFWGKIPPQIGNLSNLVYLALRDVDNGTVPSQIGNLSKLRYLDLSDNYFLGEGMAIPSFLCAMTSLTHLDLSYTRFMGKIPSQIGNLSNLVYLGLGGYSVVEPLLAENVEWVS

SEQ ID NO: 119074 - protein, 99 aa, Glycine max
  Coding DNA Sequence Number=SeqID_2296
MALGGFGCWVYHPTMETDWDLQAVRIISKAPLLFCSLLNVQALGLGIFKKLMGKKMHAVSRCLTDIDTWQSTSLLNGQRPIEASGINIAGFYKTEGPNL

SEQ ID NO: 119075 - protein, 309 aa, Glycine max
  Coding DNA Sequence Number=SeqID_2297
RGGGNLPAYSRFSQLRPNPQELAARLCIPGKGFELNVDGNADGLPLKILRKNLTTLAQTWSVLSFSNLVPTSHTSDITLDKARLIYGIIQKMDTNLGHIISCEISLIAQHNSSRLGFPTLITDLCKARGVTSDSLTFESLSPAINVAYVKKNCWNLDDLAVTFKGPCKAKGKMSEAPSSSDIPLILALSTSTSPLVPAPPTGPSSITSKTLFAMLQSLHKGQASATQEPEPVEDDVPPESFIIETDPVPREEVAAQEPSSPIPVSPAPVIDDSHPSALALEPEQPIVQDPPAAPVLDLNEHAEDHPQED

SEQ ID NO: 119076 - protein, 90 aa, Glycine max
  Coding DNA Sequence Number=SeqID_2298
MPRRLNPFLLHSSPIYSKIGEELATQLAQASKVASFRSNNLLEEGSGRPKWARLLFLSKKLRKLTDCAKTPLFNFRHITEFHGSRKPASF

SEQ ID NO: 119077 - protein, 89 aa, Glycine max
  Coding DNA Sequence Number=SeqID_2299
MLTEQLIDSTRFHEKNRLSHGILADNGGRKTATMLASGHVYKQVLNKAIEDAQRKANTHAVLEFDQLDTIFGPGNNKPVKGSTHWRFHD

SEQ ID NO: 119078 - protein, 94 aa, Glycine max
  Coding DNA Sequence Number=SeqID_2300
  Gene Ontology: Mol. function=zinc ion binding
MHQFLPGMVVEKETQPMPPQGGQEVEDFMMCHRLFWSFKPCINGFQYCRPVVQVDGIWLYGPREHYKTPMEHISFAHFCHLEGQIELGSQNLCT

SEQ ID NO: 119079 - protein, 163 aa, Glycine max
  Coding DNA Sequence Number=SeqID_2301
MGTRGCINYNLVIAIRQLGYPMRGAPLEEDLTPFIARGFNSSNAGVLQRVCKAWGMVQKKDEELMGSSNGPIGGYHKWLKAYAQGLDWLPNLRAIKEVEVEAPEEDEEVQALRTELEKARAIKEKFKSTAVRIRKENAELRDVNITTTMVVKLAILRRIVEVP

SEQ ID NO: 119080 - protein, 118 aa, Glycine max
  Coding DNA Sequence Number=SeqID_2302
MVIPKFKALDFDKYKGTTCPKNHLKMYCRKMGAYAKDEELLIHFFQESLTGVAATWDLAAQVAPPMMERELIIVMVDTLPVFSYEKMVGYTPLSFVDLVFAGERIEVGLKRGKSDHPA

SEQ ID NO: 119081 - protein, 106 aa, Glycine max
  Coding DNA Sequence Number=SeqID_2303
DAATELVQKGAQVFQKVHPKVEGYGNSSSAPKRELITMIVDALSVSYYEKMVDYMPSRFADLVFAGERIEVGLRRGKFDCLALTNKKPGTNGEKENEEGTHVEGCC

SEQ ID NO: 119082 - protein, 80 aa, Glycine max
  Coding DNA Sequence Number=SeqID_2304
MGATDIIIEKQIIKSNCSVCFKACILLSTIKKHEFKILVIGHPAGSPDPECPPHLSNVAQEWLEEWSSVPGLVWQGPLES

SEQ ID NO: 119083 - protein, 131 aa, Glycine max
  Coding DNA Sequence Number=SeqID_2305
MKVYKEKFFGKWQWMSSFCEHKNETKRKRKEDLEESASFPPKQRTAESPQGRANRMLKPDFPKKGMEKEKIKRKKRKNEKKEKEKMKERKRRIPDRRSEGSKKEIGGKQNNSRSMKEREQKIFRPDKFSIR

SEQ ID NO: 119084 - protein, 77 aa, Glycine max
  Coding DNA Sequence Number=SeqID_2306
SVTPNKVIRPPINQAFIKKYCAPQAGAGRDTTAAWGWPAVGNRRTAATSRAPQLIYKGWSVAYDPWPTSRRPSPKPK

SEQ ID NO: 119085 - protein, 109 aa, Glycine max
  Coding DNA Sequence Number=SeqID_2307
MELRLQVTTCGGARSMGTEGSKHKNGSKFVATETAWSEAKRRKTSESEETEYVTYRIAMLCFCGMRVWCGVLHPNLSPQWVYEYEREREREKWCRCPTGKRLRPLRSAT

SEQ ID NO: 119086 - protein, 90 aa, Glycine max
  Coding DNA Sequence Number=SeqID_2308
  Gene Ontology: Mol. function=oxidoreductase activity
MYLCYVFTNLPVIVILDLTEQDYNDFDYNMIKDMHVVSCFIKEWGDIVIMLKDDTKVDLRSFPKFREIAKYCLAMAQKPFILIETRPKAF

SEQ ID NO: 119087 - protein, 107 aa, Glycine max
  Coding DNA Sequence Number=SeqID_2309
  Gene Ontology: Mol. function=transition metal ion binding
  Pfam annotation: Domain name=Transposase_21; Domain location=8-107; Score=-99.7; E_value=4.3e-06; Accession=PF02992.5; Description =Transposase family tnp2
MASYGDAIDLQEAKYSIDEEDPRPTSSTWSYIRYRNETFKLRAKLFCIINDFPAYGNLSGYSVKVHLACTICEEDISYVQLKHGRKIVYTQHRHFLKAYHPYCGVLK

SEQ ID NO: 119088 - protein, 182 aa, Glycine max
  Coding DNA Sequence Number=SeqID_2310
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=6e-21, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLSHKDGPLGTSTLTFGGLHVLPSKGLHVLTFRGLYVLAFIGLHALTFRGLHVLPFRGLHALALKGLHVLAIRGLHVLHFRGLHILHFRGLHILAFRGLHAFRGLHVLAVRGLHVLTFRGLRALAFRGLHVLAIRGLHALHFRGLHILHFRGLHVLAFRGLHVLAFSRLHIRTLREFRVLCP

SEQ ID NO: 119089 - protein, 449 aa, Glycine max
  Coding DNA Sequence Number=SeqID_2311
  Gene Ontology: Mol. function=protein-N(PI)-phosphohistidine-sugar phosphotransferase activity; Cellular component=membrane; Biological process=phosphoenolpyruvate-dependent sugar phosphotransferase system
  Homolog annotation: Hit_ID=UPI00005FA75B; Match level="QueryCoverage =99%, HitCoverage=86%, E-value=0.0, Identity=79%"; Hit description =COG1263: Phosphotransferase system IIC components, glucose/maltose/N- acetylglucosamine-specific
AAKSIYRDGQRGRHRVRQPGGPDRSRRGGGVDQKRQGHGGAGLDDRLPGDERHHQCAVENQRHAGRAERRRGGAGNDSRDPDAGDRGVRRGGHRSGDLVSARPLQQDSAAAVPGFFRRLALCADRQLAGGDGGRCPDDRGVAAFPTADLRHGRAGGRQRLSRHLYLRLRAAHARAVRPASHLLPAVLDYRARRQRSDQRTAGGRHAAHFLRPVGRPEYAAVLHRHGALHVRPLYHHDVRPGRRLPGDVPKRAPGEPQTRRRAAAVGGADLFPDRHHRTYRILVPVHRAGAVRGARAVRRPGVRDRAHSAYHHRPDVLRRFYRFHAVRRAAGRSENPLDVSAAGRGALVHPVILHVPFPDRALQFQNAGARGGNRAGSVDDRHRTLAAGAGGAGRQREYRRTGLLRHAAARDGKTEPVAGRKRDEGQRRAGGDRSRQRRSGDLWPARDHY

SEQ ID NO: 119090 - protein, 176 aa, Glycine max
  Coding DNA Sequence Number=SeqID_2312
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=25%, E-value=9e-88, Identity=92%"; Hit description=DNA -directed RNA polymerase beta' chain
  Pfam annotation: Domain name=RNA_pol_Rpb1_1; Domain location=5-162; Score=-105.4; E_value=1.2e-05; Accession=PF04997.3; Description=RNA polymerase Rpb1, domain 1
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIV

SEQ ID NO: 119091 - protein, 81 aa, Glycine max
  Coding DNA Sequence Number=SeqID_2313
MDRKKKFFSVVHLLSAALALSAMSSRAKPELAHAKRFDPSPRKRYAKPGTITAKRKLQDQLELQTALSACPCAKPEYLSGI

SEQ ID NO: 119092 - protein, 99 aa, Glycine max
  Coding DNA Sequence Number=SeqID_2314
MASRKRKAPASTSQACYDRSRFTSQEVWDRYYSVVIGRKILPERNVMLYYREFDEFTKELERRKWHKELTNFMDGSIDVAIVKEFYANLYDPEDKSPKQ

SEQ ID NO: 119093 - protein, 76 aa, Glycine max
  Coding DNA Sequence Number=SeqID_2315
MNALSALAAFSQFIATVKFLYFQMIALNLTVLCYVFILLMSFNDELAKHVCALSETTLSLASQAKRNYVFVFQLLE

SEQ ID NO: 119094 - protein, 217 aa, Glycine max
  Coding DNA Sequence Number=SeqID_2316
MEAMMSMKKIMEANVVADTATSAVAKVNPMPPSSLNQMNHPTLVMVGKDLGSTSGPYYVQIQNKHAFPPYGLPPNYTPPSVAYIPSEPCLGYATEGQAVGGIPLQNPLEGPQCHPQPQPSHSTAVKNPHAMAEKGKLDHLEERLRAIEGGEDYAFPNLEELFLVPNIITPPKFKVLDFDKYKGTTCPKNHLKMYYRKMGACAKDKELLIHSFQESLT

SEQ ID NO: 119095 - protein, 114 aa, Glycine max
  Coding DNA Sequence Number=SeqID_2317
GSGVHTTRRFIRNSSPGPVVELDPRPTPIEIFPCAVQVNFALEGIPGSSELQPEEVGSGINFLSQTSLIGETSTKALIRRILVCKAFDLKGASVGETVPVAKVKPVHSFMAIGL

SEQ ID NO: 119096 - protein, 166 aa, Glycine max
  Coding DNA Sequence Number=SeqID_2318
MANENVNDIPDNESTGSNDDDAVTSPTTECQICSNPIPRNPNKQTSSKHPLQGPKPPTLVSPPPQSLSINPNNSFARVIPSRSQPINANRTHADVVRSTPPPKTSRTTPQDPTLAALWMNSNAARGCATSQAAALWTFDDAAENGEILHHRFHPYLRPVGQQAPRT

SEQ ID NO: 119097 - protein, 128 aa, Glycine max
  Coding DNA Sequence Number=SeqID_2319
MKKKTYSNIYKEEWTQSWPMGSKIYPKVHENPKAFFISSSPILLEPLAHGSGNWSFPREDCITRDQGSGNRLPDSQRHFKKYCRQRIKLNVLMMPKVHMRLKALFKTKKLKIFKMDDQDKSLVLERVY

SEQ ID NO: 119098 - protein, 292 aa, Glycine max
  Coding DNA Sequence Number=SeqID_2320
  Homolog annotation: Hit_ID=Q7WDM7; Match level="QueryCoverage=45%, HitCoverage=37%, E-value=2e-47, Identity=73%"; Hit description =Putative exported protein
RHQPGAGLRLVRAHALAGQVLERLDLAAVEILAPHDDVGVGQLAVEAEHQDGRLAGQRQGRRGGGRGGAEDDLAGRQQLVGARAALRIQVFDLQPRFAEIALFERHVAGREERVDAALPVDHAAQLGLGEGDTAADQGDAGQRPGSGQHAAAGGEVGARAHVFLGLDRVWLFGVNNTAAAPDVQQWKTPGCPGVLVVPRKCRPWRLMPRSSWARPSSRLSWRRSWSPSWWPFSWRSWWRSSSPRPSWPAPSSPPSWWRRRRSWPGHGRGRVSPDAVRTRSRSCRRAGAPGKP

SEQ ID NO: 119099 - protein, 50 aa, Glycine max
  Coding DNA Sequence Number=SeqID_2321
MTTLTQIIDDIATLATFCPATAMPISPCKSISWSVSSRHGDRTHKDTQWT

SEQ ID NO: 119100 - protein, 93 aa, Glycine max
  Coding DNA Sequence Number=SeqID_2322
PTEARNQSWKPHVPVGLLQVHWVSLWGEIGIAVAGQNVAKVAMSSIICVRVVMLVRMIRTRLFAAARVKSCPVGPPPISGGGPGTAKRKLLAP

SEQ ID NO: 119101 - protein, 189 aa, Glycine max
  Coding DNA Sequence Number=SeqID_2323
  Gene Ontology: Mol. function=chitin binding; Cellular component =extracellular region; Biological process=chitin metabolic process
  Homolog annotation: Hit_ID=UPI0000612705; Match level="QueryCoverage =94%, HitCoverage=96%, E-value=2e-16, Identity=30%"; Hit description =UPI0000612705 related cluster
GYTPSPWVLVTLTVRGLRVLTLRGLHVLTIRGLHALTSRGLHVLALRGLRALTLGTSYPHCQRTTCPRLERTTRPHLRRATHPHLERTTRPRHQRAARAHLQRTACPHLRRATRPHLWRTTRPRQQRAARPHLERTTRPRQQRVACPHLERTTRPRQQRAARPHLEEDYTSSPTEGCTPSPPEDYTSSP

SEQ ID NO: 119102 - protein, 158 aa, Glycine max
  Coding DNA Sequence Number=SeqID_2324
MSKEKMVMQFPKRKGITETPPAPLPPLLPKHHKPVPKVVVLPPPPSLKRTKKSTPKRVPLPPPLKPCNHPYYYPTLRKRPPQVTLDLLSSMVAGGMVPVQVRRENPPSNETLKAWASSLRLGDGRKQIVDLSLKLRVVKPRVSGVRFNRSEPKRSKKI

SEQ ID NO: 119103 - protein, 120 aa, Glycine max
  Coding DNA Sequence Number=SeqID_2325
  Gene Ontology: Mol. function=chorismate mutase activity; Biological process=aromatic amino acid family biosynthetic process
  Homolog annotation: Hit_ID=Q1SZ86; Match level="QueryCoverage=99%, HitCoverage=33%, E-value=6e-19, Identity=40%"; Hit description =Chorismate mutase
RARFPLNSPTYNQSYASIPQFRGTLLDFLVRDTEVIQAKTSEADMATSVVMEISKTLAEADAGRYTNLEENPFFPENLPPSVEPHYPFSQFLHPSAAMININNVIWKLYIDELLPIFVAS

SEQ ID NO: 119104 - protein, 183 aa, Glycine max
  Coding DNA Sequence Number=SeqID_2326
  Homolog annotation: Hit_ID=Q5PLM9; Match level="QueryCoverage=48%, HitCoverage=49%, E-value=3e-16, Identity=73%"; Hit description =Putative inner membrane protein
MTHTAAVNSSAHSRVSPLLSPFNAARLDAYHIGVGDEANHQHQRQQHFAADLLHLNQRREQINHHNGKEKPQIRDIPFEQADAMRMGNVPGGTVNHYYHQACYAAQAVEKNGDEIFRICPGGAAAGRLQPDTCSTRSKSAKSTYYAANYAEYGKIMQGSGGVTLQHRHPSRRRQSFRAVPGKL

SEQ ID NO: 119105 - protein, 93 aa, Glycine max
  Coding DNA Sequence Number=SeqID_2327
  Gene Ontology: Mol. function=transferase activity, transferring groups other than amino-acyl groups; Cellular component=integral to membrane
  Homolog annotation: Hit_ID=Q5PLM9; Match level="QueryCoverage=99%, HitCoverage=28%, E-value=1e-28, Identity=65%"; Hit description =Putative inner membrane protein
MLLALMLVIGLIANPNMVSIKAGGIEWLPINLYINGDTFYYVLYGILGRAIGAMNTDRRGLTLLCALLFTAAVWVISRGTLHELQWRGDFGDT

SEQ ID NO: 119106 - protein, 71 aa, Glycine max
  Coding DNA Sequence Number=SeqID_2328
  Homolog annotation: Hit_ID=Q9LTU4; Match level="QueryCoverage=90%, HitCoverage=4%, E-value=2e-10, Identity=43%"; Hit description =Helicase-like protein
MIESKRLSYVRNNQKKLKVDKFCSLQQSSDAGNTEGLGQGKRIILPSTFVGSPRYMDQLYFDGIVIVYAVT

SEQ ID NO: 119107 - protein, 87 aa, Glycine max
  Coding DNA Sequence Number=SeqID_2329
IDAFVAFHHGKESPVVAILALYDTFDRGCPSIRYKVTARASKRERESRTSPIASQGQSSGGHLLRPRGDPRTSQLLSAYDRLNGPYD

SEQ ID NO: 119108 - protein, 203 aa, Glycine max
  Coding DNA Sequence Number=SeqID_2330
  Gene Ontology: Mol. function=ribonuclease H activity; Cellular component=intracellular; Biological process=DNA integration
KGTNLDNNTMKEICEELKIQHHNSTPYRPKMNGAVEAANKDVKKIIQKMTVSYEDWHEMLPFALHGYQTSIRTSTGATPFSLVYGMEFVLPFEVEVPSLRIMVESGWVKNAFDKKVHLRRFNEGDLVLKKVSQALMDNRGKWATNYEGPFVIKKAFSGGALVLANMDDSGLLSPVNADVVKTGKDLFRAKVNVAPNGRPKETK

SEQ ID NO: 119109 - protein, 141 aa, Glycine max
  Coding DNA Sequence Number=SeqID_2331
  Subcellular localization annotation: CTP_CleavageSite=47; ConfidenceScore=5.07e-01
SGIPWRVGGFGSKVIKCGAGSSLSTSSGKDGLDREAMPTLLVTTKRRSQERKEGLEPSTSALARLCSTIKLFPPATVVAKHYGAINAGGGAAAFSINLRPLSAAIGASCKESWSRVELGRHFILVTGVSAPQDQTSYSLAA

SEQ ID NO: 119110 - protein, 166 aa, Glycine max
  Coding DNA Sequence Number=SeqID_2332
MTGDKFKLTDLELRKDKYVTFGDNNNGRIMGEGKIGNQHKNEIKNMLAHGCVFQGRKERGVATNVYLRKTSEKLESQTQVDVPSTCTTKDVPSNVLRQRSQAVKPLILCDWGYKRILRREKGDTKEFRRLVLCSFGKGRRETQKEFRRLILGEFFLAKGEENEEDE

SEQ ID NO: 119111 - protein, 166 aa, Glycine max
  Coding DNA Sequence Number=SeqID_2333
QVSGFDEESIAQLLCIPGQDFAQTTAGKRVRIMRTNTWMMLLLSNILPNNHNSNLPLPKWIVPTGHSVDPKKSNRALGFLALITSLCQFYEVPITPNKVIRPPTNRAFIKKYCAPRQAQGEAPQRPGDGQQRATDKLPPPLEPLAHLQRLEHCLRHVVDQQAANHR

SEQ ID NO: 119112 - protein, 578 aa, Glycine max
  Coding DNA Sequence Number=SeqID_2334
  Gene Ontology: Mol. function=RNA-directed DNA polymerase activity; Cellular component=intracellular; Biological process=RNA-dependent DNA replication
DEELPEEGRNHNLALHISVNCKSDALSNVLVDTGSSLNVMAKSTLDQLSYQGPPMRRSGVVVKAFDGSRKSVIGEVDLPITIGPFVFQITFQVMDIQAAYSCLLGRPWIHEAGAVTSTLHQKLKFVRNGSLITVSGEEALLVSHLSAFSFIGADETEGTSFQGLTVEGKKPEKNEVSFATWKSAQKVVQEGTGVGWGKVVQLLESKNREGLGFASSAGSATNSVGSSSITSTFCSAGFINNSPEANAVLEDVPEEIVLAFVTPGKLVRNWDAVDIPSVDEGAIILGIHEPVEHNNPALSPNFESPVYEAEEEEDDAIPEELARLLEYEKKTIRPHEEVVEVINLGTKEDKKEVKIGASLEATVKRRVIELLKEYADVFAWSYQDMPGLDPRIVEHRLPLKPECPPVKQKLRRTHPDMALKIKEEVQKQIDAGFLVTSEYPPWLANIVPVPKRDGKVRMCIDYRDLNKASPKDDFPLPHIDVLVDSAAKSKVFSFMDGFSGYNQIKMAVEDREKTSFITPWGTFCYRVMPFGLINAGATYQRGMTTLFHDMMHKEIEVYVDDMIVKSGTEEEHVEYLLK

SEQ ID NO: 119113 - protein, 180 aa, Glycine max
  Coding DNA Sequence Number=SeqID_2335
  Homolog annotation: Hit_ID=Q84VI1; Match level="QueryCoverage=77%, HitCoverage=32%, E-value=2e-59, Identity=61%"; Hit description =Envelope-like protein
FSPAAINKYLGRPTEGVVDIDVSEHQIAKEITAKRVQHWPKKGKLSAGKLSVKYAILHRIGAANWVPTNHTSTVATESFAVKLPIAFPTGKAAASGAVSKDALIAELKDTCKVLEATIKANTEKKMELELLIKRLSESGIDDEEAAEEEGEAAEEEEEAAEEEEDAAEETESDDDSEATP

SEQ ID NO: 119114 - protein, 115 aa, Glycine max
  Coding DNA Sequence Number=SeqID_2336
FKGLTTRDTFVSPAQRIQGTNRLRILCPNTLEGTSFVVQVEGTYTWVVILRTREGTSLVDQFKWRVTWKPIRGNVAERVEDPFILLRITMNALSMPVVLSLFIALEKISISKRTH

SEQ ID NO: 119115 - protein, 89 aa, Glycine max
  Coding DNA Sequence Number=SeqID_2337
MTTLTCIWMTLLFSNILPSDHNANLPLQMDRTHKTPSGPEEVQQGPGVSSFGYDPLSVLQGARPPQRGIAPTRHPVDPKKSNRALGFQL

SEQ ID NO: 119116 - protein, 113 aa, Glycine max
  Coding DNA Sequence Number=SeqID_2338
MGQLISDTIYCLQESHPQRHPVDPEKSNRALGFPALVTGLYSPTGCPFPSVRSRHHDIGIAPTRHPVDPKKSNRALGFPTLVTGLCQSYRVPVPPARSCHRDIGKYTYGSTDL

SEQ ID NO: 119117 - protein, 300 aa, Glycine max
  Coding DNA Sequence Number=SeqID_2339
  Gene Ontology: Mol. function=aminopeptidase activity
  Homolog annotation: Hit_ID=Q88G81; Match level="QueryCoverage=59%, HitCoverage=47%, E-value=9e-69, Identity=72%"; Hit description=D -aminopeptidase putative
MADHAAAAADRAFLRQAAPGRLLRLAHVLGLDVKAVDVVEQAVEGFHHHRHIPIHRVIARGQRFTLQRDQRIAHHAHAVGVGEGDRAGQQARFAHPFQTGGVAVAVQHVHPGEAGRVARGAGARFDHRHAGAHAAPVRQIGMDAGMADAHAGHVGDGVQRAGRALSDDNAQILSALRHGYSPSIEGAARGAGWRPRRWFSASPKPMMPAMIIKSFRLLAIKIVHSTYRQHSSATTTGSGHSGIRYGWWKWRRRRLISAATALIMYTSCYWITVNEVSDSRSEQNASVSDGTPNSRVAIQG

SEQ ID NO: 119118 - protein, 123 aa, Glycine max
  Coding DNA Sequence Number=SeqID_2340
SDDMQGYRMVIRTFGHPETASPMTCGDGKSDDMRGYRMVICTFCHPETASPMTCGDGKSDDMRGYRMVIRTIRQPGANGPVDTQRLTSSSVPFVILTHEVRGKRARLRAEANIVFCTFCHPDP

SEQ ID NO: 119119 - protein, 57 aa, Glycine max
  Coding DNA Sequence Number=SeqID_2341
  Subcellular localization annotation: CTP_CleavageSite=21; ConfidenceScore=5.07e-01
MRGESFWVQKPSPLPHFNPLRAGVARPAALSVCPALGKGRRSIGRDPSLYLRPSLST

SEQ ID NO: 119120 - protein, 159 aa, Glycine max
  Coding DNA Sequence Number=SeqID_2342
  Subcellular localization annotation: CTP_CleavageSite=64; ConfidenceScore=5.09e-01
MSNAFIGCKKLTKPSMKQLGRSGLKKKPRKKADAEVRLKATVKRKAKAKVAKIKPSKVVSKSIVATVEAPKVAESTLHIVTKKPKDKVDEAPTKSTSHEVTSKDATAIIVHITTCWTSGLNNIRGGGDFEHTLGSHTLMFKILTLQETHHLLITTEFKR

SEQ ID NO: 119121 - protein, 86 aa, Glycine max
  Coding DNA Sequence Number=SeqID_2343
MTEYPKPLWHLGAKLHIQQMAYGYNHTLSIKESNWKISVSNHLSGLLDPWSLTSSPCRSKKWKLGCVDWSKRLLVTTCLVATISPL

SEQ ID NO: 119122 - protein, 130 aa, Glycine max
  Coding DNA Sequence Number=SeqID_2344
MPTSTTRTTYPSHVPAEQKIKQAITSSYQYDNAHFAYSSHQYGPFQGESHSSNTMVLRDVRIKPGNYLSPRLHISKCTDIKMVPDRVCPRLPIYDEGKKKGFKLYFNKDMPNRGQKTQLINYPRDWKTLF

SEQ ID NO: 119123 - protein, 146 aa, Glycine max
  Coding DNA Sequence Number=SeqID_2345
SNCYLALCGMIIACSFFKFLDDYEGDGPITVLLSHCRIKEAQELGIEARSSFKSHGEGSTQLSGSIQLSSKESFFGKAEAKTIADINTISEEIVCVTVGTITRIVLDNHSWCYTACIQCHKKSDVEMAPFTCACDKYDKEVVLRSS

SEQ ID NO: 119124 - protein, 207 aa, Glycine max
  Coding DNA Sequence Number=SeqID_2346
  Homolog annotation: Hit_ID=Q1T254; Match level="QueryCoverage=43%, HitCoverage=22%, E-value=4e-20, Identity=55%"; Hit description =Peptidase aspartic, catalytic
MAVQAEDSKADKKVEGFKQPLVDELALELVDDLVELEEIVEEVEGDEEGETPIRDCQEKMKKKEEKEKRRRNKRRRRKSKKLKNEKQKEKVVETEKKGKSEANLEKKKEATPIECKEKLEITLPFGEALQQMHLYAKFLKDMLTKKNRYIHSDRIVVEGNYSASIQRILPPKHKDPRVVTILCSIGEADVGKALIDLGASITLMLLS

SEQ ID NO: 119125 - protein, 36 aa, Glycine max
  Coding DNA Sequence Number=SeqID_2347
MGPTHFISKRKSYLVKVSAIALALANNRGKFLTPVQ

SEQ ID NO: 119126 - protein, 80 aa, Glycine max
  Coding DNA Sequence Number=SeqID_2348
MGAKYLEVVKRGSHPNKQMAQNDHNLSLRAIGHDRAWMERRRMTIICLCAPSDTIASGWRKGVRNDHNLSPPTTRLTAHE

SEQ ID NO: 119127 - protein, 63 aa, Glycine max
  Coding DNA Sequence Number=SeqID_2349
MAVQKGKADVQGAGQIATTIGGLPCTGIASMAGGLCFVRDFTSYTWFLSSSCYVISVLGLFRM

SEQ ID NO: 119128 - protein, 158 aa, Glycine max
  Coding DNA Sequence Number=SeqID_2350
MGTRGSINYNPVLAIRELGYPMRGAPSEEIITHFIARGFSDPNARILQGVHKAWGTMQIKDKELRGSNNGIVGGYHKWLKAWTQELDWVPKLKTSNEEEAETPEESEEVQALKVKLERAQAVKEKFKTMTIKVWKECDELRDINVATTETLEWETKRA

SEQ ID NO: 119129 - protein, 86 aa, Glycine max
  Coding DNA Sequence Number=SeqID_2351
MGAKYLEVVKQGSHPNNGWSLDEIRMQNDHNLSLRVIGHDRAWAARHRMTIICLCMPPNTITSGWRKGLRNDHNLSPPTSRLTVPE

SEQ ID NO: 119130 - protein, 80 aa, Glycine max
  Coding DNA Sequence Number=SeqID_2352
  Gene Ontology: Mol. function=sequence-specific DNA binding; Cellular component=nucleus; Biological process=regulation of transcription, DNA-dependent
  Homolog annotation: Hit_ID=Q533S8; Match level="QueryCoverage=75%, HitCoverage=25%, E-value=6e-27, Identity=100%"; Hit description=MADS box protein AP1a
  Pfam annotation: Domain name=SRF-TF; Domain location=9-59; Score =120.0; E_value=6.5e-33; Accession=PF00319.9; Description=SRF-type transcription factor (DNA-binding and dimerisation domain)
MGRGRVQLKRIENKINRQVTFSKRRAGLLKKAHEISVLCDAEVALIVFSHKGKLFEYATDSWFYYTLYVHISTKFCMSVE

SEQ ID NO: 119131 - protein, 124 aa, Glycine max
  Coding DNA Sequence Number=SeqID_2353
  Gene Ontology: Mol. function=sequence-specific DNA binding; Cellular component=nucleus; Biological process=regulation of transcription, DNA-dependent
  Homolog annotation: Hit_ID=Q533S8; Match level="QueryCoverage=76%, HitCoverage=39%, E-value=2e-38, Identity=84%"; Hit description=MADS box protein AP1a
  Pfam annotation: Domain name=K-box; Domain location=13-111; Score =122.3; E_value=1.3e-33; Accession=PF01486.8; Description=K-box region
MEKILERYERYAYAERQLVANDSETQGNWTIEYTRLKAKIDLLQRNHRHYMGEDLGSMSLKELQSLEQQLDTALKQIRTRRNQLMYESISELEKKLGLCMVVTVHRNKFQRPILIMRVPLDKSA

SEQ ID NO: 119132 - protein, 203 aa, Glycine max
  Coding DNA Sequence Number=SeqID_2354
MAWHLDTNYEGKPTRLFKPLPIHFHTRKQYWLPSISLIFLETKQFKAKKGGEETTKEDGANGEAIVEEPMELEVRDATSGADDGAKAYVGATNDNKKPTNEDANKHMEPTTEATTNINMDPKEGELNDDVVVKENDAEGVTIYGAASKDIDEVAKFIGSFIFNIDEYIIAIIRDKESETDEEAAGNTTEGVTNAVQMEEEIIP

SEQ ID NO: 119133 - protein, 224 aa, Glycine max
  Coding DNA Sequence Number=SeqID_2355
MTLGQLEMAKIRHSEVALHHNKFSKLMTLELVETCHNELIFCQSEQGSLVYYVTSKFFWFQAKFEFFYGRPSRTTYQLEASCSKEVSNVLNEWRYFVGFSFATNYWSETGLLNVIRDYVDCSPFLVVQRASVSLLEWIKVKKKEHIQPQQRMHNLRWQKPPPVIVTKTKSLSIADIFPLVEAEALACLEAINWLRELGYQCAIIEIDCKGVVDGVRGNCTAQSN

SEQ ID NO: 119134 - protein, 99 aa, Glycine max
  Coding DNA Sequence Number=SeqID_2356
MEQVLLLGPALKGPEVEMSLTTITVGAPSNTLITLGFGDKVVSGLGKNQGGFANVALSSPDWVVSYHVAVCVTALSFQVSDGLNSGNAVRTRTLRASSH

SEQ ID NO: 119135 - protein, 64 aa, Glycine max
  Coding DNA Sequence Number=SeqID_2357
MTCYDERSEFPTKVQDTLAYQHGFCLKGCAFNVNAPMNSRHQTRNKVKNPTIVRQQILVDEGYT

SEQ ID NO: 119136 - protein, 125 aa, Glycine max
  Coding DNA Sequence Number=SeqID_2358
  Subcellular localization annotation: CTP_CleavageSite=49; ConfidenceScore=5.17e-01
MVFKKLLQKLNVLDNALLDKSKNPNYLFKLTHKVPILPLHSPFPCCSVSDSSSSSTTVLDKNAFSPEHNSRIVVSPDDLSFEEDLIIHRPMMDFSGEYSDEEEEEEKEVEEKEEEDDPKINIVGK

SEQ ID NO: 119137 - protein, 62 aa, Glycine max
  Coding DNA Sequence Number=SeqID_2359
MVMVVVGLVVVEVLQTEMLLLVVVMLNMCLRETSELISNNTLNRKSILLILQAFPFSEGLQL

SEQ ID NO: 119138 - protein, 189 aa, Glycine max
  Coding DNA Sequence Number=SeqID_2360
MSAPTSNFVDWPVEDDHKESIQLLCPTKVYHFDDVIACFVKNHEDGFIKRLLKLPVIFHHTVFNLKKMDEDEFSALVLHIFKELKPKRAKWEKHIQCKLAEKGGQAKAKHDEATNITQKSSKILIHLMINYFNSLGGSCVLNKLKHSQGCCSDAILPRKGPVTRAMSKRLQEDWARATEEGLRVFMNLR

SEQ ID NO: 119139 - protein, 98 aa, Glycine max
  Coding DNA Sequence Number=SeqID_2361
MEAVMVALEGDALSWHKNVQGMPTIIKRVKNRNLSSQTSQLSIYKGGVEVVLLLEWLAELGEIKANFDDLRRMDQGKGFILELNHIPDQPVIEIEVAT

SEQ ID NO: 119140 - protein, 267 aa, Glycine max
  Coding DNA Sequence Number=SeqID_2362
  Gene Ontology: Mol. function=sequence-specific DNA binding; Cellular component=endoplasmic reticulum; Biological process=lipid biosynthetic process
  Homolog annotation: Hit_ID=Q8W4Y5; Match level="QueryCoverage=85%, HitCoverage=74%, E-value=4e-93, Identity=71%"; Hit description=ASC1 -like protein
  Pfam annotation: Domain name=LAG1; Domain location=94-261; Score =211.3; E_value=2.2e-60; Accession=PF03798.6; Description=Longevity -assurance protein (LAG1)
MTTTNSLFFSLDWHNEFYPTYHDFYLLPLFALFFPSLRFFLDRFIFEKVARRLIFGKGHAALDYHSDERRKKIRKFKESAWKCVYYLSAEILALSVTYDEPWFTNTRNFWVGPGTQVWPDQKIKLKLKAVYMYAAGFYSYSIFALIFWETRRSDFGVSMSHHVATVILIVLSYIFRFARVGSVVLALHDASDVFLEIGKMSKYSGAETMASFAFILFVLSWIILRLIYYPFWILWSTRFIFVCFPIYIIFPSRCYILWPSPVYYVAS

SEQ ID NO: 119141 - protein, 73 aa, Glycine max
  Coding DNA Sequence Number=SeqID_2363
VATDPKKLEATWLWPIPKDIKGLRVFLGLGLIGYYWRFVKEYVLLGKENSVADTLSCASFAALSLAQGVEWLD

SEQ ID NO: 119142 - protein, 91 aa, Glycine max
  Coding DNA Sequence Number=SeqID_2364
MSPFRALYGQDPLLFKGTTVLSKIEEIDQLTQLRDSLLQELHENLLRVFNPYKMRSMAKRLNEKLSPKFYGPYKVSRRMGAFAYKLELSAH

SEQ ID NO: 119143 - protein, 79 aa, Glycine max
  Coding DNA Sequence Number=SeqID_2365
MQGRCVLCDLHATLNAFVRQASDVKEVLIGRQPRISTLFFSFSMICLIIMHRLSESCILAKPMVLAKRIMQEISFCKTR

SEQ ID NO: 119144 - protein, 82 aa, Glycine max
  Coding DNA Sequence Number=SeqID_2366
MTKCRVMVEMGFLRVRKVLWSLTPSESRRPGRWLKNLSTSLSASTTAQHEETTWKSSLARICDLACIWRLIAHLWLSLHLAA

SEQ ID NO: 119145 - protein, 90 aa, Glycine max
  Coding DNA Sequence Number=SeqID_2367
  Gene Ontology: Mol. function=strictosidine synthase activity; Biological process=biosynthetic process
  Homolog annotation: Hit_ID=Q84Q89; Match level="QueryCoverage=57%, HitCoverage=12%, E-value=3e-08, Identity=46%"; Hit description =Putative male fertility protein [Zea mays]
MKQSTLFLFLFLFPLVHALSYEAAYIRDGLKSYSQLDLPHSVFGSESVAFDCHGKGPYVGVSDGRILKWQETKREWIDFAVTSPHSVWLE

SEQ ID NO: 119146 - protein, 161 aa, Glycine max
  Coding DNA Sequence Number=SeqID_2368
  Subcellular localization annotation: CTP_CleavageSite=65; ConfidenceScore=5.05e-01
MSLATPSFVESHFAFLSMKDGVSSLWGKDFIPRAFIPSSMLSQSNYDMLREATLRTSMDSIGQVECAKAEQALLKVTKANETLFQSAKDSWKYLKDMKTKLKEVVSREEALKTKLATKAKEKLKSDLNKAEAKILKPHEANFFKDTCQAKYFFKEPTHPIA

SEQ ID NO: 119147 - protein, 113 aa, Glycine max
  Coding DNA Sequence Number=SeqID_2369
  Homolog annotation: Hit_ID=P26205; Match level="QueryCoverage=36%, HitCoverage=9%, E-value=2e-09, Identity=68%"; Hit description =Cyanogenic beta-glucosidase precursor
VYAASQKGLIGIILNSDWYAPVSKEKSDQDAARRGLDFMFGWVTNLRKEIIEGHTDKNFIEENSWKYDNITKTDKRYGSYISRVPDSLLKKSIPDFARPNHDGLYRAIDIYLK

SEQ ID NO: 119148 - protein, 111 aa, Glycine max
  Coding DNA Sequence Number=SeqID_2370
MYEESSCYDDPNAMVSQSEGVMSATQTHNHNHNNNTAFAYSYSSGEDAANANANAAIAMEIIAEHPQQNQYNYSNTPLENHHQLPYPTPTVPDLLNLLHFPNPIPGDNSTN

SEQ ID NO: 119149 - protein, 176 aa, Glycine max
  Coding DNA Sequence Number=SeqID_2371
  Homolog annotation: Hit_ID=P26205; Match level="QueryCoverage=23%, HitCoverage=9%, E-value=6e-12, Identity=76%"; Hit description =Cyanogenic beta-glucosidase precursor
MFKDPASEGTTEDDFRDYAKLCFKEFGNRVKHWITLNEPRSVSNNGYANGRIIPSWALCHIIVADPLFLFLLTSEGHDEYEYENDGFIVDEDEEEDEEEDRAKSDDEPPKKKKRKKKEEYVLDEDDYELLEDNNINIHRRKESKKFKRLKKGRRDTEEEPSGLSDEEEFVGSGKVG

SEQ ID NO: 119150 - protein, 76 aa, Glycine max
  Coding DNA Sequence Number=SeqID_2372
MPALSNDFPFAGHAVEGEGIQGFGNGVVDFTQDVGKKRGGKRTKQFTSTITEKQRRVDLSSKFDALKELIPNPSKN

SEQ ID NO: 119151 - protein, 106 aa, Glycine max
  Coding DNA Sequence Number=SeqID_2373
MGCLLTKGVAMTRPGRLFIKNIGLHKVIHDLGKKIWTSKGEEKEAAKKEFIKALKLLEEQLGDKSYFGGDNIGTHYLFSKHQVFIFANPPSVNTQYESNKLIIILL

SEQ ID NO: 119152 - protein, 81 aa, Glycine max
  Coding DNA Sequence Number=SeqID_2374
MGPGIYGPSTHYFSIFYHLNRKIANIFYCLNRKIAKFKLMYNQRREREANFGGVPNNPQPKIKEVKKKMKGKVNTSSISGN

SEQ ID NO: 119153 - protein, 74 aa, Glycine max
  Coding DNA Sequence Number=SeqID_2375
MGNQSSLLSFPEGTELALEFRATYPSVSFLASRVVSTEKALALPSGNLGGQLAEPMVDVGWVVDDYDHSKAFFH

SEQ ID NO: 119154 - protein, 151 aa, Glycine max
  Coding DNA Sequence Number=SeqID_2376
MTKKSAETSRADVRPKKPTGVKIQEGKQEEKEEEERPLIRKRKLPATSTKSAEQTEAGNSQAQMPKKKKKVKQVEPEPSVAVEGGEPIKKKKKKTKPSKEQGDNQPVDVQPPSTDIDGTEVEATPSVAEMGNPVDQPDSPQEQPAVEVSSS

SEQ ID NO: 119155 - protein, 74 aa, Glycine max
  Coding DNA Sequence Number=SeqID_2377
  Subcellular localization annotation: CTP_CleavageSite=45; ConfidenceScore=5.56e-01
MAISSSTRQLAPVSPSSMACCTKLGLASLTGELRVGVCSSQATCSSFAGGGTAFWWKTPVLLAICAAGRFKVQL

SEQ ID NO: 119156 - protein, 111 aa, Glycine max
  Coding DNA Sequence Number=SeqID_2378
MTYTKKTDQMMFEAAKKIANKIDSMEEQASEDSIVAHGQHPGRVRAAGADVMIKQYFEPAPRTSHTSSSMTPKDMEQLRQKIRDQLEESITEKVTRQVMLSFSQMQSRFQS

SEQ ID NO: 119157 - protein, 72 aa, Glycine max
  Coding DNA Sequence Number=SeqID_2379
  Subcellular localization annotation: CTP_CleavageSite=63; ConfidenceScore=5.37e-01
MGVQIAARPTWAFKDVPPEGGCFWRKQPSSPGRAGKSKLRRFRNVSVGDFAKIFNRSSTFFVRFSSFFGLQP

SEQ ID NO: 119158 - protein, 144 aa, Glycine max
  Coding DNA Sequence Number=SeqID_2380
MGAKYLEVIKRGSHPNNGWSPDEIRAASPLQNIRVIVVVVGDTEGPPTCLPHGLRDMCMTRLGLLALNGYGSGVVDILIRCMYNNGWWIVGRQAIRWEGMLALDLHKMGATRTSQGIASLTYHIQDWTIHLIDTRWVSRVYLSG

SEQ ID NO: 119159 - protein, 90 aa, Glycine max
  Coding DNA Sequence Number=SeqID_2381
MEVDEPRLGLWLPLHYRVDMGASQHRTPEFGWVLWFDLGMAFMDKWVVGKEMGCYWLSNDIVGLDDQFASFQTHLILPLAKSKSSKLEGV

SEQ ID NO: 119160 - protein, 291 aa, Glycine max
  Coding DNA Sequence Number=SeqID_2382
  Gene Ontology: Mol. function=RNA binding; Cellular component =cytoplasmic exosome (RNase complex); Biological process=rRNA processing
  Homolog annotation: Hit_ID=Q5SMR4; Match level="QueryCoverage=68%, HitCoverage=31%, E-value=2e-63, Identity=63%"; Hit description=ALM beta-like
METKSSSSSTNLVDQSVCPGDVILDLSNMTNQTIKLGGGLRQDCDAISVMKAGRLRFSKPNKYWVENSQKRYVPHAEDSVLGIVVDSRSDAQLRVYMEEFQPSIMFRHPPLITLMSSVNFLVDIKGPALAFLPVLAFEGGTRRNIPRFEIGTLIYARVVKANPGMNPELACTDGSGKAAEFGALKDGYMFECTTGLSRMLLSSPTCPVLDALGKKLSFEIAVGLNGRVWVCKNTLFLACHIMFFFLASLNGLVSAASPQTTIVVANAIMNSETLSGAQQRIMVEKLLERIH

SEQ ID NO: 119161 - protein, 220 aa, Glycine max
  Coding DNA Sequence Number=SeqID_2383
  Subcellular localization annotation: CTP_CleavageSite=54; ConfidenceScore=5.75e-01
MLTGLMKKIASTTMGSCASNPSRKSSGQKRRKQKSGKRRGNGLPSALPELPLKRVSNAGSRVGDFSLSNFVHLDFENNGASAPSCRRSEVSNMKFHLTQYHSHSQIDANGKYQEEAWFDSVSIIESDSDDEFSSVHGDCFPFPNNAMGSVPNTQLLQYESASCIVDSVHKYEEFYESYLKIDGGNCKSGERTQESSSKQSTVIMLSVKRTSIDGHDKTES

SEQ ID NO: 119162 - protein, 255 aa, Glycine max
  Coding DNA Sequence Number=SeqID_2384
  Gene Ontology: Mol. function=catalytic activity; Cellular component =membrane; Biological process=lipid catabolic process
  Homolog annotation: Hit_ID=Q5DWD9; Match level="QueryCoverage=54%, HitCoverage=22%, E-value=1e-20, Identity=37%"; Hit description=Lipase
MLRLWISYLQLLELFVSSLVHMLYGFYIFSSAVAGDLSQVLNEYFHKANNNVNVEVKEEISKLNNANDLPPIVLVHGIFGFGKGRLGALSYFAGAEKKDERVLVPDLGSLTSIYDRARELFYYLKGGQVDYGEEHSKACGHSQFGRIYEQGHYPEWDEDHPIHFVGHSAGAQVIRVLQQMLADKAFNGYENTSENWVLSVTSLSGAFNGTTRAYADGMLVVERACIISSLVPARRWENIETYLPATAVPHWGDNI

SEQ ID NO: 119163 - protein, 97 aa, Glycine max
  Coding DNA Sequence Number=SeqID_2385
MERYLQHLVCQQAANHRGQVQTHECLNQLSLSLQSQGFAPFACPTPDQFRAEVAWPGDWPEAQAGEAPAEAPGDVEEARMDEKMTDLLGFLGGSGAT

SEQ ID NO: 119164 - protein, 51 aa, Glycine max
  Coding DNA Sequence Number=SeqID_2386
MWLKGVKTPVVLSGNRDERAKRACARSLFIAAVKILDFQMNALSGPCRAKR

SEQ ID NO: 119165 - protein, 764 aa, Glycine max
  Coding DNA Sequence Number=SeqID_2387
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=90%, HitCoverage=92%, E-value=1e-172, Identity=46%"; Hit description =Protein kinase; Type I EGF
  Pfam annotation: Domain name=Pkinase; Domain location=434-704; Score =150.7; E_value=3.9e-42; Accession=PF00069.15; Description=Protein kinase domain
  Pfam annotation: Domain name=Pkinase_Tyr; Domain location=434-704; Score=140.4; E_value=5e-39; Accession=PF07714.7; Description=Protein tyrosine kinase
  Pfam module annotation: Pfam domain module=Pkinase::Pkinase_Tyr; Domain location=434-704::434-704
MEYCLQLCRVLMFALALAMVVAVAPDRTLSEVTPSSLNQAALSGCKSSCGDVEISYPFGIGYSSLPDHKPCFLQSKFELTCNDSSKKLLWANLEVSNINVTSHQMVVSFFVSEFCSKEKAFNKPWIKTGRFSISRKENKFLTVGCDSYGYLNSYFDGDLYSTGCLTRCYGNNNLIDNETCWGIGCCQVDIPPLMRNITVEASSFVQSGTDSSGVNASSTTFFNSTCSYSFVVRNGFYKFSTTHLQSFPNKTLPMVIDWTAGDKSCKDSMGRGDYACKANSYCDDGDTDYGYRCRCKDGYEGNSYLGCTEILECTTRRHNCSREDYCREVRGSFECFCPDGLIGNGTIEGGGCQPKQRYNVFTKVAIGVGLLGLFMGTSWLYLIYQKRKVLKLKEKFFQQNGGMILKQQLSAREDSTQSATIFTAEQLKKATNNFDESLIIGKGGYGTVFKGVLSNNTIVAIKKSKTVDQSQVEQFINEVIVLSQINHRNVVKLLGCCLETEVPLLVYEFVSNGTLFHYLHNEGQLANVCWKTRLRIATEAAGALSYLHSEASIPIIHRDVKTANILLDDACTAKVSDFGASRLIPLDQTELATIVQGTIGYLDPEYMQTSQLTEKSDVYSFGVVLVELLTGEKPFSFDKPEDKRSLTVHFLCCLKEDRLFDVLQIGIYDEENKQEIMEVAILAAKCLRLRGEERPGMKEVAMELEGIRLMEKQPRTNAGQNFEETQYLLHGAYSTHENGDSSGQQNTGYDSLRDIELIDFGDGR

SEQ ID NO: 119166 - protein, 501 aa, Glycine max
  Coding DNA Sequence Number=SeqID_2388
  Homolog annotation: Hit_ID=Q57I10; Match level="QueryCoverage=36%, HitCoverage=88%, E-value=7e-69, Identity=70%"; Hit description =Galactonate dehydratase
  Pfam annotation: Domain name=Aldolase; Domain location=252-433; Score= -14.0; E_value=3.8e-08; Accession=PF01081.9; Description=KDPG and KHG aldolase
  Pfam annotation: Domain name=DGOK; Domain location=31-264; Score =262.6; E_value=8.1e-76; Accession=PF05035.3; Description=2-keto-3 -deoxy-galactonokinase
  Pfam annotation: Domain name=His_biosynth; Domain location=203-425; Score=-119.2; E_value=0.016; Accession=PF00977.11; Description =Histidine biosynthesis protein
  Pfam annotation: Domain name=MR_MLE_N; Domain location=415-501; Score= 15.0; E_value=0.00021; Accession=PF02746.6; Description=Mandelate racemase  muconate lactonizing enzyme, N-terminal domain
  Pfam annotation: Domain name=TMP-TENI; Domain location=247-419; Score= -55.0; E_value=0.0014; Accession=PF02581.7; Description=Thiamine monophosphate synthaseTENI
  Pfam module annotation: Pfam domain module=Aldolase::DGOK::His _biosynth::MR_MLE_N::TMP-TENI; Domain location=252-433::31-264::203 -425::415-501::247-419
WRCGGTGGEGDDCQLNRPTQGDFVTRYIAIDWGSTNLRAWYYRAGECVDERRSEAGVTRLGDRTPAQVFATITDGWPVAEVPVIMAGMVGSNAGWLAVPYLACPVALNALSDRLTCVEGKAWIVPGLSVERDDNYNVMRGEETQLLGAVTLQPAPLYVMPGTHAKWVQIEQDRVIDFRTVMTGELHHLLLKQSLIGAGLPAQKPVRTRSGTMTQQLTHSRQPIVIIAGSALAQRYQQALAFIGTDSVTLEGDRAFQHGIRTEAHVAALIDAGFDAIEIPLNSPEWAESIGAMVQTFGDKALIGAGTVLQATQVDQLAALNSKLVVTPNTDAAVIRQAVAHGMLVAAGCATASEAFTALQAGAQALKIFPSSAFGPGYITALKAVLPPEVPVFAVGGVTPENLHEFIAAGCVGAGLGSDLYRAGQPLSRTVEKARAFIAAYKDAPVIEGRARSVEAAVHELSEYLIGQDPARINDLWQVMYRGGWYRGGPILMNAIVGIDQA

SEQ ID NO: 119167 - protein, 53 aa, Glycine max
  Coding DNA Sequence Number=SeqID_2389
MPLKDSIKTKTGCQEHRGVGVGGSPRVSSFGILGKRIKLALANNLMHYLLSTL

SEQ ID NO: 119168 - protein, 343 aa, Glycine max
  Coding DNA Sequence Number=SeqID_2390
  Subcellular localization annotation: CTP_CleavageSite=41; ConfidenceScore=5.42e-01
MAEPSKKRKGSSSTAAAAAHHRHGPSEASTAPIHPSLSSPRSSTLFSSDDQRLRDFSQFSSRIILNPKYLDVEFFNDETFDCYQVFQNSGLVDFMSLKLPYYPELVKVFYCNLKIQDGIIMSEGHGAPFEGTIVDDWKFDYSSHDARRMVCNDQAEMTGRLLAGILLPRSSNLAQASEEDLILMWAFLTGRQIDWAHLVRYRMHKALRANAPLPYPHLITLFLRHFQIPLDDEPFIQVKRSFAIGAGAVTSFGYRKDRNGQWLKKDALPPQDEHTPSPPPPREDFALMNEVLSELRGLRSYVGDRFESLDTRFAGMDIRLTQLEEDVGYIRQSFDLPPPPPSS

SEQ ID NO: 119169 - protein, 389 aa, Glycine max
  Coding DNA Sequence Number=SeqID_2391
  Homolog annotation: Hit_ID=UPI00005F72E5; Match level="QueryCoverage =52%, HitCoverage=65%, E-value=6e-40, Identity=46%"; Hit description =COG3515: Uncharacterized protein conserved in bacteria
  Pfam annotation: Domain name=ImpA-rel_N; Domain location=209-269; Score=67.2; E_value=5.1e-17; Accession=PF06812.2; Description=ImpA -related N-terminal
PVWNFVVPPMLGSQLIQMGCLIAARDSVGRNYPLCALRHFTPAEWSPALLARSGEWYQQVGNMLLRVVQNGGTPEQLDQALLSIPQPQQPQTDGEQSDILQVIGDGEPSTLNWKLPGDSFDPQFYTSFWWTNQSDGFPLYTQVHSGNFTAQLPTAMTMNIDALLAPVSSDNPCGDNLEYHADYQAMEQASTGKAEQQFGETIIPAESADWNKVEKLAIDLLSRSKDLRVMLALTHAWTELKGLPGYAQGLKLIEQALLLYWEPLWPRLEEYGEQDPFYRINAVALLGDKSALSSAVRQSWLLRYASDGITLRDAAALCDGSKTEVADYPGGLPRLTDELARGEQPGIEAVLQISERLQTITETLTEQLGEAAVPELSQLRRQIAMIAER

SEQ ID NO: 119170 - protein, 308 aa, Glycine max
  Coding DNA Sequence Number=SeqID_2392
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-37, Identity=34%"; Hit description= UPI00006A17C9 related cluster
MHTLTFRGLHALAFRGLHVLAFRGLHFLTFKGLHTLAFTGLHVLIFRGLHVLAFRGLHVLAFRVLHALTFKGLHELSEGCTPSPSEDYTSSPSEGYRSSPSKDYTSSPFGGLHTLAFRGLHTLAFRGLHVLTFRGLHTLAFRGLHILAFKGLHILAFRGLHALPFRGLQVLAFRGLHALAFKGLHALAFRGLHVLAFRWIHALAFRGLHVLAFRGLHTLAFRVLRALTFRGLHVLTFWVLVPSLSEDYTSSPSEGSMPSPLEDCTSSPLEGYTSLPSEDYTSSPSEDYTSLPSKGYMLSPSVGSTFAP

SEQ ID NO: 119171 - protein, 68 aa, Glycine max
  Coding DNA Sequence Number=SeqID_2393
MMPDWAPSLGKTVGVESSEVHKVFVKDDGRYEFTVGFCRVVLLEGEQGWYEMKLSERYMNEEEKREKQ

SEQ ID NO: 119172 - protein, 76 aa, Glycine max
  Coding DNA Sequence Number=SeqID_2394
MRGYLMVTRTFRQPGENEPVDAKRLTSSSTPFVIQGRRVRWQAEIPYGHPRLSSTKGNEFDGFYSRRPETFKPNDA

SEQ ID NO: 119173 - protein, 328 aa, Glycine max
  Coding DNA Sequence Number=SeqID_2395
  Gene Ontology: Mol. function=transcription regulator activity; Cellular component=nucleus; Biological process=regulation of transcription
MDGLSWDASQLWSTIQQPPDFEGGYSMPPNVLNQIQEMQKAQTGHAYSNSERGIYHSAGATTTSSEMMDVMQKQDTNLSQHVSIMQVKPAGAGASWGETLTSQSYPSLSVNRPHSMNLISNYMPDFYMAHQQQQQQQQQQQLESFDCLISATNSNTDITSVEDDDGISMILSDCGNLWSNFSYGSAASTGESESNASNGRNKDMQCSPVNIEVDETVSQTVESEANCSKRSHAHDQSKMIKVGDSCFSIVQNSSPIEEGGFRLVSDINQPECKKSRWDMSSSSNNINFQQPNSSISSSIEEPDPEAIAQMKEMIYRAAAFRPVNFGLE

SEQ ID NO: 119174 - protein, 215 aa, Glycine max
  Coding DNA Sequence Number=SeqID_2396
MEVALVGLAGLSLVIDCIFVIVFLSSSMFCFVSSSICVVIPILLLMGPTLFFVVIDTVVLDGYLQVESLFKDYSAIVGLGASFFLVALLYSLSDFILEYGHFFRLDVAFGSFAQLVDATRDLDNNASKPIYEFMERFIISLLQTDQESTIPGQCRPFKGRMEDMTHDCIVIAWYFSFHDEVDKWVSMSSPPYRTAMCERNARRLGGIWHEPPADH

SEQ ID NO: 119175 - protein, 92 aa, Glycine max
  Coding DNA Sequence Number=SeqID_2397
  Gene Ontology: Mol. function=RNA-directed DNA polymerase activity; Biological process=RNA-dependent DNA replication
MSGIHPNIICHKLAICPQAKSISQKKRKMGEERHKVVKEEVDKLLHANIIREVRYSTWLASIITVKKANDKWACPKCPLPSIDRLVDGAFGF

SEQ ID NO: 119176 - protein, 60 aa, Glycine max
  Coding DNA Sequence Number=SeqID_2398
  Gene Ontology: Mol. function=transferase activity
  Homolog annotation: Hit_ID=Q3ZUY0; Match level="QueryCoverage=85%, HitCoverage=26%, E-value=2e-16, Identity=70%"; Hit description =Strongly similar to crcA protein
  Pfam annotation: Domain name=PagP; Domain location=2-60; Score=-24.5; E_value=6.6e-06; Accession=PF07017.2; Description=Antimicrobial peptide resistance and lipid A
MYSKEKIDSFNERPWGLGIGKSYRDANGNWDGFYVMSFKDSHNDWEPIAGYGHVKNLVGK

SEQ ID NO: 119177 - protein, 261 aa, Glycine max
  Coding DNA Sequence Number=SeqID_2399
  Gene Ontology: Mol. function=sequence-specific DNA binding; Biological process=signal transduction
  Homolog annotation: Hit_ID=Q2T074; Match level="QueryCoverage=93%, HitCoverage=89%, E-value=3e-66, Identity=52%"; Hit description =COG1396:Predicted transcriptional regulators
MDTRRQELAEFLQAMRQRGTPEEFGFPSGSRRRTQGLRREEVAQLAGISATWYTWIEQAREVNVSAEALDRLATALKLSKSERSYLFDMADRRDPQAHQSEVDTAPEILVIMLSQIQIPAYVMGRTWDILAWNAPAGHLFTGLLDIAWPESQRPNLLRFVFANPQARQFVVNWEMRARRLVAEFRADCRSRLEEPEVKQLVSELSTASPEFAQFWKQHDVLERQGGQREFLHPQQGLIHFQQVTLRPVEQEQLKLVLLQPA

SEQ ID NO: 119178 - protein, 77 aa, Glycine max
  Coding DNA Sequence Number=SeqID_2400
AGVVTSFGYRKDRDGHWLKKDVHPPQDKRTPSPPPQQDDSSALMNEVLLELWGLLTYVGECFDSLDGRFEGMDTRIT

SEQ ID NO: 119179 - protein, 58 aa, Glycine max
  Coding DNA Sequence Number=SeqID_2401
MERFEIEVFTGGYAENLIIATGCGIHQARPDSVCSCDPKCMCDALTSIMERKKQDRVM

SEQ ID NO: 119180 - protein, 175 aa, Glycine max
  Coding DNA Sequence Number=SeqID_2402
  Subcellular localization annotation: CTP_CleavageSite=22; ConfidenceScore=5.77e-01
MASSSITCTFHCNLHPSISLPTSATRFSLSFSHPLLCTYNGLSLHPSSSSFRVFAKFEKFQSQPSQSQEPDPSPSLEETTETSVQDDEEDDSCLPSDLEGAVRQSSEAAATFVSSGGMRAIVELLIPQLQFLDDEGAQGELWELSRIFLDTLIEKTKSQNWFLLHAMNIRDTSES

SEQ ID NO: 119181 - protein, 310 aa, Glycine max
  Coding DNA Sequence Number=SeqID_2403
  Gene Ontology: Mol. function=nucleic acid binding; Cellular component= membrane; Biological process=DNA integration
  Homolog annotation: Hit_ID=Q1ST43; Match level="QueryCoverage=52%, HitCoverage=12%, E-value=4e-43, Identity=52%"; Hit description =Integrase, catalytic region; Peptidase aspartic, catalytic
MGNMRLINAANTNSSNSGRFGRGNSRGKGGKLCTQCGLINHTVDDCYRKHGYPPGHKFYKSQGSNIRRSVSKTSQDEWILDSGATDHYMQNLQRIGTIDMVEGLYRLKMVPLKPRREYNSNSIDVFVTNKPDDSPLESTSDSVMSVPNDNSNSSTPQQTIHTPRRLSPSYHNIVSSIAQSVEPQSYNEASQDPNWIEAMNVEIKALELNNTWVLTDLPQHKSTIGCRWVYKVKHKSDGSIERYKARLVAKGYTQVEGHDYLDTFSPMAKLAIVRLLLALAAINQWYLKKLDVNNAFLHGDLHEEVYMYIP

SEQ ID NO: 119182 - protein, 1209 aa, Glycine max
  Coding DNA Sequence Number=SeqID_2404
  Homolog annotation: Hit_ID=Q75HV1; Match level="QueryCoverage=42%, HitCoverage=63%, E-value=1e-145, Identity=52%"; Hit description =Putative kinesin-related protein
  Pfam annotation: Domain name=Kinesin; Domain location=235-525; Score =411.4; E_value=1.3e-120; Accession=PF00225.13; Description=Kinesin motor domain
MALIPPEDTNVAAASLDCRTAPSKVKGQALGIGKGEGKGHCRCKVEGGKKIRKNEWLRLEGILKDGGYSERNFDLGIVASLLRQTMNDQSMQIQMLAEKFHRFVLDCELKQPSIAQCSDIESKKVNENSDSMDEHSLSNGIHEVSPDTGHTLPILKKILDLSAKVQDLKKQHITMCDEVKLTTQSFPGTDIMKSVQLLGAEYELLKRKYSEESSERRRLYNEVIELKGNIRVFCRCRPLNENEIANGSASVVNFESSSDNELQVICADSSKKQFKFDHVFGPEDNQEAVFQQTKPIVTSVLDGYNVCIFAYGQTGTGKTFTMEGTPEHRGVNYRTLEELFRITEERHDTMKYELSVSMLEVYNEKIRDLLVENSAEPTKKLEIKQAAEGTQEVPGLVEARVYGTEDVWEMLKTGNRVRSVGSTCANELSSRSHCLLRVTVMGENLINGQRTKSHLWLVDLAGSERLGKTEAEGERLKESQFINKSLSALGGDCKTLMFVQVSPSSADLGETLCSLNFATRVRGIESGPARKQVDHTELFKYKQMAEKLKQDEKETKKLQDSLQIMQLRLAAREHHCRTLQEKVRELENQIAEERKTRLKQESRSLAAVTVQPSSAAAHKTMTDKKPPLNPSKLRMPLGRITNSLPPRSPLRSKSYTAFMSGKENSVRRNSVVTSAVRPASSSTTAQFLQARRRVSIAVRPPAPSTTQVLHTRRRVSIATLPSQTTSDITTPLRTSAFRVTGGSSQQSRIRSQRKDRYSSLFAPLPELRTSVETTPMTVRRSSKFMMSSPVRADSREGSARHPTLLALQRKPVDILKMVARTPPKQRKLLAALNPVLIKETLIKVDQCVARLQELQYTVTGGTKVVSGVNLSPRSTRGYLRTSLRCKQESLRIKNGASRRSPVGKFPANTGEWKRMSLPAMLVGETVGEILQASQFAREIVTAVGKKTPQEDPKTPMSQRSNKKAELENTQLRARRKKEKQTKAQNDGSPSLQRARSRINFKVSPPKVREFDKESNRYMANRVSPRNKPWARKTVLFPNPLFLSTHSSSQQQFCKTRSPIITRNRGTTTSHKFLIKSPSLPSRPQQFCQTRSPVISRNRGGGTPHKFLIKSPTSATKVQVQIKNSPPTVSISPTKPARLSRSPPKRSTSTASKFRRSFSPSRIASRLVSLSPLRTRKTVQRNDGFVSGLKQCPASSSVQYPAKRNLRTHQ

SEQ ID NO: 119183 - protein, 301 aa, Glycine max
  Coding DNA Sequence Number=SeqID_2405
  Gene Ontology: Biological process=cell wall catabolic process
  Pfam annotation: Domain name=F-box; Domain location=43-91; Score =28.3; E_value=2.8e-05; Accession=PF00646.23; Description=F-box domain
  Pfam annotation: Domain name=LysM; Domain location=121-202; Score =16.4; E_value=0.01; Accession=PF01476.10; Description=LysM domain
  Pfam module annotation: Pfam domain module=F-box::LysM; Domain location=43-91::121-202
  Subcellular localization annotation: CTP_CleavageSite=88; ConfidenceScore=5.36e-01
MGCCCDEDDGDIFRHLMNSNFPSSSSTSATTTSSCTVISPMNSHFSALSSTDILRLIFDNLPIPDLARASCVCRLWNSVASQRDMVTRAFVAPWKLNDVVGNPLSGSFWRDNSLAKFAVSHHITRGDTVASLAVKYSVQSISAVFRNLGLEFRTIHNPLMQAFFNWRTTHTALIELHVMDIKRLNNMMSDHGIYSRERLLIPISNPDILINRTCFIELDVYAKREVAVLYPNDLPDRRTAYVSNRISSEESNKKVLESLKRSMHVDNETAQYYWSVANGDPRAAFAQFSADLKWDWQAGHS

SEQ ID NO: 119184 - protein, 90 aa, Glycine max
  Coding DNA Sequence Number=SeqID_2406
MSNMIDKRIDAILLRKGLITRATSKRLQEDWARVAKEGPRVLSYPNFVRGMLFDDIQPLIGRFEILGTLCCTICEVPRRAENQKEASLRD

SEQ ID NO: 119185 - protein, 667 aa, Glycine max
  Coding DNA Sequence Number=SeqID_2407
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=Q93YI8; Match level="QueryCoverage=100%, HitCoverage=78%, E-value=0.0, Identity=67%"; Hit description =Lipoxygenase
  Pfam annotation: Domain name=Lipoxygenase; Domain location=193-667; Score=797.5; E_value=7.4e-237; Accession=PF00305.9; Description =Lipoxygenase
  Pfam annotation: Domain name=PLAT; Domain location=83-181; Score =128.7; E_value=1.7e-35; Accession=PF01477.13; Description=PLATLH2 domain
  Pfam module annotation: Pfam domain module=Lipoxygenase::PLAT; Domain location=193-667::83-181
MFQNIMNAFTTTGDDDNGPGHRVKGTVVLMKKNVLDFNDFSASFLDRLHEFVGKRVSLQLVSSVNVDPEEDVTKKKTEEEGDSVHARNGNGLKGKLGKPAYLEDWITTIAPLTAGEAAFKVTFEWDEEIGTPGAFIIRNNHHSEFYLKSLTLEDVPGQGVIRFICNSWVYPADKYEKDRIFFSNKTYLPSETPMPLLKYREEELENLRGNGKGQLQEWDRVYDYALYNDLGNPDKGPQHARPTLGGSKDYPYPRRGRTSRPPAKSDPKCESRLNIASSLDIYVPRDERFGHLKMADFLAYALKSIVQVPEGILTEVRDNIPAEMLKEIFRSDGQRLLKFPVPQVIAVDKSAWQTDEEFGRELLAGINPVVIRGLQEFPPASKLDPKIYGNQTSTITKEHIESNLEGFTVDEAIKERRLFILDLHDALIPYVKRINSTSTKMYASRTILFLQDSGTLKPLAIELSLPHPEGDQYGAISKVYTPVEQGIENSFWQLAKAYVVVADSGYHQLISHWLHTHAVIEPIILATNRHLSVLHPIHKLLHPHFRDTMNINALGRQILINAGGALELTVCPSKYSMEFSSVLYKDWVFPEQALPEDLVKRGVAVKDSTSPYGLRLLIEDYPFAVDGLEIWFAIKTWVKDYCSFYYKEDDTIKKDTELQSWWKEIRE

SEQ ID NO: 119186 - protein, 99 aa, Glycine max
  Coding DNA Sequence Number=SeqID_2408
MKRKIGEAKKSESERMNGSLWPSQILGLDHLSTSHLTSPHSGTPVKLLRKEDSNKAESTQGMLLKKKEKYTHREDAILHALQLERQMLKKQEKIGDASV

SEQ ID NO: 119187 - protein, 643 aa, Glycine max
  Coding DNA Sequence Number=SeqID_2409
  Gene Ontology: Mol. function=DNA binding; Cellular component=nucleus; Biological process=regulation of transcription, DNA-dependent
  Homolog annotation: Hit_ID=Q1SCD0; Match level="QueryCoverage=25%, HitCoverage=91%, E-value=1e-49, Identity=60%"; Hit description =Homeodomain-related
  Pfam annotation: Domain name=Myb_DNA-binding; Domain location=44-89; Score=45.2; E_value=2.2e-10; Accession=PF00249.21; Description=Myb -like DNA-binding domain
MAPTRKSRSVNKRMSSSNDNSPEKDGVNSNKSKQRKRKLTDKLGSQWSKEELERFYEAYRKYGKDWKKVAAVVRNRSTEMVEALYSMNRAYLSLPEGTASVVGLIAMMTDHYNVMEGSDSERESNDAPGSRKPVKRKREKVQLSISKDQSHSIASSDDCLSILKKRRFDVRRQNTAARSSTEAEYRAMAVVACELTSLRQLLQQLQFGDTQDTKLICDNQAILHIASNPVFHERTKHIEIDYHFVREKVLSGEIMTDFAGSNDQLADIFTKSLRGPRVETICNKLGIQLKPHAVGKRTPRVPVYKKDDTENYVSPYRRSLKSTIDANDDEVAHVVALALTEAAQRGGSPQVSQTPSRRVEQKSSPIQSWERKHQMSKTARAKFPDVSVDKEVLEGSIESRGAENEEYAKDNSSLMDTEGIDTAEVFQKEGQFYRKRERVKNVGNHQLDDGGEACSGTEEGLSFNSLKEKVDIEVTNEKLEKFSPKSHRKRNKKLFFGDETPALNALQTLADLSLMMPISTMESAAFSLFQLKCSDWSLLFVAAVIHGERMVADKNNRSALPEATSTSHKRHKLKYSVVPKIEVLTSKESKTGKEPTKDTNALSESKEKLPFADTAWKRKRKSMGSKVASAKLDSYPSGPLKDE

SEQ ID NO: 119188 - protein, 134 aa, Glycine max
  Coding DNA Sequence Number=SeqID_2410
MPISPCESISWSVPSRHRGHAHKTPSGPGEIQQGPGVSSSGKFAGIAPARHPVDPEKSNRVLGFPALITSLCQFYGVPVTPSKVIRPPTNRVFIKKYCAPMQAEGETPQQPGDGQQQAANAPPPPPEPLSSSTK

SEQ ID NO: 119189 - protein, 421 aa, Glycine max
  Coding DNA Sequence Number=SeqID_2411
  Gene Ontology: Mol. function=DNA binding; Cellular component=nucleus; Biological process=regulation of transcription, DNA-dependent
  Homolog annotation: Hit_ID=Q10G93; Match level="QueryCoverage=91%, HitCoverage=30%, E-value=2e-85, Identity=45%"; Hit description=DIRP family protein, expressed
  Pfam annotation: Domain name=DIRP; Domain location=36-134; Score =189.3; E_value=9.4e-54; Accession=PF06584.3; Description=DIRP
MILQRTSLPKEKSSDYILKSQSNKKSFLVACHLICAIDYPWFAKREFMEYLNHVGLGNIPRLTRVEWSVIKSSLGKPRRFSEHFLCEERQKLEQYRESVRKHYTELRTGIRDGLPTDLAKPLYVGQHVIALHPKTREIHDGSVLTVDYDKCRIQFDRPELGVEFVMSYLVLYSSFYAVCLGYGWIHCVYRRQPCICKRDIDCMPLNSSDNMPEALRRHIGSPISSFMNKEPQISGNSNFGGCEMNHSSPVKFLSQLLKSSYIGVNYVDAQAKVATVDNLCAQAGCAQPCKVTHHQAKEADIQAVSELKHALDKKETLLMELRSANSDILENKNGIDCLKDSEVFKKHYATVSDAMLQLRQRNTYRGNSLPSWMKPQASFNVHDDLPSMLDSSLTQELGSTVVQVIKGSRLRAHAMVDAAFQ

SEQ ID NO: 119190 - protein, 80 aa, Glycine max
  Coding DNA Sequence Number=SeqID_2412
MQTASSIGAFAVAVTRGEYAIATSGFHGIASPIGDFAMQGGVASQTGEFQAQGAGFSAFSGFSVGRLFQLAGAGVQAKGK

SEQ ID NO: 119191 - protein, 72 aa, Glycine max
  Coding DNA Sequence Number=SeqID_2413
MTALLTGGCSSTCFPTPAPNRCSTFLEEEDHRREERVANSRMRFWKLSRAREDGVFLVTNSPPHAIFLFLKK

SEQ ID NO: 119192 - protein, 67 aa, Glycine max
  Coding DNA Sequence Number=SeqID_2414
MTALLTGWCSSTCFPTPTPNRCSTSQTMFLEEEDHRREERVANSRMRFWKLSGGREDGGYKGNTRTF

SEQ ID NO: 119193 - protein, 159 aa, Glycine max
  Coding DNA Sequence Number=SeqID_2415
  Homolog annotation: Hit_ID=Q1SQF8; Match level="QueryCoverage=30%, HitCoverage=12%, E-value=6e-09, Identity=57%"; Hit description =Cyclin-like F-box
MQRANASLCKEKSSSTKVLKTRQYDNGSAQSLSLVVKLTYARCMLFNAGKKIAIKGALLQSYSRDRSVFKLCKTPAPLARLLWLLHVAKTPLPLAGSMVSPAPLAISPCKGSSQSNWRVPSTGRRLLSLFRLFSWQAFSVGRGRGTGKREVATGIGELG

SEQ ID NO: 119194 - protein, 98 aa, Glycine max
  Coding DNA Sequence Number=SeqID_2416
MEEKKSVAHSLLFYCVVNKTWVWCYSWIDLHNPLPHNPCMWLVVWGAVVWHLWRARNSCIFQGTKIDLVTLKHDLVMVEGIVVEQYFVIYGKEKLAYD

SEQ ID NO: 119195 - protein, 117 aa, Glycine max
  Coding DNA Sequence Number=SeqID_2417
  Gene Ontology: Mol. function=sucrose transporter activity; Cellular component=integral to plasma membrane; Biological process=sucrose transport
  Homolog annotation: Hit_ID=Q84RQ3; Match level="QueryCoverage=86%, HitCoverage=19%, E-value=1e-21, Identity=50%"; Hit description =Sucrose transporter 4 protein
MYPEGNPILWCLRINLSTKRSLCDVVGNVEDLKVDNEDSDGNRVVVRGVTEEPTDVGGVSNDKDNDKDDDDIDEDEGPTTVEAASATVINVADKGLHEEVEDWAADPNDAGTLMGDS

SEQ ID NO: 119196 - protein, 329 aa, Glycine max
  Coding DNA Sequence Number=SeqID_2418
  Homolog annotation: Hit_ID=Q84YE8; Match level="QueryCoverage=32%, HitCoverage=24%, E-value=7e-23, Identity=50%"; Hit description =Expressed protein-like protein
  Subcellular localization annotation: CTP_CleavageSite=55; ConfidenceScore=5.26e-01
MTTSLETPVSPLHLDNSQEGTSVMGSCSSPLLSPSSDKRFWSTLRSRIDTLLDARQSETSTHSPTNVEGNNRLKEDSMLLMRGFDSVAHTLSLLSNNLDNALQGARELANPPTLTDIFHSKNDKVENKEDSREKQKEEEESKQGMKRKFDPNDVSEEDAVDSQKEENGKKLMDKNIKRAKNLAVSMATKAGSLARELKSIKSDLCFMQERCSLLEEENRRLRDGFAKGVRPEEEDLVRLQLEALLAEKSRLANENANLVRENQCLHQLVEYHQLASQDLSDESYDEHAIQGMYLDFSSPPPTIAEETRDEDGDENGRATHTQERYLQVL

SEQ ID NO: 119197 - protein, 313 aa, Glycine max
  Coding DNA Sequence Number=SeqID_2419
MGRKRAPKTATGFKCRVSRGSRTHDGGHTIVSPFWRLLQKNINFWNTVVEPQPSIGNIQLSRALDSQLEIPLPGLTSPKHPNLLVDGVEMRHAKSPAQEQVNQKNMSIKRSLLPQLRKKPNSVVHLEKDEADTQLEQVLLADPELELLELPLEHEHESEPELAYNLGEKKSWKEKVDCALQRIEALDKTVELLKSKVDENIVLCEAPSMSSISYKSMYIDSQKKVEALTVENQRLNGKLENALGKIGVYKDEIHVLVDVKDKTKDAVKDTMISNVAKTIETAVNVSNQAMQIHNACSASAVKRKRNYIKRRKK

SEQ ID NO: 119198 - protein, 98 aa, Glycine max
  Coding DNA Sequence Number=SeqID_2420
MKYWSSWRRSVHSQDWCGWVLWSTTGAGGSEVASRDLSGVVVVTCLTCVSHLPPPLKQMAMEWWPQMTHPPHTMVPGLWDLHLTYEEKVESRARLPSP

SEQ ID NO: 119199 - protein, 116 aa, Glycine max
  Coding DNA Sequence Number=SeqID_2421
  Subcellular localization annotation: CTP_CleavageSite=33; ConfidenceScore=5.25e-01
MNIGALISCQMTFIAQFNTSRLGFPTLITALCRARGVVSESLTFERLSPVINLTYIRKNCWNLEDLIVSIRGARRARARPAELPSTSAASTPAAPCVPAQTDSQCFEAMLQSIHQG

SEQ ID NO: 119200 - protein, 67 aa, Glycine max
  Coding DNA Sequence Number=SeqID_2422
MYSSLHLVLVRSRSEGDVDLFSMERSTKEDFIGKQLKQQLTRTATELAFLRGGNGTKGRAGARAAAS

SEQ ID NO: 119201 - protein, 174 aa, Glycine max
  Coding DNA Sequence Number=SeqID_2423
  Gene Ontology: Mol. function=ATP binding; Cellular component =chromosome; Biological process=DNA metabolic process
  Homolog annotation: Hit_ID=Q8L6H8; Match level="QueryCoverage=36%, HitCoverage=5%, E-value=3e-28, Identity=96%"; Hit description=SMC4 protein
  Pfam annotation: Domain name=SMC_N; Domain location=42-172; Score= -63.6; E_value=5.3e-07; Accession=PF02463.9; Description=RecFRecNSMC N terminal domain
MVTSTHYTIEAQKEHYKFKKLENYMVLPNMASIKDTNAISYNLCGLVRMASGDLKVKSFSAVVGPNGSGKSNVIDAMLFVFGKRAKQMRLNKVSELIHNSTNHQNLDSAGVSVHFQEIVDSGETHVQTHFSKTGNQVNLGTTRDQIMSERKRRQLMAERFIAFSSIIPGLKVSA

SEQ ID NO: 119202 - protein, 331 aa, Glycine max
  Coding DNA Sequence Number=SeqID_2424
  Homolog annotation: Hit_ID=Q10NR6; Match level="QueryCoverage=39%, HitCoverage=30%, E-value=1e-13, Identity=40%"; Hit description =Expressed protein
  Subcellular localization annotation: CTP_CleavageSite=6; ConfidenceScore=5.06e-01
MSSSSVCQGLQSCLEPRVMEPRILRLKLSLQQGSNFPQSSPSPTNNTNTISLSPLSDSEENPLTNHECDKNNTKSDLASGWSLVQTLSHNKTEDQVYVHPTVKRSSSILSEKSLEMCTESLGSETGSNASDSGDDMSLFSSDTNTCSTEHTTTTTVTVTVTTHASYMSKRVNRTCNFPPPLTTITGFGGVHVRPLREGGRLILEAVASPSPSPYFHAERGDGRLRLCLFEGFSASDDDDDVCEGVDDQEEEEEKKNENEENREEEEEKEEKECGEEDITSGAEEEEECVENVEDEMGVKKLARPSRCKESGKGDIFGDALANLSFPRFLCL

SEQ ID NO: 119203 - protein, 201 aa, Glycine max
  Coding DNA Sequence Number=SeqID_2425
  Gene Ontology: Mol. function=kinase activity; Biological process =carbohydrate metabolic process
  Homolog annotation: Hit_ID=Q84PE0; Match level="QueryCoverage=99%, HitCoverage=54%, E-value=1e-47, Identity=46%"; Hit description=AKIN betagamma
MGIHGSNLTEEQLETHTIAVWRETQECRTDSNGRTYPQHMVHLLHLVSLSEILKCIYRHFEHSSHCLPILQLPIDSIPVAEVSSIPIVDNNDSLLDINSRRDIIALVKDKVYARISLSGFSIHQVLHFSRCTTLALLLGRDARFSCRLHNGPRCHMCLRSDSLHKERLANPGVRQLVVIEAGSRRVEGIISIGNVFRILLS

SEQ ID NO: 119204 - protein, 54 aa, Glycine max
  Coding DNA Sequence Number=SeqID_2426
  Gene Ontology: Mol. function=kinase activity
  Homolog annotation: Hit_ID=Q84PE0; Match level="QueryCoverage=92%, HitCoverage=10%, E-value=2e-12, Identity=66%"; Hit description=AKIN betagamma
VVALDITLPGKQAFHARYREGISMASLWDSNKCQFVGMLSAMDFILVLKEVCGE

SEQ ID NO: 119205 - protein, 219 aa, Glycine max
  Coding DNA Sequence Number=SeqID_2427
  Gene Ontology: Cellular component=membrane; Biological process =polysaccharide biosynthetic process
  Homolog annotation: Hit_ID=Q48H27; Match level="QueryCoverage=79%, HitCoverage=36%, E-value=1e-18, Identity=34%"; Hit description =Polysaccharide biosynthesis domain protein
MPVMRGTIACIIGLLSSRIPVAAVATTHQPVNLRNKGPHGAGESGAQRKADKGFEHAFQIVALLFARCAGHQLTGFPDTAGGFGNRHQQLPDKEGQQRIREQLDHQYRAKSTQRGNDQVHAVEPDLMLKTDNHAAIRAGTPANRGGDHHDRHGHHHITGRQVLRIQPVRGNPWRRQPAEHHQHQGGEQEEAGQRGKQRRKPDKFCLIRPVACRLAHQRG

SEQ ID NO: 119206 - protein, 239 aa, Glycine max
  Coding DNA Sequence Number=SeqID_2428
  Gene Ontology: Mol. function=transporter activity; Cellular component= membrane; Biological process=transport
  Homolog annotation: Hit_ID=Q1LNX4; Match level="QueryCoverage=84%, HitCoverage=40%, E-value=2e-12, Identity=29%"; Hit description=RND efflux system, outer membrane lipoprotein, NodT precursor
MASLGNTVLARVLLSSMATLGLTACMHTEMPALNDDIPTNWNHRATSQIAQNSQPWWHSLNDALLNNIAQTALTQNLSLQQASERIMYARALQQQELASEKPQLSFYAGPNNLSRALASNGAGSGQSNQSQLVSSGAYLAGFDLFWELPLFGQQSGQRQITQAELQISEADLSLKQISLISEIVRVYAELAAAVQRDKQLKMTETNYVNWKTSAIKGVEHGLFASDVIESMTEGGRVAI

SEQ ID NO: 119207 - protein, 134 aa, Glycine max
  Coding DNA Sequence Number=SeqID_2429
  Homolog annotation: Hit_ID=Q5HXX6; Match level="QueryCoverage=45%, HitCoverage=14%, E-value=5e-07, Identity=45%"; Hit description=RND -type multidrug efflux pump, outer membrane protein
MLKSIRLFSLAAFVSLLSACATFNRVDIQPVETARQLEQRTLSDESMLTFTQSVLGPAFSVNQPQWNIDALTLAAVYFNGDIQISKAQQKLAAASVITAKQRPNPTLTSNFTYVTNVVTKHCALDYWRCAQYAN

SEQ ID NO: 119208 - protein, 353 aa, Glycine max
  Coding DNA Sequence Number=SeqID_2430
  Gene Ontology: Mol. function=calcium ion binding; Cellular component =intracellular; Biological process=small GTPase mediated signal transduction
  Homolog annotation: Hit_ID=Q6ATR5; Match level="QueryCoverage=92%, HitCoverage=47%, E-value=1e-100, Identity=57%"; Hit description =Expressed protein
  Pfam annotation: Domain name=EF_assoc_2; Domain location=245-334; Score=127.0; E_value=5.4e-35; Accession=PF08356.2; Description=EF hand associated
  Pfam annotation: Domain name=MMR_HSR1; Domain location=14-127; Score=- 15.8; E_value=0.028; Accession=PF01926.13; Description=GTPase of unknown function
  Pfam annotation: Domain name=Miro; Domain location=15-127; Score =115.5; E_value=1.5e-31; Accession=PF08477.3; Description=Miro-like protein
  Pfam annotation: Domain name=Ras; Domain location=15-172; Score= -49.3; E_value=1.4e-05; Accession=PF00071.12; Description=Ras family
  Pfam module annotation: Pfam domain module=EF_assoc_2::MMR _HSR1::Miro::Ras; Domain location=245-334::14-127::15-127::15-172
MANHSSSFGGRSGVRVVVAGDRATGKSSLIAAIATESFAEAVPPVLPPTLLPPDLYPDAVPLTVVDTPSSLEKQRKRNEELKGADVVVLTYACNDTASFSRLSSYWFPELQKLEVKVPVIVVGCKLDLRDESQEVSLERVMTQLLQQFKEIVTCIECSAATQYQKTVLSIVDAEKWQKVNNPVPEVFYFAQKAVLHPVDPLYDHESQALKDRCVRALRRIFVLCDRDMDEALNDTELNEFQVRCFNAPLQSSEIAGVKTVVQQKVPEGFNSHGLTFPGFIYVHNMFLKKGRPETLWAVLRDFGYDNNLKLMDDFLPIPSKRALDQSVELTGEAVEFLNGIFRLLDTDKVVFHI

SEQ ID NO: 119209 - protein, 229 aa, Glycine max
  Coding DNA Sequence Number=SeqID_2431
MARLDETCIEHGGDLFFNFGFLKVRITIRLDIDKVCVRKKMDVVLDGTVGGMELMEEGVEGSRWCGEEEYEVWAGTGVIWNKVDMLCVWARHLTWWAEAEEGMRGASVRKVICWPKLEKVFPLSIMTQSGVVDDEGRAKNLATHDWINYACCRRPPISRPGGCEEAPKGERSLGSRGGVNGNNYILIDDNQMQMRFTMVAGPPLIVTVGEGLAGFEGGSTGATGGMRWP

SEQ ID NO: 119210 - protein, 297 aa, Glycine max
  Coding DNA Sequence Number=SeqID_2432
  Gene Ontology: Mol. function=calcium ion binding; Cellular component =intracellular; Biological process=small GTPase mediated signal transduction
  Homolog annotation: Hit_ID=Q6ATR5; Match level="QueryCoverage=98%, HitCoverage=45%, E-value=3e-87, Identity=56%"; Hit description =Expressed protein
  Pfam annotation: Domain name=EF_assoc_1; Domain location=3-73; Score =127.8; E_value=3e-35; Accession=PF08355.2; Description=EF hand associated
  Pfam annotation: Domain name=MMR_HSR1; Domain location=78-198; Score=- 10.6; E_value=0.0093; Accession=PF01926.13; Description=GTPase of unknown function
  Pfam annotation: Domain name=Miro; Domain location=79-198; Score =53.5; E_value=7.1e-13; Accession=PF08477.3; Description=Miro-like protein
  Pfam annotation: Domain name=Ras; Domain location=79-244; Score= -98.8; E_value=0.072; Accession=PF00071.12; Description=Ras family
  Pfam module annotation: Pfam domain module=EF_assoc_1::MMR _HSR1::Miro::Ras; Domain location=3-73::78-198::79-198::79-244
MCPWDDALYKDAAERTDMGYISLNGFLAQWALMTLLDPPCSLANLIYIGYSGNPAAALRVTRRRAVDRKKQATERNVFQCYVFGSKNAGKSALLDSSLGRPFSNNYTPTTVERFAANSIELIGGTRKTLVLREIPESEISNVLSNKDYLAACDVAVFVYDSSDEHSWKKSRDLLEKVAQQGDLTGYRVPCLLIAAKDDLTPYPRALQDSVKVTQELGIEAPIHVSMKLGDSSNVYHKIVNAAEHPHLSIPETEIGRKRKQCHRLLQHSLVFASVGTAMAVVGLAACRAYAVRKNSSG

SEQ ID NO: 119211 - protein, 503 aa, Glycine max
  Coding DNA Sequence Number=SeqID_2433
  Gene Ontology: Mol. function=RNA-directed DNA polymerase activity; Cellular component=chromatin; Biological process=chromatin assembly or disassembly
MLAWPMPTSPTALRRFLELIGFYRKFIKGYATLAAPLTNLLQKDQFQWSPTADSAFQNLKLMMTRAPVLVTPNFSIPFTIETYASSFAIGAVLIQDKHPIAYYSKVLCPRLQRASAYVWELHAITSSVRKWRHYLLGSPFTILTDHKSPKDFMSQALPTWLSMLYLASHRRRVHVFLYQCPTLIFWTSFVPPFFQDDKYVDLLSQIHSSPASHPDLSLHKDFIIRQGHIWLPFPTPFTDILLEEFHSSPLGGHTSISKTLNRLRQNFDWPHIHVDVRRYVSWCLTCQQTKYETKKIARLLHPLPIPSNIFSKAAHFGALPTQHFAYKVAQLFLDMGTSPIDVVDHMPTTRTELHTTLQRRLRKAQEATKTAADKHCRDVQYVVDDWVYVRLRPYRQTSLASKYTKLSKHFYGPFQVQEHVGPMAYKLQLPFLSRLHPIFHVSFLKPHQGPLPTTSAMLPPIADNHNPLVSPLSILDWKWDNTSSALIQKVLMQWDGLVPEDTS

SEQ ID NO: 119212 - protein, 73 aa, Glycine max
  Coding DNA Sequence Number=SeqID_2434
MELDDGGQSLNIVTIVNLHPLIIHDLAMLRVGRRGVHQLNCSIRLYILDDFGGLISIEPHLFQLQQLQLPFLP

SEQ ID NO: 119213 - protein, 213 aa, Glycine max
  Coding DNA Sequence Number=SeqID_2435
MASVHDIAAHELGFEEGIFWLPSHVMDEACDSKCNIYLSIPTDTYEEPPPKTAATLQISKGNTVTGDAINVCVEVLYCSKFSTRSSYDQRPKHATGGPGMQAVFLVSGQGSCGTGVFLPQKAGTKSIRKPACAPVLLPARVVQALNLKVHQLGLQISPSQAPKYSPRSGEVCTSESTKKKTNQKDALKQCSVVVSHESQSSSPEIFLPKEWTY

SEQ ID NO: 119214 - protein, 73 aa, Glycine max
  Coding DNA Sequence Number=SeqID_2436
MTYERSYLHIRCFQMRDPRVGFIAVPRWAPNIIEYLTRDKEVQIYSNIKKLEITYQLGIPTAKDQTSVFLCQG

SEQ ID NO: 119215 - protein, 329 aa, Glycine max
  Coding DNA Sequence Number=SeqID_2437
  Gene Ontology: Mol. function=protein translocase activity; Cellular component=membrane; Biological process=protein secretion
  Homolog annotation: Hit_ID=Q9SIQ4; Match level="QueryCoverage=73%, HitCoverage=45%, E-value=1e-51, Identity=49%"; Hit description =Putative preprotein translocase SECY protein
MEATRFSPNHFYPHRFQTKPNALRGKFPALNANEKKKKREAINTKHCSLLLNVNYAERRYVKCINGIGARVSLFTNPAFNASNRSLFPKLNRTLSVSFSDRLRGDYARVDEEVVPATRGDGGEAVISSSSPSANSSGTLQLKPLMFRNRFLNFARLGSVINGAAESFFKSEIRRRLFVTAMLIVISRVGYFIPLPGFDRRLIPEDYLSFVAGSSVDELGDFTAELKLSIFQLGISPQIIASIIMQCVHKTFYELNLYKIFMCRWWMSFGFAILEALIVACYSLPYSIYAATYRVKHVMVTSILLVCGAMTITWICDTISESGFGIFLAT

SEQ ID NO: 119216 - protein, 170 aa, Glycine max
  Coding DNA Sequence Number=SeqID_2438
MAKASSEPKIDYAEIYTASDTFDGSAVFHTIYDVVGFVLYMHQQIPSTVQDMSVEFDAMHSEYKQLEMELGTEVKPSFRRKHVSKMRDIKVGIKRLDKLMNSLLNVQTAFKIMISEIPTIDGVVLALGASPLRPKHIYVLNFSHESGVSKVDDDFARSKAADTLSRKVPY

SEQ ID NO: 119217 - protein, 235 aa, Glycine max
  Coding DNA Sequence Number=SeqID_2439
  Gene Ontology: Mol. function=protein translocase activity; Cellular component=integral to membrane; Biological process=protein transport
  Homolog annotation: Hit_ID=Q9SIQ4; Match level="QueryCoverage=98%, HitCoverage=41%, E-value=1e-105, Identity=81%"; Hit description =Putative preprotein translocase SECY protein
  Pfam annotation: Domain name=SecY; Domain location=1-216; Score= -153.5; E_value=1.6e-05; Accession=PF00344.11; Description =eubacterial secY protein
SAVSWWPYVLAVLGIFTIVTMWAVVVTEGCRKVKLQYYGFKLASAAREHSPITEVEPYIPFNINPAGMQPVLTTSYLLAFPSILASLLRSPFWEHAKEMLNPETSVGAEPWVYYSIYAFFVFLFNIFDIANMPKEIADYLNKMGARIPNIKPGKATIEYLSKVQASTRFWGGLLLSVLATTSSVLDHYLRRVNAGFAIGFTSVLIIVGSIIELRRSYQAYNVMPSLSNALRRYGV

SEQ ID NO: 119218 - protein, 420 aa, Glycine max
  Coding DNA Sequence Number=SeqID_2440
  Gene Ontology: Mol. function=transcription regulator activity; Cellular component=nucleus; Biological process=regulation of transcription
  Homolog annotation: Hit_ID=Q9FEA1; Match level="QueryCoverage=96%, HitCoverage=77%, E-value=5e-67, Identity=37%"; Hit description =Anthocyanin 1
  Pfam annotation: Domain name=HLH; Domain location=257-306; Score =55.2; E_value=2.2e-13; Accession=PF00010.16; Description=Helix-loop -helix DNA-binding domain
MTVVCIPVLEGVVELGTTDKMEEDLNFIQHIKSFFIDQQHPALTAKPALSEQYSTSKPTSSSSSYPLVTANNTIPIQNIVDRGEAIILNNNTKEAELAVPNSSFIPSELMELDATLEEFRVGSSGDGSNHLDSFPTEKSMALCSAGLELLQLQLPPAPAHPPTENLAQGGTDTHYSQTVSSILQKNSRRWPESPSLNLLTDSFQSAFNKWNSGADDYQHHFHVSVASVTSQWLLKYILFSVPYLHTNWLKGKGTSPYETSHVMAERHRREKLNERFLILRSMVPSVTRMDKASILGDTIEYIKQLRDKIESLEARKRLTGKRRMRQVEVSIIESEALLEVECVHREGLLLDLMTKLRELGVEVMMVQSWVKDDGVFVAEMRAMVRENGNGIKASVIEVKNALNQIIPRHEPYTLASSDHF

SEQ ID NO: 119219 - protein, 51 aa, Glycine max
  Coding DNA Sequence Number=SeqID_2441
MKRTSGGSRTVWPCCAVTIMHCVVRATVQGARTWCCMCEGEGKIVMMRLTK

SEQ ID NO: 119220 - protein, 121 aa, Glycine max
  Coding DNA Sequence Number=SeqID_2442
  Gene Ontology: Mol. function=transcription regulator activity; Cellular component=nucleus; Biological process=regulation of transcription
  Homolog annotation: Hit_ID=Q9FEA1; Match level="QueryCoverage=91%, HitCoverage=16%, E-value=3e-48, Identity=81%"; Hit description =Anthocyanin 1
MATPPPNNSLQTMLRAAVQSVQWTYSLFWQLCPHKGILTWGDGYYNGAIKTRKTVQAMEVSTEEASLQRSEQLRELYESLSGGETNAKTRRPCASLSPEDLTETEWFYLLCVSFSFHPGLG

SEQ ID NO: 119221 - protein, 124 aa, Glycine max
  Coding DNA Sequence Number=SeqID_2443
MPPTRHPLDPDKSNRALGFLALITGLCQSFGVPVTPSKVIRPPITRAFIEKYCTPRQAQGDAPQAADAPPPPHQADPAGSLGMERYLQRLVRQQAANHRGQVTWPGDWPKAQAGEAPAEAPSDA

SEQ ID NO: 119222 - protein, 83 aa, Glycine max
  Coding DNA Sequence Number=SeqID_2444
MKALSVNRKELLLMMAVGAIESPKGHNGCRSSEKSKAFWENDLICILFEEHVSLIYTPNLLPGVTSKGAVVDIATSPAKTQIV

SEQ ID NO: 119223 - protein, 59 aa, Glycine max
  Coding DNA Sequence Number=SeqID_2445
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=99%, HitCoverage=13%, E-value=5e-20, Identity=78%"; Hit description=TBC domain, putative
DPGAPADSFYETRPECTDVPKSRFRIKAGKTLSARKWHAAFSPEGYLDIGKTLSRIHRG

SEQ ID NO: 119224 - protein, 162 aa, Glycine max
  Coding DNA Sequence Number=SeqID_2446
  Homolog annotation: Hit_ID=Q8L9B9; Match level="QueryCoverage=29%, HitCoverage=9%, E-value=6e-10, Identity=64%"; Hit description =Chloroplast nucleoid DNA binding protein, putative
MMMPLFHIVLRRNSKELKVVEGVELRVFDERSKAHGSRNSEISEDNRGGFGQSKMIDEASSTMHVTLVLQNMNGGNLVVANLVLVVVAGGVQLTVERGPRGDSDVGSRFGGGEVGVLFLGRVLRRVWIRAMRTWVGGGGSEGASFRFGVGMQRRERKGERQG

SEQ ID NO: 119225 - protein, 169 aa, Glycine max
  Coding DNA Sequence Number=SeqID_2447
  Gene Ontology: Mol. function=Rab GTPase activator activity; Cellular component=intracellular; Biological process=regulation of Rab GTPase activity
  Homolog annotation: Hit_ID=Q2R1Y1; Match level="QueryCoverage=92%, HitCoverage=45%, E-value=1e-52, Identity=55%"; Hit description =RabGAP/TBC domain-containing protein, putative, expressed
MSDLCSPMIILLNDEADAFWCFERLMRRLRGNFRCTDNSVGVEAQLSTLATITQMMWALEYDPDLFWMYEDDDDKSEESKGRLKSLRHYGKYERENMKNGAKNGEDPPLPISVFLVASVLKDKSTMLLQQAKGLDDVVKILNDVNGNLDAKKACVAALKLHKKYLKKVL

SEQ ID NO: 119226 - protein, 285 aa, Glycine max
  Coding DNA Sequence Number=SeqID_2448
  Gene Ontology: Mol. function=nucleic acid binding; Cellular component= nucleus; Biological process=defense response
MSKLSSMRLIGVAGVRKHIIEMRDLATQLKSLQVEVSESFMEEERLALEIGEGAPTMTQDKGKKEKNHIPSIVKIKKESSTRIFESRHAKFLENDVASGSDLTQGIGLEKNQCEGTIPTSNPVEQHQTQNVEQPVEQHQTQDVEQPVEQQPEGVDESQYDFGVENDPKSFLQAINGCNFKLCYDSTKDELESMANNKVWDLVELPNGIKPIGCKWVFKTKKDSLGHIERHKARFVAKGFTQREGVEYRETFSLVSMKHSLCIIMALVAHFDLELHQMDVKTAFLN

SEQ ID NO: 119227 - protein, 68 aa, Glycine max
  Coding DNA Sequence Number=SeqID_2449
MNDKVRIVLRSPREGSLALLIQLSQLKYGSTSVDQIVLEKYYIILDVESTRTEIEVAFMRTQGLIETP

SEQ ID NO: 119228 - protein, 70 aa, Glycine max
  Coding DNA Sequence Number=SeqID_2450
MYRSAKLFAPPDSHHSKDFLDFPYPILSTIRVASFIESRKVVSLEAEAQKGLSDGPWENYKQLGLDSQLS

SEQ ID NO: 119229 - protein, 237 aa, Glycine max
  Coding DNA Sequence Number=SeqID_2451
  Gene Ontology: Mol. function=receptor activity; Cellular component =anchored to membrane; Biological process=response to abscisic acid stimulus
  Homolog annotation: Hit_ID=Q9LV60; Match level="QueryCoverage=95%, HitCoverage=87%, E-value=1e-77, Identity=59%"; Hit description =Putative 33 kDa secretory protein
  Pfam annotation: Domain name=DUF26; Domain location=164-218; Score =81.2; E_value=3.1e-21; Accession=PF01657.8; Description=Domain of unknown function DUF26
  Pfam annotation: Domain name=DUF26; Domain location=52-106; Score =109.1; E_value=1.3e-29; Accession=PF01657.8; Description=Domain of unknown function DUF26
  Pfam module annotation: Pfam domain module=DUF26::DUF26; Domain location=164-218::52-106
EDPLGRFCNENTIIGSGGKLSANIDKILTEIALKTPSTGFVATTYGKDQDKVYALAQCRGDVSTQDCSNCIQDATKQIRQRCPNQVDGRIWYDYCFLRYSNKSFFGEVDTSFGIFYFNVENVTDPEDFNKELGALMDHIRAQAVVPREEGLGKGKSVLSPFVTLYALVQCTRDLSEISCAQCLSIAVNNFPNFCSNRKGCRVLYSSCYVRYELYPFFFPLDSNKTGPSNTAKVSVYT

SEQ ID NO: 119230 - protein, 94 aa, Glycine max
  Coding DNA Sequence Number=SeqID_2452
MGEEVVAQLAQGITPEATCSPKQAQLAQANWVWQQATTTSGGHRWSWVVKKKVLSELVSLSGSPLFELSVKIHAKHDNSRLAQFPLGLKLRLAR

SEQ ID NO: 119231 - protein, 641 aa, Glycine max
  Coding DNA Sequence Number=SeqID_2453
  Gene Ontology: Mol. function=endopeptidase inhibitor activity; Cellular component=membrane; Biological process=aromatic compound metabolic process
  Homolog annotation: Hit_ID=UPI00005FA64A; Match level="QueryCoverage =99%, HitCoverage=38%, E-value=0.0, Identity=60%"; Hit description =COG2373: Large extracellular alpha-helical protein
  Pfam annotation: Domain name=A2M_N; Domain location=35-298; Score =289.5; E_value=6.2e-84; Accession=PF01835.9; Description=Alpha-2 -macroglobulin family N-terminal region
  Pfam annotation: Domain name=A2M_N_2; Domain location=502-632; Score =69.6; E_value=9.9e-18; Accession=PF07703.4; Description=Alpha-2 -macroglobulin family N-termina
  Pfam module annotation: Pfam domain module=A2M_N::A2M_N_2; Domain location=35-298::502-632
MQLPLGDVATLKQPGVYLAVMKQAGTYNYTQPATLFTLSDIGLSLHRFPAQLELFTQSLASGDPLADVSVQLLDEKGQQLASGSSDSEGHLRLAANAKGKLLLATSKGQTSLIDLNRPALDLAEFPIDGPQGYDKQFFIFGPRDLYRPGETVIVNALLRDADGKPLPPQPVKAEVVQPNGEVAQTFVWQPENGVYQQRFALPASAMTGKWTLRINSGDNQPRSWPFNVEDFLPERMALSLKSNTQPLSPDADVTFDVEGRYLYGAPAAGNELQGQLFLRPAREAVAALPGYQFGDITEELKRSLDDVDEKLDDSGRLQLRVESSWAESHSPLNLILQASLLETGGRPVTRRATQAIWPAAALPGIRPLFNSESVYDYRTDRYNDEPTVPENSLAEFDVVYANAQGEKLAAQDLDVRLIHERRDYFWSFSDSEGWQSRYDEKDLQEEQQRISVAAGGSQKVSFPVEWGTYRLEVHAGDNIISSVRFQAGYWWQDNTNGTGALRPDQVKLKIDKAAYQPGDTARVTVESPAAGKGYLLVESSSGTLWWQPLDVPAGGATINVPVSAEWKRHDLYLSAIVVREGDKANGTTPKRAVGLLHLPMATAARRLTLTLDAPDKIRPEQTVKVKVKARREGGALPQQVQ

SEQ ID NO: 119232 - protein, 33 aa, Glycine max
  Coding DNA Sequence Number=SeqID_2454
MASAGQVDSGAGAGGSFSMSGCVLDLDNIGNSC

SEQ ID NO: 119233 - protein, 47 aa, Glycine max
  Coding DNA Sequence Number=SeqID_2455
MGDFTKIFNRSSSFFGLQPKELRRSDFLITIEEYVGARETPSSTTKR

SEQ ID NO: 119234 - protein, 311 aa, Glycine max
  Coding DNA Sequence Number=SeqID_2456
  Gene Ontology: Mol. function=ent-copalyl diphosphate synthase activity; Cellular component=chloroplast; Biological process =metabolic process
  Homolog annotation: Hit_ID=O04408; Match level="QueryCoverage=83%, HitCoverage=41%, E-value=8e-60, Identity=45%"; Hit description=Ent -kaurene synthase A, chloroplast precursor
  Pfam annotation: Domain name=Terpene_synth; Domain location=1-188; Score=39.4; E_value=7.7e-10; Accession=PF01397.11; Description =Terpene synthase, N-terminal domain
WKQLLKLQSRDGSFLFSPSSTAYALMQTKDENAHKYPEKTVQTFNGGARDQRLCELCFKVCEVLSSAGIVGICWARNSEVQDIDDTAMGFRLLRLHGNQVSPAVTGMFNLYRAFQVLLQGEKILEYAKNFYAKFLTEKCEANELLNKWIMTKDLPGEFAFLLLLINICKTTLQMGYALEATRAFARIPGCDTMPYVNNDVYLQLAKLDYSNCQAVHCVEWEKNPKLASIFEPKKFLERFAWAKTAALLQTLRFHIKDEETKSALEQEKREEELLEILLTNLDYLGFQMFRSHGQEFSHYLNQAVSRNPSKL

SEQ ID NO: 119235 - protein, 109 aa, Glycine max
  Coding DNA Sequence Number=SeqID_2457
  Gene Ontology: Mol. function=ent-copalyl diphosphate synthase activity; Cellular component=chloroplast; Biological process =metabolic process
  Homolog annotation: Hit_ID=Q1T6K9; Match level="QueryCoverage=38%, HitCoverage=76%, E-value=3e-10, Identity=73%"; Hit description =Terpenoid synthase
MAGYWELHLNPHYQSLLEVTNEVCHALRSYQSNKIQIFYSSAIIVRLKIVATAASVQPASLPLTLNQTYKNLCNWCSKIPLMACTPMSRIDSSQWSRAFTMEHIVTQRP

SEQ ID NO: 119236 - protein, 138 aa, Glycine max
  Coding DNA Sequence Number=SeqID_2458
  Homolog annotation: Hit_ID=Q6V7U9; Match level="QueryCoverage=53%, HitCoverage=28%, E-value=2e-07, Identity=35%"; Hit description =Putative chalcone isomerase
MTIRLQVVYGRLSIRSVRSAFEVSVGSKLQKFGGSDNKELLQRFTSQFKDEFKIPRGSVIHLSRDKGHVLRTSISSMLPYAITPCHLGVTVVFFGDHSYAFNLEGPFKVKLLMDRKWEASRVNSYAKEEIELNMASYL

SEQ ID NO: 119237 - protein, 201 aa, Glycine max
  Coding DNA Sequence Number=SeqID_2459
  Gene Ontology: Mol. function=malate transporter activity; Biological process=response to aluminum ion
  Homolog annotation: Hit_ID=Q9LS23; Match level="QueryCoverage=68%, HitCoverage=25%, E-value=3e-24, Identity=45%"; Hit description =Arabidopsis thaliana genomic DNA, chromosome 5, BAC clone:F10E10
  Pfam annotation: Domain name=UPF0005; Domain location=57-201; Score =7.8; E_value=1.9e-06; Accession=PF01027.11; Description =Uncharacterised protein family UPF0005
MESTHVIAITNGEENMIRSSKENKTFQFQLPPIISHLGKNEVHCVSITSSNPRHKQVQSGGHDTRKIIHCIKVGISLVLVSLLYLLNPLFKQVGENAMWAIMTVVVMFEFSAGATLGKGFNRGLGTIIGGGLGCLAAVFAQSIGIGRVGNSIIIGASVFIFGSVATYLRLVPSIKKRYDYGGNDIHADFQSSCGFWRTWGM

SEQ ID NO: 119238 - protein, 488 aa, Glycine max
  Coding DNA Sequence Number=SeqID_2460
  Homolog annotation: Hit_ID=P00959; Match level="QueryCoverage=27%, HitCoverage=19%, E-value=7e-44, Identity=69%"; Hit description =Methionyl-tRNA synthetase
  Pfam annotation: Domain name=LrgA; Domain location=372-481; Score =170.3; E_value=5e-48; Accession=PF03788.5; Description=LrgA family
  Pfam annotation: Domain name=tRNA_bind; Domain location=42-136; Score= 132.8; E_value=9.4e-37; Accession=PF01588.10; Description=Putative tRNA binding domain
  Pfam module annotation: Pfam domain module=LrgA::tRNA_bind; Domain location=372-481::42-136
EALIAASKEDAAAANQPAASGPLADAPIGETITIDDFAKVDMRVALIEQAELVEGSDKLLRLQLDLGGEKRQIFSGIRAAYPDPSVLVGKMTIIVANLAPRKMRFGVSEGMVLSAGPGGKDLFVLSVDSGAQPEPDLHIAKPRARLPPLPPAGEGWGEGKTAPRLSRQHQTAINLRHYRLKFIKLLMIPEAQLCADKPVLHIAKHRTSLPPLPLTGEGTAECGVWVQSQACTSLDCLPHPLLPGWGEGKTAPRSSRQHQTAIDLRHHRLELIKHLMIPEANYAPAAALRIVLSTIQFHDQRSLNAGKINDVPSYWMLAAKLRATHISVAARCGCTVWFIAAPSLCPPAYAALISFKAKEPDMPTVLSACWRYLRAFAIVYAALYAGNGLAALLPFTIPGSILGMLLLFALLALQIIPVTWVKPGCQLLIRYMALLFVPISVGVMGYTDILSAQFGPIVVSCMVSTLLVLLIVGLSAERLQRPKESGHE

SEQ ID NO: 119239 - protein, 127 aa, Glycine max
  Coding DNA Sequence Number=SeqID_2461
  Pfam annotation: Domain name=DUF26; Domain location=72-127; Score =21.6; E_value=1.2e-05; Accession=PF01657.8; Description=Domain of unknown function DUF26
MTLSSTAPETFSNTSFGSACTKENIELNVPNTSIINVLCNNGVYTSGELEEETPAQRNYDYHNISPYPNAYAYGHATCNLNLTSSDCKTCLGAAQTAFFSTCQTPRIGARSVLYDCTIKYEQYPFDD

SEQ ID NO: 119240 - protein, 89 aa, Glycine max
  Coding DNA Sequence Number=SeqID_2462
MSDCLEAVRMLEDNNNAGVAALIEEESNLYLSNAFWCIFEERQMCWQTLSRKQASLYNEFCFYNNVPNFAVNFFEEEDIGLSYSHLGIN

SEQ ID NO: 119241 - protein, 89 aa, Glycine max
  Coding DNA Sequence Number=SeqID_2463
  Gene Ontology: Biological process=intracellular signaling cascade
  Homolog annotation: Hit_ID=Q2RAK5; Match level="QueryCoverage=99%, HitCoverage=26%, E-value=7e-23, Identity=46%"; Hit description =Expressed protein
MLEMLRDKRLVYVGDSIGRNQWESLICMLFSAIANKARVYEGRPPFGAPDGVRMTLRVDHMVWISHSWRDADVLILNAGPWWNFQKTVR

SEQ ID NO: 119242 - protein, 234 aa, Glycine max
  Coding DNA Sequence Number=SeqID_2464
  Homolog annotation: Hit_ID=Q6D8Q2; Match level="QueryCoverage=45%, HitCoverage=24%, E-value=2e-26, Identity=66%"; Hit description =Probable carbohydrate oxidoreductase
MAISGWLIASITASIPSLFACSAWAVVGHFGHAVQQILLAQSGDQRAAVEIHFAVAPVAAVLRQLVSGQRLMRAVKGTKTDVHHAGFQLAAVVTGALYVSGKAIGVIRLNGNRFVAGFRAANHKQHQQRAKSRHHARQHKGAVKFAGVLHDEAGNDRADNAGQAANQVNKAADAADAAFVHHILNNRPVNGTGDVEEEDGDRHHDHRRIHLFDGARQRHTYRCRQQRYYQHNLA

SEQ ID NO: 119243 - protein, 114 aa, Glycine max
  Coding DNA Sequence Number=SeqID_2465
MLLWGIPQLMDELVAEYRVPLEQPFGICQDEWVMEMDMTPSCLYYSIVGQHNFDSQNLGCYCLLVDKLNMPSGGSDESKFLNVEKVFYMNGWFNVCVDSGDFQGWDNLDSRGVR

SEQ ID NO: 119244 - protein, 62 aa, Glycine max
  Coding DNA Sequence Number=SeqID_2466
MESRGSRRAAKCKRRQYVHTEMTTTNWTGRHVALVNRSKRGTFMDLSSLAIVTSVFVGPWEI

SEQ ID NO: 119245 - protein, 55 aa, Glycine max
  Coding DNA Sequence Number=SeqID_2467
MGGLASHCHERLTITKRKQEVWKRMEENGGKGPQLPTLKFTLVVVFMMESCKECI

SEQ ID NO: 119246 - protein, 89 aa, Glycine max
  Coding DNA Sequence Number=SeqID_2468
  Gene Ontology: Mol. function=zinc ion binding
  Homolog annotation: Hit_ID=Q1SP42; Match level="QueryCoverage=68%, HitCoverage=11%, E-value=7e-20, Identity=76%"; Hit description=Zinc finger, RING-type; RINGv
MKAQSGEKMQDKMERNEGINLIWERLRGNFDEIGRWNSCPLGLHANGMCSCESSPMTEESSTHASISRIIMLVETLFEVLPSLILTVCC

SEQ ID NO: 119247 - protein, 88 aa, Glycine max
  Coding DNA Sequence Number=SeqID_2469
MEVEEPWQGLWLPLHYQVDIRASWHMTLEFGALWMIGDGLCGLLGERNCYWLSNDIVGLTGNLTVMIRFAFFHTHFDPFVGEDQIRKA

SEQ ID NO: 119248 - protein, 112 aa, Glycine max
  Coding DNA Sequence Number=SeqID_2470
  Gene Ontology: Mol. function=magnesium ion binding; Cellular component=chloroplast; Biological process=metabolic process
  Homolog annotation: Hit_ID=Q1T6K7; Match level="QueryCoverage=99%, HitCoverage=38%, E-value=4e-40, Identity=73%"; Hit description =Terpene synthase-like; Terpenoid synthase
  Pfam annotation: Domain name=Terpene_synth_C; Domain location=8-111; Score=-38.4; E_value=0.0029; Accession=PF03936.6; Description =Terpene synthase family, metal binding domain
MPYVNNDVYLELAKLDYNNCQAVHCAEWEKIQRWYSEAGLEEFGLSKESLLSAYFIAAASIFEPERSPERLAWAKTAALLETLRSFIKDEETKSAFVDLFNNSINGPDHSNK

SEQ ID NO: 119249 - protein, 220 aa, Glycine max
  Coding DNA Sequence Number=SeqID_2471
  Gene Ontology: Mol. function=protein dimerization activity; Cellular component=nucleus; Biological process=regulation of transcription, DNA-dependent
  Homolog annotation: Hit_ID=Q1S9P5; Match level="QueryCoverage=66%, HitCoverage=72%, E-value=2e-61, Identity=81%"; Hit description=CAMP response element binding (CREB) protein
  Pfam annotation: Domain name=bZIP_1; Domain location=94-154; Score =46.3; E_value=1.1e-10; Accession=PF00170.11; Description=bZIP transcription factor
  Pfam annotation: Domain name=bZIP_2; Domain location=90-147; Score =45.3; E_value=2.1e-10; Accession=PF07716.5; Description=Basic region leucine zipper
  Pfam module annotation: Pfam domain module=bZIP_1::bZIP_2; Domain location=94-154::90-147
  Subcellular localization annotation: CTP_CleavageSite=46; ConfidenceScore=5.03e-01
MQSREVVSGLNYLLPSNPCPYPPNNNNYTTMFQNNINPTFQFQRFSNQIYGYNNINNTPYHKVPDLFSPQSSCISSNSTSDEADEQNLSLINERKHRRMISNRESARRSRMRKQKHLDELWSQVVWLRNENHQLMDKLNHVSESHDQVMQENAQLKEQALELRQMIRDMQIHSPCPSSFITPLEDHHHDVDHVIPSAYLRSDSSNQLSNSCNNNMDDLLG

SEQ ID NO: 119250 - protein, 552 aa, Glycine max
  Coding DNA Sequence Number=SeqID_2472
  Gene Ontology: Mol. function=transferase activity, transferring hexosyl groups; Cellular component=integral to membrane; Biological process=carbohydrate biosynthetic process
  Homolog annotation: Hit_ID=Q1S9P6; Match level="QueryCoverage=95%, HitCoverage=95%, E-value=0.0, Identity=82%"; Hit description =Glycosyl transferase, family 8
  Pfam annotation: Domain name=Glyco_transf_8; Domain location=213-526; Score=321.8; E_value=1.2e-93; Accession=PF01501.10; Description =Glycosyl transferase family 8
  Subcellular localization annotation: CTP_CleavageSite=39; ConfidenceScore=5.50e-01
MAVATRGARGGSSFRSLFSFRIFISAMFSLLFVATLSVLLTTNPSTSNDDPDLPTTGNAYVHRTFLALKSDPLKTRVDLIHQQAKDHIALVNAYGAYARKLKLDISKQLKMFDELARNFSDIASKTTYKTSLFESDGPIDEDVLRQFEKEVKDRVKIARMIIVEAKENYDNQLKIQKLKDTIFAVHESLAKAKKNGALASLISARSIPKSLHCLAMRLMGEKISNPEKYRDEEPKLEFEDPTLYHYAIFSDNVIAVSVVVRSVVKNAVEPWKHVFHVVTNRMNVGAMKVWFKMRPIDGGAFLEVKSVEEFTFLNSSYVPILRQLESAKMKQRFLENQADNATNGANLKNTKSLSMLDHLRFYLPEMYPNLYKILLLDDDVVVQKDLTGLWKIDLDGKVNGAVEICFGSFHRYAQYLNFSHPLIKESFNPKSCAWAYGMNIFNLDAWRREKCTDNYHYWQNLNEDQTLWKAGTLSPGLITFYSTTKSLDKSWHVLGLGYNPSISMDEISNAAVIHYNGDMKPWLDIALNQYKNLWTKYVDNDMEFVQMCNFGL

SEQ ID NO: 119251 - protein, 112 aa, Glycine max
  Coding DNA Sequence Number=SeqID_2473
TIGDGAQIQFWNHSWIPEGGKLGDVALTTVSARLSSNLVSHYVDDQVRVLAHGNICWNKPPNDHFKLNTDGAINNDMKKAVAGRVFRDSNGKVNFFAADVGYCPVVVAENSG

SEQ ID NO: 119252 - protein, 66 aa, Glycine max
  Coding DNA Sequence Number=SeqID_2474
MDPEDKNRSNYITSFDNAVKEERGVTSCVVALPLCHYVAIIAFAPSGPAPVMPLRLDQVALTWFQS

SEQ ID NO: 119253 - protein, 175 aa, Glycine max
  Coding DNA Sequence Number=SeqID_2475
  Gene Ontology: Mol. function=zinc ion binding; Cellular component =nucleus; Biological process=ubiquitin cycle
  Homolog annotation: Hit_ID=Q1S9P3; Match level="QueryCoverage=89%, HitCoverage=40%, E-value=6e-58, Identity=68%"; Hit description=Zinc finger, RING-type; RINGv
  Pfam annotation: Domain name=zf-C3HC4; Domain location=102-142; Score= 24.0; E_value=0.00052; Accession=PF00097.15; Description=Zinc finger, C3HC4 type (RING finger)
EEDAGEEALRYLEWEILLAVNNSERNVNGVLEHEGNAVGGADFLTIQDGYVYAAEYDVLFGQFLENESALKGSPPAAKSVVESLPLVELSKEELLQGKNVACAICKDEILLEEKVRRLPCSHCYHGDCIFPWLGIRNTCPVCRFELPTDDPDYEQGKVNRAARGLLELAAARMQF

SEQ ID NO: 119254 - protein, 67 aa, Glycine max
  Coding DNA Sequence Number=SeqID_2476
MDRGQGWLKTVTASQKTLGNVAKRGGYFITECCQREQCHDSHYLISHDNLLFNFCSLLWTLHDTILR

SEQ ID NO: 119255 - protein, 152 aa, Glycine max
  Coding DNA Sequence Number=SeqID_2477
MSNHHHSSNPFASSSSTHSDSDSDSVSCFVTDLFETRLCSCDDDTDINPFSDVVCDLHRTEHVLGLGFGVEIDPHSQTNGDNHHRDRVFDADRVFNFTVGDGSSGVRVVGFGLDSESSSEEGGIRDGGGFEDFDARLCWDSLCLEDQRTLNE

SEQ ID NO: 119256 - protein, 109 aa, Glycine max
  Coding DNA Sequence Number=SeqID_2478
  Gene Ontology: Mol. function=RNA-directed DNA polymerase activity; Biological process=RNA-dependent DNA replication
MPGRTLILYMTVLDESMGCMLRHHDASGKKERVVYYLSKNPPSKEIHAELHHLTGIEDEPSQVYFRKAHSHQTDRSVVGSAVRVRHCLRHSKGDRGKHLGRLPSSVAHQ

SEQ ID NO: 119257 - protein, 192 aa, Glycine max
  Coding DNA Sequence Number=SeqID_2479
  Gene Ontology: Mol. function=DNA binding; Cellular component=oxygen evolving complex; Biological process=DNA integration
  Homolog annotation: Hit_ID=Q1SJY5; Match level="QueryCoverage=66%, HitCoverage=12%, E-value=2e-40, Identity=59%"; Hit description =Integrase, catalytic region
  Pfam annotation: Domain name=rve; Domain location=2-148; Score=47.7; E_value=4.1e-11; Accession=PF00665.16; Description=Integrase core domain
MTLITSISGKRYGLVVVDDYLRWTQVMLLAHKNDSFEVFFKFSKRVQNENGVCITSIRSDHGREFEKESFHLFYEENGILQNFSTARTPQKIGVVERKNKSLQEMTRTMLNDNSTPKHFWVEAVNTGYYLLTRLISLTGSHPFVGIDHEDPYTHFSTFMELYSTMGASDEDPEAIYLRVFPFSLTGKAKRWL

SEQ ID NO: 119258 - protein, 50 aa, Glycine max
  Coding DNA Sequence Number=SeqID_2480
MALPGSKFEGVLALREKGDDRREEWMVENEWGGLGFISRELREKLTPQKW

SEQ ID NO: 119259 - protein, 126 aa, Glycine max
  Coding DNA Sequence Number=SeqID_2481
MGEGFPTRGLPRSLLESINKWCYHRIYVGVFFLTNAMKILKTSVDGKTDQVVPQWIEVKSYVQSGGYECGYYFMHWMWNIVSGGLKNYWSMWFGDGTTIDIETITTICNKWETYFVKVKNTKFRKV

SEQ ID NO: 119260 - protein, 126 aa, Glycine max
  Coding DNA Sequence Number=SeqID_2482
  Subcellular localization annotation: CTP_CleavageSite=43; ConfidenceScore=5.68e-01
MSSTLSIPLGFCFPPTVATSFPHSQTKPQNVTFQRRKTTTKACAASENPNQRQNPKQNQKEAKTKNAGDDDGEKGINPAGFLAKRGISHKAFAQFLRERQEFWKMRMEVVWCLVEFAFGFFGSVWF

SEQ ID NO: 119261 - protein, 396 aa, Glycine max
  Coding DNA Sequence Number=SeqID_2483
  Gene Ontology: Mol. function=1,4-alpha-glucan branching enzyme activity; Biological process=carbohydrate metabolic process
  Homolog annotation: Hit_ID=Q9LTP8; Match level="QueryCoverage=99%, HitCoverage=39%, E-value=1e-152, Identity=62%"; Hit description =Starch-branching enzyme-like protein
MKDEILKRHENFMILASGFELLGMHRHPEHRVDYMEWAPVANTLALAKRCDTEKSLFCQVAIVTKKNMLFEHDFVHPFLFSDKQVNAGARYCAIIGDFNGWSPTEDCAREHYFGHDDFGYWFIILQDKLREGEEPDKYYFQMYNYVDDYDKGDSGVSVEELIKKANEKYWQPGEDRFVNNRFEGPVKLYEQIFGPNGPQTIEDIPDIPDPETRYKAWAAEHGPSPTAAIDSGKEYDIYNVIVDPQWQEKIRALEPPVLYWFETRKGRKAWMKKYSPGIPHGSKYRVYFNTANGPLERVPAWATYVQPEVDGRQACAIHWEPSPEQAYKWKNMSPKVPKSLRIYEAHVGISGSEPKISSFNDFTDKVLPYIKEAGYNAIQLIGIVEHKDYFTVGYRG

SEQ ID NO: 119262 - protein, 194 aa, Glycine max
  Coding DNA Sequence Number=SeqID_2484
  Gene Ontology: Mol. function=RNA-directed DNA polymerase activity; Cellular component=chromatin; Biological process=chromatin assembly or disassembly
MTEPPPSSADKLEELLIRLTHQQLSLTSKIDDLIHHVSPLIPPAPSFSSPLPRHFPAPVTNHRMKLDVPRFDGTDPLGWIFKINQFFEYHGTPEYERLTIASFYMEGRALSWFQWMTSNGHLTSWPVFLQALQSRFAPSQYEDPTGALCKLMQKGTVAAYQAEFEDLSNRVSGIPPTVLLSCFISGLLPEIRRE

SEQ ID NO: 119263 - protein, 306 aa, Glycine max
  Coding DNA Sequence Number=SeqID_2485
  Subcellular localization annotation: CTP_CleavageSite=41; ConfidenceScore=5.42e-01
MAESSKKHKGSSATTAAAGHCHHGPSGAPTTPISPSFSSPRSFTLFSLDDQCQSQGVPFEGTLVDDWKFDYSSHDGRHMVCNDQADMTGRLLAGSLTFDYRIMHYIIVHILLPRSSNLAQTFEENLILMWAFLTGHQIDWAHLIWYQMHKELRANAPLPYPHLVTLFLHYFKIPLDDEPFIQVKRSFANGAGAVTLFGNHKDDDVIVKGILQDSGILKRVSWGLDVGTKYVPTPRVTRMQGFCTCIAHACSSKQMLHPFFNALSNGQKRSSVFKFDYLPYMTRQRHVHHEQLDKSSPDDTCPDSGA

SEQ ID NO: 119264 - protein, 106 aa, Glycine max
  Coding DNA Sequence Number=SeqID_2486
  Gene Ontology: Biological process=lipid metabolic process
MNNAGECSTSMLIDIALDGVSETVDQMLGNAFCWNRTDYVRIQAIGLGDQGKDDEKVLNERVLESLPFGGKRLLQETNGNRIESFVQRLVATGKTSLPPSPCKLPP

SEQ ID NO: 119265 - protein, 54 aa, Glycine max
  Coding DNA Sequence Number=SeqID_2487
MEVWFKGCVGLLAVASRSCCPVLCAVRLEVLNGIHGGSEIATMPSLSGREAMRE

SEQ ID NO: 119266 - protein, 927 aa, Glycine max
  Coding DNA Sequence Number=SeqID_2488
  Gene Ontology: Mol. function=binding; Cellular component =intracellular; Biological process=metabolic process
  Homolog annotation: Hit_ID=Q1T2K1; Match level="QueryCoverage=74%, HitCoverage=86%, E-value=0.0, Identity=58%"; Hit description =Tetratricopeptide-like helical
  Pfam annotation: Domain name=PPR; Domain location=285-319; Score =11.3; E_value=0.34; Accession=PF01535.11; Description=PPR repeat
  Pfam annotation: Domain name=PPR; Domain location=351-385; Score =40.1; E_value=7.4e-09; Accession=PF01535.11; Description=PPR repeat
  Pfam annotation: Domain name=PPR; Domain location=386-420; Score=5.5; E_value=1.7; Accession=PF01535.11; Description=PPR repeat
  Pfam annotation: Domain name=PPR; Domain location=452-486; Score =21.8; E_value=0.0025; Accession=PF01535.11; Description=PPR repeat
  Pfam annotation: Domain name=PPR; Domain location=554-587; Score =23.9; E_value=0.00056; Accession=PF01535.11; Description=PPR repeat
  Pfam annotation: Domain name=PPR; Domain location=655-689; Score =37.7; E_value=4.1e-08; Accession=PF01535.11; Description=PPR repeat
  Pfam annotation: Domain name=PPR; Domain location=756-790; Score =45.0; E_value=2.6e-10; Accession=PF01535.11; Description=PPR repeat
  Pfam annotation: Domain name=PPR; Domain location=791-825; Score =11.4; E_value=0.34; Accession=PF01535.11; Description=PPR repeat
  Pfam annotation: Domain name=PPR; Domain location=893-927; Score=1.9; E_value=4.5; Accession=PF01535.11; Description=PPR repeat
  Pfam module annotation: Pfam domain module=PPR::PPR::PPR::PPR::PPR::PP R::PPR::PPR::PPR; Domain location=285-319::351-385::386-420::452 -486::554-587::655-689::756-790::791-825::893-927
MEELEIINIGKASKVYNAVEPVVLNVLKCKIPLFCGIGFSFHNNPQQWLRNQLYSICQPSQKHCLVGILGFTGMVSGIGAIQILLTFVVRFDISLGCGANSVLFETATLVEKREDLPVGAKPVKTPIKKHREKWSMAFFHRRTFFFDLSSEPIFFEPPEAQSSGNTLVYTILRSNAACPVIPLSVESAHGEESRGHPPVKNHEAIRRDSTTIQEQKPDKLRFILVAAGIVYNRAMRMVNRTILTTMEELSTNSYINLMCKQQHYREALDTFNFHLKNSSIQLEPSTYVNLILACTNVRSLKYGKRIHDHILKSNCQPDLVLQNHILNMYGKCGSLKDARKAFDTMQLRSVVSWTIMISGYSQNGQENDAIIMYIQMLRSGYFPDQLTFGSIIKACCIAGDIDLGGQLHGHVIKSGYDHHLIAQNALISMYTKFGQIAHASDVFTMISTKDLISWASMITGFTQLGYEIEALYLFRDMFRQGVYQPNEFIFGSVFSACRSLLKPEFGRQIQGMCAKFGLGRNVFAGCSLCDMYAKFGFLPSAKRAFYQIESPDLVSWNAIIAALANSDVNEAIYFFCQMIHMGLMPDDITFLNLLCACGSPMTLNQGMQIHSYIIKMGLDKVAAVCNSLLTMYTKCSNLHDAFNVFKDISENGNLVSWNAILSACSQHKQPGEAFRLFKLMLFSENKPDNITITTILGTCAELVSLEVGNQVHCFSVKSGLVVDVSVSNRLIDMYAKCGLLKHARYVFDSTQNPDIVSWSSLIVGYAQFGLGQEALNLFRMMRNLGVQPNEVTYLGVLSACSHIGLVEEGWHLYNTMEIELGIPPTREHVSCMVDLLARAGCLYEAENFIKKTGFDPDITMWKTLLASCKTHGNVDIAERAAENILKLDPSNSAALVLLSNIHASAGNWKEVARLRNLMKQMGVQKVP

SEQ ID NO: 119267 - protein, 307 aa, Glycine max
  Coding DNA Sequence Number=SeqID_2489
  Homolog annotation: Hit_ID=Q23GQ3; Match level="QueryCoverage=85%, HitCoverage=18%, E-value=2e-10, Identity=22%"; Hit description=Viral A-type inclusion protein repeat containing protein
  Pfam annotation: Domain name=Tropomyosin; Domain location=88-306; Score=-93.1; E_value=0.0023; Accession=PF00261.10; Description =Tropomyosin
MTTEIKLQTVEQQRHILRMLEKSLAREMDLEKDINDSREIQENLRLKMFFSEQEFVNMEGEAIDVWERWLEADNASEILLGISKGLLGKLHISQFSLNGQSHRESELRANLKDAEDKLTFANSEVSALSNKVSSLEKQLKESEFQLLNAKASADEYQKQYNVKCSEARDMGSVIVELKEAVYNAESRANSAETKCKLLTETNSKLDEELALLRGSSTRAELLERQLKESNLRLQKMTASAKGSQEKQSKLYSTIRDMENVIKDLKSKVSKAEGRADSTEDNCIILSESNAELNEELSFMRSRLESLE

SEQ ID NO: 119268 - protein, 65 aa, Glycine max
  Coding DNA Sequence Number=SeqID_2490
  Homolog annotation: Hit_ID=Q1T2K1; Match level="QueryCoverage=42%, HitCoverage=3%, E-value=4e-07, Identity=82%"; Hit description =Tetratricopeptide-like helical
MGVQNVLVKWIEVRTDPCVFSEDSRIHRGATSTQCLKICGYRCWMMVMILVRELQEFFVLTDPKG

SEQ ID NO: 119269 - protein, 585 aa, Glycine max
  Coding DNA Sequence Number=SeqID_2491
  Gene Ontology: Mol. function=ATP-dependent helicase activity; Cellular component=nucleus; Biological process=rRNA processing
  Homolog annotation: Hit_ID=Q1T2K0; Match level="QueryCoverage=99%, HitCoverage=85%, E-value=0.0, Identity=70%"; Hit description =Helicase, C-terminal; Type III restriction enzyme, res subunit
  Pfam annotation: Domain name=DEAD; Domain location=200-382; Score =155.4; E_value=1.5e-43; Accession=PF00270.19; Description=DEADDEAH box helicase
  Pfam annotation: Domain name=DUF1253; Domain location=245-562; Score=- 303.7; E_value=0.1; Accession=PF06862.2; Description=Protein of unknown function (DUF1253)
  Pfam annotation: Domain name=Helicase_C; Domain location=450-526; Score=125.5; E_value=1.5e-34; Accession=PF00271.21; Description =Helicase conserved C-terminal domain
  Pfam annotation: Domain name=ResIII; Domain location=196-377; Score= -19.7; E_value=0.0021; Accession=PF04851.6; Description=Type III restriction enzyme, res subunit
  Pfam module annotation: Pfam domain module=DEAD::DUF1253::Helicase _C::ResIII; Domain location=200-382::245-562::450-526::196-377
MANDSSFLFAGIRFDRKKFGADIARFQKKDSDTDSAKISSAAEDEGEKTIEPVEEKVAASTTKKRKRKGTSSGIHILVLYLYYATSCIQLYVSHFCFVFRKRTKETVEGFNVFRSSTSVAQSNDEVRVNEESVELNKKTKKKEQNKQLERDAKFRKQHNIHVSGYNVPTPLQSFDELKSRYNCPSYLLRNLKELGFREPTPIQRQAIPVLLQGRECFACAPTGSGKTLAFVCPMLMKLKFPTSVSLVQIINCVLQDPEKGGIRAVILCHTRELSVQTYRECKKLAKRKKFRIKLMTKNLLRNADFSKFPCDVLISTPLRLRLAIKRKKIDLSRVEYLVLDESDKLFEPELFKQIDSVIKACSNPSIIRSLFSATLPDFVEDQARELMHDAVRVIVGRKNMASETIKQKLVFTGSEEGKLLAIRQSFAESLNPPVLVFLQSKERAKELYSELAFDNIRVDVIHSDLSQAERENAVDNFRAGKTWVLIATDVVARGMDFKGVNCVINYDFPDSAAAYVHRIGRSGRAGRTGEAITFYTEDDIPFLRNVANLMAASGCEVPSYLMELRKKKWKKHRPKRDSISTKPDL

SEQ ID NO: 119270 - protein, 145 aa, Glycine max
  Coding DNA Sequence Number=SeqID_2492
MGPKVLNQGCIMLCERSISISTLTLWPIIEHVSLRAWGVDVGVLVRACGDSWKCIGKVLGSSLGGYQLTHLLRYSRLRAELLTSPCSSSALKALSHGPHHRWPSIAVLIVVAPPSSSLLLRRHRWPLPCWSSLMLQALLHVTMLR

SEQ ID NO: 119271 - protein, 171 aa, Glycine max
  Coding DNA Sequence Number=SeqID_2493
MSTESAEHDASVVDLEGVAVSSPSGNVMGDLGDVYSTMLTSLDLGLACFSEKVSNLSNFVMHVETKECELEALEKEDHIGEKGLEFDLLSVVLDSEVRELEGVLDTLQGGVDEAREWGCSCTHLGEGFVAMQEKLGDYEQQLKQFEEEFNGIKMQSASFQRNLSSLKKAEN

SEQ ID NO: 119272 - protein, 280 aa, Glycine max
  Coding DNA Sequence Number=SeqID_2494
  Subcellular localization annotation: CTP_CleavageSite=63; ConfidenceScore=5.74e-01
MKLSAKPISSPGRTDKFPPPLMRFLRSNAGSRSRRSRSSPMFVRKKNTTFETHTQEPSSPKVTCMGQVRVKRASKQPTTQPDLAPTRCRRRRRRCCCFWIRRPNNPCRCNPLWPNWPFFRRKPTKLKQDSQSEPNFYAHEESELPFQERVNVDKDSDFASNSSTPPRNALLLTRCRSAPYRSSSLASRFWSSPVKDQETELQHTSEGPQTEPELGFLTEKIASLTEPEKVEEVETETESVLRPTVLTRCKSEPARTGHRLDPLMVTSSTRILPQNMVVKY

SEQ ID NO: 119273 - protein, 76 aa, Glycine max
  Coding DNA Sequence Number=SeqID_2495
MQCGTFFSEKLVGRLGVHDRTCLTMGRLVRVTLFCENVQPCGIGTGLKEHSNRMTPKAYTPKSPSGPLPPDLVHLK

SEQ ID NO: 119274 - protein, 94 aa, Glycine max
  Coding DNA Sequence Number=SeqID_2496
MDNLRCGVEPVKTLSRAITGPGMMGRVEDLVAQAHASPPGVRKNVRRKVKRRMHRAAWRVTIGGWMSSGKNKSVKSEMKIKKSVGEMKRLLCWN

SEQ ID NO: 119275 - protein, 182 aa, Glycine max
  Coding DNA Sequence Number=SeqID_2497
  Gene Ontology: Mol. function=sugar porter activity
  Homolog annotation: Hit_ID=Q6ZCE6; Match level="QueryCoverage=72%, HitCoverage=38%, E-value=4e-46, Identity=70%"; Hit description =Putative integral membrane protein
MPLWGRIASLVHHTGDDECDGRNDPLGREPEGTNEQIEKEKKGAIPKREEVVVEDEVLCVEAEAHDHVLDVDHLNGDGDEISEGPRVGDEGEGKVGGDEVEGVNEDDEEGEEGEVGGARLNAEGGVGKGDEERGEGSEDNEGVNVCMSEEIGVGEDGEVEDKCGGEEFFGSGECEGVMMEKS

SEQ ID NO: 119276 - protein, 362 aa, Glycine max
  Coding DNA Sequence Number=SeqID_2498
  Gene Ontology: Mol. function=oxidoreductase activity; Cellular component=integral to membrane; Biological process=electron transport
  Homolog annotation: Hit_ID=Q43071; Match level="QueryCoverage=99%, HitCoverage=84%, E-value=1e-129, Identity=65%"; Hit description =Cytochrome P-450
  Pfam annotation: Domain name=p450; Domain location=1-362; Score=99.3; E_value=1.2e-26; Accession=PF00067.12; Description=Cytochrome P450
MAFSIGLTRFVISSEPETAKEILGSPGFADRPVKESAYQLLFHRAMGFAPYGEYWRNLRRISALHLFSPKRITGSEAFRNEVGLKMVDEVKKVMKDNRHVEVKRILHYGSLNNVMMTVFGKCYEFYEGEGVELEALVSEGYELLGVFNWSDHFPVLGWLDLQGVRKRCRCLVEKVNAFVGGVIEEHRVKRVRGGCVKDEGTGDFVDVLLDLENENKLSEADMIAVLWEMIFRGTDTVAILLEWILARMVLHPDIQAKAQREIDSVCGPYRLVSEADMPNLRYLQGIVKETLRVHPPGPLLSWARLAVHDVTVGGKHVIPKGTTAMVNMWAITHDERFWAEPERFRPERFVEEEDVNIMGSDL

SEQ ID NO: 119277 - protein, 43 aa, Glycine max
  Coding DNA Sequence Number=SeqID_2499
FHREKKGIPSSHERNATATIVSGEVPPTTNVGQIRCDDGLDNM

SEQ ID NO: 119278 - protein, 497 aa, Glycine max
  Coding DNA Sequence Number=SeqID_2500
  Gene Ontology: Mol. function=sulfate adenylyltransferase (ATP) activity; Cellular component=intracellular; Biological process =sulfate assimilation
  Homolog annotation: Hit_ID=Q1S9P0; Match level="QueryCoverage=87%, HitCoverage=91%, E-value=0.0, Identity=76%"; Hit description=ATP -sulfurylase
  Pfam annotation: Domain name=ATP-sulfurylase; Domain location=166 -485; Score=512.5; E_value=4.6e-151; Accession=PF01747.8; Description= ATP-sulfurylase
  Subcellular localization annotation: CTP_CleavageSite=88; ConfidenceScore=5.06e-01
MEILPTCVALSLQHVCHIHSMSLSLTIKLHLASSSSFSNFTLNSHHHANKVTTSKTCSNAKIRPKPIYSTNPLIIPTCKVRPRVQQHRGTMIKSSLIEPDGGALVDLMVSEGERGAKITEAESLPKVQLTRIDLEWVHVVGEGWASPLRGFMREDEYLQSLHFNSLRVKDGSLVNMSLPIVLAIDDETKEGIGSSSHVGLLGPHGDCVAILRRCWDDLKNLGNNLKTDEGKLGLEGNWLIGGDLEVLKPIKYNDGLDNYRLSPKQLREEFDKRQADAVFAFQLRNPVHNGRALLMNDTRKRLLEIGFKNPILLLHPLGGFVKADDVPLDVRMEQHSKVLEDGVLDPETTIVAIFPSPMHYVGPTEVQWHAKARIDAGANFYIVGRDPTGMGHPTEKRDLYDPDHGKKVLNMAPGLEKLNILPFRVAAYDTKLNKMAFFDPTRAKDFLFIYGTKMRAFAKSGENPPKGFMCPSGWKVLVKYYESLQAEESSQQPVLST

SEQ ID NO: 119279 - protein, 106 aa, Glycine max
  Coding DNA Sequence Number=SeqID_2501
  Subcellular localization annotation: CTP_CleavageSite=62; ConfidenceScore=5.80e-01
MNSSTFSFEPFSTNHGPHTTTKAAYYVSNSTTVSKKRRRSSTGGISVIKGFRTTTINTSSISSFRYKDGPAATPVFVLFVLHRASSPTKTIVSDNHHLMSVASRSV

SEQ ID NO: 119280 - protein, 112 aa, Glycine max
  Coding DNA Sequence Number=SeqID_2502
  Gene Ontology: Mol. function=polygalacturonase activity; Cellular component=cellulose and pectin-containing cell wall; Biological process=carbohydrate metabolic process
  Homolog annotation: Hit_ID=Q1S5D1; Match level="QueryCoverage=91%, HitCoverage=30%, E-value=4e-18, Identity=40%"; Hit description =Polygalacturonase
MTCRWNVGTQNTIYNVIDFGAVGDGKTDDTQAFLKAWQSMCEAQGTSTLLIPPNKLQGVIVAPTKDAWVEGNLNTLIMISNVNGLTIDGSGGLIDGYGSAWWACKSCPRPSV

SEQ ID NO: 119281 - protein, 141 aa, Glycine max
  Coding DNA Sequence Number=SeqID_2503
MRQVVKILEVEIDSIESDEDNMEMSLLGKIRSATTWSKAECALPYSGYPSFDEVKMFSFNSRTSRSGSNTTKHEDSKSEAQIKHHGFHQVQCTNLDQTLNETDNVAQDDTPLMKDGSRLFPKVVHSLPASQLHQRAPHKPH

SEQ ID NO: 119282 - protein, 259 aa, Glycine max
  Coding DNA Sequence Number=SeqID_2504
MANKNFLCIIEEMDRLWFHQAILFSEPTASVISLPSPPDEKKPVPTSESVSCSSSILSSPPPPDEETSTDESPSSEQQLSSESMSVPLQDGSINNEEERKDGLTRMNLLDNRTRSHSSSPSTQNRHRKLRKPATTCARKLQKSISCRTLGELELDEVKGFMDLGFTFKKECLSPRMMSVIPGLQRLGVMDATETVEGNHIEAEEQKRGIMRPYLSEAWPIKRPDSPLLNLKIPKRCSSANMKKHLRFWAKTVASEIHQE

SEQ ID NO: 119283 - protein, 160 aa, Glycine max
  Coding DNA Sequence Number=SeqID_2505
  Homolog annotation: Hit_ID=Q1T2J4; Match level="QueryCoverage=90%, HitCoverage=63%, E-value=2e-73, Identity=86%"; Hit description =Uncharacterized Cys-rich domain
  Pfam annotation: Domain name=PLAC8; Domain location=8-131; Score =103.8; E_value=5.1e-28; Accession=PF04749.7; Description=PLAC8 family
MNSAAKRSAPTMSGLLGSVAPCVLYGSNVERLESAPGTFANHCLPYSGMYIIGNSCFGWNCLAPWFSYPSRTAIRRRFNLEGSCEALNRSCGCCGSILEDEVQREQCESTCDLATHVFCHVCALCQEGRELRRRLPHPGFNAQPVLVMIPPGEQTMGREA

SEQ ID NO: 119284 - protein, 216 aa, Glycine max
  Coding DNA Sequence Number=SeqID_2506
  Gene Ontology: Mol. function=calmodulin binding; Cellular component =integral to membrane; Biological process=response to biotic stimulus
  Homolog annotation: Hit_ID=O80961; Match level="QueryCoverage=45%, HitCoverage=21%, E-value=1e-21, Identity=53%"; Hit description=MLO -like protein 12
  Pfam annotation: Domain name=Mlo; Domain location=1-184; Score= -353.8; E_value=0.012; Accession=PF03094.6; Description=Mlo family
MNICMASNSAFPAFYLQLVLVVGAKLEVIVDQMALKMKDVNNVTKGTPLVCPSDKFFWFGHPGFVLTLLHYTLFVNAFELAFFIWVSGSRSSPMQLCYSPPLCTSGTGKLYLDIDVLVCDCVRMGSEVKSKALAKMLKQWHLEVRERRRNREQLKSFSFRHTNMSSEWSQENKSAPDFSSTLCESIRSSDEGEIVEELEHMEKTKASSSSDPPCVV

SEQ ID NO: 119285 - protein, 129 aa, Glycine max
  Coding DNA Sequence Number=SeqID_2507
MESAKARDYMEGVVEDMESEVSYLVQEMGLTLQGKVDGHYGAGGVECTVTKGIGGSFDEEENHLQGVEEHALFEGPWMFTDHHLLVQRWRPFFPLSVEKATNKGGCVGLKNLGELASGDYPTVGTLIWC

SEQ ID NO: 119286 - protein, 71 aa, Glycine max
  Coding DNA Sequence Number=SeqID_2508
MLIQYLNMKKYDNYVLLLGFCGIIGLSLSHVQNTVGEHHIEVELPKELQTEEQGIQPEQVVGIRMFGLAGT

SEQ ID NO: 119287 - protein, 54 aa, Glycine max
  Coding DNA Sequence Number=SeqID_2509
MIMLVVMTMVMTLLTVVVIAVDGHGGSSGCGHDGSSGCGHDNCDENNMTMVMVI

SEQ ID NO: 119288 - protein, 464 aa, Glycine max
  Coding DNA Sequence Number=SeqID_2510
  Gene Ontology: Mol. function=amino acid-polyamine transporter activity; Cellular component=integral to membrane; Biological process=amino acid transport
  Homolog annotation: Hit_ID=Q9FMC0; Match level="QueryCoverage=94%, HitCoverage=95%, E-value=1e-129, Identity=53%"; Hit description =Amino acid transporter-like protein
  Pfam annotation: Domain name=Aa_trans; Domain location=44-453; Score =122.9; E_value=9.1e-34; Accession=PF01490.8; Description =Transmembrane amino acid transporter protein
  Pfam annotation: Domain name=Trp_Tyr_perm; Domain location=44-447; Score=-219.4; E_value=0.00016; Accession=PF03222.4; Description =Tryptophantyrosine permease family
  Pfam module annotation: Pfam domain module=Aa_trans::Trp_Tyr_perm; Domain location=44-453::44-447
MTIGSIEHKAKKTKSRKNKVVVDEKTPLIPKTHDADAEGLDEFNGASFSGAVFNLSTTAIGAGIMGLPACVKKLGMVPGLLAIILTALLTEKSIGFMIRNSRAGNLSSYGNLVGDSFGKFGKALVQICVIINNIGMLIIYMIIIGDVISGTSSSEIHHSGVLEGWFGVHWWTGRTFVLLFTTFAVFAPLSCFKRIDSLRYTSALSFGLAVAFLVIAVGISIFKIAIGGIGMPRLFPIITDVASVFELFTVTPVVVTAYLCHFNVHSIDNELEDSSQIHGIVRTSLTLCASVYLLTSFFGFLLFGEGTLDDVLANFDSDLGIPFGSVLNDAVRFSYAAHLVLVFPVVFYAVRINLDGLIFPSSRPLVLDNFRFASITMALIVASFLGANFIPSIWDIFQFTGATAAASLSFIFPSAITLRDRYNIGTKKDKILSVFMIVLAVFANVVAVYSDAFALIKNSTTKRE

SEQ ID NO: 119289 - protein, 71 aa, Glycine max
  Coding DNA Sequence Number=SeqID_2511
MDTISGTKLPIHSFIYVVQVVAGRPTKLVLVEGTNVGMKVDETKADVEVIAIDQGKQLMENKDLQDLIPSS

SEQ ID NO: 119290 - protein, 99 aa, Glycine max
  Coding DNA Sequence Number=SeqID_2512
MKADTGVRPLNKRGVKNEGMNLALGLLFTAIKSYQSKRKQGWKLMTNKDTIVSKVWFMQEVMIGMNDHVIFDALWALAQALGIKVPAVEWPMFHELDRF

SEQ ID NO: 119291 - protein, 192 aa, Glycine max
  Coding DNA Sequence Number=SeqID_2513
  Gene Ontology: Mol. function=amino acid-polyamine transporter activity; Cellular component=membrane; Biological process=amino acid transport
  Homolog annotation: Hit_ID=Q67VL0; Match level="QueryCoverage=86%, HitCoverage=38%, E-value=2e-45, Identity=53%"; Hit description =Putative system A transporter isoform 2
MRSGSVAPEAEKLESRRNKRVVDENAPLIPKAQESDSAGFDEFNGASFSGAVFNLSTTIIGAGIMGLPACVKKLGMVPGLLAIILTGFLTEKSIEFMIRISRAGNLSSYGSLMGDAFGKYGKALVQICVVVNNIGDVISGTSSSGTHHSGVLEGWFGVHWWTGRAFVLLFTTLAVFAPLVSFKRIGECFFCH

SEQ ID NO: 119292 - protein, 84 aa, Glycine max
  Coding DNA Sequence Number=SeqID_2514
MTTVEYAMKFEKHIFLTTMGRQEKAQRSRIQLQLTNMATIIAVRRLSLVNLLVVRVRERLLLTHKGKETMVVLIIQHLSPKTRM

SEQ ID NO: 119293 - protein, 267 aa, Glycine max
  Coding DNA Sequence Number=SeqID_2515
  Gene Ontology: Mol. function=amino acid-polyamine transporter activity; Cellular component=integral to membrane; Biological process=amino acid transport
  Homolog annotation: Hit_ID=Q9FMC0; Match level="QueryCoverage=97%, HitCoverage=57%, E-value=1e-95, Identity=67%"; Hit description=Amino acid transporter-like protein
  Pfam annotation: Domain name=Aa_trans; Domain location=1-260; Score= -153.0; E_value=0.042; Accession=PF01490.8; Description=Transmembrane amino acid transporter protein
SLKFTSALSVGLAVVFLVIAVGISIFKIIIGGLEMPRLFPIITDVASVFELFTVVPVLVTAYICHYNVHSINNELEDSSQMHGVVRTSLALCASVYLLTSFFGFLLFGEGTLDDVLANFDTDLGIPFGSVLNDAVRFSYAAHLVLVFPVVFYAVRVNLDGLVFSSYRPLRQDNFRFASITISLIGVIFLGANFIPSIWDIFQFTGATAAVCVAFIFPAAVTLGDRHNITTKADKVLSVFMIVLAVLSNAVAIYSDAYALIKKNKTYT

SEQ ID NO: 119294 - protein, 1239 aa, Glycine max
  Coding DNA Sequence Number=SeqID_2516
  Gene Ontology: Mol. function=RNA-directed DNA polymerase activity; Cellular component=chromatin; Biological process=chromatin assembly or disassembly
  Pfam annotation: Domain name=Chromo; Domain location=933-978; Score =23.6; E_value=0.00072; Accession=PF00385.14; Description='chromo' (CHRromatin Organisation MOdifier
  Pfam annotation: Domain name=RnaseH; Domain location=375-493; Score= -31.2; E_value=0.046; Accession=PF00075.14; Description=RNase H
  Pfam annotation: Domain name=rve; Domain location=627-783; Score =112.1; E_value=1.6e-30; Accession=PF00665.16; Description=Integrase core domain
  Pfam annotation: Domain name=zf-H2C2; Domain location=568-609; Score =11.7; E_value=0.01; Accession=PF09337.1; Description=His(2)-Cys(2) zinc finger
  Pfam module annotation: Pfam domain module=Chromo::RVT_1::RnaseH::rve: :zf-H2C2; Domain location=933-978::114-283::375-493::627-783::568-609
MDAALSSLSSLQFRRLSRKNRDGLYYHITLLPSVDTSTQDLPPSILTLLTKYDTLFHPPNTLPPTRDTDHHIHLLPQAPPVNVRPYRYPHYQKQEIESQVDSMLQKGLIQPSSSPFSSPVLLVKKQDGSWRFCVDYRALNALTVRDRFPIPTIDELLDELGGARYFSKLDLLQGYHQIRMHPPDIPKTAFRTHHGHYEFKVMPFGLCNAPSSFQATMNAIFRPYLRQFLIVFFDDILIYSNSLDVHVHHLELTFQVLLHHQFTLKLSKCSFAQEQVEYLGHLVSHRGVEPLPSKVDAIQQWPTPRTVKTLKSFLGLAGFYRRFIKGYATIAAPLVKATTGDALRWTADTQTAFDRLKHALSSAPVLALPDFTLPFTVETDASGVGMGAVLSQQGHPIAYFSKPFSAKLLWSSTYVRELFAITTAIKKWRQYLLGHHFIIVTDHRSLKELLTQVIQTPEQHTYLARLLGYDYEIQYRAGAHNQAADALSRLPENTASLWVLSVPCLTFFEELQQQLQTHPDYVRKRQAITEQPSNHPAFSISSNLILHKGRIWLPEGFHLIPALIAEFHSTPTGGHAGIAKTVARVLENFSWPKLREDVTHFVTNWAECQCTKYETKRLAGLLCPLPVPFRPWEDLSLDFITGLPAYHGHTVILVVVDRFSKGVHLGTLPTAHTALTVASLFVDIVVKLHGVPRSLVSDRDPLFISRFWQELFRRSGTQLRMSTAYHPQSDGQTEVLNRTIEQYLRSFVHRRPNTWGKYLPWAEWSHNTSWNSATGTTPYELTFGKKPFNFPEYIAGTSAVDAVDSLLQDREETFQLVRRKLLKAQSCMKEQADRHRRDVSCNSGDWVWLKLRPHRQTSAKGPQSSAGKLARRYYGPFKIIEAIGKVAYRLQLPPATKIHDVFHCSLLKPFHGQLDTTSFAPLPAQFHNDQPIITPAAIVDYRKTPSEAWEVLVQWHGLSPDDTSWEDWSALLNDYHLEDKVISQGPRDDRENTDHRAGVQREHSAEGFSGDSAVRAGDKLNGIDSVIFLLHQKIRILLAEDSINKYCNQYVDKDALVYLILANEILHSLHPNIITIAEDATFYPGLCEPTSQGGLGFDYYVNLSVPDMWSTFLESVPDHEWSMTKIVNTLVSNREHADKMLMYAENHNQIIRLITLTIGGRAYLNFMGNEFGHPKRVEFPTSSNNNSYLLANRQWDLLTKDGVHRDLFAFDKDMMKLDENVKVLSRNIPNIHHVNDSSM

SEQ ID NO: 119295 - protein, 54 aa, Glycine max
  Coding DNA Sequence Number=SeqID_2517
MNLHIMASKHFDPDAKLPKLPDESWALSEEKKVINGCMFVLEGEGIMYTVNMRV

SEQ ID NO: 119296 - protein, 133 aa, Glycine max
  Coding DNA Sequence Number=SeqID_2518
  Gene Ontology: Mol. function=transition metal ion binding; Biological process=proteolysis
MGSYLAYGHEIYPKAHENPRAFSCISGPIYLESSIQCPCGVGLHQILCPMGMEYQKIHACPNDRIMYKHEFQKMSKCPICGTSRFKVKDAKESSSDENSKKGPPAKHMGISAVTMLRVIMHAPSVKKTQATYN

SEQ ID NO: 119297 - protein, 272 aa, Glycine max
  Coding DNA Sequence Number=SeqID_2519
  Gene Ontology: Mol. function=RNA binding; Cellular component =cytoplasm; Biological process=sex differentiation
  Homolog annotation: Hit_ID=Q9LT41; Match level="QueryCoverage=78%, HitCoverage=65%, E-value=4e-71, Identity=65%"; Hit description=RCD1
  Pfam annotation: Domain name=Rcd1; Domain location=4-208; Score =239.5; E_value=7.4e-69; Accession=PF04078.4; Description=Cell differentiation family, Rcd1-like
MEDNPITKASHPDTRMLFLNGIVTFLIHVKDFELLSDSVLINFVLHVLIVIELASHIPLYLYPFLNTTSKSRPFEYLRLTSLGVIGALVKVDDTEVISFLLSTEIIPLCLRTMEMGSELSKTVEFTDSSFFGRVLGNMVAALAEQPSSRLLKHIIRCYLRLSDNPRACDALRSCLPDMLRDATFSTCLREDPTTRRWLQQLLHNVGVNRVPALQAGGEEEGLLDLKAFLDGNGGGVDSECIVRVVVAGGVIGTTIRAFIRDFGGGRDRKEMF

SEQ ID NO: 119298 - protein, 59 aa, Glycine max
  Coding DNA Sequence Number=SeqID_2520
MVQSYYGVHGGATTQYPYGGEGSGGGSTTRHGYGVNYPPQAYLFQYSPIASTAGYARQY

SEQ ID NO: 119299 - protein, 90 aa, Glycine max
  Coding DNA Sequence Number=SeqID_2521
  Gene Ontology: Mol. function=RNA-directed DNA polymerase activity; Biological process=RNA-dependent DNA replication
  Homolog annotation: Hit_ID=Q1SLA3; Match level="QueryCoverage=69%, HitCoverage=5%, E-value=3e-12, Identity=53%"; Hit description=RNA -directed DNA polymerase
  Subcellular localization annotation: CTP_CleavageSite=44; ConfidenceScore=5.03e-01
MVYVGMSVLNSYSTSCLKNHSSYSINHNTKLGGFSPGEKKNIVRKEQVGELRPISTNSVRLPSSIINNLLDHIPQSFHAKEKTTRRKGIY

SEQ ID NO: 119300 - protein, 115 aa, Glycine max
  Coding DNA Sequence Number=SeqID_2522
  Homolog annotation: Hit_ID=Q1SMF0; Match level="QueryCoverage=80%, HitCoverage=17%, E-value=9e-12, Identity=36%"; Hit description =Tetratricopeptide-like helical
MSKEVDIDDENEHESGVNEEQHVDCSDAFNTSQVFATQDDVWQWAQLVSYENGFVVVIMRSDTNIGMKGRTSFVLIVCERSGRYRSRKKGFVRRDIGSRKCGCPFKFRGKLVVGG

SEQ ID NO: 119301 - protein, 108 aa, Glycine max
  Coding DNA Sequence Number=SeqID_2523
MEERGHGMYYMPPTFPQYPSQMYQHPFEGHHTDMSASTRWNVPGPIPNIDDLLGVDLRHEFSAGVTKKKRGDIGVGEILITKHKDGINHVAHPHGITDTKMNDLRVSV

SEQ ID NO: 119302 - protein, 161 aa, Glycine max
  Coding DNA Sequence Number=SeqID_2524
  Homolog annotation: Hit_ID=Q9SBR1; Match level="QueryCoverage=74%, HitCoverage=88%, E-value=1e-15, Identity=39%"; Hit description=Stig1
  Pfam annotation: Domain name=Stig1; Domain location=31-161; Score =90.6; E_value=4.9e-24; Accession=PF04885.4; Description=Stigma -specific protein, Stig1
MVCFYIHRLDSKSFSHTFKMKAILVQTLALVTLLELLVLIPIEGKSTPKTLHQNGTTRVPSSPISPWVKNVVKARSSGCRGRSWVCNQGEFPPRSLCCRNRCVNVTSDRNNCGLCGIRCPFNWKCCGGLCRNINLSIFNCGKCGHRCPFGTLCFFGTCGYA

SEQ ID NO: 119303 - protein, 279 aa, Glycine max
  Coding DNA Sequence Number=SeqID_2525
MSTPVSPLPLAGHALLPKLMAASMQKETPCANTFKIDPVTTHLNARKKEAVVVGVALGVGVKLYKKENVFFHFQFSKLRTPPVIENKPLEHRWLRRENQHIGNDDLIVFRRKLDIMKQHEFLWEPYTTTVMSVLPPICLVGSVLWCAVGPSQPLNIHGLTLKGKQDENWFQLLAPMISQWNNRADFRVDVYPRQEGLLSFNSDYMAEVTETLQYMVSLQGRNTWTIDDLVPYVEKITILSEEQERITESMAHGPASERRFPPQEFHMLQSSVETRGFGR

SEQ ID NO: 119304 - protein, 1186 aa, Glycine max
  Coding DNA Sequence Number=SeqID_2526
  Gene Ontology: Mol. function=helicase activity; Cellular component =intracellular; Biological process=metabolic process
  Homolog annotation: Hit_ID=Q8S7U7; Match level="QueryCoverage=96%, HitCoverage=85%, E-value=1e-171, Identity=32%"; Hit description =Putative pentatricopeptide repeat containing protein
  Pfam annotation: Domain name=PPR; Domain location=1008-1042; Score =21.6; E_value=0.0028; Accession=PF01535.11; Description=PPR repeat
  Pfam annotation: Domain name=PPR; Domain location=1043-1077; Score =24.7; E_value=0.00033; Accession=PF01535.11; Description=PPR repeat
  Pfam annotation: Domain name=PPR; Domain location=1078-1112; Score =11.3; E_value=0.34; Accession=PF01535.11; Description=PPR repeat
  Pfam annotation: Domain name=PPR; Domain location=1113-1147; Score =25.5; E_value=0.00019; Accession=PF01535.11; Description=PPR repeat
  Pfam annotation: Domain name=PPR; Domain location=138-172; Score =13.5; E_value=0.19; Accession=PF01535.11; Description=PPR repeat
  Pfam annotation: Domain name=PPR; Domain location=173-207; Score=4.1; E_value=2.4; Accession=PF01535.11; Description=PPR repeat
  Pfam annotation: Domain name=PPR; Domain location=278-312; Score=7.5; E_value=0.97; Accession=PF01535.11; Description=PPR repeat
  Pfam annotation: Domain name=PPR; Domain location=313-347; Score =28.5; E_value=2.4e-05; Accession=PF01535.11; Description=PPR repeat
  Pfam annotation: Domain name=PPR; Domain location=348-382; Score =50.0; E_value=7.7e-12; Accession=PF01535.11; Description=PPR repeat
  Pfam annotation: Domain name=PPR; Domain location=383-417; Score =28.3; E_value=2.8e-05; Accession=PF01535.11; Description=PPR repeat
  Pfam annotation: Domain name=PPR; Domain location=483-517; Score=3.7; E_value=2.7; Accession=PF01535.11; Description=PPR repeat
  Pfam annotation: Domain name=PPR; Domain location=554-588; Score =16.9; E_value=0.071; Accession=PF01535.11; Description=PPR repeat
  Pfam annotation: Domain name=PPR; Domain location=589-623; Score=0.8; E_value=6; Accession=PF01535.11; Description=PPR repeat
  Pfam annotation: Domain name=PPR; Domain location=693-727; Score =27.1; E_value=6.1e-05; Accession=PF01535.11; Description=PPR repeat
  Pfam annotation: Domain name=PPR; Domain location=763-797; Score =23.1; E_value=0.001; Accession=PF01535.11; Description=PPR repeat
  Pfam annotation: Domain name=PPR; Domain location=798-832; Score=8.2; E_value=0.8; Accession=PF01535.11; Description=PPR repeat
  Pfam annotation: Domain name=PPR; Domain location=833-866; Score=6.6; E_value=1.2; Accession=PF01535.11; Description=PPR repeat
  Pfam annotation: Domain name=PPR; Domain location=868-902; Score =20.7; E_value=0.0051; Accession=PF01535.11; Description=PPR repeat
  Pfam annotation: Domain name=PPR; Domain location=903-937; Score =12.3; E_value=0.26; Accession=PF01535.11; Description=PPR repeat
  Pfam annotation: Domain name=PPR; Domain location=938-972; Score =12.7; E_value=0.24; Accession=PF01535.11; Description=PPR repeat
  Pfam annotation: Domain name=PPR; Domain location=973-1007; Score =8.7; E_value=0.7; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR; Domain location=1008-1042::1043-1077::1078-1112::1113 -1147::138-172::...
  Pfam module annotation: Domain location=173-207::278-312::313 -347::348-382::383-417::483-517::554-588::589-623::693-727::763 -797::798-832::833-866::868-902::903-937::938-972::973-1007
MLHSLFTLRRHRHRLCSSLSNIPTAQNHNINLLDNNASLKPHLLELSLAIPETTRTCWRLPALGPSHVLQLLLALQSHSVTVEKVRSLWEIFKWGAHKNVALNSKHPSQSLETMTSLLVQVGLFEEAEDLLFALESNEIFYDLVKGYVAARDWEKGVFVYDVMKGRGKVPSKDCYGVLIDLLVKVKRTGLASRVAFDLVDLGVPLSGDEVKALEKVMVQLCVDGKIQEARNMVKKVLVLNSEVSSLVFDEIAFGYCEKRDFKDLLSFFVEVKCAPSVMAANRVVNSLCSSYGVERAGLFLQELESLGFSPDEVTYGILIGWSCREGKMRNALSCLSVMLSKSFVPHVYTYNALISGLFKLGMLDHARDIVDEMIERGILPDISTFRVLIAGYCKSRRFDEVKSLIHEMENRGLIKLALMENPISKAFLILGLGPLSVKLKRDNDGGLSKTEFFDEVGNGLYLDTDVDEYDKHITLDLEESMVPNFNSFVSKECSDGNLKNALVLVEEMLCWGQELLFPEFSNLVRQLCSSRSQIKSMTKLLEQMPKSAHKLDPETLNLVVQAYSKKGLLFKAKIILDGMLQNEFHVKNETYTAILMPLCKKGNMKDFSYYWDVACRNKWLPSLEDFKCLLVHICHWKMLKEASQFLEIMLLSYPYLKSDICHVFLEVLSSTGLADTALVVLKQLQPCFNLDHTDYNHLIRGLCNEGKFSLAFTVLDDMLDRSLAPCLDVSVLLIPQLCKAHRYDKAIALKDIILKEQPSFSHAADCALICGFCNMGSTGKADTLFRDMLSKGLTPDDELCNIIIQGHCHVNDLRKVGELLGFAIRKDWELSLTSYKNLVRLVCRKGRVQFALSLKNLMLAQCPLDGLIIYNILMFYLLKDGNSLDVNKILTEMEEKKVVLDEVGHNFLVYGFLQCRDLSSSLHYLTTMISKGLKPSNRSLRKVISKLCDAGNLKKALKLSQEMRLRGWMHDSSIQTSIVESLLLCGNIQGAETFLDRMGEESLTPDDINYDYLIKCFCQHGRLNKAVHLMNTMLKKHNIPVSTSYDFIIHGFCAQNKLDIALNFYSEMLSWNLKPRIDTVEMLLHRFCQDGKTELAEQFLVDMSHGGETPTRKMYCTVIKSYHMKKNLRKASELLQAMQENGYQPDFETHWSLISNLNSAKAKDTDNASKGFLSRLLFKSGFLQKK

SEQ ID NO: 119305 - protein, 93 aa, Glycine max
  Coding DNA Sequence Number=SeqID_2527
MKKKSPTSITCIMQMRKRTQFLPIITNLNFKPTGKRGNEGEFPMEAHLTRTCRDNNVQCTNTQTAPRNLQLKTIKTQLILKKSDKNQTNNNIF

SEQ ID NO: 119306 - protein, 68 aa, Glycine max
  Coding DNA Sequence Number=SeqID_2528
MSIHHQAYQAKMVIYARNKQAETDEASAYRKPKKEKAYDRQQNSHRSRETNKRQNTELIKENQPDKRG

SEQ ID NO: 119307 - protein, 151 aa, Glycine max
  Coding DNA Sequence Number=SeqID_2529
  Gene Ontology: Mol. function=RNA-directed DNA polymerase activity; Biological process=RNA-dependent DNA replication
ENTYESFQRDDGDWMSGPAKLESMEVGKMVTWEEVCAIIFLMGALKAPVPDGFHALTNLVTGVFEDPKREVIQGLVSPYQSIFIPNRQSVDNVIIVQEVFHSIKTKKGNCWWMEIKIDLEKAYSRFSWEFPIRENRAMHHEVASATDGELG

SEQ ID NO: 119308 - protein, 39 aa, Glycine max
  Coding DNA Sequence Number=SeqID_2530
MADECMQVEDTRKALNLVLEVDIVVNAVWAYRMDEWAKL

SEQ ID NO: 119309 - protein, 249 aa, Glycine max
  Coding DNA Sequence Number=SeqID_2531
  Gene Ontology: Mol. function=protein transporter activity; Cellular component=integral to membrane; Biological process=intracellular protein transport
  Homolog annotation: Hit_ID=Q9SF29; Match level="QueryCoverage=92%, HitCoverage=89%, E-value=7e-92, Identity=71%"; Hit description =Syntaxin-71
  Pfam annotation: Domain name=SNARE; Domain location=166-230; Score =42.8; E_value=1.2e-09; Accession=PF05739.9; Description=SNARE domain
MSVIDILTRVDSICKKYDKYDVEKQRDSNLSADDAFAKLYASVDADIEALLQKAETADKEKSKASTVAINAEIRRTKARLLEEVPKLQRLAMKKVKGLSSQEFAARNDLALALPDRIQAIPDGAPAAPKQTGSWAASASRPGIKFDSDGKFDDEYFQQTEESSRFRQEYEMRKMKQAKGLDTLKNMAHDMNEELDRQVPLMDEIDTKVDRASSDLKNTNVRLRDTVNQIKIYASLYSLLLCGFIAQFIF

SEQ ID NO: 119310 - protein, 1014 aa, Glycine max
  Coding DNA Sequence Number=SeqID_2532
  Gene Ontology: Mol. function=steroid hormone receptor activity; Cellular component=nucleus; Biological process=regulation of transcription, DNA-dependent
  Homolog annotation: Hit_ID=Q2UHA8; Match level="QueryCoverage=87%, HitCoverage=27%, E-value=4e-30, Identity=23%"; Hit description=Fry -like conserved proteins
MPPNSIIPPVLVIVCLENGQFCYHSNSSVADGYFSVLAEVYMRQEIPNCEIQRLLSLILYKVVDPSRQIRDDALQMLETLSVREWAEDGIEGSGSYRAAVVGNLPDSYQQFQYKLSCKLAKDHPELSQLLCEEIMLRQLDAVDIIAQHQVLTCMAPWIENLNFWKLKEGWSERLLKSLYYVTGRHGDQFPDEIEKLWSTIASKNRNISPVLDFLITKGIEDCDSNASTEISGAFATYFSVAKRRLLEDSIEPVTSKGDASANFVLEFSQGPAVAQMTSVMDNQPHMSPLLVRGSLDGPLRNVSGSLSWRTAGMTGRSVSGPLSPMPPELNIVPVNAGRSGQLLPALVNMSGPLMGVRSSTGSLRSRHVSRDSGDYLVDTPNSGEDGLHTGSAMHAVNPKELQSALQGHQQHSLTHADIALILLAEIAYENDEDFRQYLPLLFHVIFVSMDSSEDIVLEHCQHLLVNLLYSLAGRHLEQYEVENNDRENKQQVVSLIKYVQSKRGSMMWENEDPTVVRTELPSAALLSALVQSMVDAIFFQGDLRETWGEEALRWAMECTSRHLACRSHQIYRALRPSVTSDACVSLLRCLHRCLGNPVPQVLGFVMEILMTLQVMVENMEPEKVILYPQLFWGCVAMMHTDFVHVYRQVLELFSHVIDRLSFRDRTTENVLLSSMPRDELTTSDLGEFQRTESKSSYEPLQEGSLPTYEGVQPLVLKGLMSSVSHSVSIDVLSRITVHSCDSIFGDAETRLLMHIIGLLPWLCLQLSKDIVIGPASPLQHQYQKACSVAANIAIWCRAKSFDELATVFMIYSRGEIKSVDNFLACVSPLLCNEWFPKHSTLAFGHLLRLLEKGPVEYQRVILLMLKALLQHTPMDATQSPHIYAIVSQLVESTLCWEALSVLEALLQSCSSLTGSHPYEPGSLENGIGGTEEKLLAPQTSFKARSGPLQYGFGSGLGSVSTPGHVGSTESGMSPREVALQNTRLIIGRVLDRSALGKRKDQKKLVPFVANIGNP

SEQ ID NO: 119311 - protein, 510 aa, Glycine max
  Coding DNA Sequence Number=SeqID_2533
  Gene Ontology: Mol. function=nucleic acid binding; Cellular component= intracellular; Biological process=regulation of transcription
  Homolog annotation: Hit_ID=Q1SZA5; Match level="QueryCoverage=74%, HitCoverage=77%, E-value=1e-105, Identity=57%"; Hit description=Zinc finger, C2H2-type
  Pfam annotation: Domain name=RS4NT; Domain location=128-165; Score =15.7; E_value=0.027; Accession=PF08071.2; Description=RS4NT (NUC023) domain
  Pfam annotation: Domain name=zf-C2H2; Domain location=143-165; Score =22.0; E_value=0.0022; Accession=PF00096.16; Description=Zinc finger, C2H2 type
  Pfam annotation: Domain name=zf-C2H2; Domain location=170-191; Score =16.3; E_value=0.11; Accession=PF00096.16; Description=Zinc finger, C2H2 type
  Pfam annotation: Domain name=zf-C2H2; Domain location=67-89; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=128-165::143-165::170-191::67-89
  Subcellular localization annotation: CTP_CleavageSite=36; ConfidenceScore=5.27e-01
MQMIPGDPFSLSTSLPGLPNNEQNTNTNPNPNTPPPNKKKRNLPGTPDPDAEVIALSPKTLMATNRFICEICNKGFQRDQNLQLHRRGHNLPWKLRQRSNKDIRKKVYICPEKTCVHHDAARALGDLTGIKKHYSRKHGEKKWKCEKCSKKYAVQSDWKAHTKTCGTREYKCDCGTLFSRKDSFITHRAFCDALAEESSRLTSVASTSLNFMSEDTTMMNTQASLSSSGLINGQGMQSVSHFGPHGLRLMSMGTDQQRPNLSLWLNQGNHHINNPLDVASSSSSGLPEVLHMAQPNNNALIGSSTMFSNFGITPASSNSSNPNLSLMGKKGEGGASDLASMYSESQNKNSNSATPMSATALLQKAAQMGSTRSTNPSIFSGSFGVMSSSSTQSTSLNSNSNQSSDQLNHAFQNFNATSSSATLLGSSTNFSSLTHSSNGFDQFLMENNVEPTQLKLHPGSNIMEQHNLTRDFLGVSGNGGGHHAFLPQELAKFASLGSSMGLNQFTAGHQ

SEQ ID NO: 119312 - protein, 350 aa, Glycine max
  Coding DNA Sequence Number=SeqID_2534
  Gene Ontology: Mol. function=DNA binding; Cellular component=nucleus; Biological process=regulation of transcription
  Homolog annotation: Hit_ID=Q1SZA2; Match level="QueryCoverage=95%, HitCoverage=99%, E-value=1e-143, Identity=75%"; Hit description=No apical meristem (NAM) protein
  Pfam annotation: Domain name=NAM; Domain location=26-154; Score =306.1; E_value=6.4e-89; Accession=PF02365.6; Description=No apical meristem (NAM) protein
MKTRLFLLRHPTFMFMDKDANSEIQLPPGFRFHPSDEELIVHYLRNKVTSSPLPASFIAEIDLYKYNPWELPSKALFGEDEWYFFTPRDRKYPNGVRPNRAAASGYWKATGTDKPIFTSCGMKSIAVKKALVFYKGRPPKGSKTDWIMHEYRLHDSTISNSKQGGTMRLDEWVLCRVRQKTISPRSLWEDSNEPIYEPTSYFQQMSEKSNPEPVKNSLHSEYPMLPYILASKSALPNSIDMASSSSFGCNDDVKAYASLHDGNLNNIIIGAQFIAPVAEDLFNPLKRRNIEENELDLYAPLNKKLNEEVDVGKQILEKDVNKGYNFNNFDQWTSIIQPQEFNSLAFTKYA

SEQ ID NO: 119313 - protein, 47 aa, Glycine max
  Coding DNA Sequence Number=SeqID_2535
MAKEKGFPYERCSETLMRLARNFALSASLSFFVGFFRAKLELTAKRE

SEQ ID NO: 119314 - protein, 197 aa, Glycine max
  Coding DNA Sequence Number=SeqID_2536
FSSVTERFFMELNTRRIDTSATRSETLSIINGMRYLKLGVKTEGGLNASASFVAKAHPINRQAHKRKSELHHALCNMLSNILAPLADGGKSQWPPSGVEPALTLWYEAVGRIRVQLMHWMDKQSKHIAVGYPLVTLLLCLGDPQIFHNNLSPHMDQLYKLLREGCQEAYVSVDDVRHSGIGIRKLANETLGESRAGL

SEQ ID NO: 119315 - protein, 426 aa, Glycine max
  Coding DNA Sequence Number=SeqID_2537
  Homolog annotation: Hit_ID=UPI0000D574D4; Match level="QueryCoverage =76%, HitCoverage=11%, E-value=2e-13, Identity=22%"; Hit description =PREDICTED: similar to CG32045-PB, isoform B
MALDCLHRVLRFYLSVHAANQAPNRIWDNLDSVTSQLLAVLRKGLLTQDVQHDKLVEFCVTIAEHNLDFTMNHMILELLKQDSPSEAKVIGLRALLAIVMSPSSKHFGLDIFKGPDIGHYIPKVKAAIESILRSCHKTYSQALLTSSRTTIDAVTKEKSQGYLFRSVLKCIPNLIEEVGRTDKITEIIPQHGISIDPGVREEAAQVLNRIVKYLPHRRFAVMKGMANFILRLPDEFPLLIQNSLGRLLELMRFWRSCLIDDRIQLEADAKSLGHETVRFRKSSIQQSGEAIEFRASEIDAVGLIFLSSVDSQIRHTALELLRCVRALRNDIRDLKIHEQPNHTLKYEAEPIFIIDVLEEHGDEIVQNCYWDSGRPFDLKREPDAIPPEVTLQSIIFESPDKNRWARCLSELVKYAAELSPSSVQEA

SEQ ID NO: 119316 - protein, 119 aa, Glycine max
  Coding DNA Sequence Number=SeqID_2538
MHEGTEVGFSILGKVGRGHFYGQRVINRVANPTCGKPNSTLRRTAQQLDHRSSPVIFNDPAKTRFSPLANSDRAQKIVKSYDLTSQIAVLSTMVLPPFHILLSLKSLSGFVVFFFCISA

SEQ ID NO: 119317 - protein, 126 aa, Glycine max
  Coding DNA Sequence Number=SeqID_2539
MKAGSAAKLIVDALLQRFLPLARRRIETAQAQDGQYLRPSDPAYEQVLDSLAMVARHTPVPLLEALLRWRESESPKGANDASTFQRKLAVECIFCSACIRFVECCPQEGLTGNAVVDGSRTTVACS

SEQ ID NO: 119318 - protein, 196 aa, Glycine max
  Coding DNA Sequence Number=SeqID_2540
  Gene Ontology: Mol. function=nucleic acid binding; Cellular component= nuclear pore; Biological process=DNA integration
MAEAHSISSPMVSSCKLSKHGADIFQDPTLYRSVVGALQYATLTKPKISFNKVCQFMAKPLESHWAVVKRILRYLKEAVIFLGPNLISWWSGKQKVTARSSTEAEYRSLAQNSAELTWIHALLTELQVPFTTPVLYCDNQSVVSIAHNPVFHSRTKHMKIDVFFVREKVLAKKLFILHIPALDQWADMLTKPLSSA

SEQ ID NO: 119319 - protein, 212 aa, Glycine max
  Coding DNA Sequence Number=SeqID_2541
  Gene Ontology: Mol. function=structural constituent of ribosome; Cellular component=ribonucleoprotein complex; Biological process =translation
  Homolog annotation: Hit_ID=Q7EYE3; Match level="QueryCoverage=76%, HitCoverage=66%, E-value=1e-56, Identity=66%"; Hit description =Putative ribosomal protein I
  Pfam annotation: Domain name=Ribosomal_L13; Domain location=45-166; Score=120.0; E_value=6.9e-33; Accession=PF00572.8; Description =Ribosomal protein L13
MKMVTAFNGNMKVIWICIGFVKRDPPPPMKAAAGLRRINLDGLRWRVFDAKGQVLGRLASQIATVVQGKDKPTYTPNRDDGDMCIVLNAKDICVTGRKLTDKVYYWHTGQQRTLKDQMAKDPTEVIRKAVLRMLPRNKLRDDRDRKLRIFPGSEHPFVDRPLEPYVMPPRSVREMRPRARRAMIRAQKKAEQQQQKADGMKGKNGEAQEESA

SEQ ID NO: 119320 - protein, 277 aa, Glycine max
  Coding DNA Sequence Number=SeqID_2542
  Gene Ontology: Mol. function=GPI anchor binding; Cellular component =membrane; Biological process=cell adhesion
  Homolog annotation: Hit_ID=Q1SZB4; Match level="QueryCoverage=59%, HitCoverage=65%, E-value=1e-62, Identity=74%"; Hit description=Beta -Ig-H3/fasciclin
  Pfam annotation: Domain name=Fasciclin; Domain location=43-177; Score= 107.5; E_value=3.8e-29; Accession=PF02469.12; Description=Fasciclin domain
MAKLFNFLPLLFLNIFIQTISAQVAPAPAGPTNITQVLEKAGQFTTFIKLLKASQIADRINSQLNNSNQGLTVFAPTDNAFSSLKAGTLNSINSQDQMQLIQFHILPTLYTISQFQTASNPLHTQAGNSDDGEYPLNVTTSGNQVNVTTGVVDTTVSNTIYSDNQLAVYQVDKVLLPMKLFGATAPAASPAEAPAPTKPEKNVRAGAADSPSGSSDTSADASSAVCLFYPSMLIIPLQDKIKLCMFKLERHRSKVVMGPGWSNDSNIPNQSEGRNSN

SEQ ID NO: 119321 - protein, 422 aa, Glycine max
  Coding DNA Sequence Number=SeqID_2543
  Gene Ontology: Mol. function=RNA-directed DNA polymerase activity; Cellular component=chromatin; Biological process=chromatin assembly or disassembly
MEFDFSIEYKQGHYNVAADALSRVELVSCQALAVHQVVSELVIKIKASWDSDPAVHRELMRKGRLVEGKDDALRQDIILHFHASATTGHSARNATLQRLKYVVYWKGMSKDVRAFVQKCSVCQKCKYETKASPGLLQPLPIPDLIWQHITMDFIEGLSSSFDSITSDRDSIFLSQFWQDLMAFEGVQVQLSTAYHPQMDNQTKIISRCFETYLRSTPYEVVYGQSPPVNLPYLAGSSKIELVDRSLLRREEMLKIIKFHMKRAQDRMKQLTDKHRYERQFSVGDMVYVKLHPYRQISVAARSNVKLSPKFYGPFQLKKHVGEAVTSSSLHSSVEEDPLIKEPEAILDRMPIKRRGRVVTKVLVNLEDKTEAKGGELIRDILVRLKTSRRATESTEVTRVLFESRDYNVTPTTTVSNKATLSK

SEQ ID NO: 119322 - protein, 352 aa, Glycine max
  Coding DNA Sequence Number=SeqID_2544
  Gene Ontology: Mol. function=RNA-directed DNA polymerase activity; Cellular component=chromatin; Biological process=chromatin assembly or disassembly
MGLLNSLTTQAIDKEVPHTLAKLLDKFFDLFQEPSGLPPRRPGHDHRIPLVQGVGPISKRPYKYAKQHKDVIDKLVQESLSTGIIQNSSSPFASPVVLVGNKDRSWRLCVDYRDLNKHTVKNKFPIPLVDDLLDELAGSSIFSKIDLKSAYNQVRMDPADVYKTAFKTHARHFEYLVMPFGLTNAHATFQGLMNSVFKEFLRKFLLVFFDDILVYSCSLEDHLLYLHKVLATMRANSLFAKRSKCYFGVSKVEYLGHFISKEGVSTDPAKVLVVEQWPLPKTLKQLRSFLGLAGYYKRFVKGYGGIAKPLTNMLKKDNFIWFDAAKLAFQQLKKKLTETQFWLYPTVQKSLW

SEQ ID NO: 119323 - protein, 132 aa, Glycine max
  Coding DNA Sequence Number=SeqID_2545
  Homolog annotation: Hit_ID=Q67U57; Match level="QueryCoverage=33%, HitCoverage=21%, E-value=3e-16, Identity=84%"; Hit description=Major intrinsic protein-like
  Pfam annotation: Domain name=DZC; Domain location=4-27; Score=22.4; E_ value=0.00044; Accession=PF08381.1; Description=Disease resistancezinc fingerchromo
MDQSEMFNKWQAHRWWAENYDKVMELYSVQRFNQQLVPLPTLPRSEDEVLEYPTSGKCTSLCELKKKIMTWYTRGRIEAKMACWQSEIAQPLLNIIKLPRQIWKVDKLEKMDEGNLVDPRTSPEQVVETKAI

SEQ ID NO: 119324 - protein, 159 aa, Glycine max
  Coding DNA Sequence Number=SeqID_2546
MITNNCRTISFKVKVHENLKRKKNHLHGTQNFNLVATKKYTRSTSSISSNLTQGKRKEKKKNKKKIHVKNCHLKTYIHKQETTIATVKITPSNVCLFKLNALEASADMPFQTWVMLVGPSGAGATWAEIVWTRRLRKRSGSNSLNFLQNPKYEYMNQRN

SEQ ID NO: 119325 - protein, 96 aa, Glycine max
  Coding DNA Sequence Number=SeqID_2547
MKFKPQVVHATASKPPLENGGACHPARPGELGCFLQKQLPSGGTSWKAQIVHLHFLLTSGMSRKFMGCATMLSFDFRHATELHELLNDGCQVPQSG

SEQ ID NO: 119326 - protein, 76 aa, Glycine max
  Coding DNA Sequence Number=SeqID_2548
MEGRANLGLKLGGIDGNPVLRGTRIRATWEYVSSVEGGQLGMVDLCVICGCGESTCTIARSPPSTTYDGYPIILQA

SEQ ID NO: 119327 - protein, 478 aa, Glycine max
  Coding DNA Sequence Number=SeqID_2549
  Gene Ontology: Mol. function=zinc ion binding
  Homolog annotation: Hit_ID=Q6H6V3; Match level="QueryCoverage=86%, HitCoverage=82%, E-value=6e-66, Identity=39%"; Hit description=Zinc finger (C3HC4-type RING finger) protein-like
  Pfam annotation: Domain name=zf-C3HC4; Domain location=244-291; Score= 56.4; E_value=9.6e-14; Accession=PF00097.15; Description=Zinc finger, C3HC4 type (RING finger)
MATEAHHFPKINDQGTSSSSRAYNPIQKDVEPSEITEELPSRHTHGRSKSLTEIPTRTLDETREEFFRTSKPPTPSLRSQINEFQVPSSTKNESTTKTLIPKLSFKFHNTCSDVEEASIPALEGSPPERLQDPIISRTSSPNGKKISSLPVTPIAQSNQESEHGGNISYPATHVKKGQQLPMHRSRSVPVLTEDGNTYVGAMFRIVPTTPRLARSIATTSTKSPPDDTIENEDGEDIPEEEAVCRICLIELGEGSDTLKMECSCKGELALAHQECAVKWFSIKGNRTCDVCKQEVQNLPVTLLRVLNGQTLYLTRSRSQQYRQGETNNFHRVWQNVPILVIINMLAYFCFLEQLLVSSMGSGAVAISLPFSCILGLLASMTSTIMGSSEIGLQQAISKKVLDLNLVDRKYVIERKNLAKSDQVGSLMKIKSLNKEAVLSILLATFTGFGAVMCGAYILIEFLKWRRRWLGSQEVVLPH

SEQ ID NO: 119328 - protein, 69 aa, Glycine max
  Coding DNA Sequence Number=SeqID_2550
MAGNLFHNNDRGFGRRTKGGGDRRHGCLQNQCPFYKKILHFNIISSVEIVNCFGKTKLEEIWKREDESS

SEQ ID NO: 119329 - protein, 562 aa, Glycine max
  Coding DNA Sequence Number=SeqID_2551
  Gene Ontology: Mol. function=methyltransferase activity; Biological process=metabolic process
  Pfam annotation: Domain name=Methyltransf_11; Domain location=204 -279; Score=1.6; E_value=0.038; Accession=PF08241.2; Description =Methyltransferase domain
  Subcellular localization annotation: CTP_CleavageSite=32; ConfidenceScore=5.11e-01
MTMMRLHNHITDRNFTGFAFAASLCPFYIFTRSTTLPTPHFFFFFFFFFIAHGKNGWGPVQTDAEEEEGSKEGVVKLPKINGCPRGWKPYLLQFNMDTKAFKFQILTSSIARRVLLRTILLACAVSFVSLYRALSLFDFGTLAPIATYFDCVSGFQSVTFRPGSPLLRTRFGVSANCEKDANLTLTVVTELTGSRLLHPGAKSLCVGEGSSMAVTAMKQLGFFSSVSAVQTHRFEQRNVLYEDNSFDFVFSRDLDKVSVPALLVLEVERVLKPGGVGVFLVGTTSSHPNDMIRAATPVSSLLRSSNVVHVGSVNDHNLVVFKKRVENATLFYQHGLPADCPSVTFTKPLIELMEPLVSEKQQQPPIEFHKRNIPYLPKFVDVSTRKRLVYIDIGVGELLDANVSDCWFLPSYPIDQKDFNVYFVHYNTSIMLSYVKRPGITFVYHPGLAGIDKVNAKLGSDDDDDMDPLLGEEEKFDFPAWFKETVQYADFVVLKMNAGSVELKFLSDIFENGAICFVDELFLKCPERRGGDEKSVTSKESCMDIYKALRSNGVYVHQWWGD

SEQ ID NO: 119330 - protein, 190 aa, Glycine max
  Coding DNA Sequence Number=SeqID_2552
  Gene Ontology: Mol. function=zinc ion binding; Cellular component =nucleus; Biological process=ubiquitin cycle
  Homolog annotation: Hit_ID=Q2HV40; Match level="QueryCoverage=98%, HitCoverage=51%, E-value=2e-78, Identity=75%"; Hit description=Zinc finger, RING-type
  Pfam annotation: Domain name=zf-C3HC4; Domain location=136-174; Score= 6.4; E_value=0.034; Accession=PF00097.15; Description=Zinc finger, C3HC4 type (RING finger)
  Pfam annotation: Domain name=zf-P11; Domain location=134-183; Score =2.4; E_value=0.061; Accession=PF03854.4; Description=P-11 zinc finger
  Pfam module annotation: Pfam domain module=zf-C3HC4::zf-P11; Domain location=136-174::134-183
MKENHLAPVTVHFEQGLGQKFRQAAGTGIDFSVFEESELLKVGDMNVYPLAVKADASVKADAPPGNYDESDRSPTSGNTNSQITQVVFEKEKGEFRVKVAKQILWVNGMRYELQEIYGIGNSTESDLDENDQGKDCVICWSEPRDTIVHPCRHMCMCSGCAKVLRFQTDRCPICRQPIERLLEIKVGSEE

SEQ ID NO: 119331 - protein, 630 aa, Glycine max
  Coding DNA Sequence Number=SeqID_2553
MTEDMKIDHIVEVPDTPDRTTVRHDYQKYLGNPDKRGRAFNAADENNNHSNYISLSPSEESYSSQNAPIFRRAQTDGAEKMEKGKSISSKVPSKSSHRGISILDLTEENEQIRHPKPAFSHRGSRDNATEDKKALKATNGRSSLPVISDSSNTSRNAFIGKYKLDIKTLPGPNISVDHGKGISLSNDSQLQNEKQVSLPPRVSTSPRGRGHKRLVRNGCISPHNIATMEKQLAEQSNHKTKDVEQSHGHSVSSSTVSPVSVDDIVAGERGNGRGKGKEVLAYRSPHRLTFRTASSPVTNYEEINGPSNAIRNPLQYSGGQGGRRTTHNERNANWHLHDVNGHHLRINNDVGRFINGHNTTGMDRRNTGNGQSSNQIHGSQSDHTAQPTSVIIPDVDQSSGTHRTADILTKRQRKRESPSGFMFRGSTGDSSSSSRNPVSDPEVIELLSPPRGSSSSSRTSVLDHEVVDLLSTPRYANRSSEDLDDNDNNSSEARARQVEADERLARELQEQLYHDDPFEGRGIDEDLAWDLQRAEALMRATIDSHSISQPRQLPRAIRQPRTRFPENPSRRRAMAQASFSNRMSQWRSRATSRTRAPSTSSRGRGPRFPLDMDLDMSLQLLYSMILNGLL

SEQ ID NO: 119332 - protein, 89 aa, Glycine max
  Coding DNA Sequence Number=SeqID_2554
MWISLPSYALEDFINEHKEAESRSKEAQAYKKYHCEPSSKMGASVFATGHFIHVPARVDIYVVELVRTKFAIDFYCGKMLMLFALRGMC

SEQ ID NO: 119333 - protein, 557 aa, Glycine max
  Coding DNA Sequence Number=SeqID_2555
  Gene Ontology: Mol. function=zinc ion binding; Cellular component =endoplasmic reticulum
  Homolog annotation: Hit_ID=Q6KA74; Match level="QueryCoverage=98%, HitCoverage=94%, E-value=1e-124, Identity=41%"; Hit description =Ankyrin repeat protein-like
  Pfam annotation: Domain name=Ank; Domain location=69-101; Score=29.3; E_value=1.3e-05; Accession=PF00023.20; Description=Ankyrin repeat
MAGLNVSEYGHSCVHKAIILKDHVGLKEILGVLPKLGNPFEIKTEAASIAEDEKAAAISVVVDRRDVPHGDTPLHLAAKLGDIVATEMLMDAGANGRLKNTEGWTALREAIINKQDKIAMIMIKYYWNDYDKKYYRRLPRYIGTVRRMKDFYMEITFHFESSVIPFISRIAPSDTYKIWKKGGNMRADMTLAGFDGLKIKRSNQSILFLGDGTSDDERKFPGSLFKVLHKEKEVIVASPRKVAPTDRQVKNTLARKSRSESVRVGIDVSQALLVPQLTWRRKERKEMVGPWKAKVYDMQNVVLSVKSRRIPGAPPPEAKPAPKQANMKDNEKIEDILTDEERKQLEAAMNSSDDNGHTHKSKHAKKEKKGRSGGHRDHNKDKNTTSAQSAEISVNQKGESQFKRGMMPSLWLSQNFPLKIDELLPMLDILAEKLKAVRRLRELLTTKLPKESFPIKVAIPVVSTVRVLVTFTKFEEMQHENADEFESAPSSPTSSDQENPEEEHSSSWFGWIKTPSRSSTTSAESSSKIFDDQDLFAIPSGYKWVTIEDKLKKRGLE

SEQ ID NO: 119334 - protein, 75 aa, Glycine max
  Coding DNA Sequence Number=SeqID_2556
MASSGTPIIFTVLQISIYVARWAYGSSLGVAELEYSSSVILYRWSSAMMHSSRKGCGLVKGEREDNSDDEGPLSP

SEQ ID NO: 119335 - protein, 112 aa, Glycine max
  Coding DNA Sequence Number=SeqID_2557
MEEVTLHAVVEGDYSELLILRSELKKTFLCEYVGSITEDGIEVLLGLGSQAINEDVELDWLAKPVCRSLPEQPMEADEISTLPSAVLDSGKYFFGDFSTTSSYVRRLFHLNK

SEQ ID NO: 119336 - protein, 189 aa, Glycine max
  Coding DNA Sequence Number=SeqID_2558
  Gene Ontology: Mol. function=zinc ion binding
  Homolog annotation: Hit_ID=Q1SZC1; Match level="QueryCoverage=65%, HitCoverage=36%, E-value=5e-34, Identity=56%"; Hit description=Zinc finger, RING-type
  Subcellular localization annotation: CTP_CleavageSite=47; ConfidenceScore=5.11e-01
MGNISSSGGVGGGNPRRRHSGASRRSHPPPPPPVTPQPEIAANPFVYHGAASQYPNPPLHYPQYHYPGYYLSVPPPMPHHPHHHHHQHHHPHMDPAWIQGRYPCGPMMPNPAPFVEHQKAVTIKNDVNIRKETLRLEPDEQNSGHLLVSFSFDATVSGRFGLFSRGYMLIKLIDTVDLEGGPGTSFCSL

SEQ ID NO: 119337 - protein, 958 aa, Glycine max
  Coding DNA Sequence Number=SeqID_2559
  Gene Ontology: Mol. function=ATPase activity, coupled to transmembrane movement of ions, phosphorylative mechanism; Cellular component=membrane; Biological process=metabolic process
  Homolog annotation: Hit_ID=Q1SF23; Match level="QueryCoverage=58%, HitCoverage=98%, E-value=0.0, Identity=77%"; Hit description=Cation transporting ATPase, C-terminal
  Pfam annotation: Domain name=Cation_ATPase_C; Domain location=807 -946; Score=40.1; E_value=7.5e-09; Accession=PF00689.11; Description =Cation transporting ATPase, C-terminus
  Pfam annotation: Domain name=Cation_ATPase_N; Domain location=92-179; Score=44.8; E_value=2.9e-10; Accession=PF00690.16; Description=Cation transporterATPase, N-terminus
  Pfam annotation: Domain name=E1-E2_ATPase; Domain location=194-372; Score=54.1; E_value=4.6e-13; Accession=PF00122.10; Description=E1-E2 ATPase
  Pfam annotation: Domain name=Hydrolase; Domain location=376-711; Score=58.7; E_value=1.9e-14; Accession=PF00702.16; Description =haloacid dehalogenase-like hydrolase
  Pfam annotation: Domain name=Hydrolase_3; Domain location=523-735; Score=-75.9; E_value=0.01; Accession=PF08282.2; Description=haloacid dehalogenase-like hydrolase
  Pfam module annotation: Pfam domain module=Cation_ATPase_C::Cation _ATPase_N::E1-E2_ATPase::Hydrolase::Hydrolase_3; Domain location=807 -946::92-179::194-372::376-711::523-735
MSMPLLTNLQHIETLLNAPNPTVSASIKRWHSAFMAIYCSRAIMSHSTLKKPNKTKAKASPSPTPTPTPSFTVVDLNPHHSFDIDQTALTDIVKEKELENLDRFGGVEGVAKALQTHVEYGIKGGDDDAEDITRRRQVFGSNTYHKPPSKGFFHFVVEAFKDVTILILMVCAALSLGFGIKEHGIKEGWYDGGSIFVAVFIVISLSAVSNFRQNRQFDKLSQVSNDIQIDVVRSGRRQNVSIFEIVVGDVICLKIGDQVPADGLFIEGHSLKVDEASMTGESDHVEISRQNHPFLFSGNTKDETGIKEFNGSRTKFDDIMNAVVGIVADAVTIVVVAIPEGLPLAVTLTLAYSMKKMMADQAMVRKLSACETMGSATTICTDKTGTLTLNEMKVTKVWLGLEPVLESAYTKVAPFVLQLIQEGVALNTTGSVHKSNKSGSEFEFSGSPTEKAILSWAVLELNMEMENLTRSCSIIHVETFNSKKKRSGVLLRRKVDNTVNAHWKGAAEMVLKMCSRYYDASGIVKDLDNDRMLKFEHIIQGMASSSLRCIAFAHVEVAEEELVDEEGNAMAKVKENGLTLLGLVGIKDPCRQGVKNAVEACQNAGVNIKMITGDNVFTAKAIATECGILRPNQDTDGAVIEGEEFRNYTHEERLEKVEKICVMARSSPFDKLLMVQCLKQKGHVVAVTGDGTNDAPALKEADIGLSMGIQGTEVAKESSDIVILDDNFASVVTVLRWGRCVYNNIQKFIQFQLTVNVAALAINFVAAVSAGKVPLTAVQLLWVNLIMDTLGALALATEKPTMELMHKPPVGRTKPLITNVMWRNLLAQALYQIAILLTLQFKGESIFGVTSGVNDTLIFNTFVLCQVFNEFNARKMEKRNVFKGIHRSKLFLGIIGITIILQVVMVEFLKKFADTERLNWGQWGICIGLAAVSWPIGWVVKLIPVPDKPFLSFLSKKK

SEQ ID NO: 119338 - protein, 239 aa, Glycine max
  Coding DNA Sequence Number=SeqID_2560
  Gene Ontology: Mol. function=oxidoreductase activity; Cellular component=membrane; Biological process=metabolic process
  Homolog annotation: Hit_ID=Q6ZG50; Match level="QueryCoverage=92%, HitCoverage=92%, E-value=3e-61, Identity=52%"; Hit description=Short- chain dehydrogenase/reductase family protein-like
  Pfam annotation: Domain name=adh_short; Domain location=9-158; Score=- 23.5; E_value=0.00019; Accession=PF00106.15; Description=short chain dehydrogenase
MASSASSRGIAAIVGVGPNLGLSIARKFAHEGYTVAILARDLGRLSRFADEIAREEKAQVFAIRIDCSDSRSVREAFEGVLSLGFVEILVYNAYQPLPWCPSSFQDLRIESFERSLAVSSVGAFHCAQQNTAPNGGDETGCGKFALRALSQCLAKEFQPQGVHLAHVIIDGVIGPPRGPTLTSSSSQRGNSLGEQSSGGGGEGTMDPDALAQTFWHLHVQDRNAWTLEMDLRSPSARFF

SEQ ID NO: 119339 - protein, 115 aa, Glycine max
  Coding DNA Sequence Number=SeqID_2561
  Subcellular localization annotation: CTP_CleavageSite=37; ConfidenceScore=5.17e-01
MWDRHRLKGALKPGVFTPKAYTLKSPSGPLPPDSVIAASLIDSSSFFFDCSNRVPKRQREGKWIEASILYCLHAIFFPLSMDIILQIPTMKVCGIESQTTYQNFMTMQRLTSQGS

SEQ ID NO: 119340 - protein, 691 aa, Glycine max
  Coding DNA Sequence Number=SeqID_2562
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=56%, HitCoverage=28%, E-value=1e-137, Identity=55%"; Hit description =Chromo
  Pfam annotation: Domain name=Integrase_Zn; Domain location=327-368; Score=8.5; E_value=0.029; Accession=PF02022.9; Description=Integrase Zinc binding domain
  Pfam annotation: Domain name=LRR_1; Domain location=123-145; Score =7.0; E_value=14; Accession=PF00560.23; Description=Leucine Rich Repeat
  Pfam annotation: Domain name=LRR_1; Domain location=150-173; Score =4.9; E_value=34; Accession=PF00560.23; Description=Leucine Rich Repeat
  Pfam annotation: Domain name=LRR_1; Domain location=175-197; Score =3.4; E_value=66; Accession=PF00560.23; Description=Leucine Rich Repeat
  Pfam annotation: Domain name=LRR_1; Domain location=199-220; Score =6.4; E_value=18; Accession=PF00560.23; Description=Leucine Rich Repeat
  Pfam annotation: Domain name=LRR_1; Domain location=222-242; Score =10.8; E_value=2.8; Accession=PF00560.23; Description=Leucine Rich Repeat
  Pfam annotation: Domain name=LRR_1; Domain location=244-269; Score =6.6; E_value=16; Accession=PF00560.23; Description=Leucine Rich Repeat
  Pfam annotation: Domain name=LRR_1; Domain location=48-70; Score=2.6; E_value=92; Accession=PF00560.23; Description=Leucine Rich Repeat
  Pfam annotation: Domain name=LRR_1; Domain location=72-95; Score=4.8; E_value=37; Accession=PF00560.23; Description=Leucine Rich Repeat
  Pfam annotation: Domain name=LRR_1; Domain location=97-117; Score =6.8; E_value=15; Accession=PF00560.23; Description=Leucine Rich Repeat
  Pfam annotation: Domain name=rve; Domain location=383-539; Score =95.5; E_value=1.6e-25; Accession=PF00665.16; Description=Integrase core domain
  Pfam annotation: Domain name=zf-H2C2; Domain location=324-365; Score =10.2; E_value=0.016; Accession=PF09337.1; Description=His(2)-Cys(2) zinc finger
  Pfam module annotation: Pfam domain module=Integrase_Zn::LRR_1::LRR _1::LRR_1::LRR_1::LRR_1::LRR_1::LRR_1::LRR_1::LRR_1::rve::zf-H2C2; Domain location=327-368::123-145::150-173::175-197::199-220::222 -242::244-269::48-70::...
  Pfam module annotation: Domain location=72-95::97-117::383-539::324 -365
MASCNGEDCCKWKGISCNNLTARVTRLVIQFSYSIPVPGPTSYENFVALGELKLALNELVGLVPHTLANLSNLQTLDLLDNYNLFANDLEWLSHLSNLRYLDLSNVSLSRVVDWPSSISKIPSLMELYLDHCMLPQVNPKSITHLSSSTSLQILSLQENELNSSILSWVLNVSKVLKSLDLASNNLPIQSSQILCQLKDLELLGLDQNSFSGPFLDFSRLSSLKSLTLQNNSISGPLSFGHLPHLEFLDLSFNHLNGSLLIFELGKDNLAADALSRVMLMAWSEPHCQFIQELKDELQQNEPLIAIMAGCTSNTNEDPDHTKFHSSAIGGHTGISRTKARIVAQFYWPNMQAKIRKIVQECSICQQAKSVTALLEGLLQPLSIPSQVWEDIAMDFVTGLLLSFRYTVIMVVVDRLSKYGHFIPLKTYYTAKQVAKAFFANVAKLHGVPKSIVSDRDKVFTSQFRQQPFKLQGTTLAMSSADHPQTDGQSEALNKCLEMYLRCFTFQESNSWFKALPWAEFWYNTTFHNSLGMTPFKALYGREPPTLKRYNPNSSDSTDDQADKRRFNVGDLVLVKLQPYKQNSVALRKNQKLGMKYFGPFPILAKVGAIAYKLKLPKNARIHVVFHISQLKLFKGDMSDPYLPLPMSNARNGNDDKDNKTKGSNNSHEDTGQNSQLVKDLMDNAEIQGLRK

SEQ ID NO: 119341 - protein, 102 aa, Glycine max
  Coding DNA Sequence Number=SeqID_2563
MAKGIRKLSSWMEVAPAPIIYTKKPSNTPTLETITEEEEEAAEGFENGNGYINIHQSSMHEHFVGGTIKHISWVHNRGLNFTFAGMVKCSKVNVARFCPINM

SEQ ID NO: 119342 - protein, 69 aa, Glycine max
  Coding DNA Sequence Number=SeqID_2564
MAHHAVELLGSPSEPDWLSETHPLSEKACSLNENKILENVESESSALSVQPVRPMRTLSLLALSTSKLA

SEQ ID NO: 119343 - protein, 47 aa, Glycine max
  Coding DNA Sequence Number=SeqID_2565
MESPKWEKDESHKAVQYGGFNLFSVSLTFGNSIGAVGGKTGKISGNH

SEQ ID NO: 119344 - protein, 74 aa, Glycine max
  Coding DNA Sequence Number=SeqID_2566
  Gene Ontology: Mol. function=DNA binding; Cellular component=nucleus; Biological process=regulation of transcription
  Homolog annotation: Hit_ID=Q0PJD2; Match level="QueryCoverage=56%, HitCoverage=25%, E-value=8e-13, Identity=83%"; Hit description=MYB transcription factor MYB67
MGIDPKTHKPRTDLNDLMSLSQFLGMSNLSSAINTAWGNNLLVVARLAVSGSENDTGARHRKYRTERKMHKCES

SEQ ID NO: 119345 - protein, 240 aa, Glycine max
  Coding DNA Sequence Number=SeqID_2567
  Pfam annotation: Domain name=Transposase_23; Domain location=136-208; Score=-12.6; E_value=0.027; Accession=PF03017.5; Description =TNP1ENSPM transposase
MGEKKKEQLQEATKFESSDIVIDVPSPIKRHVKWKMVCTKKSDQMTSEASNEIAEKIDQALEGSFVAHGRQDVLIVAIGRLEHPSHIRVVGADSQFQSQMQSQGLALSHEPEVGPSVARVSTNECCVDPSGNDPDTGDSKKCGLYIEENSPCLVALGRLYEGSATIHNIPLGGDQIKVGVEEVQDADARIPVPTEEGAMEPAKPAHRSDYDVNDPLYLMTLIIPQIFLKSLQLMWEATVF

SEQ ID NO: 119346 - protein, 47 aa, Glycine max
  Coding DNA Sequence Number=SeqID_2568
  Homolog annotation: Hit_ID=Q681Q0; Match level="QueryCoverage=70%, HitCoverage=4%, E-value=5e-07, Identity=61%"; Hit description=MRNA, complete cds, clone: RAFL21-99-B01
MSMRTLEERFVPSPTWVMKAWETTQDEMMTAGGLDAVAMVKWLYYKF

SEQ ID NO: 119347 - protein, 78 aa, Glycine max
  Coding DNA Sequence Number=SeqID_2569
  Subcellular localization annotation: CTP_CleavageSite=45; ConfidenceScore=5.26e-01
MNSLPSVVQVSSTIESGATRVHCLALLANSLFSNLIRRPMNSLPSAVHVDSTNESRAPRIHCLALFANSPFSILFGDP

SEQ ID NO: 119348 - protein, 283 aa, Glycine max
  Coding DNA Sequence Number=SeqID_2570
  Gene Ontology: Mol. function=hydrolase activity
  Homolog annotation: Hit_ID=UPI0000E696CA; Match level="QueryCoverage =90%, HitCoverage=89%, E-value=1e-77, Identity=52%"; Hit description =Zn-dependent hydrolase
  Pfam annotation: Domain name=Lactamase_B; Domain location=36-218; Score=46.6; E_value=8.3e-11; Accession=PF00753.17; Description =Metallo-beta-lactamase superfamily
  Subcellular localization annotation: CTP_CleavageSite=4; ConfidenceScore=5.06e-01
MKVSALAIATALFSTTAFAAPLTLQTYNPQENAIFAVNSTLASGPHEAVLFDAQFSVKDGEKLVEMINKSGKKLTHIVITSGDPDFYFGLEPLVKAFPQAKVVATEQVVKHIEETKAAKLAYWGPQMKDGAPKQVYVPQVLAADSFTIDGEKVEIRQPQNYAAFVWIPANKAILGGTGVAWGMHVWTADTQSAASRQQWRQTLSDMAALHPQQVIPGHYLGTPPAGDKAIVFTRDYLEKFEQALKAHKDSASVIKAMKAQYPGLAEESSLELSAKVNTGEMKW

SEQ ID NO: 119349 - protein, 82 aa, Glycine max
  Coding DNA Sequence Number=SeqID_2571
  Gene Ontology: Mol. function=transcription factor activity; Biological process=regulation of transcription, DNA-dependent
  Homolog annotation: Hit_ID=UPI00005F736A; Match level="QueryCoverage =81%, HitCoverage=22%, E-value=1e-10, Identity=48%"; Hit description =COG0583: Transcriptional regulator
MLSFIKRADGYGYGSSYRRPGIYAHMRAGQFERGGQGAWYVATDGESLSGADGTLGRYPAHSSFDAQTDLNQRRRKGIAENA

SEQ ID NO: 119350 - protein, 890 aa, Glycine max
  Coding DNA Sequence Number=SeqID_2572
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=68%, E-value=1e-109, Identity=40%"; Hit description =Chromo
  Pfam module annotation: Pfam domain module=RVT_1::Retrotrans_gag; Domain location=384-569::105-195
MAEATRSRASADRIEDAIAKLSASQLAMNTKIDDLLQRMTQLEAGQQPPQSSASSSAGQTPQMHNVVHRMKLDVPRFDGSDPTGWTFKITQFFEYHATPDQERLTIASFYMEGPALAWFQWMHRNAQLSSWPAFLHALHSRFASSTYEDPTGLLCKLQQCSSVSEYLSEFESLANRVVGLPATFVLSCFISGLNPSICREVQVREPVSLAQAVAYARLQEEKLLDSRRQQTPRSLVITPSSRAATGTTNSSYTNSLSRGSNPSIPFKRLTPEELAVRQEKGLCFHCEEKYSWGHKCAPSLFLLVAEDDQLTPEVVSRSPSPTDELLREPPPAQLSFHALSGHSAPKTLRLKGTINGLHVSILIDGGSTHNFLHHRAVATLGLTTKEVAPLKVTVGNGEEIRYVVLGVEWLKTLGPVLTDYTSLSMKFITEGKLVELQGEREQVGRRMGHDAFVSTIGLSTPSRYATISPFQQWMNCSMNLEDTEFRVMPFGLCNAPSSFQATMNQLFQPCLRKHIIVFFDDILVYSKTIVDHLLHLENAFRTLVAGQFSLKLSKCTFAQQQLEYLGHIVTAVGVIPVPEKVQAIQTWSNPRSPRALRGFLGLAGFYRRFIMGYTILASPLTNLLSQGQFQWSPEATEAFQKLKDAITGAPVLALPDFKVPFVVEKDASNMGMGAVLSQGAIIAAVKKWRQYLLGHKFTILMDHRSLRELMSQAIQTPEQHRYLVRLLGFDYTIQYHLRKELAHTPAFKELYEQIQADPTKYPDHSVTSGLILHKGRIWLPPTSSFIKLLLEEFHQTPVGGHMGVQKTLQRLQENFTWDSMRTDIRNFVANCITCQHTKYDNRKPGGLLCLIPIPALPWEDLSMDFIVGLPAYKGNTCILVDAILPPKGIG

SEQ ID NO: 119351 - protein, 739 aa, Glycine max
  Coding DNA Sequence Number=SeqID_2573
  Homolog annotation: Hit_ID=Q1SAV4; Match level="QueryCoverage=37%, HitCoverage=84%, E-value=3e-76, Identity=47%"; Hit description =Integrase, catalytic region
  Pfam annotation: Domain name=rve; Domain location=1-111; Score=-2.5; E_value=0.0096; Accession=PF00665.16; Description=Integrase core domain
MELTSLVIVDRFSKGLHLGMLPPHHTAYTVAMLFMEIAGKLHGMPRSIISDRDPLFTDGQMEVANRIIEQYLGAYVHQKPATWGRYLMWADWSYNTSCHSTTGMTPFEVMYGRKPPSFPQYITGTSRIDAVDELLTQREEVFAFLRKKLSKAQNRMKETADKSRRDQKFNVGDWVLVKLRPHRQTSAAGAPYSKLAKRYYGPFHIIARLGKVAYKLQLPDHSKIHPVFHVSLLKAYIAAADANRSAELPSEDWVGLTPEDTSWEDWYEFQALYDLEDEVWFEGHGSDTQQTQGVPLAGQVEDSSGGMETELVRLGRFEGSGTQLQVARPLGGSQEKPMIDVVDVLTSCSNTGDTSSFEYSSFSDFSSLDDVDLSQSQREEGIGKYAEVATSERVIVEVSCSDNVDPFPHKKSRLWVQKEKLPPIMLSEYTWVDGEMGSYYSCYSDKLSVLHFINCVIVCSFANEDFSPFHLYYCRNNACAKPDWVFLRKDMLSTDNPFKTPPMRLRALSSLLQLFGLHLLVQLHRTLCRLGIRAKRKKAKRVTEEEARPQKLKQPTLHWFNTHPPSSLEALPLVLGKNFFNSTYHPRNLMLSSAIFNYDKDILQVLKLKTGLDAIERDKKHALDANNQLTNDIKKFLVQGGGVEKKRDVDFQTFMCSAHEKILEEHHIPTDADFDILMDVYEGNLVSIQDIPKKTPQNSRTSSVDAFCPVTSPADTVMTNVDTDEDDNRNKEANEVSDN

SEQ ID NO: 119352 - protein, 46 aa, Glycine max
  Coding DNA Sequence Number=SeqID_2574
MRSTSFQWLKVKKRLSHEVLKVTVELSSTVGLNVHPPLSAASARLA

SEQ ID NO: 119353 - protein, 124 aa, Glycine max
  Coding DNA Sequence Number=SeqID_2575
MTQEAVWKWHVESALVWQIYCGIAISISDTLVSPLVAAEQKLSHCAHAAIQTVPPLAPAEHVGVGVAVCRWVSLGFAVLKSLHVNVKNLNVGVSLCFVVCFLLCAPWFKFGAWLPSFKCSYPYL

SEQ ID NO: 119354 - protein, 629 aa, Glycine max
  Coding DNA Sequence Number=SeqID_2576
  Gene Ontology: Mol. function=RNA-directed DNA polymerase activity; Biological process=RNA-dependent DNA replication
MPDITFTSANFKGLDLEQNNPMVITIQVAGFLVKKTLRDHRSSKNILFQNTFTQLDILESTLYPRMTPSSDFPGEESSPGLGQPLELDPRIEEDQRVKPNEETKPNPLGHREDQITYMGTQLEENEQQLIIQVLNLRQPLELDPRIEEDQRVKPNEETKPNPLGHREDQITYMGTQLEENEQQLIIQVLNRLSQSPRKKKGWRRKTNNNSGQGHWMLSFLDAYSGYNPICIHPWDEEKTTFITKSANYCYQVMPFDLKNAKATYQHLMDTNFKDQIGRNTEVYVDNMVVKFDGAKPYAQDLQEIFLQIQKYNMRLNPKKCVFGDPQGDTKTHGPDNSLTRFLPWIAEKAKLIMNLLKKTKTFRWDQECDEVFQNLKLTPVTPPTLAKLDTHKKLIIYLSVSEEVASGQINEGYQVKEPQLLKYWHAFMSLKDDFEEIQVEHIDRDHNDGVDNDIIKYLTKGLAPKDSLEAKVLRMKAARYTVIASDLYKRGFVVLLLKCLSQDQANYTIRELHEDAPSSLISGPRRKAGFDKIVSRLSKNAYNANMTVSNSKHPLVVVDYFMEWIKSYSAKDVPSQRFPSQVLLLGKGCTFKKVSLPSTSTQLKKYLQKGFLPEYSYSTKDLPSNKLSS

SEQ ID NO: 119355 - protein, 244 aa, Glycine max
  Coding DNA Sequence Number=SeqID_2577
MVYTKKVVVKNHTSFFATESESLYSPSPMIQKDKGKGIIDVIEVISCSDSKNTILRTPPHAKGVAIGSLKKKVISQKEKQGQQRRRSDFEEPHLLKDKATKRNSRPTGKTKKVVFGRFRDLKVIKKYGWDILCFVKKQKSTEFVDFPSLRRNYVIKKLKELKDNELKSKSLNSFGGLVHWICMHYVLPKIGTFQEEESSKSKEVLLKEKEFEDFHDFDTLFGKEVLSIEKKDEGHHEVKKISQE

SEQ ID NO: 119356 - protein, 35 aa, Glycine max
  Coding DNA Sequence Number=SeqID_2578
MGRVDLMLNCKVLSDVSHTATDFTDREKLMIEVAL

SEQ ID NO: 119357 - protein, 54 aa, Glycine max
  Coding DNA Sequence Number=SeqID_2579
MMGKAIIAPAENNTIYELMWKLGQVFTPYKVAYNNSYHTSIGMTPYEALLWEEV

SEQ ID NO: 119358 - protein, 64 aa, Glycine max
  Coding DNA Sequence Number=SeqID_2580
MMSPMRTGCVSNPKLRYISTEFHTSVYPPNCRSSYIIKCNGNKFSVMSCLMPSQSEPQIFHYHE

SEQ ID NO: 119359 - protein, 42 aa, Glycine max
  Coding DNA Sequence Number=SeqID_2581
MVEAEKISEGKHSWRSWRRLQKQFQNSDSVAVLFVEQDKREG

SEQ ID NO: 119360 - protein, 183 aa, Glycine max
  Coding DNA Sequence Number=SeqID_2582
  Gene Ontology: Mol. function=DNA binding; Cellular component=nucleus; Biological process=regulation of transcription, DNA-dependent
  Homolog annotation: Hit_ID=Q2HV56; Match level="QueryCoverage=90%, HitCoverage=25%, E-value=1e-65, Identity=71%"; Hit description =Transcriptional factor B3; Auxin response factor
MQEFAVRTGYCMMESKEKLKEVEKCLDSRLWHACAGGMVQMPVVNAKVFYFPQGHAEHACGPVDFRVYPKIPPFIQCKVGAIKYMADPETDEVYVKLRLVPLTRNEGDFEDDAVGGINGSENKDKSPSFAKTLTQSDANNGGGFSVPRYCAETIFPRLDYSADPPVQNILAKDVHGARRAGTC

SEQ ID NO: 119361 - protein, 67 aa, Glycine max
  Coding DNA Sequence Number=SeqID_2583
MQNHQGEMFSYLKKGEIVHCAERDSLAPEQLERSCHARKSDKPDIWRGIDVLHGYNTYFYFWSIGAS

SEQ ID NO: 119362 - protein, 285 aa, Glycine max
  Coding DNA Sequence Number=SeqID_2584
  Gene Ontology: Mol. function=transporter activity; Cellular component= integral to membrane; Biological process=ethylene mediated signaling pathway
  Homolog annotation: Hit_ID=Q9S814; Match level="QueryCoverage=55%, HitCoverage=17%, E-value=4e-29, Identity=37%"; Hit description =Ethylene-insensitive protein 2
MSTACRGRKNRRKVEKRVANEGKRRSREVRVGSDDDGCIWEPFLKLKIAGAVYEFWPQIGLIFSHVEEINGIVNSGVVKRFCDGIRVDLIENLGLLLHSLIVASKISKSKMEAETLSPNHPPSFLCQSLPAVVPMLLISTVYVDPGKWVATVEDGARFGFDLMAVMLIFNFAAIFCQYISARIGAITGKSLAQDIEKAKILGQFVAGFVFLSFILGLLINQPEVPFSMNGIPGEGAFVLMSLPGANLVPHNFYLHSSIVQEKLASCNMVVACMGSCLAAGLLEVY

SEQ ID NO: 119363 - protein, 585 aa, Glycine max
  Coding DNA Sequence Number=SeqID_2585
  Gene Ontology: Mol. function=RNA-directed DNA polymerase activity; Cellular component=nucleus; Biological process=RNA-dependent DNA replication
MDPLAPFLFNIVAEALNGLMREAEKQNLFKGFRVGSNNVDINILQYADDTIFFGEGSMENVKAIKAILRTFEMVSGLKIIFAKSCFGAFGMSDRWKREAASCLNCSLLSIPFVYPGISIGENLRRFHMWNPILEKCERALNKWTQRHLSFGGRVTLIQSVLTSLPIYFLSFSKIPKKVVEKLVSIQRRFLWGGGTDQNKIAWVKWETVCLPKEKGSLGIKDIDTFNIALLGKWRWNLFQHEGQLWARVLESKYGGWRGLDEAHRDNHESIWWRDLKMVVQNSQQGMELSNSIEWRLGCGDRIKFWEDKWVDGEESLAAKYPRLYLISCQQNQIIQQMGGYREEEWEWNFLWRRPLFDNEIPMAVNFLQHVESKAIQIQRRDDWVWTPDSSGQYTAKSAYRMMMGGATDGTQDRDFEELWKMKVPTKFAVFARRLLRDRLPTKTNLHRRQVEIDDRICPFCRSAEEEAGHLFFHCTKIIPMWWESLSWVNNVGVFPQDPRQHFLQHGSIVADGLRTNRWKCWWLAVTWTIWKKRNDIIFSNDSFDINKMMEEAAFLMWTWLRNLEKDFVIHFNQWSTNLREGFVYH

SEQ ID NO: 119364 - protein, 276 aa, Glycine max
  Coding DNA Sequence Number=SeqID_2586
  Gene Ontology: Mol. function=tyrosine decarboxylase activity; Cellular component=cytoplasm; Biological process=metabolic process
  Homolog annotation: Hit_ID=Q8RUN2; Match level="QueryCoverage=71%, HitCoverage=92%, E-value=8e-98, Identity=89%"; Hit description =Expressed protein
  Pfam annotation: Domain name=Lysine_decarbox; Domain location=57-190; Score=255.8; E_value=8.7e-74; Accession=PF03641.4; Description=Lysine decarboxylase family
METRSEIRHSKFKRICVFCGSSPGKKSSYQDAAIQLGNELVSRNIDLVYGGGSIGLMGLVSQAVHDGGRHVIGVIPKTLMPRELTGETVGEVKAVADMHQRKAEMAKHSDAFIALPGGYGTLEELLEVITWAQLGIHDKPVGLVNVDGYFNSLLSFIDKAVEEGFISPNARHIIVSAPTAKELVKKLEDYVPCHEGVASKLSWQIEQQLAYPQDYDMSRYRRVTELETTNKRDTVLGDRGQFLGGSAMERKGLHSSVCTWHCKEVLKSNSSHQGHI

SEQ ID NO: 119365 - protein, 90 aa, Glycine max
  Coding DNA Sequence Number=SeqID_2587
MITSDTPGTEIAAETAAAMRSQLQLWKIRELLDANRVINLKVYNNKMKLNLSPWRRVNLLEVCDGRKRKRHYSTWSERGRMSERRARETE

SEQ ID NO: 119366 - protein, 114 aa, Glycine max
  Coding DNA Sequence Number=SeqID_2588
  Subcellular localization annotation: CTP_CleavageSite=52; ConfidenceScore=5.27e-01
MPNILQHLTTRRALPLTSSKVIQSDGATWWMNMRSTNQLMPSRVVLYIQMTSARMIRHVSVTDSWSYLTCRSDRNHCFRFRIRIHAVVKPMSIINQIKIVDEWVNGVGSVIGLV

SEQ ID NO: 119367 - protein, 117 aa, Glycine max
  Coding DNA Sequence Number=SeqID_2589
MSIHSAQLNSVEADAGTSASTAVPEFRQWYSVTSPVCDESTALESPETTLPYMQPSDSNWWPLPQRDPLLLTATTLEALHEHSCTLPLNYNLCCQDSRSTTRSYLVGLGGGRKTAKT

SEQ ID NO: 119368 - protein, 113 aa, Glycine max
  Coding DNA Sequence Number=SeqID_2590
MAMSAIPSFPENNSGSTVMPLDDIFCHSSEDHCYIHEAEVILEAPNDLNSSFVSPVILQPFTSVLMNENTAHVPDSITTPGFMNSDYFQAHSVTSEMAIIENMNEEAFRDPHQ

SEQ ID NO: 119369 - protein, 226 aa, Glycine max
  Coding DNA Sequence Number=SeqID_2591
  Subcellular localization annotation: CTP_CleavageSite=45; ConfidenceScore=5.37e-01
MSDHHPRLQHLRSASHLLKESFSSFSSNFLIFLFLSLLTLSFRTLVETGTAHVTSFIDRDPSLRALLSRLDLAGNSHNHHNGHDLPSPNNHRHRRRPFLHLTRVGTLDDDFFSGDDDDARSLFGSIPKPSANATLLALSPFKTTSAFSDLFADDGIRVSQVIRSGTTFNTQGLSSLSSSSSRRDNDDDDDDREEKEEPTKEKVDLQFFVKGIEVGRPRRGGAVLPW

SEQ ID NO: 119370 - protein, 445 aa, Glycine max
  Coding DNA Sequence Number=SeqID_2592
  Gene Ontology: Mol. function=adenosine kinase activity; Cellular component=nucleus; Biological process=purine ribonucleoside salvage
  Homolog annotation: Hit_ID=Q1RYR5; Match level="QueryCoverage=87%, HitCoverage=95%, E-value=1e-137, Identity=83%"; Hit description =Adenosine kinase
  Pfam annotation: Domain name=PfkB; Domain location=23-406; Score =136.8; E_value=6e-38; Accession=PF00294.14; Description=pfkB family carbohydrate kinase
MVSEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAEKKKPEHVHTFAVAAALRLSCACFRGARVRGGAAAVVAPLCVMLETAVAIHAVAVRRAGVSFCRWHSGDAFVGGFLSQLVQEKPIEECVRAGCYAANGVKLGNHMQHATRAPIIVEIAAALEEVVDGIEGGRDKEVVVIGEDNGVDEGGEE

SEQ ID NO: 119371 - protein, 118 aa, Glycine max
  Coding DNA Sequence Number=SeqID_2593
MTLRKDTFIEKTTTSKDNFDPSRRKVSKDSVDPKRRKVSKDNVDPNWRKFTTNKFDPKRRKVPNDDADSKGRKVYKNIVDSKYRKTRLKSKKNPSVVVNRASKSNGTADCFLATFICP

SEQ ID NO: 119372 - protein, 100 aa, Glycine max
  Coding DNA Sequence Number=SeqID_2594
  Homolog annotation: Hit_ID=Q8H2C2; Match level="QueryCoverage=40%, HitCoverage=9%, E-value=4e-09, Identity=65%"; Hit description =Serine/threonine kinase
MEQKGGVPMQRYEVGRLLGQGTFAKVYHARNIITGMSLSMKNRTQREGEWRIQARSCIMWELGKTGKAKNGTTSDSVAKEPVAETEDENAASKQQKQGCN

SEQ ID NO: 119373 - protein, 241 aa, Glycine max
  Coding DNA Sequence Number=SeqID_2595
MSLKLPVYSELVKAFYSNLEIHEDVLMYEIYGIKMVIDQSLFYDLTKLPSEGVPFEGALIDEWKFDFSEHDARRLVCTNQADMTGRLLAGSLAFESRILHYLIVCILLPRSSNLAQVSEEDLIVMWAFHKEPYVPIKRSFLIGASVIASFGYIKEHDGSWVKKGARNIGEEGHEGEDSSLLLKILERFDGLQTFVGERFDTLELQGDMCFNEMESRMTKAEEDVSYIRSSFDLPPPPPPSS

SEQ ID NO: 119374 - protein, 74 aa, Glycine max
  Coding DNA Sequence Number=SeqID_2596
MPTYVPFPLQQVQLVRLILSAVIHKLNCWNLNQWELGKTGKAKNSTTSDSVAKEPVAETEDENAASKQQKQGCN

SEQ ID NO: 119375 - protein, 125 aa, Glycine max
  Coding DNA Sequence Number=SeqID_2597
  Gene Ontology: Biological process=response to chitin
  Homolog annotation: Hit_ID=Q9SJK4; Match level="QueryCoverage=94%, HitCoverage=95%, E-value=4e-27, Identity=52%"; Hit description =Putative auxin-induced protein
  Pfam annotation: Domain name=Auxin_inducible; Domain location=16-114; Score=83.8; E_value=5.5e-22; Accession=PF02519.5; Description=Auxin responsive protein
MKGKFLRGCLNKWKKMGSRVFHCAAYGYCCEWELGSSMHEDEGDSIPNDVPKGHLVVYVGEHHKRYVIKITLLNHPLFKTLLDQAKDEYDFIADSKLYIPCSEHLFLTVLRRASTPHNERVFVRV

SEQ ID NO: 119376 - protein, 138 aa, Glycine max
  Coding DNA Sequence Number=SeqID_2598
  Homolog annotation: Hit_ID=Q7XDC6; Match level="QueryCoverage=99%, HitCoverage=31%, E-value=3e-26, Identity=40%"; Hit description =Expressed protein
MSPWVRGFEREISGFLFTWFLVDTFVAFIFSVDAWVAIVDSRKSGREIVKEGCYLISTMLNQAIQVKCLEAILCGSFVRWGLSRVCGRSLAKMFQSTMEVYFMVTWLMFYFAARCKDADLHGRRFGQRELEGLVEGHR

SEQ ID NO: 119377 - protein, 115 aa, Glycine max
  Coding DNA Sequence Number=SeqID_2599
MLGRSQHELEPLIQLLRKSKEVVYKCSKIGKYNFVAKKFLPWKTKIKDLADSIERFFNIEMLALIARDQLEILLRVSEIEYFNDEKFSDSVIAALAIAAAVTVAIVIKFIKFLLF

SEQ ID NO: 119378 - protein, 445 aa, Glycine max
  Coding DNA Sequence Number=SeqID_2600
  Homolog annotation: Hit_ID=A0EJF1; Match level="QueryCoverage=37%, HitCoverage=26%, E-value=4e-55, Identity=63%"; Hit description=Beta -glucan-binding protein 2
  Pfam annotation: Domain name=Glyco_hydro_81; Domain location=7-343; Score=-274.3; E_value=6.3e-06; Accession=PF03639.4; Description =Glycosyl hydrolase family 81
MALLIEATVGAVFNELLRTEIEQQNNELQLPKEELQSFIRKMEEGTQLVFDCSKIRWLHFVTRACYKDMLHGQTGPVRRILRVVEKTCFDPGEAIENTLLMFLTWISVFAVKLIRVAFTFSSTKQEQISLDKQLKRKKGYLLSARSLTVLWGEGDTPRYWGWAGVSEFEDGRNQESTSEAVNAYYAAALLGLAYGYSSLVDTGSTLVALEILAAQTWWHVKAEDNLYEEEFAKDNRIVGVLWANKRDSKLWWAPATCRECTLGIQVLPLLPITETLFSDADYVKELVEWTVPFLSSQGWKGMTYALQGIYDKKTALQNIRKLTDLAHPPTVVEILTYIVLLAQPLFLSEIAELTQLRFNEQQALSTHESFSTLVPTVYVGFSSSHTSKSSVGGSVGLSEGFPALLKTMWDNVGVEGAVFGRFQAGGKREERFQEGGGQGFRVRGL

SEQ ID NO: 119379 - protein, 98 aa, Glycine max
  Coding DNA Sequence Number=SeqID_2601
MATTNLLLSKITHGPPFPKENPPLCFHHFLLFTYDTQVGLRAKCERETGREVSWRWHEQWHDWQHQWWPMAGLVVTFKKGEQEEATMKARVCKKSSQL

SEQ ID NO: 119380 - protein, 83 aa, Glycine max
  Coding DNA Sequence Number=SeqID_2602
MASMVDSKAMYGVIMESSKPNTQRRTNLGLHVVQHTKVSQKAKTNGGGNNVKDHKGKNSASTYSINKSSSLFIPVMLLFGYLF

SEQ ID NO: 119381 - protein, 269 aa, Glycine max
  Coding DNA Sequence Number=SeqID_2603
  Gene Ontology: Mol. function=protein binding; Cellular component =nucleus; Biological process=DNA recombination
  Homolog annotation: Hit_ID=Q9SJK5; Match level="QueryCoverage=71%, HitCoverage=91%, E-value=2e-78, Identity=68%"; Hit description =Translin-like protein
  Pfam annotation: Domain name=Translin; Domain location=77-246; Score =69.8; E_value=8.5e-18; Accession=PF01997.7; Description=Translin family
  Subcellular localization annotation: CTP_CleavageSite=53; ConfidenceScore=5.71e-01
MQYTKPAFRNAAFYCHVFSRSLTLNPNPLLLVSPFRKPETFRLASPVSCLSSSSMAVPPSSLEKQFDDFRVQLEESGTLRERIRSVVSEIESSTRLIYATLLLVHQSRPTPELLEKAKSHVNVLKKQYKQLAEVVGGCPGQYYRYHGDWKSETQSVVSMLTFMHWLETGSLLEHKEAEEKLGYVVNQVTAGDYDCPRKVLKFLTDLHAAFRMLNLRNDFLRKKFDGMKYDLRKVEEVYYDVKIRGLTPNGEPVGDLEIKESQDNLNLKL

SEQ ID NO: 119382 - protein, 50 aa, Glycine max
  Coding DNA Sequence Number=SeqID_2604
MEYTIVPSLILLILLSVEALVLENQLLSSSLSTNIDILLLPYRAGTRSTN

SEQ ID NO: 119383 - protein, 124 aa, Glycine max
  Coding DNA Sequence Number=SeqID_2605
  Homolog annotation: Hit_ID=Q7XXN8; Match level="QueryCoverage=30%, HitCoverage=71%, E-value=5e-15, Identity=84%"; Hit description =Hypothetical protein ROT4
  Pfam annotation: Domain name=DVL; Domain location=38-56; Score=38.7; E_value=2e-08; Accession=PF08137.3; Description=DVL family
MAVKESNTSQNIQQQQQQQQEACDPCKSFGQKCSHIVKKQRAKFYILRRCIAMLLCWHEREPYLYISSNQIMRVGVGPLEETARIVIRRKDELWVRPGAVPSCSPDPDPRAALSAPWAHSFPKL

SEQ ID NO: 119384 - protein, 608 aa, Glycine max
  Coding DNA Sequence Number=SeqID_2606
  Gene Ontology: Mol. function=transcription factor activity; Cellular component=plastid; Biological process=regulation of transcription, DNA-dependent
  Homolog annotation: Hit_ID=Q9LD95; Match level="QueryCoverage=97%, HitCoverage=94%, E-value=1e-117, Identity=42%"; Hit description =Sigma factor-like protein
  Pfam annotation: Domain name=Sigma70_r1_2; Domain location=239-275; Score=11.6; E_value=0.026; Accession=PF00140.10; Description=Sigma -70 factor, region 1.2
  Pfam annotation: Domain name=Sigma70_r2; Domain location=318-388; Score=84.2; E_value=4.2e-22; Accession=PF04542.4; Description=Sigma -70 region 2
  Pfam annotation: Domain name=Sigma70_r3; Domain location=392-472; Score=48.8; E_value=1.8e-11; Accession=PF04539.6; Description=Sigma -70 region 3
  Pfam annotation: Domain name=Sigma70_r4; Domain location=540-593; Score=86.6; E_value=7.9e-23; Accession=PF04545.6; Description=Sigma -70, region 4
  Pfam annotation: Domain name=Sigma70_r4_2; Domain location=534-591; Score=12.8; E_value=0.033; Accession=PF08281.2; Description=Sigma-70, region 4
  Pfam module annotation: Pfam domain module=Sigma70_r1_2::Sigma70 _r2::Sigma70_r3::Sigma70_r4::Sigma70_r4_2; Domain location=239 -275::318-388::392-472::540-593::534-591
  Subcellular localization annotation: CTP_CleavageSite=25; ConfidenceScore=5.27e-01
MFSSSPPFPSSSSPSVTMLHEQAAPAVASWSSSSAAQHFPTSVLLQEQRDEYKPFLHVHNKETTLNTRQMDMTSVHEKGNTSNADQLVHDFVQQLHLRSHLQNLLTCSPTRGIAASSILQPVDIDSEWPADGVPRNAVSLAQQALSASKQAVSTTGEMKLIEIDDDDPLPSGLASTSLTDSSLKKNKVVRSTRIIERLSKQRKSSKSKFLDEESYLERKSDVQRRLRLEKKLKEGYDPNDPLRLFLSGPESRQLLTREEESQLITQLQDLSRLEEVKIRLQTQLRREPTLAEWADAVGHSCYALQTQLHCANRSKEKLFHANLRMVVHIAKHYQGRGLSLQDLFQEGSTGLMKSIEKFKPEAGCRFGTYAYWWIRHAVRKAIFLHSRTIRLPENLYTLLGKVIEAKKSYIQEGNLHPTKEELARKVGITIEKMDNLLFASRNPISMQQTVWADQDTTFQLLHSVVRDGNESAAAKSLCASILTMRFHVEQVIVIPLWCKFLLSWSSPNVGECWEITADSAIEIPDVTVSKQLMRMHVHNLLNILSPKERGIIRLRFGIEDGEEKTLSDIGKVFGLTKERVRQLESRALLKLRQCLESQGLDAYTDLLV

SEQ ID NO: 119385 - protein, 165 aa, Glycine max
  Coding DNA Sequence Number=SeqID_2607
MALLGKWAWRLLSDKECLWRDVLVSKYELRVVGTGSEVSFWNALWVGEFRPNHNTQDGWEWKSKEYMWLEKSTQGAINGGVTLWANTIAHFWQHFGMIKGRKKQMAWWVAWVTVIWSIWKLKNDIFSNSSCDLEELLEAIKFRSWSWSRSFVEGLDIEECLRHLA

SEQ ID NO: 119386 - protein, 467 aa, Glycine max
  Coding DNA Sequence Number=SeqID_2608
  Gene Ontology: Mol. function=protein kinase activity; Cellular component=plasma membrane; Biological process=protein amino acid phosphorylation
  Homolog annotation: Hit_ID=Q9LZF8; Match level="QueryCoverage=86%, HitCoverage=94%, E-value=1e-148, Identity=66%"; Hit description =Protein kinase-like
  Pfam annotation: Domain name=APH; Domain location=80-276; Score= -16.9; E_value=0.092; Accession=PF01636.13; Description =Phosphotransferase enzyme family
  Pfam annotation: Domain name=Pkinase; Domain location=88-369; Score =155.3; E_value=1.6e-43; Accession=PF00069.15; Description=Protein kinase domain
  Pfam annotation: Domain name=Pkinase_Tyr; Domain location=88-369; Score=125.0; E_value=2.1e-34; Accession=PF07714.7; Description =Protein tyrosine kinase
  Pfam module annotation: Pfam domain module=APH::Pkinase::Pkinase_Tyr; Domain location=80-276::88-369::88-369
MKCFPFSYGEKKDEPKGLQLQSTSGRSDNSTCVEAEVRRSGSALNSQDVSDNGSSESLRRNAIPSLSQRPCNLRVFTVSELKSATKNFSRSVMIGEGGFGCVYLGLIRSAEDPSRRTEVAVKQLSKRGMQGHREWVTEVNVLGIVEHPNLVKLVGYCADDDERGIQRLLIYEYMPNRSVEHHLSHRSETPLPWSRRLKIARDAASGLTYLHEEMDFQIIFRDFKSSNILLDEQWNAKLSDFGLARLGPSDGLTHVSTAVVGTMGYAAPEYVQTGRLTSKNDVWSYGVFLYELITGRRPLDRNRPRGEQKLLEWIRPYLSDGKKFQLILDPRLDKKQVFKSAQRLATIANRCLVKNPKNRPKMSEVLEMVNGMVESISSSSPQLPLRSVATLEASQDTETNNKKRTMDHKPGENLSHQACYLGAKLLHDKGRAPACFSMPCGHKQCATSPSLLRMCINLPLHATYQLL

SEQ ID NO: 119387 - protein, 107 aa, Glycine max
  Coding DNA Sequence Number=SeqID_2609
MAMVGWDRYGYSLSNPLPRLSNISPYSYPIPDGFKFIVPSPSGIGDGPFLCVKPVRSDRCNRDPVANCPSLDRSSRVNCMTDPIVKLVRLDHRVTVESNQVSQLCLQ

SEQ ID NO: 119388 - protein, 530 aa, Glycine max
  Coding DNA Sequence Number=SeqID_2610
  Gene Ontology: Mol. function=nucleoside-triphosphatase activity; Cellular component=nucleus; Biological process=protein transport
  Homolog annotation: Hit_ID=Q9LZF6; Match level="QueryCoverage=99%, HitCoverage=76%, E-value=0.0, Identity=70%"; Hit description=Cell division control protein 48 homolog E
  Pfam annotation: Domain name=AAA; Domain location=1-150; Score=194.0; E_value=3.5e-55; Accession=PF00004.19; Description=ATPase family associated with various cellular activities (AAA)
  Pfam annotation: Domain name=AAA; Domain location=239-426; Score =340.5; E_value=2.8e-99; Accession=PF00004.19; Description=ATPase family associated with various cellular activities (AAA)
  Pfam annotation: Domain name=AAA_2; Domain location=235-368; Score= -35.1; E_value=0.0042; Accession=PF07724.4; Description=ATPase family associated with various
  Pfam annotation: Domain name=AAA_5; Domain location=239-374; Score= -15.4; E_value=0.027; Accession=PF07728.4; Description=ATPase family associated with various
  Pfam annotation: Domain name=Vps4_C; Domain location=439-496; Score= -18.8; E_value=0.099; Accession=PF09336.1; Description=Vps4 C terminal oligomerisation domain
  Pfam module annotation: Pfam domain module=AAA::AAA::AAA_2::AAA _5::Vps4_C; Domain location=1-150::239-426::235-368::239-374::439-496
MSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERISKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDDVEDEIAEIKAAHFEESMKYARRSVSDADIRKYQAFAQTLQQSRGFGSEFRFADSTSSGGAATASDPFASAGGADEDDLYS

SEQ ID NO: 119389 - protein, 528 aa, Glycine max
  Coding DNA Sequence Number=SeqID_2611
  Gene Ontology: Mol. function=RNA-directed DNA polymerase activity; Cellular component=chromatin; Biological process=chromatin assembly or disassembly
  Pfam annotation: Domain name=RVP_2; Domain location=372-496; Score= -33.4; E_value=0.0004; Accession=PF08284.2; Description=Retroviral aspartyl protease
  Pfam annotation: Domain name=zf-CCHC; Domain location=303-320; Score =7.1; E_value=0.067; Accession=PF00098.13; Description=Zinc knuckle
  Pfam module annotation: Pfam domain module=RVP_2::Retrotrans_gag::zf -CCHC; Domain location=372-496::107-197::303-320
MPNPDESSSSYDKLEDVLSRLTKQQLYLEESVNAMTLKIEELLHRVSPIVPPSQPTPTPLPHPQPATPIHRLKLEVPRFDGSEPLGWIYKINQFFYYHNTPEADKLTVASFHMEGRALAWFQWMNTTHQFPSWPAFLEALRTRFAPSQFEDPSGALCKLTQTGTVAQYLADFEDLANRTIGLPTPFLLSCFISGLTSEIRREVQAHQPATLVQAAGLARLQEEKFADMRTPSRHRPAPTPPLSPRLNPTIPSSPIRVPSPSSPPQPFPLPSPNLPPLLPSPRNPPQAWKRLSPEEIASRREKGLCFNCEEKFHRGHKCASRFFLLISEEDDPANPLITGSDLPNTITHDPPQLQPPDPPDSPNSYPAQISLNSLAGHVAPETIWLMGSISGHPLLLLVDGGSTHNFVQQQLVTHLGLPCRETAPLRVMVGNGQYLECTSICDAINIHIQNQTFIVDLHILPISGANVVLGVQWLKTLGPVLTDYTSLTMQFFYQGNLIKLQVSPSMPDTALWPVLSYHSPFGRTFDFI

SEQ ID NO: 119390 - protein, 123 aa, Glycine max
  Coding DNA Sequence Number=SeqID_2612
  Homolog annotation: Hit_ID=Q2QNG6; Match level="QueryCoverage=47%, HitCoverage=55%, E-value=2e-15, Identity=62%"; Hit description =Expressed protein
MGLALIVGLLGLLILFHAAYSTIQCTLKTVSHIHRYFAFHRTFQHRGLLKITEEEFSGPPFDVVIELFLGLLLCFWAALTAPGKFLSIHPHSEDNRQLGGTWANTNERGEGSQNTDQDRDFCQ

SEQ ID NO: 119391 - protein, 176 aa, Glycine max
  Coding DNA Sequence Number=SeqID_2613
  Gene Ontology: Mol. function=nucleoside-triphosphatase activity; Cellular component=nucleus; Biological process=protein transport
  Homolog annotation: Hit_ID=Q9LZF6; Match level="QueryCoverage=86%, HitCoverage=15%, E-value=2e-60, Identity=78%"; Hit description=Cell division control protein 48 homolog E
  Pfam annotation: Domain name=CDC48_N; Domain location=35-145; Score =104.9; E_value=2.3e-28; Accession=PF02359.8; Description=Cell division protein 48 (CDC48), N-t
MNLIAPMCCLALFELFYSKGTKRDFSTAILERKKALNRLVVDEAVNDDNSVVALHPDTMEKLQLFRGDTILIKCLLANIMCPLLLTSMVIRVWAQEKGKKRKDTVCIALADETCEEPKIRMNKVVRNNLRVRLGDVVSVHQCPDVKYGKRVHILPVDDTIEGVTGNLFDAYLKRKA

SEQ ID NO: 119392 - protein, 90 aa, Glycine max
  Coding DNA Sequence Number=SeqID_2614
CFPNNSKTHARTDRRKHISTTRSEKKKKPHTYSGWKRAAKVNPDLQVVVEDIETIVEPDYGDAGEDECDGAEEKECDDAGEKKETDRTFD

SEQ ID NO: 119393 - protein, 80 aa, Glycine max
  Coding DNA Sequence Number=SeqID_2615
MATIVSKSTSLVIEKQFEELRKKYESLKKERSVLQLIRMNLEAECPETSNEDKTIEEERGPESAANILTMKRGTSTLLKE

SEQ ID NO: 119394 - protein, 106 aa, Glycine max
  Coding DNA Sequence Number=SeqID_2616
  Homolog annotation: Hit_ID=Q8S8L5; Match level="QueryCoverage=62%, HitCoverage=55%, E-value=2e-15, Identity=60%"; Hit description =Expressed protein
  Pfam annotation: Domain name=Auxin_inducible; Domain location=1-98; Score=51.4; E_value=3.1e-12; Accession=PF02519.5; Description=Auxin responsive protein
MLRSCLKQLQKNLSSFVHSNEDQVLEAVTLVPEDVMEGHFAVLAIKGEDTRRFIVKLDYLTDPMFMELLNQAREEYGFKQKGALAVPCRPQELQNILDGPRAKAER

SEQ ID NO: 119395 - protein, 51 aa, Glycine max
  Coding DNA Sequence Number=SeqID_2617
MGQLQFLRNVVVGLNGAILVGVVVVIHGRVWVGLDVRAYRMGMAMVGGDGQ

SEQ ID NO: 119396 - protein, 258 aa, Glycine max
  Coding DNA Sequence Number=SeqID_2618
  Gene Ontology: Mol. function=RNA-directed DNA polymerase activity; Biological process=RNA-dependent DNA replication
MGYKQSAPDAHETLSSPSYMNYPIARTVRQHPFVNHIMEAYIHLGWKPLNLKRYDGTIDLDEHLDAFLTQANLYTNNDVILCRIFPTPLKGTTLTRYGELLPRSINCFDTLVERFSMQYATSRSHCMTLAALANLQQADDESLREFMDRFRCTTIQIRNLNPKVVLHSILLALRPNKFTNNLCKKNYQVAWTNYTNKPRPTSIWKKCSNSRMKSTKLDRSVTSAKQTPRPTCTSRTRGTSQTSTILSPKGPSTSVTHP

SEQ ID NO: 119397 - protein, 193 aa, Glycine max
  Coding DNA Sequence Number=SeqID_2619
  Gene Ontology: Mol. function=RNA-directed DNA polymerase activity; Cellular component=mitochondrion; Biological process=RNA-dependent DNA replication
MVVKSQSIPEHVVDLEEVFGELRIYNMCLNPEKCTFGVGGGKFLGFMITYRGIEANPDKTIVVLEMRIPNNSHQVVVKMNYPIKQVLRKPKLAGRMIACSIDLLEFDLQYEPCSPIKTQFMADFLVEFAGNDITTPNQWTLYVDGASNIKGSGPGIILEGPDNITPEQAFKLNFRALKQPTRVRDANYWSKAS

SEQ ID NO: 119398 - protein, 104 aa, Glycine max
  Coding DNA Sequence Number=SeqID_2620
MKFPTLTREIITVKADQKQPHQCSTKSLKPSDMLGIHLDIICHKLDICPQAKPISQKKRKMGEERHKAFKEEVDKQLHQIGQVFHQAHQCCDGKKNQRPMSSVD

SEQ ID NO: 119399 - protein, 158 aa, Glycine max
  Coding DNA Sequence Number=SeqID_2621
MGKGMVGSRMEGYGATFRLFVEHCVGNFIVGWGMETMASSSLSVFLPIKEKYDEFAPTNLESLEVLLVQDVSGTALVDKDPGHHEVQYNDEDNHRVVLVDRIDALEVPVHKGDRRETSLWVPVLLEVVTRAAMANVFDGLSLPLFFCLLLGSCAAPLD

SEQ ID NO: 119400 - protein, 517 aa, Glycine max
  Coding DNA Sequence Number=SeqID_2622
  Gene Ontology: Mol. function=monooxygenase activity; Cellular component=membrane; Biological process=electron transport
  Homolog annotation: Hit_ID=Q1SKI2; Match level="QueryCoverage=97%, HitCoverage=99%, E-value=0.0, Identity=72%"; Hit description =Arthropod hemocyanin/insect LSP; E-class P450, group I
  Pfam annotation: Domain name=p450; Domain location=39-501; Score =358.2; E_value=1.4e-104; Accession=PF00067.12; Description =Cytochrome P450
MDSEVHNMLAVIMSFSLFIIVALKIGRNLKKTESSPNIPPGPWKLPIIGNIHHLVTCTPHRKLRDLAKTYGPLMHLQLGEVFTIIVSSPEYAKEIMKTHDVIFASRPKILASDILCYESTNIVFSPYGNYWRQLRKICTVELLTQRRVNSFKQIREEEFTNLVKMIDSHKGSPINLTEAVFLSIYSIISRAAFGTKCKDQEEFISVVKEAVTIGSGFNIGDLFPSAKWLQLVTGLRPKLERLHGKTDRILKEIINEHREAKSKAKEDQGEAEEDLVDVLLKFQDGDDRNQDISLTINNIKAIILDVFAAGGETSATTINWAMAEIIKDPRVMKKAQVEVREIFNMKGRVDEICINELKYLKSVVKETLRLHPPAPLLIPRECGQTCEINGYHIPVKSKVFVNAWAIGRDPKYWTEPERFYPERFIDSSIDYKGNNFEFTPFGSGRRICPGITLGSVNVELALAFLLYHFHWKLPNGMKSEELDMTEKFGASVRRKEDLYLIPVICHPLQGSGAGKEG

SEQ ID NO: 119401 - protein, 122 aa, Glycine max
  Coding DNA Sequence Number=SeqID_2623
  Homolog annotation: Hit_ID=Q8S8L5; Match level="QueryCoverage=50%, HitCoverage=51%, E-value=8e-13, Identity=57%"; Hit description =Expressed protein
  Pfam annotation: Domain name=Auxin_inducible; Domain location=1-104; Score=42.6; E_value=1.1e-09; Accession=PF02519.5; Description=Auxin responsive protein
MGKTCSSSCSWGLWIGGFGVVEPMMRKLQSTFSRPKGVKQGHFLVIATQGWKPERFSIELEFLDHPDFVKLLKQAEEEYGFSQVGALAIPCEPDDLKRIITRKKNRNKGIAIACWVKGLRVA

SEQ ID NO: 119402 - protein, 131 aa, Glycine max
  Coding DNA Sequence Number=SeqID_2624
  Homolog annotation: Hit_ID=Q8S8L5; Match level="QueryCoverage=50%, HitCoverage=55%, E-value=1e-14, Identity=60%"; Hit description =Expressed protein
  Pfam annotation: Domain name=Auxin_inducible; Domain location=29-124; Score=45.7; E_value=1.6e-10; Accession=PF02519.5; Description=Auxin responsive protein
MEVGKKKMLLKSLITKVIKGLPLFLAPNGGARGTRRVSYLSDIVEEENERTTKVPEDVKEGHFAVVAMHGEETKRFVVELDYLTDHAFLKLLEQAREEYGFQQKGALAVPCTPEELQKIIENRRVDMPLLN

SEQ ID NO: 119403 - protein, 66 aa, Glycine max
  Coding DNA Sequence Number=SeqID_2625
MDFQMAKTSAWCKEMSEELSETIVGLGKFGSFLTHHQLHQMIAIFWALKGILQLDHGPLSQTEIVA

SEQ ID NO: 119404 - protein, 114 aa, Glycine max
  Coding DNA Sequence Number=SeqID_2626
MEINDGLWWLMVVVGDGESAWDFRNGFGRKKEEEMTFFLSYTKAKAELRAHSRHLLKDPNGQIVDKCLGKLQTKVREDPTVNEGWGTFLPRKLHVASSRSFIKRLLQEASPWLL

SEQ ID NO: 119405 - protein, 151 aa, Glycine max
  Coding DNA Sequence Number=SeqID_2627
  Homolog annotation: Hit_ID=Q1SM20; Match level="QueryCoverage=71%, HitCoverage=28%, E-value=2e-18, Identity=37%"; Hit description =Nucleic acid-binding, OB-fold
  Pfam annotation: Domain name=DUF223; Domain location=40-135; Score= -0.7; E_value=0.0033; Accession=PF02721.5; Description=Domain of unknown function DUF223
MARIPDKIKSIDGSRETLKLAVRITDLWFVGTPNKFEQAEMVIVDSEGDQIHAVCKADHLKSWKADLKENSTYVMHNFKVVKNDGQFRVCEHEYKLAFIGVTIVREVDLHELPFKEFRFVEFGNVVAGNFVVGLLVGAFSACFIKKYQGCF

SEQ ID NO: 119406 - protein, 167 aa, Glycine max
  Coding DNA Sequence Number=SeqID_2628
  Homolog annotation: Hit_ID=Q69M22; Match level="QueryCoverage=48%, HitCoverage=23%, E-value=3e-26, Identity=73%"; Hit description =Integral membrane protein-like
MAITWQVKQKPSLTCSCNNIKLLEAAQSMSQKRSNGGLPQNFYLQFLAPSLLHPDLQHRFIPKLQIRSQCENRKKEEEKPNIVIVEGANKDDEEGEKGEIGGARLAAKGGVGEGNKERGKGWEDDASVNIGVAEEIGVDEDGEVEDECGREEFFGNGEGEGVVVEKP

SEQ ID NO: 119407 - protein, 553 aa, Glycine max
  Coding DNA Sequence Number=SeqID_2629
  Gene Ontology: Mol. function=helicase activity; Biological process =viral genome replication
  Homolog annotation: Hit_ID=Q9LW42; Match level="QueryCoverage=77%, HitCoverage=25%, E-value=2e-95, Identity=43%"; Hit description =Helicase-like protein
SCSNFLTAYEDCQSPTNRPIINTEGYSDLGDQFMQCRYCNAQMLYDERISKDKNCGSPSQYSGIQGHIVSSLTHMLDQHNYHAKSFRMAKDRLIDDQADNIKLQLIAARGKDGCVYNMPNVPKIVALIVGDFHQGSKRDIIVEIQNGELQRIHELHPSYLPLQYPLLFPYGEDGYRADILHCSTSSSKKRKRNRLTMREWFAYRLQSRSNEAQTLLHSRKLFQQFIVEGYTMVESKRLSYIRNNQKKFRVDKYCSLQNSLDTGTAKGLTKGKRVILPSTFVGSPRYMAQLYFDGMAICSHVGFPNLFITLTCNPNWPEIRISPLNLKPTDRPDIVSRIFRLKYEQMLSDLTKGQLLGKVVAYMHTIEFQKRGFPLVHLLLFLHPDNKYPSSTDIDQIISAEIPSHEDDSELYRLVENHMIHGPCGILQPNSPCMKEGKCSRFYPKQFQPQTLLDSNGYPVYRRRNNGHSISKNGYDIVIAVMVSNSNETTQNVNIQNDELKEYLDCSCKGPTSFEDIRTVANIQYATYRETCFAMGFLQDDREYVEAIKEAKD

SEQ ID NO: 119408 - protein, 973 aa, Glycine max
  Coding DNA Sequence Number=SeqID_2630
  Gene Ontology: Mol. function=nucleic acid binding; Cellular component= chromatin; Biological process=DNA integration
  Homolog annotation: Hit_ID=Q1RWN2; Match level="QueryCoverage=95%, HitCoverage=92%, E-value=1e-176, Identity=50%"; Hit description =Peptidase S8 and S53, subtilisin, kexin, sedolisin; Integrase, catalytic region; Zinc finger, CCHC-type
  Pfam annotation: Domain name=rve; Domain location=384-559; Score =118.7; E_value=1.6e-32; Accession=PF00665.16; Description=Integrase core domain
  Pfam module annotation: Pfam domain module=RVT_2::rve; Domain location=682-877::384-559
MATSEKFVQPSIPKFNGHYDFWSMNMENFLRSKELWSVVEEGIPAPVIGSGPGSEAQKKAMEEAKLKDLKVKNFLFQAIDRGILETILDKGTSKAIWTSMKQKYQGSMRVKRAQLQALRREFELLTMKEGEKVDSFLGANLTVVTKMKSNGETMAESTVITLAKTLKRIGPSEAGVEEDVAEGELQPARLEERWYFDSGCSNHMTGNKAWFLDLEDEHCRTVKLGNNMHMTVVAKGSLRMQINGITQVLSDVYYIPELKNNLLSLGQLQEKDLAILVSNSSCKVFNPRKGLIIQTDMSGNRIFYVTASMHPKQSFCLQTKTVSAKEAYIWHCRFRHLNYKGLNMLSCKEMVVGLPALEHPQKTCLTCLTGKQTRKSFPNNSSWKASRQLQLVHSDICGPIQPTSNSSKRYFLSFIDDFARKTWVYFLHEKSEALAVFKKFKARVEKETGTSITCLRTDRGGEFLSREFEVFCQTQGIRRQLTTSYTPKQNGVAERKNRTIMNVNRCPTAAVENKTPEEAWSGTKPAVEYFRIFGCLAHAHVLDQKRTKVDDKSRKCVFIGVSDESKAWRLFDPISKTIIISRDLVFEEDESWDWSNTELKIQQDELSCDDEGDVEGENNHNGGEDADDGSEGEDEDDGGHSTSLDSSQGRGERARRAPRWMADYAIGEGFSEEENLNKRTTPGSSEYYQMESNQLELIGHGIDYTEVFAPVARLDTIWVILAIAAQFSWEVFQLDVKSAFLHGELKEDVFVLQPEGFIKKGEEEKVYRLKKALYGLKQAPRAWYNKIEAYFAQEKFYKCPSEHTLFTKSPESSNVQMEYLFVKEDKGGRSADETLFKQLVGSLMYLTVTRPDLMYTVSLISRFMTNPTTAHWPAAKRVLRYVKGTTNLGILYKKGAGNPKLVAFTDSDYAVDLDGKSTSAFVFMMGTGAVYRKTEYSCPNPYSKNYKQEYSYTLLKLDMANATACFTVKRIIV

SEQ ID NO: 119409 - protein, 496 aa, Glycine max
  Coding DNA Sequence Number=SeqID_2631
  Gene Ontology: Mol. function=transferase activity; Cellular component= membrane; Biological process=protein metabolic process
  Homolog annotation: Hit_ID=Q6UDF0; Match level="QueryCoverage=95%, HitCoverage=90%, E-value=0.0, Identity=89%"; Hit description=Beta-1 ,4-mannan synthase
  Pfam annotation: Domain name=Glycos_transf_2; Domain location=95-274; Score=17.0; E_value=5e-05; Accession=PF00535.16; Description=Glycosyl transferase
MRNLIFEEPEVRVPGDTSSSLRYAWESIRAPVIIPVLKLAVILCSIMSIMLFVERVAMAIVILVVKVLGKKRYTKYNLEAMKQKLERNKRFPMVLIQIPMYNEKEVYKLSIGAVCGLSWPADRFIVQVLDDSTNQSLRECVQIECQRWMQKGVNVKYETRTNRNGYKAGAMKEGLEKEYVEDCEFVAIFDADFQPDADFLWNTIPYLLENPKLGLVQARWKFVNSKECMMTRLQEMSLDYHFSVEQEVGSSTYSFFGFNGTAGIWRIQAIKDAGGWKDRTTVEDMDLAVRASLQGWEFVFVGDIKVKNELPSTFKAYRYQQHRWSCGPANLFKKMTMESSIAMYRVPLLKRLHLVYAFFFVRKIVAHWVTFFFYCIVIPACVIVPEVSLKKQIAIYIPATITILNAVSTPRSMHLLVLWILFENVMSLHRTKAAIIGLLEANRVNEWVVTEKLGNAMKQRKNARPSRTSWFRIIDRQELSLQWDLGKWEQLYPTKA

SEQ ID NO: 119410 - protein, 664 aa, Glycine max
  Coding DNA Sequence Number=SeqID_2632
  Gene Ontology: Mol. function=helicase activity; Cellular component =mitochondrion; Biological process=embryonic development ending in seed dormancy
  Homolog annotation: Hit_ID=Q84TY4; Match level="QueryCoverage=93%, HitCoverage=85%, E-value=3e-71, Identity=28%"; Hit description =Putative pentatricopeptide repeat protein
  Pfam annotation: Domain name=PPR; Domain location=109-143; Score =25.5; E_value=0.00018; Accession=PF01535.11; Description=PPR repeat
  Pfam annotation: Domain name=PPR; Domain location=181-215; Score =49.6; E_value=1e-11; Accession=PF01535.11; Description=PPR repeat
  Pfam annotation: Domain name=PPR; Domain location=248-282; Score =41.5; E_value=2.9e-09; Accession=PF01535.11; Description=PPR repeat
  Pfam annotation: Domain name=PPR; Domain location=283-317; Score =39.2; E_value=1.4e-08; Accession=PF01535.11; Description=PPR repeat
  Pfam annotation: Domain name=PPR; Domain location=318-352; Score =31.6; E_value=2.7e-06; Accession=PF01535.11; Description=PPR repeat
  Pfam annotation: Domain name=PPR; Domain location=353-387; Score =30.4; E_value=6.4e-06; Accession=PF01535.11; Description=PPR repeat
  Pfam annotation: Domain name=PPR; Domain location=389-423; Score =43.5; E_value=7.1e-10; Accession=PF01535.11; Description=PPR repeat
  Pfam annotation: Domain name=PPR; Domain location=424-458; Score =37.0; E_value=6.5e-08; Accession=PF01535.11; Description=PPR repeat
  Pfam annotation: Domain name=PPR; Domain location=459-493; Score =38.5; E_value=2.3e-08; Accession=PF01535.11; Description=PPR repeat
  Pfam annotation: Domain name=PPR; Domain location=494-528; Score =27.2; E_value=5.8e-05; Accession=PF01535.11; Description=PPR repeat
  Pfam annotation: Domain name=PPR; Domain location=529-563; Score =37.4; E_value=5.1e-08; Accession=PF01535.11; Description=PPR repeat
  Pfam annotation: Domain name=PPR; Domain location=564-598; Score =10.0; E_value=0.49; Accession=PF01535.11; Description=PPR repeat
  Pfam annotation: Domain name=PPR; Domain location=600-634; Score =21.3; E_value=0.0035; Accession=PF01535.11; Description=PPR repeat
  Pfam annotation: Domain name=PPR; Domain location=74-108; Score=7.1; E_value=1.1; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=109 -143::181-215::248-282::283-317::318-352::353-387::389-423::424 -458::459-493::494-528::...
  Pfam module annotation: Domain location=529-563::564-598::600-634::74- 108
MYLKDGYSLLLKHRKPSSLPLVLATRPLNPPPSSASLLHESHVAHALRREPNVLYALQHFQYLTNTLAFKHTPLTYHVMIEKLGRNSELDALHYILHQMKIERIPCSQDSFICVLNSYKNSGLGDRALKMFYRIKEFGCKPTVKIYNHLLDALLGESGNKFHMIGAVYENMRGEGMEPNVFTYNVLLKALCKNGKLDGACKLLVEMSKRGCVPDGVSYTTVVAAMCEDGRVEEAREVARRFGAEGVVSVCNALICGLCREGRVGEVFGLMDEMVGNGVDPNVVSYSSVISWLSDVGEVELALAVLGKMIRRGCRPNVHTFSSLMKGYFLGGRVGEGVGLWRVMVLEGVRPNVVVYNTLLNGLCCSGNLAEAVDVCGRMEKDCFCRPNVTTYSTLVHGFVKAGDLQGASEVWNKMVNCGVRPNVVVYTSMVDVLCKNSMFDQAYRLIDNMATDGCPPTVVTFNTFIKGLCCGGRVLWAMRVVDQMQRYGCLPDTRTYNELLDGLFSVNELKEACELIRELEERKVELNLVTYNTVMYGFSSHGKEEWVLQVLGRMLVNGVKPDAITVNVVIYAYSKLGKVRTAIQFLDRITAGKELCPDIIAHTSLLWGICNSLGIEEAIVYLNKMLNKGIFPNIATWDVLVRGFFKKLGHMGPIRILDDILGKG

SEQ ID NO: 119411 - protein, 81 aa, Glycine max
  Coding DNA Sequence Number=SeqID_2633
MEGGTPTMLLSVQGLAARGRYEDDIGTKESQEHKRRKDEDDGEYHKKKEWGTKKKWERKIGEGNMRVSDGMKGYLETPFLI

SEQ ID NO: 119412 - protein, 757 aa, Glycine max
  Coding DNA Sequence Number=SeqID_2634
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=1-232; Score=46.4; E_value=9.9e-11; Accession=PF03372.13; Description =EndonucleaseExonucleasephosphatase family
  Pfam module annotation: Pfam domain module=Exo_endo_phos::RVT_1; Domain location=1-232::482-750
MLVSWNIRGLNKAGKLREISSHLLNLQPSIVVLIETRVKEANAHKIRGKLGLKGKYLDNYSHHGNGRLWIFWDDSKLELRYVRSSCQLIHCSVHDVAGKFKFWLTTIYAHNQLDNRKKLWLELDDIYKNQQGPWCAVGDYNNVLNSMDKIGGQLVTEAEFKDLRAMMENIGLCEMDSSSEFFTWSNKQAFAPIYSRIDRILANVEWLQDHVGASLDIIPAHISDHALLHLHFPDSVKKHKLFRFHNGWTNVLGFQDIVDKSWSKDVKGLPMQRLWKRLMRLKNELLTLNRKFDIQKKVQSARIDLAEAFVELRTNQTEASRINKVKEKTESLIYWNEMEERDLMQRAKIDWISLGDGNTKFFHAYLKTKQKSTTMKMLQKLDGSVITNHANIAQEVIEYYSSLMGHNSPHLNHIDIKALREGKQFSLDVWEIELALQGIGDLKSPDLDGYNAKNFKSCWGIVKNDVIDAVKEFFENDRLFLPFNRTLVTLIPKSEDAKSVRDYRPIAGCSTFYKIISKILTARLGSMMPSVISKAHAAFVPGQNIHNHILQAYELIKGYSRRGGTPRIMMQLDLQKAYDMVDWTALETIMKELDLPGKFITWIMNIVTTVSYVFNINGEISNDMFARRGIRQGDPISPLLFVFIMEYFNRLMEQLQLNPNFNHHAKYEKLGITHLTFVVDVLLFCRGDTVSMEMMIKTITEFSNTTGLVINPTKCRIYFGGINSVDKASFQSVAPFCEGQLPFRYLGVPLTDKKLDI

SEQ ID NO: 119413 - protein, 108 aa, Glycine max
  Coding DNA Sequence Number=SeqID_2635
  Subcellular localization annotation: CTP_CleavageSite=83; ConfidenceScore=5.53e-01
MNSLASAVHVSAPNESGAPRIHCLALFANSPFSTLIQRPMNSLASAVHVSSTIESGASRIYCLALFANSPFSIFRRPMNSLPSAIHVSSVIKRGASEKEEGETRVVID

SEQ ID NO: 119414 - protein, 179 aa, Glycine max
  Coding DNA Sequence Number=SeqID_2636
RVFCLCPVLLEKRGYGLCGSTWAQLEVGNRGWWVYARFVDVENLLCTITRPPPSTTCDGVVPGDMSWGSGDLGDVRRAPGSQQIKGTKTHKARRLVWWLASCETLIDIRDMASGNRLPRVGKSITRLKNEDQEAKMVSGNRLPRECNRLPGLKTRQHVVEASGNRLPGCVIDYTEEHAT

SEQ ID NO: 119415 - protein, 103 aa, Glycine max
  Coding DNA Sequence Number=SeqID_2637
FTCDSPQISASPHQLDLAPYASEPYNAQWNAPGLLRDKHTLRSSRILGEMEVDEPWLGLWLPLNYQIDMGARIAFVDNWAVGKEKVYYWLSNDIVGLVGNLAV

SEQ ID NO: 119416 - protein, 99 aa, Glycine max
  Coding DNA Sequence Number=SeqID_2638
  Gene Ontology: Mol. function=nucleic acid binding; Biological process= negative regulation of protein biosynthetic process
MTQDHEKLDSDLIATCIVGMIREDPSIKISLIQERINSEFAYKVSYKKAWLAKQKAIAIEYGDWDESYAKLSSWLRHMQNHSPGSYFQVLHDDFIVGNT

SEQ ID NO: 119417 - protein, 102 aa, Glycine max
  Coding DNA Sequence Number=SeqID_2639
MEALKIFKWSLFFTPMSDSGTSHIEMLKIEQLKLSKYSNGLDFSHGGSIQAHSTSRCSKLNYGSSQEIQMVESFHSNVQFRRIAYRDARNRTTEALEIFKWS

SEQ ID NO: 119418 - protein, 127 aa, Glycine max
  Coding DNA Sequence Number=SeqID_2640
MKLLSFELAQRFYIQFRASRYVSGLGTKIDQEELRIYTSDIQREVNSVEPDSIRHPSKKLLSLNWLRDSTFNFEHLDILRDSIRHPSKKLLSFELAQSFNSQFRASRYVTGLNQTSEKKVIVVCIGS

SEQ ID NO: 119419 - protein, 225 aa, Glycine max
  Coding DNA Sequence Number=SeqID_2641
  Gene Ontology: Mol. function=porin activity; Cellular component =integral to membrane; Biological process=transport
  Homolog annotation: Hit_ID=Q1BKM1; Match level="QueryCoverage=92%, HitCoverage=88%, E-value=1e-48, Identity=45%"; Hit description=Porin, opacity type precursor
  Pfam annotation: Domain name=Opacity; Domain location=69-225; Score= -53.8; E_value=0.033; Accession=PF02462.6; Description=Opacity family porin protein
MKAIVVALPVVMIPATVLAANTEEGYYGSAKYLQIEQRAKEMDTSSRPGVGQFVGGKEKEHFGGAAIAAGYQFGNGWRTEGEYTFKQKTEYTSGSSTFANNFNHLQTKTERLMLNVYRDYELGYGVSVYGTAGLGVSKIKAGGWQGNAGREYASTTQSNLTYALGAGVSYTPVERLYVDLGYRYIDMGKIESGYNNFTNARGLKDEQMKAHIVSNEFTLGMRYVF

SEQ ID NO: 119420 - protein, 74 aa, Glycine max
  Coding DNA Sequence Number=SeqID_2642
MPISPTEVLVGLCRPDIGRVRTHKDIQWTRRSPTGPWGFQLWLQASVSPTGCPFPPARSCHRDIGKYARGLTDF

SEQ ID NO: 119421 - protein, 165 aa, Glycine max
  Coding DNA Sequence Number=SeqID_2643
  Gene Ontology: Mol. function=DNA binding
  Homolog annotation: Hit_ID=Q1S0F5; Match level="QueryCoverage=73%, HitCoverage=25%, E-value=1e-09, Identity=27%"; Hit description=IMP dehydrogenase/GMP reductase
MDQVQCQSFSKVYGKIWDLAMIEVSVEVIAALTQYYDQPLRCFTFWDFQLAPTIEEFEGILGCPIGGRKPYLFFGYYPSVAKVARVVKISERELDRVKQSRNGVVGIPRKFLEEKTETLTSQGELESFMDVLALLVFGVVLLLNVDGLVDLATIHAFLAYHHNKV

SEQ ID NO: 119422 - protein, 224 aa, Glycine max
  Coding DNA Sequence Number=SeqID_2644
  Gene Ontology: Mol. function=N-acetylmuramoyl-L-alanine amidase activity; Biological process=peptidoglycan catabolic process
  Homolog annotation: Hit_ID=Q0X5Z7; Match level="QueryCoverage=91%, HitCoverage=97%, E-value=1e-36, Identity=44%"; Hit description=N -acetylmuramoyl-L-alanine amidase, family 2 precursor
  Pfam annotation: Domain name=Amidase_2; Domain location=34-179; Score= -1.2; E_value=0.003; Accession=PF01510.15; Description=N -acetylmuramoyl-L-alanine amidase
MPAAIQRNPGTHMLVEINKDGMLIHARVRNARSPAIERGKRTAAITGIVVHQTDANTAQSSLNSYRNPKANGAHFLIDKDGTIYQTAAIYQRANHVGPLKARCLLVGKCKARDYEGLKAKEVHRIEMLKAPGERYPSNMEAIGIEMVGRAELPKGFTPPPRPRGWTTEELRGWFGIYPTPTEAQNRALTWLVGALQDSMQLSPSELFKHPDVSRKNLTEAGGIL

SEQ ID NO: 119423 - protein, 163 aa, Glycine max
  Coding DNA Sequence Number=SeqID_2645
  Gene Ontology: Mol. function=nucleic acid binding; Biological process= DNA integration
  Homolog annotation: Hit_ID=Q0KIN0; Match level="QueryCoverage=93%, HitCoverage=10%, E-value=2e-19, Identity=31%"; Hit description =Integrase core domain containing protein
MTSAGPAFSFSGTPTITTAKLNWKNYLSWSASEKGIDIVPSDRKSEWEKLDYQLCAVLWQSVKADVLEILRSFKTCCSFWKKAREIFANDIQSLFDATMKVTALKQTSHDMIAHIGKARAAVKELKRFLVADSLEEVNKKLDKFYMVLILRSLHADCDHMRDQ

SEQ ID NO: 119424 - protein, 877 aa, Glycine max
  Coding DNA Sequence Number=SeqID_2646
  Gene Ontology: Mol. function=protein binding; Cellular component =membrane; Biological process=defense response
  Homolog annotation: Hit_ID=Q1SW20; Match level="QueryCoverage=96%, HitCoverage=96%, E-value=1e-158, Identity=39%"; Hit description =Disease resistance protein; AAA ATPase
  Pfam annotation: Domain name=LRR_1; Domain location=521-543; Score =1.0; E_value=1.9e+02; Accession=PF00560.23; Description=Leucine Rich Repeat
  Pfam annotation: Domain name=LRR_1; Domain location=545-566; Score =6.5; E_value=18; Accession=PF00560.23; Description=Leucine Rich Repeat
  Pfam annotation: Domain name=LRR_1; Domain location=568-589; Score =9.7; E_value=4.4; Accession=PF00560.23; Description=Leucine Rich Repeat
  Pfam annotation: Domain name=LRR_1; Domain location=722-744; Score =11.1; E_value=2.4; Accession=PF00560.23; Description=Leucine Rich Repeat
  Pfam annotation: Domain name=LRR_1; Domain location=795-817; Score =1.9; E_value=1.3e+02; Accession=PF00560.23; Description=Leucine Rich Repeat
  Pfam annotation: Domain name=NB-ARC; Domain location=152-406; Score =179.0; E_value=1.2e-50; Accession=PF00931.13; Description=NB-ARC domain
  Pfam module annotation: Pfam domain module=LRR_1::LRR_1::LRR_1::LRR _1::LRR_1::NB-ARC; Domain location=521-543::545-566::568-589::722 -744::795-817::152-406
MDIAKEIAVPLAAEHLLPRLKKALNAVMNVPKDVADMKNKLDRIQSIIHDKEKKAADEEGNKAKVKQLVQTSFHMEDIIDECAIVEERQLRDDAGCVALPCKAVDFVKTKASCLHFAYMNEGVESEIAATKDKNESEFGSQMHPPGGNQNSMFRNLRDAPLYIKDDEVVGFDVARNELIGWLVSDRSERTVISVVGIGGLGKTTLAKKVFDKVAEKFKRHAWITVSQSYTEVGLLRDLLQELRKENKENHPQNLSTMDQKSLRDEVINHLRDKRYVIVFDDVWNTSFWDDMEFALIDDKIGSRVFITTRNKECGGLPLAIVAIGGLLSRIERDATCWKKFSENLSKELEDGLSPVTKILSFSYHDLPDNLKPCFLYFGVYPEDYEVENVRLIRQWVAEGFIKFEADKTLEEVAEQYLRELIQRSLVQVSSFTGDGKPKFCRVHDLVGDMILKIAVDLSFCHFARENENLLESGIIRRLTIASGSIDLMKSVESSSIRSLHIFRDELSESYVSSILMKKYRFLKVLDFEKAALFNCVPEHLGDLFLLRYLSFRNTKLNDLPTSIGMLHNLETLDLRQTMVCKMPREINKLKKLRHLLAYDMSKGVGYGLQMENGIGDLESLQTLREVETNHGGEEVFKELERLTQVRVLGLTNVQQGFRNVLYSLINKLQHMEKLYIAAIDEHEVIDLNFIVSELVLQNSQLQKVRLVGRLNGFPNWVAKLQNLVMLSLSHSKLTDDPLGLLKDLPNLLCLSILYCAYEGSCLHFPNGGFPKLEQIIIRRLYKLNSIRIENGALPSLKKLKLVSISQLTEVPSGVCSLPKLEVFHAINMSNEFEENFHSNRGQRAQWIIEQVPFALGFNFHGLLILHVDFDNNSVESS

SEQ ID NO: 119425 - protein, 337 aa, Glycine max
  Coding DNA Sequence Number=SeqID_2647
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=95%, HitCoverage=54%, E-value=1e-163, Identity=88%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=28-320; Score=196.5; E_value=6.4e-56; Accession=PF00977.11; Description =Histidine biosynthesis protein
MAKVAFISFYAILLQKPGEGKASKLAKRVIACLDVRTNDKGDLVVTKGDQYDVREHTKENEVRNLGKPVDLAGQYYKDGADEVSFLNITGFRDFPLGDLPMLQVLRYTSENVFVPLTVGGGIRDFTDSTGRYYSSLEVASEYFRSGADKISIGSDAVYAAEEYLKTGVKTGKTSLEQISRVYGNQAVVVSIDPRRVYVKDPNDVQLKTIRVSSPGSNGEEYAWYQCTVNGGREGRPIGAYELAKAVEELGAGEILLNCIDCDGQGKGFDVDLIKLISDAVSIPVIASSGAGAPEHFSEVFYKTNASAALAAGIFHRKEVPIQSVKEHLLKEGIEVRI

SEQ ID NO: 119426 - protein, 99 aa, Glycine max
  Coding DNA Sequence Number=SeqID_2648
MTWTTSEEKLEKMRGGRTTWGCRIDDFINVVTGGDGEDEEVELSKKRSRGASLKDPRLCIKTTSFISLIVPDKEAPPRSPMISPPLESSFCGLSWCGKS

SEQ ID NO: 119427 - protein, 64 aa, Glycine max
  Coding DNA Sequence Number=SeqID_2649
MVEDPTVAKLEACQGIDINEPIHPFNTGEHQHEKRSRRNSNPRGNCPECELSCLAPKMDSCLVI

SEQ ID NO: 119428 - protein, 144 aa, Glycine max
  Coding DNA Sequence Number=SeqID_2650
MISKVPTYDAKDVENHVQTVHRDESELKHKLDSPDRRPNFPHREHEVIHVIAGGFVDATLGRNLEVYVDDLIIKRNNMCPWQKKPLLNYERSRAILQGILAQTRYKPLKPTQIKEKMKYYIRYLPSVRSAPDSASRNSISWKQR

SEQ ID NO: 119429 - protein, 202 aa, Glycine max
  Coding DNA Sequence Number=SeqID_2651
GLALALELEISPSVARVSTNKSCVDPSGNNPNTSDLEKCGLYVEKNPARLVALGRLYERSTIVHNIHLCNDQVKVSVEEVRDANALILVPTQEGTVGPAKLADRPDHDVNDPLYFMTLTIPQIFLKLLQMQNSKRNVYLGAYLNGTLKGFDDTPQSKSTTVVRWIVVKYFNAARPLEPEILKAFHIQWASYYLKVKNETISV

SEQ ID NO: 119430 - protein, 102 aa, Glycine max
  Coding DNA Sequence Number=SeqID_2652
  Subcellular localization annotation: CTP_CleavageSite=41; ConfidenceScore=5.45e-01
MATPPNSPTPPPPTDSTSHSPSTMKRTRKFKSNLTSKWALTANKDGVYDTVCEKYDISKEKWTQFCQSRRDLSWEEKKKKQMEEAATSESTNTVIDPPSPIR
